United States Patent 7,365,185 (GENOMIC PLANT SEQUENCES AND USES THEREOF) - sequence listing, part 64

SEQ ID NO: 71941 - DNA, 47153 bp, Oryza sativa
aggtgattagattgtgaataagacatgaatcaggttctaatttgataagatgttctgctggtgaaatcacatattcgttgcaaaatataccatgtctgaacaagtttgaactccacggaaggcaaaaatttgacgactgcgaaagcaagtcctgcagaaaatgttccacttttccaatttcaacgcaacacgaaatacacaaatccttagcatacatcaggttaataattttgccaaaaaaaatggtgaaaaatgcaagaacagatcaacagaggaagaggccagcaagcaggacagagagtagggttcttgtgtggcttcagaaggttagcacctgctcatcattgtcagagtcatcgaggtcaaagacagcagagcagcagattattcgcacggtctagtgtaattaactagatagggacgcaaattaccttatcctatgcatgtctgaggcaacaatgcacatgaactgggatgctgcagagcattgctcacatctgacagcgccacacctggatctggatctgaccgatctggtcggcagcagcaaggcaaattcagtatactaatctctgtttacctgcaccgattagaaaacaatcatcaaatcaaacctagtggaagcttagtacatcagagagatatttttctctgagatattcctgactccaagcaacaccatgcatgcatttgcacagcatgaaacaactattaatcctcccctgtttttccgatgagccgttgtaaaaaagaaaaaaaaaagaactcttattctctccgctgaattcgggctcttcttcccgttgcgatcttgaatggcggaggcgtcgtctccgcttccggctgagcaacacctacacggatcgtcgaagctgaagctttcggtggtgttgggttcttccattctctgacggcacggcagcaacgacgtccatggatcaggaaactgcagttacaatgatctcccgctccaagtaagtacaccaatctactcttcctcgatcatctctatctctttctgttccactcgatttaaggcgtttgattggaaatgtgatcaaaccatcaaattcagtgaatgtggcgacaatgtattacatgcatgagctgccatctgggcgtctgcagctaatggtgctgaaagcctgaatctacgatctcactcactgaatttcgaacaagatatatgcttctttaagcctgtgattttcttacctttccggccgctacgatccgaaaagcatgacatgatcacttgcagtgtatgggcagaaatgcaggaattgctaggtgctactagctagctttttgcccatgtacctcgacatgtgtgaattgtgatcaacggacagacagatatacagtatagccccttcctaacttgattgccatgtactgctcgtagattttatctgctactacatattagcttttgtaacgattggtagctagcactctcatattttgatcagcaatagtaattacaactctgaaaaacctctgaaacaggtaggacatcgtataggcctaatatgttctttttaattaaggtgtggagtgaccataagcctagctaacttctcacaacgaaaatatttttggtcaatgcactagttgattaattatcgatcgattcccccttagcttggccatatatgctactacaacacactcaaagatattttttcatgtgaataaactatctcaatatttccattttccatataatctttgatcagtttttgcttacatacgcattattttctgagcttatatacacaagattttccggtcaaaatattctaggaattgataaatgcaatgtgcacgccgagcagagatcagaagttcagaaccatcagattcggtccactcccgacatgttccacacatgcacagatgcactgatgccccctctcggatgcagcacgcgtacacagatcttcctcctccagccatttttccagacaaccatgcatcttgttttatcattgatccaataatgacatgcagaaaaaagtcattgcttgcacagttgcatttgtccttgtccagcatctgatcaacgtacttgtcccaaagccccctgcaatctctgaatctgatgatcaactcactcaggcccccccatactcacacagtcacaaacaactctctttctctcactctgaatgaactctcacgtcagtactaatgcatggatgcatgtgaagtagtattgctgggtcctggaacaacaaggggaatcagacagcggatcgagagatgttggcagctacagttcccagctgtactagagcctgtgaatactgacgtgttggcacagtggctagatcaaaacgcacagccactttgctcagaaatggcgccctgcactgcacggccttcaactcacgggtacccaacccctgtcccctcccttcccaaaaggcgtagccgcgaccaaaagcgccccaaccttgcagttttcgagcactgtagctaccatgtcctctctccaagtaaaagagatcagtgtgacaatggcaatggcaatggcatggcctctctctctctctctctctctcaccttctgaattcaaagttactgcttctgctgctgctgcgtctctggctgagagggttaaattcagcttcggctttgcttcagtggagaggaggagatggccaaaactgagaaacatctcttctcctctcgtggcagtggcatgcatttataaccgttgctgtttccggctttgcgatgcgactgtgctgctagctagctgctcgtttgctgacagtaacaacgctttacctgcctcccggtctgacggatgcagcgcatgcgttactactgcgacgtcgtaactactcagctcgcacccgaaccctacctacaaaacgctagcagcaaagctcgccgtgtcacgtcgcgatcatttcctgcatcctctcgagatcgccggcgagttcagtgtgtgtgccactacagctactagctcactcgctcgctcactgacgcgaatcgcgcattgttcaactatgagcagggccatgcagctgcagcggccacggcggtggcgcgacggcgacggcgacggggaggaggggcccacgacggcgggcggcggcggcggtgtggggtgcaggtgccggtcgtgcgcggcggtgatgctcgcggactgcatcgcgctgggttgctgcccgtgcgcgctggtcagcatgctgagcctagcgctcgtcaaggccccgctcgccgtcggccgccgctgcgtcggccgcctcaggagccggaggcggacgctgctgcacaacaagcgcgtccgcgacgtcgccgccacgtcggcggccgccgccggcgagaagaaggcgatcgcgaagccagaagaagagctagaagccgccgacatcgtcgccaacgacgacgacaccgcgtccgccgccgctgccaccgccggcgcgggtgccccgaccgacgaggacctggcgtggctggaggagatgtaccagatgggtcactggggctttggccgcgtgtccatctcggggaaaaccccgtgagaagcgcgcgcgccacgcctcgccgcgccggcgccggatcggatcaagtccacgcgacgcgcgccccggcggcgcaaggcgcgggaacgggtcaacgtagtacgtgcaaaggttgcaccactattcggtttgatgttttctccagctgttttcgtgtacgattgaatttgtcggggtgcacacgcgcgcccgtgtggccgtgtgcgctgtgcgtgcgtgtgtgcgcgcctcgcgcgcgcgtgtggctctggaaagcgtgtgctgcagcctttcgcgcgcacgaatctcaatgtaaaaaaggttcccaacggaagcagtttccgaagtactcatgggccctctcgtatctggcacttactgtagcccgtgcaactgatgggcccgttctactaggccgacgactggatccatcaaacttttgtcgcgtaggcgaacgttaaaaaaaaggagaaagtctaatattaatccctcaatgtaggtctgatcatgttcgtatctcttaatagcaaaaggaatacatactagcatatcgactattaaaacaagtgtaaaatgactccctcaaaagttttgaaggcgaattccattgacgtggttcgttgacctaatcaaaccaacgtcaaacatctgatggtatgccacatggtttgctgatgagagatacgaattaaattagacctatatttcagtgagtcaaattaaatttattttatctacaaaagtagatatgaataagagtcagctcaagcaccagagagaacatcttggcccattaaacccctaaaaaataaagagtttgtgcttgtttggttctctaccgtaccaatttattggtagtgccaaagtctaggcaaactttggcactaccaaaatattggtagggtaaaattatttggctaccatttggattgctaccgatataaagtcaaattcttatagtatagtgaagaaatttctagaaaatgaccaaatagtataagggtactaccaaatatttggcttcaatccaaaataacacgcatactattcaatttgccaataaattggtagggtatgtttttggtatcaaatcaaaacggccctttatttcctccgaggaaaaaatgccttttattttacggaaagaaaaccctgcagagccgttcgactcttttgtgaattcacgggctcacagtatgttggttgagtagcgtatgtactgcacagtacatttacatgtgctgcctttgattttttgctgttaccatggcgtgcatcttgagtgaaacatactttacttagaacggagcagattacccgggcgccatgccgtcaatcacacgccatacagatcaaacatcacaagcatcgatcctaggacaagctaaacggaaccccagagctgctaatttttttctttccttttgtgttgtttccctttcagtttcatcttttgcttctagatctaacccaacaacgtcttctgatctcggtggtaggtgatccatttggagctcaaggaagcaacaagtagaatagatagacaacaataatttttttttaaaaaaaggcttgtaagagacactagaaaacgatgagaaaagcacatggatccaatccattccgttccattccactaggattctttgctgtccagcttgcattctatttcccttccattgcatgccagccttttcttttcttttcctctcccaaatggcaactcaactcaagcatcgtccgccacgtgtcgcgtggcccaccgtggccctcatgggcccacgcaccaaccgaccaaccagctcccccctctcatcactggcgggagattggtggggcccacctgtcggttagattatgggccgtaccggccgtcacttgttgctcgcgacgcgcaaccgcccgtggcccacctcacgcgcgcatctcccgcctccctttagttccgccgccccgttggccacagcgcagcgcagctcgcgccacagaaaaactccaccaccaccagccacgccatggcggaggcggacggcgaccgtggcgtcgctgccgccgccgccgccgccgccgtcgtccacgacgacgtcctagagtctgacgaggaggacttcaccttcgcggcggcggcggctgtcacgtgtgtggttggaggcggccgcatcggcgctgtcgtgtacccggtcttcggccgcccgcggtcgccgccgccggtgcaggaggtggaggagcctgacacggccaccgtgcgggtgccgctggggcagcttctgctggaggagagggcgtcggcgccgccgtcgggggagcaggccgacgaggatggcgttcttgacggcgtgccggcggagacgtactgcctgtggtcgcccggatcacccgcgccggcggtttctaactctccggcgaggtgccagaagagcggctcgaccgggtcggtcctccggtggcggcagcggctcatcgggcggagccacagcgacgggaaggagaagttcgtgttcttgagctcgggctccgacgtccgtagtaaggggaggacgaccacgacgtcgcgcggcgatgccggtggccgtggcggcggctggagatattacgcgagtggaggcggcaatggcggtggccggaggccgtcgttcctcccgtacaagcaggatctcgtcggcttgttcgccaacgccggcgcgttccgccggagctaccacccgttctaacgtattgtagcgttctttctcgctgatcgtttgcttaattaattccttaattatatatatttttgtcaagtcatggtgtgacttcggattgccttgtggtagaactgaagtgtgacagatttgtagtagcagaaaatctttatgcagattttttttgtatgtgggtaatactaatacttatgtatatatcgtggattttgtattggtttgatcactttgatgattcctactacctttttaataagcattggaattcagaaacgtgtagtacgtttctctctctttccaacgtaaaaacgtgtagcagtacgtgaaacgcgattccgccagccgaagttcgaattaattcgaattcggtttagaacataggaattccaagcaaatagtttattttagaaaatggattaaaaatccagcctttataccttaaaggatgtacgcggtcacagtttgaacaactattggtacttaggccttgtttatttcagtctaagctgcgagttgtttgtttctccaatatatgctcttatattggaggtatataagggcagtgggtcttatagattattagattatactaatctggcttatagattataataatctatcttaataatctacttatttattttagcttactcctaataatacagattataataatcatagactgaatcaaacagggccttcgacgtaatccctccttcctattttaaatacaatcatgagtttacatgtccaactttaattgtccatcttatttaaaaaaaataaaaaatgtaagtcgcgcataaaataatattaatattttatcatctaataaaaataaaaaaactaatcataaaaaaataaaataaaaatcaaataagacggaagatcaaagttggaaacgaaaactcatggttgcgttaaaaatggaacaggggagtacaccttaaacaagtctttccaaacaaatagtttacaataacatttgaaaaatgcaacgcatcatcacaccaaacaatgcagattacccaattagctttagctctctcagaatcaaggacgcaacttgtggttgcggcaatggggagtaggattacctgcttatgttaacacatcttatcgatctggaagcctgaagagtacatcggatcagacgtcgcaaatacatacggacgcaacacaacacaacacaggacacaaaaatcgctgtcaaatcttcagtatctttctcaccactcgattaccaacccttctccatctccttttcaattaagccctgcgctttgggttagtggacacaattaacccggtcgttgcgtctacgtagcactgtaccctgtttcgtaggtgaaaggtacaagtggttctttacttcttttttttttttgcctcttttattattaacccgttacctatagagtcgtcatttgttggcaccttgtcgttgagctattggactcatgcttaattatgctgtatttgtacagcagctagcactcgacgcagcaacgtccttcattctcgtacagtctcactgtacccaaaagggcacttgtatcgagatggggcgttaatcttgaccgctgatcacagcattagagagctcacgtggccttgacacgagatgtgggtttgcggagttgcagcccaagcccacgtgagcgctctgtacgaatcgccgtacaacttaggtgggcccgtcttgtcattgagtgactgaaaaagttcatttgggccccttaatttgacaccgaatccgatttacgtccctggaaaaaaaacagatacaacgggtctccaacttataaaaccagtgcaaacgagatccctcggtagtattgtccctttttttggttgtcgtggtacctactaggctaatttgaccatgtcttttgttccacgtggtattgacgcttacgtggtagtttacttcggaaaacaaataaaaggagcaaaattgaaaactaaataattaaaacaaaataggggcctacaaacaagataaaaaatggtgggacccacatgttaatgggtcctacttcctccacccatggcgaagggacagcgtggcgagccgatgcccatggcgaggatgttgttgaggtcggagcacgatagagtacagaggatggcgagcaggttggagggcgttgggaagggcgggcactgtgtggcgagcagtgtccgtgagagggagttgagatcggtgaaggagaggaaggaggtggagaagacgaagtggcggaggaggtggcggagatcgtgctgggagaggtgcggcggttggaagggggaggggaggacgaacagcgtggtgtggcgagcaacagtggtgcgaagacggatgagacaggggagaggaagaggaggtatgcgtcctcctcctcaaacccattaccgttgttgtcgtcgtcttcggtggcgggaaagcaggttgggaagcgggagctcacccgccactgcccatggcgaggatgccatcaaggttggaggatggcggagacagtggcgggcgccacggtggtgaggcatgagtcctcctcctcctgtccattaagatgaggttaccacgcattacgaggaaatgtaggccctctagagcccgtctggagaaaatcacgactcgttcggcccattacgaaggaatggcggtcgactgcggtccatttagaggaaatgtcggatgggcccattgacggttaattcggcccattaaatagcttctgcggcactctgcggccttattgggcctagggaggcctaacctggcgaaaaaagagacctacctaggcccaataaaaaattcgggcctaccaaaattgcccagcgattcgtaaggctccgctcaggtgggcttgggccgcaactagccacatctctgcatgccacgttgacagcgagtgcaacctaacccaactagtagtacgattcaactgcaacgcgcaatcacatccgttgcgagctgtcaaatatcgtgatcagcggtcgagattagtgcccccatctcgaggcaattcgaaacgctttcgtgcagtacagttgagaatgaaggcttctactactccgtagcttggtgtatataaggagagccatggcgccaagacaccgaggaggaagccgcacacgccatgggaggcgacacgcacggcagaagcagctgaacgcgatggagctcaacgcgatcatcgccggcggcaacatgatggccgacgacgacggcggcggcttcaccttcgccgaggtcccgccgctagccggcggccgctgcgtgggcccgccgctgtacccggtcttcggccggccgaggtcgccgccgccgacgccgccgccgcatcggcaggcgccggagaaggcctcgcgtctgccgctatggcggtttctgatggtggaccacggcccgccgccgccgccaccaccgacgacgcagccggcggcggacgacgacctcgacctcgacctcgacggggagccggcggagtcgacgttcctgtactgcccgctgtgtcccgcgttgccggtggcggcggcggcctccccggcgcggtgccggaagagcggctccactgggtcgtctctcctccggtggcgccagcgctccatcggccggagccacagcgacggcaaggagaagttcgtgttcttgaacgcgagctcctcctcctccggctccgagcacaagggcggcagaggcggcgaggtgggccatgacggtgccctgagctactacgccaacggcggcagcaggggcggcggcggcggcggcggtcgccggaggtcgttccttccctaccggcaggacatcgtcggacttttcgccaacgccaccgcgttccgccggagctatcacccgttctgacgtcgcgaacgtcttcgataccaatgttgctcgatcgattttattctcttctctctgcaggttaagtatgtacttaattacttgccacgataaattcgtgagcaggtttaattaaatttgtttgatgcgtgtggctgataagtttggctgcacgctttaatttgtttgtctgcggtaaatggtaattgtaacaatttattccaaaaaaatgttgagtgtaacagagcttgcataataagtatatattgtatacagagtttttatatgttcatgcagggctactatataagttcaaatatagtcataaaaatgtttttaaaatttttcctcgagtcgcaatattttccacaagcttatttgctcttgttcgcagaatttctagtaagtacaacttcgcacagaatcttcaattcccttattaagaaaataaactagaaattagatgctgggaaagttaccttttataaattctcagaagcaacgtaccaatcaattatttcttataatcttaaacccctttaaacatagcctttgttttttttatcatagagaagtaccgaagtagtcatatgtttttctctttattgttactaaatactccatccgtctctggaaaaccaaattttctaagaataaatttagacaatatatattcagattcatccctaaaagttgatggccaatgctgtatgttggtaaaacagtctacgtgcggctcctgtcatatttctagctctgcatggtgtggtgagtatgtggtagtgcagagattgacttgtgttgctaattaaccaacatggcacagttgtagtcgacttgtaacacttgtttcggcatattcacataattagctacatcattaatgtactagctagctcaacacgtacgtacaggacagatgcaaccttcaaaacaaaactaattaaagtacagatcgatgcaacattcaaacgaaactaattaaagtacaggtgcaaacttctttgtttcaacagggcctttaatctctccaaccttctcttcccctgaccggccactacgtactgatgataatctgatactgaactactctatgaaccatgctgcatgcaccatagatttcaaccatatgctacaaatgaacggtcattttccagatatctccttcgatcaccaactctcctttaccaagctttactcttaattcgtcctgaaaaatatatattagtgcccttaatatcataatctgtacttgtgcaatcatgcaaatccggtcatgcgcgagaatatgctaccaagtcctccctaattaaactcatgaaagttaactatttctccggtcaaaaatatattattagctatatttagtgagagaaagcccatctatgcatgcaataatgtagtactgatttggcttgttgtctcatctaatttattactagtccatcaagatgaaagctaaacaccaagggtactctgaatgatacaagcataactacctaaccaaagttccagaagagcaaagaggtgaagtacaaatactacacacttcggttaatccatatctttcgtataaatgacagctattaaaaaccaaacgagttttagcctactctgtccgtgcttatctccacgatcttctctgataggcatatctctttggaccacgtttgattagcaaggaaggctctgattaggaaattactatgcatacgacctatctgttatttacgtacgactcaatttaatcactaattttaaacgaatgcaatgcatataaatatactctattttaattaatctatagttgtatgtctctaattatacatgagttatgtaactggatcacacgtatagcagtaatcctctaattaatcaatttgtgggtggtaatctcgctgagcggctgagccgagcagacttcaatgtgaagtagactctgcacgcgacagccggggccaacggcggcttgaccgatcgtcctgctctgctcgctcgtcagcgccccggttgagcgattatcgacttatcgtagcggattatcaatttggttacaaggataaactactccctctgtttctaaatatttaataccgttgactttttagcacatgtttaaccgttcgtcttattaaaaaattttgtgaaatatgtaaaactatatgtatacgtataagtatatttaacaatgaatcaaatgatagaaaaagaattaataattacttaaattttttaaataagatgaacggtcaatatttaaaaaagtcaacggcatcaaatatttagaaacggagggagtaaatactttattacaaaataaacttaacaaatgtcttacaataagtgggtaaataatgtagtagaattttttttaagaaaaggtattttctaatcaatggaacaaacaattcataagaatccaatgaataagcatgtgtttagttcacatcaaaattaaaagtttggttgaaattgaaacgatatgacgaaaaagttgagaaaagttggaagtttgtgtgtagaaaagttttgatgtgataaaaaaattgaaagtttgaagaattattttggaactaaacatggcctaagttcaaaagaatagggcaaagtgtgttatagtatcatcttgcggctgatttatagccggtttcagatagcaacacggtacggccgtgcagggcttgatgagaagttgcatggaatcaatcagcatggctagtttcttgattacatcctacctctgctatacttaagagacaattaagttttttttaatgtattctttgatgaagtcagatatgatccatctatcagaacttaaagtggactgtgacggtttaccttgcaaacagtgcccagaccgatggacctgacgtctgtctacttgtccagagcagcaaggatactgtagtagtatcacttgaaaatcctcgtactggtaattgtttatttatttattctctgatataaattaatcatgcaatgaacatgattagcttttcgttgcttgttgctgcggtgcttcctttctaaaacattgcatccttttcacttgttgctcacagatcttttcacgcctttgatgcaaaatcctcgcagaggtgtgaccatgaagctaaagtatcttcagagacttctttgatggttaccctgccgcgtttacagaaacatcagccctgcctctcgacaaccgtatggatccccaaaatccacgacagggtcgtgtgtggttgacactgctgtattagacatcacgacataaccatcacattaatctccatgccatcgcagactacccaacgcattgcattggccatgaaaacaacttctctagcaaaacctgcatggattctactgtcagaaaggatttttaggtgatatgtgagatcagtacgaccatcaacctgttagttcatagatggcccagtgatgaatgcagtgtaaatacggtaggccatgttaagtagacttacggagcagtgtggggtctactatatagtctctgctgtacatggtcctcaccaaaatacaggaaaacagagacatcacgtatgacacgtctctactgaggcggttacaccagaagcatgaatgacaaggaaataagccaaattggattttctctttttgccagaaaatttacaagcatgaattatgtacagcgaattccgtggtaggggaaaatgctaatttcttgtatatattccatttctgcatctatgtggacatacaaacagtagagtggatcctatggaggtggcttactattatgattcatctggctttggttcaagaatcacgggtatcttctccttttgatctccacgcaatacttccacagtcacctataacacaatatgcataagtacctgagctattatcaatcacagcaatttcttccttacaaaaacgtgtgaaagcttaccttctctccaactttacactgatccagaatcctatacaagtcgcttccatttgttacctttgttccattcacagaagtaattatgtcccctaggataagccgaccataggaatcccgcttggtcgattgcagaccctagcatacaacaagatgtataagttttagttgcaccagtcattttcaaagcaagcagctagtcttctattacacgaacatgttcaaagaaaatacagtgtctgcaataaaaaggatttgttctatcaatcacataaggttagcctttatgctaaatgaattatcactgttatgtctgttcagctgtccttagtcctagtgacgattgaaaacacacgagaggacatcaatcaacatagcatatgatgttatggagtaataactcaggtgttctcccagtaaactcaaattgacacgtaattggaacatgcctagtgcaagaaaaccaatgcttttaagactgactgcaatttacaggaaaccaataaataagatctatggacaataccgctttgcctgctggtccatttggaggagcatccaagacaagcactccacttaatccaagctgctctacagattgatctggagcaaattttatccctagaataggtcttgttactttaccaaactttataagctgatccacaataccaccaacctggatgtgttcaaaagagatgttaatagaatagaaaataaaaaattctgaaactctgagttttgtatttatgtcaagttgcatactgtatcaactggaatggaaaagccaacaccggatgatgctcctgaaggtgagtatatagcagtgtttacacctatcaagtttcctgagctatcaagaagtggcccaccactgttaccaggattgatagcagcatcagtttgtatcacatcctgtatagggcgtcctgttgcagctgaactgatttctctacgcaatccactgcagggaagggggtcaacagaaaaacaaaacagaggtgtctcagtgtattgcattatgaatcagcaaaagacagaatctgtttactcaaacaacattacacctgatgactcctgtagtaagagtgtggtcaagaccaaactgcataaacatagacataacatgttacagactgttagtgatcagtaagttaatgcaagcatgatagaaaataactcagaataatcaagtgttgtaagcatatttttctatccaggaatcaatacgtgctaaaagcctaaagatatcaccaaaacacgcgatacatagtcttagtggcataagatcattttgatatattggttgtttgcatagtgattaattgtattttttttgtgtacaatattctctagcatatattgtattttcattacaatgtcagacatattcatgaacagctagggggatttctaaggttgtttcagctctgaacagaaaagtacattgaaactatggaaataaattattcaggggtgcacatcacaagtaaagaactggatagtgtttttttgagactatgttagaatacattttattaagcttatgagccagttgtcatgaatgggtaatacaccgaacagttggtgtaagaaacactcaccgggttccctatggcaaatactttctgaccgaccagtaagtctgccgacacaccaactggtacaggtcttaatttatctgttggtgctttaatacgcaaaacagcaacatccttatcctggtcaaatccaacaacttgcgcttcatacactgtctgatcagcaagtgtgaccctgcataaaactagcgtggtaacttcacttcgccatgataccgttggaggttattatgtcataagaattcatcaaaacagtatcttagatggatggatgttttagctctatatgcaataatgcattgtcaataagttggcaccatgtagcattagcagaacagtgtacacagcatactagtatatgcggcttagaagaaaccaaaacgcaagttattgttgggctcgggaatgaattattgtgcaccaaatactcaagtgtagcatttaagtacataatgaaaatgatatgcaaaatataatcgttttaaagcttcaaacacacaatcctgtcagcaactatgactaatctatatcatagcacctttgaacatattaaactaagaaaaaggaagccattgaataatgagtcactagtaggaagtgtttacagttcactgaaccgttgtcagttgtcactgtaaccacattactgcagctaaccaacatctatttgcattactccatccatttcaagttctagaagtctagagcaatttacactcctatacaaatcttcatgcacccaaaaaaatctatcagaattgtgaagtatgattcgaattcagctctaagtgggcgacagcagcatgtcattttaacaaacctgagatctgacgcgccacggatgacatggaaattggtgactatgtggccgctcttgtcccagacgaaccccgacccggacccctgcggcacctcgagcacgtccagcgtgaaggcatcctgcctatagcaacccgaattcgcatcagtacgcgtgaaaaaaaaaaaggcaagccgaggaggacgaacgcggcggatttctacctcacggcgaggttggtaatgtagacgacggagggcgtgttctcctggaagaggcgcacggtggcgagctcgtcggcctgcagcttccgcggcgtggcgacgacgaacgcggaggcggagccggcgtcgccgaggatcagcgcggccgaggcgagggcgacgatgagggagcccgtggcggacgacaggatccggccggtctcgtcggggagcaggtcgcggagccgccgcggccacggccacggagaagccgaagccgaaggcgaagggagggcgagggagcgggaggaggagggccccggcgacggcgacctggaggcggcgcacgcgaggtgtttgatggaatggtggcgcgggcggggaggaggggacggggagaggaagcaggcggcggcagaggaggaggcggcggccattggaggaagggcggaatcagtggagggggaggagcagcagccgcggcctcccgtagaactggatgagtggacgaggatttgctgctacttggctcgccacgtcgtcgtcttcttctttttccttttttttttcttcttgtttattgttgttgccctcgtcggggtcttcgccttggttcgggttgcttcttcttttggtccacggatggatcaacggatggttctcgattgttcgagtttgcattttggatggaattcagcggatgatctgaatttgatggcagtttgcaaggctgcttgttattatcaaattttgcgataactgacaacactcacgtactaccaacaagatccgaagaggtttatacggctggcagctccagaacctgaagctgcatctgatacttcaatttgattctgtctcgacaaatgatcatgtaatagctggtgaattctggcactgggaggtggatctggattccaatcgattagtttttttttcctcttttcaaccttgcatcggagcttggcagtatggtctgttacggttttgtttgccataactgataatttgtagtataacctttgggcaactaatcattgtcatcgtcgtcaactaaaagtacaaactaggcttttggtcagcaacagagcttgccatcgtccccagattagttcatatttctgtcatcgatgatcctttcctcagtatttttcgtcgttatctagctcgggctccctagaaatgcaaaattcaatttttgaaaaaagaaaagcaaagtcatccaaaagatcagtttcaccagcacctccatttttattggatgaaaaaaattaatacatggtggagagtgtacctgcaaggagagattaaattctgtagttgaaccagtgtatcgcataataagttactcctgctggtatttatgttctagcaatttagtattcagcaaagtgcccattccattgactaaagaagagagtttgaacaacccctagaagcaaggaaacctatgtacgacaatacattttatacttgcagtatgtaaggctacattttgtaccaacagttttacatatacagacatactctatctgatcttttaagatcaaaatcactaacaaggcctaggcccagctcttatagaaagcactacaaggcacattacagcaggtcacacagctcaaaagcgaccacagctagtaaactctatctttgaacatctataagcaacaccaagggcaattttcagccaataatgctttcttttttgtgtgaacagtttcaaccccaaatcacattacaagaggagctcacagttgtgtcactgcatcatcacggcttctaatcagcagaaaactacacctaccaagtcaagctacaagaaaagagcaccaggtttactatttttctacaagcaaactggggaaacaacagcaaccgagaactaattcatcatcagagatcttgtacggcttgacaggtctactgatcgctcgattcaaattctgctcttgaggttgttcccagctccacaaatccaaccccgttagttatttatcagtagcctctcgcactgcagtagcaaagcgataattagaaatattacacttacaatttatctctagtctttcaagggaacacaaagcaaagatcacaagaattaaaatgaggataaagaacatccacgactatttagttaatgcaagctccaagatacatatatcaaggtgtttccaaaccagtatttcctgaaactattcacgacccttgctaacagccaccccattgaggttttcaaaatttacactgcaccagcaaccaaggttcaggaatctctctagagcacaagtagtacgtactcaaatcctttggtacattgcaattgcgcatttgccctggatctgcggtggtaatgcagggcctagtggacacagacgggcattgaactgaaaggtgaagcaggtgtgcagttagaaactgaaaaagttcaataaaaactgaaagagaattactactgaacagattgtaaaggaaacaatgcattatacaggattggttttgcttaaaacttaccccagcggcttctacatgtgtccaatttgttggctctaataggcaatagagacaagccttgtttctttctggcattacgcacgtaagcccatagtccttggggaaaaaaatagtgagaggcgattcagttcactgctacgatctaaatacttttccacatcactaaggaaatctgggaatatacctgatttaagattctcaactcaggcaggaggcctgaaacttcatagaagtttagaacctgtggtaatttgcacactttcatacgcttgtatcctacagcgatcttgcactcatgacagtccaggtaacactcctcttcaaactcggagacagaacggccatccatataaatagatttgctacattccatgcgggtgaaatgtacagcacagttgtagcatccccactacaaaattatgataatgtaatattcgcacaatacaagcccaacttatgttagagataagggaagtactacctttgtggaggactcaaaaagaagaagatcatttgtttgttgtgtgaagctgacttgcatcaaaaccatattcattgaattctcataatccttctctaagcaccaatagtcaatctcagatagaagctcatccataagagcttgtacattcaccgtcactgtttttggctcccctataatattgataaactaccagtaagaacactgcagatcaggaatttagagtgttcaactatagattgagttaataacacttacagtttctgaaaataaacagggagtttgtgatgcgttgtatttccaaatagtccatcagaatatatttattcaattccttcatattacatctcaagcacagatttcctacgtggaaaagataataaatatgagtggttcacttcaatggttgaggttttgggaacaaaataacatagggatcagattagtacctccaacatgtccaacatcataactatgatgaggaatgtcatctacgagagctctgagaccagggattgctttcaggagagcataagcgcatacctgaaagcatattcaaagggatgatttcctagaattgaacttgattcttttcaagagtaccatgcaacattgtaatctttcatactactactgctccatttgagattagctagatacatagaccctacaaaacatttattataactgcattgtatcataaaccacatcatatctgtggcatgaaattttcataagcctgaaactaagacactcatgtaggctcgcatatcttgtctgctgtaaaacactacttgtgcaaccagatttatataatctcttcggaactttcaaattttatttgccatattctgttaaagtatacgacctcggtttatcacttgcctagagcaagaccttatggtgtacagttttttttttctctaaggtagtaaagcaaggaatagggattattttcacaaaacatgcacgcaagtctgactgcacattcgaaaattggctttaggaaactatagcctgaaactggacttaatacgaccagaggcttacctaaattaacagaatacataaggtaaatagaggtcaaaagcttaaatacaaccagaaaatactgaattcgcctatattttctagaaccgataaagattctgcacttaatttgctagaaacgaaataaagactgaggacaaatatcatgttgaataacttaaatttggtccaaatatatcaagtttaaggatcctataacgcaaatcataaagaacatcaagcagaatctgaaagcctgacatggaaactaggaaattgaaaggatttttttttaattcacccagaggataacttcttcatctgaatcattccattggtaataagagttgccgcacagatgaaaagtactactacattacgactttgcaacttgatcatatgattggataactagtaaaacgatcaaagcggaagtaactgctaattggtgttgttctccagtgtggccagccaaagttggccttggatcgcagcatgtgagattgtgtttctggataattttgaccactctctccttggctggaacagttgttatgaacagaaatgcaaaggacaaaaaattctcaggtctaaggtcatgtggagttgttgttggggactcttaattatagtgtactcgcccacatgaatgatgcatccaggcaaacaggtgatcaactgctgggcctctgtgtccaatgacactgaattttcaggttgtgcacattaacattcctatatattttcagtgcactgtgtgtcaggattcaggatgattcaggaacagatatttcttccatttttttcataatttgcaatgcatgaagaaatgtaattaagtgaaatgcaagtcaatttatgtctggttttttttttcatctgaatttgcagggaatagctaggtttctgtccacttccagatttgtaaatataactttggagcttctttgcttgacaaaaaaaaagtaagagcctactcaagaatttgaccaaatccttcagatatatgttcacgaagagggactaaagaagagaaatttctaggaagaaactgaacaaggattgagttgtatgaataagcttacggcaaacagggtgcgtcggccatggacaaagtcctccatatcgacatcaaatatcgtacccaaatccagaggcccggccaccagctccaaatctgctccagacaaagagaaatgtggtaggtcaaagaagcaagaactctcgtagcatggaagaacagagagagagagagagagagagagagagagagagagagagagagagcgagagagaaatccgaagaacagaaagaaagaaagaaaacaagaaaagaggaaaaacactataattcaagcaagaagaggggataagaacaagaagaagaaatcgtgaaacaaaagaaagaaaagaaagaaaaatcgcaagaacagaaagaaagagagaaaatcgtaaaatcaagaaagcaagaaaaagaaagagagggagaagaaccaacctggagaggtaacagaatcgctcccctccatatcggtgaactgggacacctggtcggagaatgcagggagcggaggggcaggccacacgcgcgggaggcggggagaggaaggatttggatctccgcgaacggggaggaggcagcaacaatggtggacgcctggtcggagaagatgcagggaagcggaggagcaggccacgcgcgcgggaggcggggagaggaaggatttgggaggaagccgagcacgggaagaagaagagaaaaaacatttgggctggccagatactcatacccgcccacggctaggtacctcaaatgggccgggctaagccaagccacaaagtaggcccagtctgatatacaaccagacggcccatttggctgccgatgctaccaccgaggcaccgactagggctgcggcggcggcgaccgggtgggcggtgaggcggcggcggcggcggcataagagatttgagtctctctgtgcagtctgcagccaagggatttcatggatctgccaagttgacgatggctgaagcagatggcggccgatcgatcgaacgattcgagcaatcgatcccatcgcttcaaacttggagcggagcaggacgacgaggaggatatattatagcaaggaggtaagaggtcgcaagtaagcggcctcaatgcctaagagaggacaagattaaagaatcggagaaggatgagcaaatcgacaagagaatggacgatttttttggagatctacagagcacagacctggggaagaagaagaaagcaaaccgtatgtggggattctcgctctagcgcctttgggggttgtttaccatctgataccagcccgacccatctaatagctgagcgactgaaggaataagtccactttgactcccttacctagtgcctgaatctaattcgtatccctcaaccataatagaggatctctcaaccccaactattaaaaccggtgcaatttaactcccacgacggttttgcagagcggttttgctgacgtggtgtccatgtggcatctcaatcatcaaataaaataaagtgggacccatatatcatcttcttcatctctcccatccccctctctctcctcctttcttcttcttgacgccctagcgcaatacgacggccgacaccacgagcatcaccgctactgccaccgcctagctccggcggccactactcacgtaattgccaccgccaccgaggccgtttctcagcgtcatcagtggacggcgcagcagcactccaacatccagcgccacgcactaccactcctcctccgctcccaccatcgcctccgtggaggcgggccctcttggacgccttccagaagcttctggagcccacgccactgatctgatcggagcagcgctgctgtcgcgtgccattgccgatgaggcgaaagcgaagggtaatgtggccttctctgcaaaatggagcatagactgcagcaaagcaaggccaagtagtgccacgaccacgacgggcagtgaggatggagctacaacaggcaagccgcggactcacatggctgcgatgggcggcgatgccgtggcgaagtagacgagtttgggacggagtagattggcgcgatggctagtagttgatggctgattgggggccccgccaaccttctctagtggcggaggatggcgcgcggcgacgggcggcagaggatggtgcgtagcgacaggcggtgaggatgacaagtgccgcgacgaatggtggttgacgtgggatagatgcacgtggaggcgaacgcttcctgctagttgctatgaactgctgctgcttcatacttcctccgattaacaatataagactttataggattgctcatatttatatagatattaatgaatctagacatatatatgcatctagattcagtaacatctagtatatgaatatgagcaatgctagaaagtcttacattatgaaacgaagtcttacattatgaaacgaagggagtagatctatgaagagatgatgagccgtgaatagaaatgatcaaatgagagtaaaccctagctttcttcggtgggggcaaaataaggaaggggaggtgactagctccctcccccttgcacgtgcgggtgctatgtgctattgcatgggcgcagtaccactgtatccatggagccaggttgagttgcgaagttcaattcctgcgtttccgctcggcatggctcaaaggcaatttttgcattgcctcatcctgtctcgagagccaatacaggcagccaaacatatcaaatctgcatgcatggtctgacgaatttgctatatatctctcgtgtgatttttttcttcgtatttgacgttttttcaaccgtcggatctgcaccgcgattaggcgcgacgaatcagacacgcacaaagtggtccagcgccacacgtctcacgggcgacatggtggaggaaacgatcgataagctgatagtaacacagtagacagtagccagtagccggagtatctcagcttccagtcaacagaaaatggatcatgcatggcgccgcatggggcccatgttcaccacggtctccgtgcgatattttgatttgcgcgcccatgcttctctctatttcttttttttctttttctagttaccaaaatttacagtatatttgtactaaaattatagcgcacttacataccataactactatttttacaaatgtaattttagttataaagcactataattttagttataaatgcaatatttaacactttagatacctggacggtttctcaagcagtgcatttatactaaaacgataaatattctagttaccaaattttacattacatttgtactaaaattacagtgcacttacatgccatatctactatttttacaactgtaattttagttataaatcactgtaattttagcatattgcaacccatattgtatctgttttattagtctgtattggcccgatcttatttagacctgtttttgtctgtgtactattttttctaccgttggatacaaatatgaggggataaaaaatctgggtaattttttttcaaaaatcacacgagagatacctagacagtcccatggtctgatgcgagctaggcctagtacaggcaaccaaacataccctaaatagaccctaagtgtccagctacggtcgatcgacatgatataggtgagatttttcgtacaatataaatgtgtataatttacagtgtaatctgactatttttaatgaaaaatagctagtcaaatttgccttactaactgctccgcgtaattatttttgtaaagttaaggccccgccacccaaaatagctcgcgtatagaacagatatattaatttcaggcgtttggtggagtagcagcagcctcgcaatgcgaacagagatagctggactttaagatcgctggacagaacagctgaagtgctgaacgcaaatcgcaaccccgcgcgtcgtggcgagcgacctccgagagtccgagtcctagaggaagaagaaagcgctgtccggtacgtacgctcggtgcctgaacccaatttcgaatcgtatccggacaacgcctgcctattagtttacagaacagctgaagtgttgaacgcattggacgatctcatcatcatcctcgtttagggtgttaagccaattaaggagctgggcatcagggccagggggtttcggttccggtttcgatagatctactggcgaggacaccaactatggagacgatccctgtcgagctatggcaagaaatcttgctcagggcatcaaccaaagacgtcgcccggtcatgttgcgtctcgacgcagtggcgcgacatcgttagggacccctccttccggaagctccaccatgacaggcacgccacggcgcacgatgtccccgacgctctgctcgtcgccacatacaacatcgactcgcaaagagtcgccagcgtcttcccggtcgaaccggccgccgtctctccgacgtcgtccacgcgcacggccacggcgcccatctgccgggtcaaccacatggaaggctacaggatcgccaacatctgcaacggcttcctctgcttcgcctcccatagcacagccaaggccatcgtacacaaccccgtcaccggcgagaggctggaggtccccagggctcctcgcctccctcccgaccaagacaacgctcgctcgccggtcacgttcgcgttggggttcagcccgaacaactgtgtttacaagctgttccgcttcaccaaccgcacgatggatgtgtacacgctgggccgcggcgccgaatccaccgggtggcgccgacacgcgcttcctctgcacccgcgcaacctggtagaaagcaagccggccgttgtcatcggcggcaagatttgtatggcgaccatcggccctgcgccgtacaggcacccagccgacaatggcacgcccggcccggtgctggtggtcgacgtcgcgcacgaggagccctgcacgtacagcccaccggactacgggctcccgtgggcggacgcggcggtgagcgtcttcgagctgcacgggaggttgtgcctggccatcaggacagagaggatgatccagttttggacaatgccagttgaagaagacgacgacgaccaaccatggcagcttctctacaagttcaaggtcgtggatgatatccgattcaaccaatttcaaaggctagtgcccatgagtgcttggctcgacggccacaccaacacgctttgctaccgagagggcaacaacgtgtaccgtaagtacgtcggcactaccacggcaacagtacgacgtttttcttcgacaaaggtcgttattatgtcgtgggacagcaaaatctgcctcccggtggcttcatcgtcgttgtcgtcgttccagtgggacatctacgcgggctaccgtccgaccctgctatcgcctctcacctttgcatccgggcaacatgaggaagatgataacaagtgtgatctgttcatccgcagcttactacgcacactgcgatcccaaaaatcacagaaatgccgcccgtctccgacgtcagccggttgcaccaatgccaagagaatttgctgcataaatccacgcggattctaacataacataaatcccgttcccttttgtataagttcgacctgcacagacgcacagacgcagttgagttcgtgagtgcggtgtacggacacggaccttgtcttcactgtaacgaaaaaaatgaaatacaaatttgttgacaagttttctcggaaaaggagtaagatgacatcacctcgttttttttcatgtcatctaaatatttataaaaaaaatcataacatggattaatataaaatatcacttcataaacatgttagcataaattcaacttctacaaattacaataaaaagaacaaattaaactgaaaatagttaacatattcacaattatatttgttatttttattataacttgtaaaagctgaatttgaatagccatgctatcgaagttacatatttcatattaatatatcttgttatcttttttaaaaaaaaatagtgtgactatttaggtacaatgtgacatgcaagaaaataggaaaagggggttgaaaacactttcccagctttctcttccataggcccaactataacgggcacaacccaagtaaaattacggcccaatattatacaggcaaaatgggagaagagaaacgaggcgaaggggaaaaagggtaaggaaaccagcgagcgatccagggaggccgtagcccgtagcgaccatgtcgattgctccgtcgagctcgctccgtgccctggtcgtccccatcctcccctccgtctcctcctcgccctctgctcgcccagggctccgcggagtggcggcaccggtgcagcacgcgcgggcgcggcggcggaggggggcggcggtcgtggcgcgggcggcggcgctgccgtcggacgccgagtggctggagcggctgccggagaagaagaagccgctgtacacgcacagcctgccgtgcatcgaggcgtggctgcgcagcatcgggttctcccagacccgcgaggaccgcgccgtctgggtcgccgagatgcccctctggcacgcccgcctcagcctcgacgtcactgacctccacatcaggtagattttgcagtaacttgtccgtagattttgctgcccacacgtcgtaggctgtagtagtctctgaaaacttggtgatgcactgcacaatgcgtgctcgtttgggctttaattcttgctcgccaaattgctcctgaaccgtggttttgccaaattaaatctctaaattatgtggtgtgggtgcatcaaatggatggatatgtctactgaatattcactgtggatgtttcattgctgccctttgtagcaatcggcatattgttcagctaatgctgcaatctcttcatagcaatcagcatattgccagttcagcagatatataccaactttatttagtaccctgacagcctgacttccccgactgaaccctcgaatcacactatggaatgtttcggtataaggacgatgattctgtttctcacttatcaaaattcagttactaactccgtgtcatattgtgaatcaggtacttgaagagcggccctgggaatcttgacaaggacgtagagaggagattcagctatgcccttagcagagaagacatcgagaacgcaatacttggaggaccttaatctcatcaggccatcagaggctcaagattagaagttcttgcaggatcttagcttatgggcagcgcagtaggtgcatgctctttcatgagtgactaagaaaagctctgccctgctgctgattggtcgttcgacgtccatcaggaaggagctttgcttaagttcccttcagtcatttgtacaagagaaaattaattatgtatctcaatttcatttgtaataattcaatgtgcttaaggatgagacgtccagctgataatttggcaatttatttaagctgcaactactgttgagtagtactccagcagttttagctatagtctggaagaattttttttgagtagcctcttgacctctgtgcttgggttcttctctggaacagccgatggtagtgcgatgcactatcgtattcgtatctcagagcctttaaatcggtggttctagttttatttttgggtttgttaaaactgttgcgttctctttgcctcgttgcacctaacgagcaggggaactgcatccagctcagatagccagcagtagcctacaaggcacaagatagtgattggcaacatggcatcatccatcaggcattcaggctagtacttatctgaacgccgaatagcgactctacataaaatggaatcaggaagactcgccttgcctgtaattgcataaagttggtgtcccgaatgtagtactacaagacaacgtttgctacttgctactgtcctgtgtttcatttccagatcacgcaatatcgccaccgagagaatggtgcctagctcagctgacaggcagttgctaggagtagagcactggcctgagctcaaatcctctcaaacgcaagtttcttatcattttcttatttagcaattacactatgctaagtttctcattgattccaacacattttagagaacgatgcctagctcaactggcaagctcctgctagcagtaatacgctggcctgagctcaaatcctcttgggcgcaggtttcctcactaatttctcctctatcaatatcaataatgggtactatgtttctctccagtactttcaaaggaaaaacatatcgatgatttgcatctttgtgtatctgctggggcaaaccaggactgatcaatggtcattatagacaaaatcgaccattaacaacgggagaaaaaaacggagtacatgatcaattgatcaggtttccggcgcaaccaacctatactagacgggtgcagatcctctggagttggcttccaattctaaccggtgaatttgaaccaatctgaccccttactttgtttctatgggctagatgtagccatgttacctctttctaattacacatttacaacagaaataatcctatctacttttatttttttgtgttgtccgtccattcagatcaatagtctcggaagagcattatacatcatggagtaaaaaataattatctttaaacttttttaactgagttgttatgaaatttacggtattgagacctgtatcgaactcattcatcctaataatcgacagaacaaaaggcttctatcggtgcaatgtttttgttttgttcttctctaattgttgccagaaagtttgaaggtaacatgttctctacaatactagataacatttttttatagactctacattgtagtatttcttttgaaagaaaatgggccagtagtaaccaggggaaaatggattggatttaatctaatccatcaaattaaagggacggcttggattaagtaaatccaccatgtggatttggaggcaactccaggggatccacacccacactagaccaaggaggagcccccaggatatgcaaggaaacaagaaaaatcattcagcaaaccgagacacggacgaggtatcagtgaagccacacacacgaggcacactagttccaaactttctgtttaaacttctaatttttccatcacatcaaaactttcctacacataaatttttatttttttatcgcatcgttacaattttaatcaaatttttaattttagcgttaactagacacaccaactgaacttctattccaacacgcatgctgcaacgaggcaattggataggtctggtccaacccaatcaccgggcgccccaatccaacccaagccaggtcagggcgggatcaaaaagataagctagctaggccccgtgagctggcacctagtcactgaccgcctcgtctccacgctcgcgtgggcccacccccacactgttcccggcgacgtggctcaatcgcctcctgactgctgcgtaggcgcacatgggcgacgacgtggcaaaattgacgcacatgtcccctttctttttccttttattccctcctctcgcacttactccaatcgccaggctataagcggtggccccacacccccacacgctcgggcccacaaagcccacgccccacggcacgccaacggcgtgggagaagcttccgcttttttgctcggcaagtttttaatagtatagctaattgtggactctaaattatttatagtcaatttaattaccgattcatataataattatttaatagatggtcacacatgtcatatacatatgcatcttgaagttcgacacatgcatcttaaagtctgtgctacaactggctacaaatctatagtccgttgtccttttctctcctgttttatctttatgaaatgtgttatagcttgtttagggcccctttgaatcgtagggttgaaaatttggagaaataggaaaaacacatgattctgatatgaattgaagtgtaaaacagaggattataaaacacaaaaaaaacacaggaatgatcgtttgattgaagcgcaggaaaaacgcaggaatcggatgagagagatgaattttccaagaggttagagctcttgctatatttcctctaaaatccacatataatgtgtcattccatagaaatttcataggatttggaaaacttcaatcctttgaatcaaaaggccaggtaggaaaattttctataggatttgaattctatgaaattcctagataaatcatttgattcaaaggggtcttatatttgctattgtacttgctctagcacgaaaaagtttattttattctgtggggggtgtgggtcccacctggggatgcgggcaccacgtcacccacatgactcggatgcaaagctggacctggagggggcgacgcgtagagcggcgagatggtcgacacgtgagcggacggatggaggtgacgaggaataaacaagtggcccccacaccacgcagcccgtggcccagtgcaccctccacttgccgcctcgcccatcacccgaccccaaattccagacgcacccccccagagaatgtacacaccagtacaccaccaccaccatttggtccatggggcgcacaatgacacaaaccactttgcttacctaacgagcagtcgagcacgcacgtttatcacgaaattagtactactagttcttatcctggagattctatctggtacagaagcttgttggcaactcaattatttgcttggtgcgtgcaatcttagtcgtccagttaatcacaacattattgttcttagcgtggtaggtctccttataattggaggattagcatagaaactttagaggattctaatattatattagcaattcttgtgaaacctttgaaacaaatgattaaatcctgttatatctttgaattcatatggaataaacaatcctataatgatttttgaggaaaatagccaagagatccagtatcatgtttttagttctttctcttttgcaatcatatgttttctcttggtttgtaatcaaacatctcttttgaagtttttatgttagaattgaggattttttgtgtaactcctattcctatgttgtgagtttttcatgattagggtctatttatatacaccaatgctagacaatcttaagctaggggtgtaacaaaaggtacacgtagcacttggggatgaggttcactggctggctgaaggctaaggagatggggggaacaaacaaggtacatcggcggctgacggtgttaacatagtggacgacggcactgatggcaggaagtagtaactcgagcgaaattcaacagaggagtagaaggatactgagggaaattcagccgctcgcttaatttgaatttgaatccaaaacgacctacaatctgtaaaattacttatatacgctaatgtgaatcaatctcaagttggggtgcaataaagggtacgcgtagcaattggcggtgcagggcaacccccggtggcctagtccttatcatagacacgtgtctcgtgacgtggctccagcctttgccgcctcccctttctctcgcctccctccctccctcctctctccgcgcccttctctctctcccctctctcgctgctcattggagatcaatctgctttcacgtctcctctctctctccgcgtgcttcctccgagggtctcctcctccaccgccgtctcgcttcccggcacgcgcgcgcgggcggcggcgagctccctctccttcgccactcctccaacccctgtgcggctactccggtgcggagccggcgagcgagcatgttctaagtggctctcttccttaaatctctctacaagaggcaattgaattgaaggtatttgttctcttcctagccgctgctttcatgagcgataggagatccatgctagcaagttggattgatttgttcactccgtccaaattattagtccgtgtcctcctctttgttccggatttcgatgatgcgttggtggtggagttctaattgcagtttgtatcgattgggtgtgtgactgaatatctagttactgaagcagtttcatgttgatgtatgcgtttgccctgtcctgttcctggaaccaggattaataataaacatatgaaaagttatttgacctcgaaaaaaaaattgtgctctccaatgtaggagaccgacgaaacttttgtttttaatagctgcttttagttctaaaaatcataattcgacttgtatgataggaatttgcatcttatgaaaagattgagaattgtttttacacaagttgatagctttatatcgatactgttgggcagtgtgccaaaacgtccttttggtgaaatcaaacatttctcacatttcaggctcacgcaaatttttatttatttttagttgcttaactgcacaccattataacctgaatttctacttgataagcagacagcaggctttcataaaaggcatggctcatgatgaagctgttgctacacaaaagattgggaaaacaacctcccctcctaaggtaagaatacctgttttagttgtagttgtactgactactgagatattccttgtgatctgttatgttatatcttctttgctgtgaattgaaattagttgtactgttgtcgaaaacagtggcatgaccaaaagccccagatcatgatcaatgtatatataacccgtctctttttccttcactcttttttgctttcctttatgtacctctatctctgtctctcttctctctaaccttaaacttgtaacctgtaaacctcatttctattaatgaaatgactataaggtagagcatgctctaccttcttgcgtcaaaaaaaaaaaactagtctcttaccgcctcttttctaaaagggagagttcttctttctccaaaagtaggggacagagtacgtaaatgaattagcaacctttgaattacatccagtattcccaatctgttaacatgatgtctacactttgaggtcttatttccactacatggcttactctgaggtcttgtgtggaatgacaacatattgtattttctcacctgactcatcaatttcaagggtaggagagtagagctacatccataaacatcttatcaattgccttcatttgcaggatcaaccaactccatgtccatttcctgattggtccgctgttcaggttaagtgttttgctagtaaattatcctataatctccacttccaaaagatagaatatatataatgtaagcatcaatacaaaatttttcaggcatattatggccctggtgtcttaccaccgacatattttgccccagcaatagcttcaggccatgctcctccaccatatatgtggggtcctcaggtaatttattttcgatctatctatgcaatgaagttccaggtgttgcatgaaatctgaatttctctctgcatatctgcagcctataatgccacccccttttgggaccccgtatgctgcaatgtacccacacggtggagcttatccacaccctcttatgcccatggtaaacattaatcttgatgtgcttccatacacttttttgttcaattaaacttgttagttgaagcattaaatataagatttctgcctaaccattttagatagatgttttgttatcaataatggacttgcacaagatattgtagttttgtggaaaatcggacaaccaagtcccatcatatacagtatcaaattaacttctaacatggcagatatttcggaaaagtctatcacggttgaccagacaacacagtatattaaagggaaaaaatgtatgctaatctgacttctgtaatgttgtttacggtgcaccataatcagcactgatttcataccaagcatatcaaacttttaaatgatgtgccgaatactagcttacaggaagaacatacgtgtaggcacagtaacagaatcacattcctaatgatccatcacgcttgttccccttggaccatacagtccgattgttttcattatttcagttacagcgtcagaacctctcatattgattcttattgaaaaattttagccttaatcctatgttgacttgtgattcaatatatttattctgctgactcctattaatttgttttatgtcaattctttcaagatggcaaatccattgagcatggaaccagccaagtctgcaagcagtaaggaaaaaggctccaacaagaaacttaaggaagttgatggggctgcagtatccactgggagtggtgacagtaaaaaaacaatgacgtctagtggggattacagtgcagaaggctctagtgatgtaaatgatctaaaggtaccagttagtttcaaatgcatgctacattgtgttatcttgttgttttctaatgaacatgtctgaatatgcttaaatatactaaaattgtacattctttaggtgggcaagactggcaggaaacggagattggatgatggagctggtatttcactttgtaacaacttttttaatatcataggcataatgctaatttcattttccctcatctttgtaagacttgttatagatgtatgcagtaccaaacttgattaatcatttgcttcagcggttatcttgtcctctatcatgccttgtttggtataacttgcaacaatttttttattctcaacattatccctttgtattatttggctcttcttaatagaaaatagtgtaaagcttctgcaccttcctgagaaaagggaaaaatatttatcaaatgacacataagacacatctttatctttcagtttcttaatggaatggtgactaatcaaatcctgtttcaaatttgactttgtaaaaaaatagtggctaacaacttaaatctctgccaggtgctgaaacatcagcagctgcaaagatggaaaatgctttacctcccagccatatattgggaagtactgcgattttgccaaatcacagctttccagctcaagtaattaggcccagtgctactaatgttgctaattcgagggcattgggcacaccaatatctccaccgcctggtgtgattgttccaagtcatacaggagtatcaacagaattactgatcaaggtatcttcaatctgacatcatttagaaaactgtgaaatcagaaattatgaaaaacaataattttatgtaaataagttaactttcatgtcattgttattccttgaaaaaaattacactagtatatatacatttctcagggattaactttgtggaattcttatatgccaggatgaaagggaattaaagcgtgaaaagaggaaacaatcaaatagggaatccgccagacgatcaaggctgagaaagcaggtatattatagtagcaattaccctgtgatcaatatgagcaaaacccagttttctgaagaagaaaaagaggcatcatcctggaaacatggactgaaactgaaaaccaatttggacattctgttttgggaaagggattttattgcaaatcccagtgaagtcacaggataatttaatcacatacatgtcatgtcacatacaaaatttcaagttagtacagaacatatttccataatgctttcacttatgatgtcagtgttttcgtttaggctgaaacggaggatctggctacacaagtagaatcacttacagcagagaacacgtcacttagatctgaaatcagtaggctatcagaaagctccgagaagctcaggctggagaattcggctctaatggtactgaacctcttttatgcttccacataacccttaacatgtattatatacatttctctgatagaaatgtgccttattattcctaggggaagcttaaggatcctgcagcatcgacccaggcagaaacatctctgcagaaaaccaccacagcctcctctcctcgcgtcgtggagaactttttgtcaatgatcgacaacacgaacaagacgagtgtcagacacacagagcatgctgaacccaagcttcgacaactcctcggctccggcccggccactgatgttgttgctgcaagctaatctgccattttccctgtcacagaggagagactacgcgcatgcggcctggggattttgcaagctcacgctactactcacataacattcggcagtacagtgttaggtgtcaatttggtcagtatattcaggtgaccatctactactcaaaataccgtttccaattgctgttccctgctcaggcatggaagcttgctaggtgagaccaatgtaccacgttttagcagtgttgtaacataggggtgttgtgctgcatgccaacctcaaaccttgtgagatcgctaaacactttttagaattgaaatttgtggagaccaaactaaatgaaatgtaacctaccctttttacttgggtatatgggcccatattctttacatggcttggaactgtaactttgtaagatgtttttagtcaaacttctttaaaatttatatttataacactaaattagtttcattaaatatattatgatattatgtttgttttggtttgaaagtgttactagatttttctaaaagcttaattaaatttaaataaatttaactataaaaggataaactctattataatatagagtaaagtgtacgggcagtacttaaacttatagtggtatgttatctaggtctctaaacttttaaaatacatatccaagtcccaaaacttatcacagtgtgttatctaggtcctaaatcaccgcaacgccttcagcatcctgcgtggagttgatgtagcatgccacatggacatgacatgacattatacaaatggaacccatataattttttcctttttctttttttttctctttttcccgtttcttctcctttctctgtgacccgagcagaaaaaaaaggaaaaaagaagaatgagaagaaaacgaaaaagaaaaaaaatagtaaaaaaaaagaaaagacatgtcacgtccatgtggtattgccacatcagcaccacgtaggatcctagaggggatgtgtcaatttaaacttagatgatacactttaaccagttttgggacctggatatgtattttgagagtttagggagttatataacacaattctgcaagtttaagaactgctaatgtattttactctataatatattacgaaaaggaggaagtagttcatatccaaaaggttaagccatactagtacgtgaatccatacactttctacagtacaccctgtgatctgaacttctgatctgatcaactctagttaatgactctgtcggcctgtccttgtacaggaggaccactctgccccaacagctttgacagtttgacgtttgaccctttgcaatcggatcaaacgacaaaccacaaacgattgacaccgaaacactatccagatccactttgaccgctggatgccaaacttcttcttcttcttcttcttcttcttcttcttatttttttccaaagccaaactcaaggatggtagaagtcctcctgtcttaagcacatgtactacattacaacacgtgtatgatctttcagtttctcatcaatttatcctgcttaaagttcaacatcacaccaaccgcaagttcttgaatctttgatgcataatcgtgccatgtcttgggagtttgatcaagcaattccctcttttgtgctgtgcgcattagcaagttagcattaagcaatggcgcactctcgccatgacatgccaccacatgtaatgtccatgtactgatgcagagttaacactctagtggcttagctagtgcttcacttgctcgcagttaagtgggagattaggtcctctttcagcttaagactttgctcgaaatgaaaggaaaagatacagaaagaaaaaatggaatgccgtactaagcacttgacctctcctgatctctgacggcgatgggtgaaagaaaatctctatctcttcaactcagcttagcatggtgcttagctagcagccgtagctttacacggaggatgccgttaatttcgccatggacctgccgcccatgcacatgcgggagactcaacgagacgacaactgaagacgacctgtgcagggcaaatctccaagcttctgacttgtggattacactcgctgcacttctccctttccgaaagattcgcttaaacagttttcggatcaccatttttgtccgaatcattgagttcttttttaagttaaaaaaagttaaatcactgggttgatgtaagtaaatgagaggcccctgttctaagcaggtttcagagagcacggcactcgtacatttggcgaccatggataagttccaggtcctgaagcaacgcaagtgttcctttcgctgcactgtctgtgaacaaagcatacctggcctatgtgtgcatgcaaacaaagttatttagagatcgtgtcacgcataagaatcgtttgtttctggaaatttgtcctctccgaaaacaaaagaacacattacttcgatgtttgaacagacgccatgtttagaacaaggcttgttgattatagtagctactactaatctgccgttctgctttaaagaagagaataaagattataataaaggagtaaagaaagagagatggcgaagcggaaggcttaagaaacgccaaaaaagcctttgaaaaacttggaggagaaaacttgaccgttgcagcgtgggctcctccgcgaaattaaaaagaaccggctaaaattaaaatgcaggcattacattacgcagactcaaggcaggacacgagaaaagctgcaagagtttatccgattattatccacaaggcagaagccaaaacaatctgttaattctcctcctcgttcttccttcaaaatttctttctcctactcagcattgcgtcgtcgatgaaacccttttttcctttctcagtttctttcctgagacttttctatacctgcaaagtgcaacaaagtggtcgaacccccacggtttgtcttagttttttctcaacgaaaaagcggcgactgcacgtgtcctccatggccgcggcgctgggttggttttaccgggttccgggctctgccgggtgcacgaagccatcggtatcagcatcaacctctcctctcctagcctcggatcctctcatcctcctcgcgcactagagaagctagagcttcacccactcgtgcttctctcctcgcctcgcctccctcatctcgatcttccaatggcgacgtgacgaggtggttgccctgcgctgcgcttctgaccaccacgtgcatttccatttcccgctgcatccgatccgtttgttgttgttgccgtggcgtgccttgtgaatttgctgctccgagcgagagcgagccggtggtttggttggttgcagaagctttggcttccgctgaggctgcgctggtgtggccggtggctcacgggtttcaggccgcgcgcgcgctcgcgcggtgttttttttttttttttttttttttttttttgcgctcacaaggaaagtgcagacgcgcagtgtaaaacgtcgtggcaaccccaaccgtcccaatggcgacgccgcccactgcttcccgcgcgtcgccataaaatctcgtacgcgtacgtgcgcgcgctcgtgtgcgtctctccttctcctctactctctcttcacgcgggctggctggctggctgttgatgagcatggggcactacaccaacctgacggatccgaggacggagctggaggtggtcagggactggaacggcgtcgaccaggtcgtgctccgctcgccgcggggcgcctacgcgcgggtgagcaggtttttgcgaatggattttgatcggcttggcattgagtcctttggtttggtttggtgcgattctgatggctttgttttcttcgtcgtggtgtgtgttttgcaggtgagcctgcacggcgggcaggtcctctcctggaggaacgaccgcggcgaggagcttctcttcaccagcagcaaggtgacgttttttttttttcaattcatttttcgattcttcagtgctctgcaaccgggttcacattactgcgattagcctagggaagtgtatttcgcaagttcaattgattgcagtagaattcaaactgtacgctcgcgggatatgttcttggattgattctgtttgagaagtgtgtactctgaacattaaactgtacttgtggaaggacagttcagacgggctctgaagacacaaaaacctgaactgtttcactgtttccatctgggaaactgaagaaatcttcagtattctcttccatggctctttcactggcttcaacacgcagtttcttgacgtgcaggcaatcttcaagccaccaaaggcgatgcgtggtggaatcccgatatgttttccacaggtatcatagtcttccattgcactgaagatttgtattatatactgttacaaataggatgccaattgataaggaagctagcttcccttctttttggtcttttctgatatccacaagactcactgcagtttggaaattctggaacattggagcaacatggatttgcaagaaacaggatatgggccctagatgaggagcatccaccattaaatcaaaatgataacaacagcaaagcttctgttgaccttatactaaagccatctgaagatgacctgaagtgctggccacatgggtatgcatttgtttttgtccaatatgtatttccttttctcttatagcacgcctttttgttagtaagggccatatgtcaaagttttgttatgtactgcatcatgggggtaattagttgaacagcctaatcctggcacttttgatgataatagtcaggagaatattttatttcagggaggttgttgaacatttgcacctcatctcgttgttaatgctgactgaatttgattttatgtatgatcctgcaatatttgatttcagttttgagttccgcctgagagtttctcttacaaaggatgggaacctgtcactagtatcacgcatcagaaatgttaatggcaagccattcagtttctcatttggttatcacacatatctgtctgtttctgacatcaggtcaggcatttcacccaacattctttttgtacttcaaccactttttgttggtgccatataatattttgaagatgacagattatatatcttgttaattccagtgaggtgaggatagaaggccttgagacacttgattatctcgataatcttagccagagagaacgttttacagaacaaggagatgccataacatttgaatcggaggtgaaaaatgtttgaataatcatatgcgctatatactttgatctactgattccgcaaatcttgttttgacattttgttgtaaaaatttacttgccacatcataaagtccaagatttacggtgttagcacctggtctatgtgcaaacatatgcaggttgaccgagtctatgttagctcaccaaatgtaatagctgttctggaccatgagaagaaacgcacatttgtcataagaaaggaaggactgcctgacgttggtaagacacaatattctctttgccacctaaccatggtaactttgcttgaaaaatttccatcatattcgctttattcctcccagttgtgtggaatccgtgggaaaagaaatcgaaaaacatcgtggacttcggcgatgaggagtacaaacagatgctgtgcgttgatgcggctgcagcggagagacaaatcactctgaaaccgggagaggagtggacagggaagcttgagctttctgaagttccatcgactaactgcagtggccatcttgatcaacccggtatcatcatttagaatatggcttgatagtttagaattttaccattttccttttttacatgagatcgatatgctcctcctctgccatcttggtaaaaattcttcttgtacgtgtacaaagattttaccatcttggtcagcggttcgttttaagcttatgccagagtcatcttgtttgttttggtttctgtgataccaatacatgtgggcgcaagatatactgaacttttctgatcagaattcagagctaacagctacgcagacagaattcagacttcagggtgacacttaaaaaaaagaggacttttacggtacattatactgcaagtatatactagcagtatatttatgggtataataggaatttgtcaaaaacctaaaaagtgcttattagtcatttgaagttgagatttataataccgtccatcgacagtaccctggaggcctggatctcgcatgagcggtcggggcatgttctgacgacgacgcgcttgtaggctcctcgtttgacgactgcgcgattcctccccgcgtggctttctcctccgcatccgtcctcacagctccagcctttcccaaaccgctacgagctggctgcctccccccgcttcccacctccagtctcactgctcctgtactccccaacccgtggcggtgaagtgtttgtacactactctcgtggcggctggaacccagcatcagcctccgtgccctctcgcggcgaggcggcgcgctgctatagccggctgcctccccatcttctgccctccatgcccggccgtcgccgattctgtaggcttccttggactgctggtgttgcagaaaatgttacttccatgcggtctgcctcctgagggagagacaaagactgaggtcgagcgttcaatgttacatgctactactgaaagtatcagattcttatccaaaacaggatcaaaatatttttttgcgtagccatcttgaacatctgaagccctctatatgtacccttttcgaacctgttcatcattaatgttcagtccttgtgtgtagccttgccggtgcaaactgccgcagctgcgccccttggcctgggcccccagcagccggcacccatatgcagctccgcctgaatgccgtctccgcacacccgagccgtcaatagaggagttaaggaaggttttggatgagtgggaatgatagaagaggatgaaaagaggacgtaaatagaatcgattcccgggggcggcggcgcggggcgcggcgtgcttccggtggttgtcggcggcggcggtcaaacatgcgacaaaggaaagggaacggctctaactctccaactggaattcgctcgagcgggatctgacgaagaagtaaagaaatgcgaaaatacaaaaatattcctccacgcaaaagatgaaaaaaactaatataccctattcaatttatactgcaggctcattgggcggaagattagatgaatctacaccgttaaatcatatatactgctagtatatacttgcagtacaatgtaccctaaaaatcctcttaaaaaaaggccaatattagagaaggatctaatatcaaataattagaatgggtgaggtttcaaacccagatcgtctagcccaccaccttatggagttagtcggaggaaaatgggctgaattctgacaatcctattgggccgcgggccgaaaatggacacctcaatttcatcgctcttaggcccatatgcttcgtgccgatagttcgagtcgtgggcgctcgtggcagccggcggcagcgaagcatctgtcgcgggagacacgtgcctcctccagaactacacgtgtgcaactgcatgggcgagtcagcgcaccataagaacagctcgctcgcactcgagtctctctctcgttcatccatccagcggcacacacaccaagctagcttctagtagttgagcaatggcggcgtcgtgccacgaggtggaggtgccggggaagccgacggagacggggacggcgctgctggaggcggcgacggggagcatccaggggttcggccccgtgaaccagatccaccagcacctgtgcgcgttccacttctacgccgacgacatgacgcggcaggtggaggcgcaccacttctgcgcccacctcaacgaggacatgcgccagtgcctcatcttcgacgggcccgacgccggcgcgcgcctcatcggcgtcgagtacatcgtcgccgagccgctgttcctcacgctccccgacgacgagaagccgctgtggcacacccacgagttcgaggtcaagggcggcgtcctcttcatgcccggcgtccccggcgtcgtcgagcgccgcgacctcgagagggtgtgcaagacctacggcaagaccatccacttctggcaggtcgaccgcggcgacgcgctcccgctcggcctgccccagatcatgatggctctcacccgcgacggccagctccgccaagaactcgccaaatgtacgtgcaaaatcattcatgttcaattgtgtttttttctccaatctatcgtcagtcgtcacagcttaactacttgtgttggtgattggtgcgtgcattgcaggtgtggaggagaagttcagcgtgtcgttcgacaaggagagggagaaccgagcgtacatgagcggcccggatcacggcatccacccgctggcgaatgccgccggcaagggcttgaagaccgatctccgggaggttgatctgccggcgatgactacggcgcacgccgggagggttttcacctgatgacgacacactgatgagcgattgagcgacgactcgacggccttgctgcttctgcctgacgacggttaagtagtatgctagcatatcacgggatgctccgattagcttgtgtaccttcactcgtgttatgtatcgatctgttgtccctgagcgtttgttctgaaagaagcacactagagtatccgactgtagtacctgtagcctcttttctagcagcttgatgaacacaagaacaacagaacaggttgtgtatagctagttcaaaacgtgacatctgtacctgtctcgactcgtctcacgtctccccatctgtactgtgttgactcgtctcacgtctccccgagtctacacgtcaccacgcacgtacgtacgacgacacagaactctcacacgaaggggcaaatattttccaaatatttttcttttttagagggttgtggttacctgtcttgatgccttttggatctcaagggccacaccgctgtacggtgcacgtcgcgtaacggcgcgtggagcgggttccacagcgccaggacgccgtagtggtcaccgatcccccggagacggccaggtatcagcgctgcgagttgaaagcgacgggaatttttttcatttttaattttttttcttttaatatttacagaaataatccatcagcgcaaaaaattacaaaaatagaccctactgccctccattagggcggcaagctgacgtggcaaacgggtgagggacgggcggtaacggcagatgggcggcaagctgacgttgcaaataggggagggacgggcggtgacggcagacgggcggtgacgggagaggtaagctgacgtggcaaacgggggagggacaggcggtaatggcagacgggcggcaagctgacgttgcaaataggggaggggcaagctgacgttgcaaataggggagggacgggcggtgacgttgcaaataggggagggacgggcggtgacgggagagggagggttttttttttcgacgaaaaccggcaaggggctcccatgcaaaaaaagccaacccgggcctaatactttttggctggtactttttgcatctgggccttttgccgcccttggtactttttgcatctgggcggcaaggggcccagatgcaaaagt

SEQ ID NO: 71942 - DNA, 1112 bp, Oryza sativa
tttctattcaagttaaatcacacttatgcaattattcatggttacttacattgtctgctctgttaatctatacaacttgattgccaatggcattctctgtagtctcaagggtacatgattatgcttttcaggtcttggctaaatgcatatgaaaaaacatattgattgaactttactaaaaatattgctcgtccgggatttagtaagaatgtccctctgctcttattgatcaaatagaactgtccatatatgcctactctcttttctgatcacatagtactgtgtcaaataaattcaatatgttgctttggtgtccttaaatggcatggttgtttttataagacagtaaatacaatgtgctaaatccagaatatatcaataagtctacccttaatgatgaaatttaacttgtgcttgctgcatatttctgttcttttaaccctgatgtgtattgtagaaagtataatccaattccacgcagctattttctcctccgctttctctgccaccgctgcctggtatctaaatgtttgcacatgtgctattttcaactcaggtactttcagcgaacaagaatcttactccattataaggaatcaaaccaatcgtgaaggtagctggtactttgagaactgtcagatatgcaaatctggctaaatagtcatccatgtgaaatgccttaatgaactctgtatttatatagatgagatagctcatttagagagtacatacatgatgtgggttcttcgatccaataaactctgtagtgttgatccatttatatataattctccctgttgtgctgatccatttatatatatttctcccttgcatatgcacttttcatttactcccatccatgtaacattgtcagcactgcagcgggtactggtgtgtatacatttcgtgtgcatggtgcgttgtaccatcgcctgggtaatttggttccaggttctcaagggccactccatatgcaactttacttttatgatacagaagacgctgaagcactggcccatagggttcagaggtctcctgaccttgatatcaaccttgttcgggtcattctacgtattttggcacaaacccttacgtacagaccttcaatagag

SEQ ID NO: 71943 - DNA, 15507 bp, Oryza sativa
tgtgttcatccaaagacttgctgtaaatcaatatgtcatcaaagtacactaccacaaatcgtccgataaaaggccttacaacctcattcattaagcgcatgaaagtactaggtgcattagtcaaaccaaaaggcattactaaccactcatacaaaccaaatttagttttaaaagctgttttccattcatctccaagtttcattctaatttggtgatagccactacgcaagtcaatctttgtgaaaattatagagccacacaactcatcaagcatgtcatctaacctaggaataggatgacgatatcggatagtaatattattaatggctctacaatctacacacattcgccaagaaccatctttcttaggaaccaaaattacaggaactgcatagggactaaggctttgacgtacatacccgcggtccaaaaggtcttcaacttgctgctgaatttccttagtctcatctgggttggttcgataagcagcacggtttggcaatgatgctcctggaatcaaatcaatttgatgctctatccctctcataggcggaatcctgggggtatctcagctggaaagacatcctcatacttctgcaaaaggttagtaacaacaggaggtatcgaactagcaatatcatctaaagaaaccaaggcttgtttgcatatcaagaaatagcacatatcatcatctgacatttcagcaatgtcacatttagttgcaagcataacaccacccttcaacttaattccctcaaccttagaactaggtgaaatcttatcctttttaggtggaaaaacagatttagccacttgctgattttcagattcatcaagtttcaaactagcagctcgctctttatcagcttctacaatttcagcaggggtcaaaggtagcaaagtaattttcttcccattatgcacaaaggtgtatttattactcctaccatggtgtgtagcatcattatcatgttccaaggacggcccagcaaaagtgaacaagcttgcataggatccacatcacaatcaacagaatctgcatattagccaatggaaaacgaaaccctacaaaccagtgttacctttgctcttccggaatcgtttaaccactgaatatggtaagggtgtggatgtgtaagtgtagtcaagccaagcttctcgaccaaatcagaactcaccaagtgtgttgcagctacctccatcaatgatcacacgtgcacgacggttgttgatgacgaaaaaaatctgaaacaaattatggcgttgcaacctgtcatgctgctgtacctgcatgctgagcacccactgcacaatgttggtcctgtagtccgttgtgtcatcacgaccaaagacttcgccatcctcatcctcaacttcttcttccccctcttcctcttccatgtcggaggtggtgatgtagccatcttctgtagcaacataggcccgttgactagggcaatctttctgcacatgcccaaacccttggcaacggtggcactgaatgcgtcccgtcgaggcgacagatgaggcactcttggcgggtacctgcgtggaacctttacctgactctgctggtcgtggtggtggagatggttttggtgccgcagaagctccggatgcagctggtcgcttgcccgctggctgggaggacacccgaaaagagacggccttgggcagtgccgcagatggcgtcgtgcgcggagtgtatgtgcttgccttgctcttgccctgatggtcgcgcccctgtaattccttctctgcaagcatagcaaaccgaaacaactgttgacagagttaaattccttataatcaacaatgttctgaatttcctccctcaaaccagaataaaaacgacaaatagcatcctcgaccccctccactatgccacagcgtctcacacccttttgtagctcaccatagtaatcctgtacagatttatccccttgttccaaacgcatcagtttcttgcgcaaatctctatgataagatggaggaacaaacctattgcgcatagctaccttaagttcttcccaagtagtaggtagtaccccctcagcagttaacccaacccaccacataatagcaaaatccttgaactcactactggcttgtctaactctatgttgctcgggtacaaggtgggcattaaacttttgttctactgtcatctcccaatcaaggtatttctcagcatcataatatcccgaaaaagatggtattttaaacttaaccttagcataaggatcatcggacacacgattattattattaccttgttggtggcgagtgccacccatacctatgcagtttgtgcgtaggcgacgtcgtagctgtgcttgccttgtagccggtgcgtcaatatagccactggaatcatacaccgtgtcttccggatgagcatcgtcatcaccactcaccacttcctcattggaaggtgtctccaacgcggcgacccgatcagttagcgtggatatccgcttgtccaacctctccatgtggttcaggaagccgattttagtgaaggcatcttggacagactttgcaacggcctccgtgatgtccttttgagtattttgttggagagttcgtagttgctcttggctgacacagtcagcaaaatcctagggactcttctcaccttcgttacctgacattgaaacaccaaaacagaaacaaaacggtgaaggttatccctaataatccactacgcaggtgtagtggtgcctttcaacgattctcagcaatatggagttcctaaccaagctcttataaggttcttaccagcaaagcaaaggatacctggaaggcgtagtcagtgattgcagggatcaagaacctgtgctgtccagaagtaataagtggagctaggaaggccaaatatacgaatatgagtggtacacaatccaatgacagatagtaatgctgaataaaaatcccaagtcacttgcccttagttactggactactcgtgtcctagacagtagtgataacaaagatggctcaaagaatatgacactagtaaacagcaaagaaggactggcaggcaagcttcggcgagtttcagcaaaaagtacaaaaccgaactggcagataagctcaatggagcgcgtcgtgagctcaatgcactagtggaaatcaacttttcttttttttcttttattttttttgatatttttttcttttttcagaacacgaaaataggcacacctccaagttacagctcaatcggagtagatatgtggcctatggatttttctgaaacctctataaacaaggtgcaggaacttgtgagctcgaacagacaattttgcaagccaaatttcgaaattttggattcgccaatccgccaaaggcggggagaaacagatgtaaattttttttctcttatccgaaaagttaaagtttgcctgattccaagtccgtatgcaaaagttatggctgtttgaagtttcggcttccgactaggttttccagaggggatataacctagtctattatgcggtggaattggaatgtggtggcagcggagttgtagggtgttttggtgatgcatggtgatctggatgggtgtttatgatggtggaaacggctctcaaaggatgaaccctaacacacggtgaaaggtggcggctagggttacaaaggacaaacacatgactagactaaaacacgcactagaccagcaacaggaacttaaactaggactcaaactcaacactacggactctgaaaaagaatcatgtaaaggctaaacacggtctaggttaaggtaactaacaactaaaattttttttggcttttctgtagactctaggttaaggaaactgagcgaacatgacggtgaaccaagagctctgataccacttgatgtgcactagggttcccgatcttccgaaaggttctaataaacaacgatttgggcggagtcgcgacacaaatcgatccggcttcttgaacgcgcacgctcttgagccccgcaatcgcagcactatgtctcctctggttatcacccgtgtccaaacgcggatgacctcgccaagaaggccaatccttgtttgccaatcgaagaacaataacaagaacgagatagaaaaacaaccaaaattgcagatgaatgattaagctcacgagttggggtcttacaaaccgatctagcggccaaactgttctcgacagattaatctaagcaaaacccaaaaagctaaagatggcagcgggtactgataaatagagtttagggtcgtgcaaacccctctcgacgcaaccctaatgggttccaacacgatacacgggccaaaggcccaaatacggtgacgcaacaccgggacagattttggccgtcaacttgttcggtcaattcccattggaaaggttatcttcttagctttccatctgtataaagaacgccccaatctgagcacgtatgcgacctgggcgcccgttttagtgtagactggtcctggactccgaattgcacccgacgttgacttggtttgggcctccaccttgacttggacgtccccgatggtcctccatgggtctaagtccttctccaagtgtctccttgtcccctccattgttcctaatcacaatataatcattaggtagcaatctattctcgaattcatacaaagaagaacataggaacgagctcacctctaaatttaattgtcgcgcacgagctcttgttatcggtccttgaatgaccgttggaggattgttgtgtgtatccgagatagtgatgtccgcatcatggttgcccttatgaaagggacatttacatgggtacataatgtaataaggactcatgggcccctgatgggccatcgggcgatcgtcggccttacggtccctggggttgatgggacggaaaggcttcttcggccctcgcgggggcgaacttgctgtggcgaagtcatcttcctccggtatatactcttcgccctgcacccttcgcccaagaggcctctggcttgacaaggtactcgcacgatctctcgcccctcgccgttcatgttccatagtcttcgccatggggggacttcgccccgtctaacgtcgatgtctcgggctcgaatctccactattcacatggtttcggtagatttggtcgaagggcttcatgccacaccgccaacaacttgctattacaattatgcagccaataccccctaactatgcctacctgatatatcaagaaaccacccctaattgccgagttccttatgacaacccgttatgaccatccaacccgtaatgaataccgagaaatacccacaccaaaaaattctcttagtattatatacgcacatgggaggaatatccgtactgagctgtcaccatcagcggcctacctctacagacccatggcatataacaccattttctttagataatggaatataataccatttaataatactactctacatctcagcagatgacatagagcaatcatatagatgagcattaaagcaataccattgcagatctccagtaagctagctacgtaactattacgagacaagtatgaactaaagtcggtactcgaataattatataagtaaagtaaaggaccgaaactataataagaagaatattgagaaaattccctatgtaccttgaaagttcatccaatccttattataccctgagattttctcattcccttccatagccctaaatttcagtttggatcccttctgtaccccttccgtcagttggacgttaagttgaccgttaaattcatatcataaactctattttaccctttggtatcaagaaaatataaatttatgaattatattaatggagtgtataaatttagtgtatacgactattatatttataagtttattttgtgagatattatttagcaaaaataattttaatctcgcataacaagatttatcttataaaaaattcatactactataacaaaatatgcagtttttaatggtcaaaaatatttctttgttttatctaaaatattgccatagataaaaattattttgtttccccttcgcgaggcgaaactaaaatattacatttgttaaaaatatctcacaaaataaactcataaatatgatagtcacatacaataaatttatacagtccatcaatatacttcataattttatattttcttgataccaaagggttgccatagataaaaattatttttgttttcccttcgcgaggcgaaactaaaatattacttttgttaaataatatctcacaaaataaactcatacatataatagtcacaaacaataaatttatacgcttcatcaatatagttcataaatttatattttcttgatagcaaaggacaaaatggactctatgatagaaatttagtggtcaactaatggaaagggtatagaagggatccaaactgaaatttaggggtatcgaagggaatgagcaaatctcaggggcatagaatggattgggtgaagtttcatgggtgcataggaaattttctcaagaatatttcattaatgaattaagtcttacaaaagagagagaagctactaaagctatatccgaattctcctaaagacttgaagaactaagaaaaaaattctattcctacaccactagcactagaacaatataaataaactggagagagctcttgacttcttcttggcgccctttggaatagagagtgaactcctcaaataggctggcaatggcggttgtggcggttggaattgtcggaaacgcgcaggaggggtttcagccgaattagccctggtctggcccaattagcctgtgccttttctagtgcgttgcttgatggatcttaagtccagcggcatggtggtttggcccaattgcagatattttaatggggaataagatcactttgactccctcaactgactaccgaacctaaatcgtatccctcaatcgcaatagcagaaatcttgacccccaaacttgcaaaaccggtgcaattagactcccttggtggttttggagggccgtttcgctgacgtggcgcacacgtggcagtgttgacctggtcttcaccccacgtggcattgacgtggcactaatgtggcattaaaataaataatatatgtggggcctatttgtcattcaaaaaaaattgtgggacccactgacgtcatcttctctctcactacccttctgcttcctcctctctcccttatttctctctctctctctctctctctccccccttgacatgagccggtggtaggcggtggacctcgggcaacgggcatgggagcagctcctccttaaggatgcagagcgggcgctcaaggttgtgcaccacctccgattttgcggcggcggtgggtgcgtctcggcctcgaggtggcgacgcgaagcaatgagtggtctccggcgacgccttccaccgacgatgaaggccgacgccttccaccgagcctttactgtctctgccactgtgaccacatcaagccgccgccgccgccctgctgctgcagcttgtcctctagtcgcccgtcgtggccgattcggagctctggatctaggttgatggagctcggtgctacgccgcggagtcgccatgcattcctgagctcctcgtgcatggctgcgcgacaccgtcgagggcaccaccaccatcgtggtccaccgtgagaagccaccaccgccaccgtcactcctgcacccgcttgccccacacggcctaagaggtcaccagcgacggtcggtggcgcaacggcggccacggtgtggtctatcgggaggaggaaggaagctaggggtatatccggcctccgggtccgcaactccaacacccggccgcctacccttcacccatagctgccgctccatccatcgcccgccgttgctgccgccgatccggacgccgctccccacgcacgaggagaaagagggagagatagagaagggaggagagggaggaggaagaagggataagagaggatgacatgtgggacccactgacacaattgtttttaattgacaaatgggccccgcatatatttttttattttaatgccacataagcgccacgtcaatgccacgtgggacaaaggccaggtcaacactgccacgtgtccgccacgtcagcgaaactgtcctctaaaaccactaagggagccaaattgcaccagttttgcaggttcgggggtcaagatttctggtattgtggctgagggatacgatttagattcggtggtcagttgagggagtcaaagtgatcttattccttttaatgggtttgtaagcccatccatccataagtgtgccactcgtcggacttcgattgattattcagttattttccatcatctcctccatttatgtgaagatctcccgcatacaaataaagttccaagtacaagtgaaaatagattattcttaaacaaatatgtatgcaggcattactagttcttatttattttagatatattgacaatcaaaattggtctataatgaccctcaacaataatttaatggatattagacatcacgtataacaattttatatgatgaaatagctcttgtaaaccgaaaacccactcgccatagcggtgtcgccgaatctacaaacactaaccacgccacaaatttctgaagaaaccttggcacccctaatgttcgagttcaatgatttgccatcgacatggtctctttctataatataccggtgactttaacaattgttctacgatataccattaggccggaccttcttttcaaaaaatacccaaaatacccttagagatatacaagataaacaattgatttatctcattagaagtttcaaaaaaaatatgaaaatttttacgtggcctccttacacaatatggaagtttctatacaagttgtaattttttttctggtatatttagtttttttaaaaaagtgtttttacgtggtatatgagagagagtttgcttatccaggagatgatagcataaaactatcttatgtagtgtgtgaaagatgatttatattaaaaactaataaaaaggtatttttatataccatataacagataagttatattttttttaaaaaaataaatgtaaaaaacttaaaactcctatagaaatttccatgttatgtaataaggaggccacataaaagttttcatattttttttggaacttctaataagataaatcaattgctaagcttctatgttcataagggtattttgggtatttttaaaaagaatgtcaatggcaaatcgttaaactcgaacaaacccagtagtatacaatagattatctcaactcgctggtagtacggtacataacccattaatatttctataagtacaaaaggctgtgatttacacgaaggcctaagtcaaggtctcctcgttcccctgaatttctctttcaaagcatgaaaggctaccgattcaatgaaactgtgaaacatcacaaaaaggaggctatatatataagaagagaagttgtaagcaagctatataattaagcaaactacaaagccgattagctaaatttctccagtccaaccagcttccatacatggccacttcgatcatgattacgctgctactgtacctctggtttttagcatctattgccattgcttctattgccattgcttcgaccccagacagtgtcaccgccggcaacggcagtgacacagacgttaccgcgctgctggctttcaaagcccagctcgccgaccctcgcggcgttctatccaactggactactgccacatctttctgtcattggttcggcgtgtcatgtagtcgccgccgggcacgggttgttgcccttgtgctgcacgatgtgccactccagggaagcatctcgcctcatcttggtaacctctctttcctcactgtcctcaacctcactagcacgggactcaccggcgccatcccagccgatctcggaaagctgcatcgtcttgaagttctcgttttccgccggaatagcttgtcaggcgtcattccaccagtggtaggaaacctcacaaggcttgaggttgttgacatggggcacaacagcatatcagggcagattccacttgagctgcaaaaactgcacaatcttacgcacatagatttcataacgaattacttaactggaccactaccgaatgatctcttcagcaacaattctaagctacaatatctagactttgggaacaacagtttgacaggaacacttccgtattctgtgggttccttaggcatgctccaacacctcgattttcaggctaaccacttctctggcccagttccaacaactatactcaacatgtccaagctgcaaatattatctcttggaggcaactggggcctaactggaactatcccaggtaacaataataccttcaacctccccatgctgcaaatgatctctctatttgcgaatagattcacgggacagataccattagggcttgcaaactgcaaatacatccaaataatttccattggagagaactcattcgagggccctgtgccaacatggctgagcaaactgccagacctccttttacttgatctaggttacaataatcttatcggtcaaatcccatctgcactgggtaatattactaatcttgtctcccttggtcttcaatcgtgtaccttatcagggctaattccacaagaacttggacagcttcagcaactcaatgcattgtatctggaccataatcattttactggatccatccctaccttttttgctaacttttctgaactacaagtctttctaatcggtgctaatagttttactgggtcagtaccaactgcacttggtagctcaagatcaattgagtggtttaatattggagggaactaccaagaagggagcctcgacttcttggctacactttcaaactgtcaaaatatctgggaagttggcttcgacttgaatgattttacagggaagctccctgactatgtcggaaacttctcaagtactctgataaatttctttgcagaaggaaacaagttatccggtgagcttccttctaccctgtcgaatttaagcaatctcgtttggttggacatttcaaacaaccaactgactggtactattccagaatcaatcaagctaatggacaagctccaacttcttaatctctccggaaatagcttgtctggttcaatcccaaggcagataggtcaactctggaacctacaaacactaatactcaataacaacaacttctctggtacgctaccaaacgatcttggaaacctcggtaatctacaatatcttgttctatctaaaaagagtttttttacagtccatcatgactggtggtacctcccagtacctgtaatcagagccatccattgagtccgatctaacggatgagaatcctcggtactgtccggtaccaaaatctcctcaatggtacctccccttcgccgaacaggtggaagggcaaagctgggttttcgcatggtccgctcctccccaacaccacaatccacacctcccggaggcttgttccggtccagcgaaatgtaccgcccggtacaagtacctgtagataccagttgtaatctgaccgttcaatacatgggggtacgatggggtcgacatagttcttcctcgtggtcgtggccattccatcccctccagctgcagacatcctccatctcttccctgcgggtgtaacttttcttcttccatcccctccggcgcagccggcttttgcgcagctgtgacgtcgcaaagctacgcggcggcgtcgtggaggtctcacccctctcgatccaaggctgcgcgccggcggcggtggccagggcaagcatggtcacaaaggatgcgcccgactgtgtcgccgctgcggcggcgtagtctcctctcccaaaacgtagggtataacagcctctctgggcaaataccacgtgagctgcagaatcttcgcaaccttaggtacatagatttgctagtgaattatttgactggaccactacccaatgatctgttcaacaacacccctaagctaaaatatctaaacttccggaataacagtttgtcagggacaataccagttggtatcggcactttgcccatccttcaacacttggaaatagcatataaccacttttctggaccagtacctgagttaattttcaacatgtccaaactagaaatgttgcatctcggaggcaacgggtacctagatggatctatccctggtaacaagagcttcaacctccccatgctgcaaaagatctgcttgtatgaaaacagattcatgggacagattccgttggggcttgcagactgcaaatacctccaatggattttcattggacataatttattcgagggcccagttccagcatggttgggaaaactgccagacctcgtattacttgatttagagagtaataaccttgttggtccgatcccatctgcattgggtaatcttagtaatcttgacacccttggccttcaatcctgcaatttaacaggacagattccacaagaacttgcacagctcaggaaaatcaaagggctattcctcgaccataatcattttacaggatccatccctaccttttttgccaacttttcggaactagctgtattcttaattggtgctaatagttttaccggagcagtaccaactgcaatcggtagcacaggatcagttgaatggttcaatattggagacaactacctacaagggagcctcgacttcttggctacactttcaaactgtcaaaatatctgggaagttggcttcgacttgaattatttcacaggggagctccctaactatgtcggaaacttctcaagtactctaataaatttctttgcagtaggaaacaggttatccggtgatcttccttctaccctgttgaatttaagcaatctcgtttggttggacctttcaaacaaccaactgactggtactattccagaatcaatcatgctaatggacaagctccaagttcttaatctctctggaaatatcatgtctggcacaatcccaagacaaataggtcatctaaggaacctacaaacactaatactcaataacaacaacttctcaggtgtgctaccaaacgatcttggaaacctcagtaatctacaatatcttgttctatctaaaaatcatatgtcatcaaccataccagcaagcctattccatatgaatagcttgataaccgttgatctgtctcagaactccttggaaggtgcattgccagtagatatagggcagctaaatcatattgacaggattgatctctcttccaaccggttgtttggtaggatccctgaatcctttggacagtttctaatgacaacatacctgaacctgtcacacaactcactaaatggttcatttccaaactcttttgacaagttgatcaacttgaaatcactggatgtttcatacaatgatctgtcggggacaattccacaatatttagcaaattttactgatctctctagcttgaacctttcattcaataacctacatggtccaataccagaaggtggcatctttgcaaacatcaccctgcaatctttgatgggcaaccccgccctttgtggtggtgttccacgtttggggtttatgccatgtaagagcaacaataatagtaataaaaggcaaatactaaaattcttgctccccagtgttattattgttgtcggagttatagccacatgcatgtacatgatgatgaggaagaaagccaagcaacaagatagaatcatttctcctgatatggaagatgtgctcaacaataggttgatctcttaccatgacattgtccgagccacggataattttagtgagactaaattgttgggggctggaagctttggaaaagttttcaagggccaactgaacgacggtactatggtggcaataaaagttctcaacatggagctggaacaagctattagaagcttcgattcagagtgtcatgccctgcgcatggcccggcatcgcaacttgattaggatactcaccacttgttccaacctggacttctttttttcgccgggaaggccgaaggaggccaaccgagtatattaagaaggaataaaagttacaagagaaaaaacaacaaaatgcaccaaggtgcattgcaacacaccacgcgctaccacccaagcacaaaccgctgagggtgaaacctagcaccaaacgacccccgctgagcgtggccgaacgccgctaggcctacagcaacaccacagagacgaggctccgaaaacgatgccaccatggtggtcacgacatccaagatgccgccatcgcccataaaaaaagatgtggttttcacccagagaagctcgccaagaaagggagagggtaaccctcgacaacgctccaaggagattacgacgcccgaagacgtagccgctgacggcccggtgaaccaccggactaggctttcgcctgggtccctacaaccttgactgcagatcgccatccaccaactcagaaccaccacacagacaaatggcagcacgtggcatccaccacaccgcaccgacgcccctccgtcggtcgacttcaacgaaccaccacccctgaaagctggcctaggactcctccgttccaccacccgccggccgcctcgccagatttggccgaaggagaacccgggactaggtggcattgcttcggcagcctgagcttcccccattgatgagctgccgcctcaatccaacctagaaactccccgcaaagaaggggaggagctccacgaaggccgagggtgccgaccggcaacgaggaagacggcccatcgccgccagctccctttgcactgccatctggccgccggtggtgctgctgctccggaccggcgccacccgccggcgcccctgaagtccggccgctgcgcctcacctagccaccgcgacggcatcccggctgcccggccaccacgccgagccaccaccgaggcctggacgacccaccgcgccatgggctggcgctgggtggccagggcgagcgagtgagcaggggcaccgctgccgctctgggcaggcttagctgcccgccgcctccgcgcggccaccgcctctgcgacccagccggccacgacgagccgcggccatccgctgcccgcgcccgccgctgacgagccgcctccacgccttgccgcagccgtccgccacctccgcgccagtgccgggccggcctagccgcagccggccgccgcctcgccgccttgcagccagccgccaccatgaccgcatgccgtcgcgccgccccaggcctcctcgcgccgccgccacgcagatccaggcgagggagggccggatccggccatgggggctccggatccgccgcttctccacacctcgccgccgtagccgctatggaccacgccggtggggagcttcgtcgtcttcgtccttcgcgccgaggagggagacgctacgaagagaagaaggcctcgccgctgccttccctgcccgctgccggcttcgccgccggcgggctccagcggcggcgaggtggggggagggagggagagaaagc

SEQ ID NO: 71944 - DNA, 67216 bp, Oryza sativa
tgcaattcggagtccaggaccagtctgcactaaaacatgcgcccaggtcgcatacgtgctcggattggggcgttctttatatggatggaaagctaagaagatatcatttccaatggttttggtcccacgtccaaattatttccgagtcaatgggaattgaccgaacaatttgatggccagaatctgtcccggtattacgtcaccgtatttgggcctttggcccgtgtatcgtgttggaacccattagggttgcgtcgagaggggtttgtacgaccctaaactctatttatcagtacccgcagacatctttagctttttgggttttgcttagattaatctgtcgagaacagtttggccgctagatcggtttgtaagaccccaactcgtgagcttaatcattcatctgcaattttggttgtttttctatctcgttcttgttattgttcttcgattggcaaacaaggattggccttctcagcgaggtcatccgcgttttgacacaggtgataaccagaggagacgtagtgctgcgattgcggggctcaagagcgtgcgcgttcaagaagcaagatcgatttgtgtcgcgactccgcccaaatcgttgtttatcagaacctttcgggagatcgggaaccctagtgcacatgtaaattcccctgtataaccaaaaccctagtggtaagaacctttaatgggggctataaatagtcccatagggggatccaagtaaaaatttctcaaattaatacactatagagtaaccacgtctttcgacgtatgcggttgtcgtttcgacaacagctggcgccgaccgtggggacctccgagcgaaaccactgacagcgaatgccaccgaagaaggtcgtgaaggaaaaggttacgaggcgaaaggaaagcgacgccggggcggacatggccgccgaagagggagcagagccttcggtgcccgttgccgaagatggaggagcgccatctgcttccgcacctgtgctatcactaccgccttcggcccctaccacctctgtgcaggtgccgaacgcggccgacatgacgaaggctgctgcggcggcaagggcactccagaccagggcggagatcctttcgacaagccaattgttggtgccacaagacgctccatcgcagccggcagcggccccaaccgcactcgccgccgtgcaggccgtcaaccatgaccccgaaacacaaaccgaagccgacatggaagccatgcgacagaacatgacacgtctccaggacatgcttcgccagatgcaagagtaacagtaagcatacgaggcggcgaggcggaccaagatcacttcggccccaatcctccagtattcggtaggctatgttccacctcaggtttatccacaagtgacgacccagccccttccgccacaagtcgcgcaggcgccaatgtacttcgtcgggcagccgtcgactgcagcagcgcatccggcccctcacgtgcaactgcaacctcaaccggtcgctgcccaagtacaccctcaaccacttggccaagtgccgcaagcaatggcagaaggggcttcggccctgcaggcgcagttccaagctccttcagcagctcaaccaaccccacatttcaagtacaaccccatcggctcgcccggaggggaatacaagtcaaggtgcgcccagttgtttgccatcaaatcagccaagaatgggggcttcgctgtagagtcaaggaccgcagttcgactttatcaatgctgctcaggcgccaaccgtttggccgcaagcaccaacgccaggcttcggagcaagccacgcaccaacccaggtcgccatgacatggtcgcagccaatttttgacccatccatggcggctcagcaagcgtaaccaattggagctaggcagccgaatgccatggcccaacctcacgcgcaagccgtgatttcgcccttcgccacgccgtacccacagcaaggtgtcgtgaaaagggcggggggcaaaaaggggctaccgctgagtgggggaatcaagacccgtccaatcccaccccaattcaagttcccacccgtcccacgctactcaggagaaaactaacccaaaagaattcctctccatttacgagtccgcgatcgaagcggctcatggcgacgaaaataccaaggcaaaggtaatacatctcgctctggacggcatcgcctgctcgtggtatttcaatttgctagcctatagcatttactcatgggagcaattgtgcaatgtctttgtccttaactttcgaggtacctatgaagagccgaaaacgcagcagcacctacttggtattcgccagaggccgggggagtcaataagggagtacatgcgtcgcttctcgcaggcccgatgccaagttcaagacataaccgaggcgtctgtcataaacgctgcttcggctggcctgctcgagggcgaactcacaagaaaaatcgccaacaaggagccacagacgcttgagcacctacttcgcttcattgacaggttcgcaaggggcgaggacgattccaagcgacggcaagctattcaagctgagtacgatatggcttccgtcgccgctgctcaagcccaagcacaaagtttaagttgccgaaccacctcccctcgctgttcgccaaccccagccggcaatccaaggacaaccgccaaggcaaggtcaagcccccatgacctggaggaagttcagaaccgaccgtgcgggcaaggatgtgatggctgtcgaagaagtgcacgccctccgcaaggagttcgacgctcagcaagcaagcaaccatctactgcccgtccgcaagaaggtctgaaaagacctctactgcgccttccacagacgctcttcgcacaccacggagcaatgccgaaacattcggcaacgtggtaacgcacaagattcaaggtcacagcagggagcagcggtcgaagcacctcgcgaggtagctcaagaacaagcacccccggccgaacagcgccaagatgcacagcgcagaataatccaagtgattacaagggctgacccgctaacccaactgttgaagcgacaaaagaagatgcagctacgaacgatccacaacatcacttcggcaggcgaaggggctccgcagtatctgaaccaccaaatctcttttgggcctgaatatgccgaaggagtaatgttcccgcaccaagatggggttgactacccaagcccttaccccagcaccagcatcacttcgaggcttcggcggagaagcagttcaagttcttggccaagcacagttgatgatagccttcggcacaggggaaaacagatgcaaagagcaagtattgttcgacgttgtcgacatcccgtacaactacaatgccatcttcggccgtgcaaccctgaacaagttcgaagccatttcccaccacaattatctcaagctcaagatgcccggcccaacaggagtgatcgtggttaaggggcttcagccttcggctgcctcaaaaggtgatctgaccataatcaacagagcagtgcacaatgttgaggccgaaccgcatgaccgggcgaagcacgtgccaaagcccgcccctcacggcaagatagccaagatacaaatcgatgatgccgaccccacaaagctcgtatcgctggggcgacatgggcgaagaagaagccaagaaaatcctagaggtactcaagaagaacattgatatcttcgcctggagccccgatgaagtgggaggtgtttcaacaaaatctcatcatgcatcacatagtagtcaagccggatgccaagccaaggaaatagaagctgcgcaagatgtccgctgatcgccaagaggcagcaaaagccgaagttcaaaaattactcaaagctggggtcattcaagagatcgaccacccagaatggctggcgaatccagtgctggtgcggaagccaaatggcaaatggcgcatgtgtgtcgatttcacagacttaaacaaggcatgtccgaaggacgatttccccttgccacgaatagaccagctagtggattcgacggctggctgtgaactcttgagttttctagatgcatattccggctatcaccagatccacatgaacccggccgacatccccaaaacagccttcatcactccatttggcaccttttgtcaccttaggatgcctttcggcttgagtaatgccggagcaaccttcgccaagttggtgtacaaggtcctttgcaagcagttggggcgaaatgtggaagcttatattgacgacaccgtcttaaaaagccgcaaggctttcgaccacgcgtccgaccatcaggaaaccttcgacaacctgcgcgcagcgggcatgaaactgaatcctgagaagtgcattttcggcgttcgtgcaggcaagttgttgggtttccttgtttctgaaagaggcatcgaggcgaatcccgagaaaatcgatgccattcagcaaatgaagcctccgtcgagcgtacgtgaagtacaaaagctcgcaggccgaattgtggcactcagtcgattcctctcaaaggtagccgaaagaggtttgcccttcttcaaaaccctccggagcacgggaaaattcaattggacacccgaatgccaagcagcgttcgacgagttaaagcaatacctgtaaagcccgccagctttgatcagcctagcaccaggaagcgaactgctattatacctagcagcttcgatagtggcagtcagtgctgccctcgtccaagaaacagattcaggccagaaaccggtctatttcgtctccgaagcattgcaaggagcgaagacaaggtacattgaaatagaaaagctcgtctacgccctggtgatggcttcgcgcaaactcaagcattactttcaggcccacaaagttatagtgccatcgcagtaccctttgggagaaatactccgaggcaaggaagtcactggccggctcagcaagtgggcggcagagctatcccctttcgacttgtattttgtcgcccgcactgctgtcaagtctcaggtgctggttgacttcgtagccgagtggacaccagcattcgcccccaaacccgagccggtcgaatagccttgggtgatgtactccgacggttcgtggtcgcacaggggggcaggcattgcagtagtactcacttcgccgaatggtgtgccgattcggtatgctgcaaggctacagttcgaaactaccaacaacgcaacagaatacgaagctattcttccgggcctaagaaaggcaaaagcactggggttcggcccttactaatccgaaccgactccaaactgttgcaggacatgttgacaaatcctttgaggcaaaagaagaaggaatgaagaggtatttggaggccgttcggtctatggaaaaaatgcttcaccggcataacggtcgaacatttgcctagaggccagaacaaggaagcagacgccttggcgaaatctgctgcttgtggcggcccacattctcctggcatcttttttgaagtcctgtatgcaccaagtgtgcccacggacatcttggaggtcacgacaatcgaccaagtgaaactgggcgaagacccatacaactggcgtaccccatttgtgaaacaccttgaaaccggatggcttccggaagacgaagcagaagcaaaatgcttgcagcacagagctacaaagtacaagatggtctcgggccagctctatcactccggggtacttcaacccttgcttcgctgcatctctttcgccgaaggcgaggaaatggcgaaggagatacaccaggggctatgtggcgcgcaccaagttgcaagaacagttgcctccaaagtgtttagacaaggagtttactggcccactgtgttgaaagtctgcgttgagcaaatcaagaaatgcgaaagttgccagcgtcatggccgaagccaaaccgcgcccaagtatgagttgcagcccattgcaccaatctggcctttcgccagatggggactggacatcattggaccgttcccggtggcgcgaaacgggtacatgttcgcaattgtggcggccgtcgaatacttctctcgatggattgaggccgagcccctcggagcgatcacttcgacagcagtacaaaagttcgtatggaaaaacattgtttgccgtttcggagtgccaaaagagttcatcacttacaacggcaagcagttcgactctgacaagttcagggaaatgtgcgaagggcttaacctggaaatcaggttcgcatcggtcgcacacccacaatcaaacggggcggccgaacgcacaaacggcaaaatcctagaagcactaaagaaaaggctcgagggggcagcgaagggcaaatggccagaggaaatgctgtctgttctctgggcccttcgaacgacccgtacaagaccaaccaagttcagcccgttcatgctactttttggcgatgaagcaatgaccccaacaaagctaggggctaactcaccaagggtgacgttctccggggacgaaggggggcgtgaggtgtcgctcgaactcttggaaggggtaagagtcgaagcactcgaacacatgcgcaagtatgacacaggcacttcggcaacttacaacaaaaaagttcgaccgacagagctgttgcctggccgatcgttgtaggcaagcttgaatcaaattgggaaggaccataccttatcaagcacaagtccaggacaggatcttttcgattggcgacactagaaggtgacgagttcaaccattcctggaatgctgcctctctcaagcgcttctatgtctagaacgggtggcacccaaatcgccaacttgtaaaaatgtacatattgtcatattagcccctcggcactacgtaacccccttggcactatgtaagcctttcggcaagaaaaaaaaagaaaaaaagaggaaaatgagaaaagacaaaaaaaaactggatgtagggctattatccactacggaggcccgaaccagtataaaacctctgtgtcctccgccttctttttatttttgtgtgattgacagtttgtcgaaaaaccccaaggcaaacgcctgatcagcgaaaaaggccagtgggcgaaacgaatcggccgaagcatcgctcgccgaacgttgaaaccgtaacagcttgtttcgggaaacaactaaccgaacaccgttacactccatcaaaaggaaagcacaaaaagctccttacaacgtggagcgaaactgatcgaaaacggaagccgaaagctgaaaagtcaaaacccatttcgctaatatatgcaaaggggccgacacattccgacccaacgaaaagcacacgaagtgacaatgcaaaaatagcgaaaagaaaataaaaaacacctttattgatttcaagtaaaaatcaaagtatacaaacctatcacaatggtacaagtgaaaaagaaaagggcaatggtgtcacggcccagctcacagataaattacatcttcgcccccgcaacctctctctctctctctctaaggagtggttagacgaactaggttcgtcatcactactaatatcatacgcaaccctaagatgagtagggggcgaaacacagactagactgtaacgacgctgggagatcgcctcctgctgatcagtcttctgatgatttcgccaaaagcgagccatatcctccaaacgtcttgagcgaacaaaatcgtagtcttctaaggttcgcccggggtgcgcccgcagccagccggcaaccttaaaaacattatagctgcgaccgtttatcaccatctcacggtaaacaggccgaaatgggcatcgcaccttcggcagacccttcaatgccacaaatttctcgtttgactccaccaactcccagaagggggccgaatgcacaactttcggcgaacaccctggtagacagtgcaaaaagagcaaaacacaatttacatagtaagaataggcgaaaaaagggaaagtattgtataatgcgaaacaggcgaaatcataatacgccaaagacttcaaccaccaaaaagtggctaaggttgagttgtacattccaaatatccaaggggcccttttttggctacaataagggggattagcggcagcctgccgaatatacatcgttcgcctctccaggcaaacacaaaaagaaggaaaactacaaaaatctaaggaaagggcggagggcctcacacctctgggtgatcctgggcatcgcctccaccctctttgtctgccgcgtcctcttcctcgcaccggactgccgcccccgccttcgccagttgctccaaaaggcgtgccttggcagtggaccggccttccttctgccagaaatgttttcgccatgcacgaaacgcgggtgaaatgttctgcgcactaatctcccagtcccctttcgcatagttagggaactcagcgacgtgctcacagccgaactgttgcaaaaggcccatagtgaaggccgccgatacgcgcgagcagcaatcgccgtacgtagtggcgcagtccgaaaccgaaccaccaacctgctaggtccactcggagaagtctaaagctgaggcatcttcagcagggacccctcacaccttcgcacccatgtcagtaagggcgaggcgcagcgtttggcacgccgttttcccggactcggttgtttttgccatctctcgagaaaaccgctgcgactcctccacagcgcttgcttcagccttgctgaccttcaggcgaagagcctccatcttcggctcagtgaggttataatagtcggtcagcgcagcggaatgggccttttctttctccagttcagccttgaggcgatcgacctcggccctagcctcgtttcctttctcaaactcggattggaggcgcctgttttcggttttcgcctctttgagggtgttggcgagggcctccatctccaagttcttgcggcctatttcgtcatccttggcccgaagacggttcttaaatccgtcaagacgggcgcgcacgattcgttctgtcgaacagtgagccgcaagaatctggatgcaagataggagcaggcgaagagaacaaaatgtcaattatgagacatgtaaaaaaaagaggagtggaaaatcaagaagagagaagaagcatacccgaaccgccaagcttttaatagcggaacacccctcatcaaactcattcagttcggtgaataggcttagggtgctggcaggcaagacaagattgcttactccctcgacaaagggaataagtcgcccgggtctcgaaatcgccaggggcgaagtggggcgccgcaagggaatattccgaggcggatgtttcggcggccgcacccttccccttcgttttgaccagaggcgaaacaaccggttgacgcgaagggctgccgaagaccctcgtcgcagccgtcacgatccattctgcggaagctgaaacctcggcagcggcgctaccgcctgccccatcggcaccgagtgaaagaatgggggcggtcgaaaggtccaggctgcggccagcgggcgaagtcggagtctcgtcagaagactcgtcgtcgctgaaaacgcgagcgacatcgacgagtcctctccttttggagatcttcttgaccggacctcccttcgccgccttgcctgacgaaaacgcaactagcgtcttcgccccctccaaatcctttcgtcgaaggggggagctgttcgactccaccccggtctcgttgtgacctggacttggagtaggagtgtagccaggggtgtcgacacggtcttcggccgcctcgttcgtgaccttttcggcaacggcctccgcttcttcttcttcctctccttcctcctcgccgtcaggctcttcgacatcgtcctcatcgtcggcgtcagaatcggaggaagcaggaacccttcgcttcctgggggcaagcttcacttgtccgcgtgttcactttcgcgaaggtcctgtatcgtcgtcagctttgtgggggttcgcccggggaggcaattcgccgttgtaaacccggttcgcccggccggctgcttgtcgtgtcagcaactggctgtactcgacgaccgacacgtcgccgatcatcctacgggcttcggcttcaacttggtcaagtgtcaacactgcaaaagtaaagggtgtagccacattaagcgtcaaacaaagcaaaataacaaagcgcaggagtgcatagcgaaagagcagtcttactattcgttccctcagggagaaccaatttcggcaaaccatcacactcttcgccttgatcaactacgacttgccacgattgggagaggggaaagatgcgaagcatgaaaattcctccaccaagtcgcggcagctaaggcgggagcaaaccttacgtagcagagcaaaccgtgcctccatagcgtcgtccatggcgatcttgggtttccggttcgatgcaatcgccctggcgccggcacaggagggctttcgctgagtcggagccagcctcgaaggggatggtgtggtagaaccacctcgccatccaatatccatcccacttcgacatggcggcgttcaccggccagagatcggatcgctcggggcgaacattaaagttaatgctcccgaacactgtcttcttcgtccctgccagggtaatcaccgtcttcgagttcacggtggcagaaaatattgcaccgaaaagttcggcgctaggctcaaatccggaagtccgtgtcacgtcctaaatatcctaaatatataaactgtggtttaaatggaatttttagaaattattttaaaagcctacaagctaaactctaattttctaggaaaattttcaacataaaaatgagctacataaaattttattaaatactatgcttgttcctctattttctagatttttctgggaattatttgagcaagggaagtatttttaataattgaaacaacatttcacaaattgttttatttgaaaaagttcaaaaacctctcctttaggttattgggccgattttggcccaatactccctctttcccgcgcggccgagccggcccaagccggcccaaaccgtcgccgccgccccctcctctcgggagaccgacatgtgggccccacatgtcggatccatccctaacctccagccgccggctcaagccgcccgagccgcctccttctccctccaaatccgcctcaatccggcctccttgagtccgattgattgaggggttttgatcctctcgttctcctctatcttttcccccaagtttcggagcaaatcgttgaggattttatccgaatcgagttcgtttcgattttatccctaaaaccgagtttggatttttcccgagtcgattcctctcgtttggagtccgatctcttcaatccaaggctataaataggaccacctcgtcgtcctctttcgtttgccccctatcccgagctctctagtgccccgtagcgtcgccgcatcgagctccaagtcgccgccgtcgccggccatcttccggcgtcgtcgcgccgtcgattccgccgtcgccgccgccttttctcgtcgccgttaggtgcgccgtggtgaggagaacctcggccgcccgtcccccttcgccgccgaccaccggagctccgccgtcgccgttaacccgagccgccgccgccgtcttcctcgtcgccggccgtcgtcgttcgtcgtttgccgttgtggtgagtaccatcgggttcgtctcgtcgtcctctacgcgtagatgtcctccaaatccccggccgaccgtcctatctccggcgagcttgctaaccctagccggccggccatggatgacgtcagcatgacgtcatcatctccttttttctttcttttttccaattttctaatagattaaaacttcggaaaatcataactaaataaccgtagatccgtttcaggtggttcaagttgctaaatttttctaaaatcaagatctacatgttaaaaatatccacatgtactgtttatgcttgtttttgtactgttttgttgatttttgtttaattgctttagtttccgacgttccggaggagagcgtttccgttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccagttaatttatggctgaagatgactttattttcctatgggttataattggattagcatgaaccttatatattggattggttcagctaaatgctatatgtaagtttgcttagccatgcttagaaacattagctaactaaagggattaattataaactatgttacattattattattaattatggttacattaaatggtagctcacgatggtaaatcgtgtgatgttaattaattgataattaaaacctggttaaggtgggttgtgagcatatggttttgatggttgtgctcatgacaattaagaccggttcgcgagctactgttgtgaaacatttatcgtgccaaccacaagccagcgtgggcaacggctttatcttttgtatagcgtgattctttatagtgcgccagactgagaagtggcgagaagtccacgggggtcgctggggagtccatgccttgtttataagggggtgattatgatccaggaaaggtgtgctgtaatgggttatgttgtgcaaggggtattgtcacaactcctttccgaggtaccgtggtggtattgaggcacatggtaacatgatgtggggttgtgtcttgtgggtacagtggtacacctctgatcagagtttaatctattcgaatagccgtacccgcggttatgggtgagttgagcaatgtttttcgtgattagtctcacactactcattagtggtaataatgtggtaattaatttgactcctggtttggaatggataattcctggtttggaggtttaatttgttcaaccggggttggttgttcaaatgtggttgggcctatgcaacatgggtgtgttgtatagtgtttatttaatattgattaattatacaactgttttactattctcttaaaatatttactaaatgctgtttctgcaaatgagctatattatgccatcctttgttatcctgtgcacttgcatttttgctgtgtgacttgttgagtatgtcatatgctcattcttgcaatattcattcatcagaagaggagtatctcagtgaaggtgatgatctggaggattaggcttgttcttggttaagatgcctgtggagtagagtcgccatagctgttccgtagtttgttttagttttaattttccactgcgtagaatgttatttttttgagaggaactatccacctctgtaatattttattatttgcgaatgttaaatagttatttattcgtactctattattaatttgtcattgtgtgcctcggttgattcctggacgagggtttaacacacatgtaagcgtttggaattttggatagaaattccgggcgtgacaagttggtatcagagccaccttgaccttaggataagccaaatggtaaaccttaagtagccttcaaaatatttttgaaaaaaaaatagaactgctcttctctattctcttataaattaaataagttggcagcacatgcaaggttatgcacaaaatttatttaaatcaatttcttttcttttaaaagcaaaaggttgttcttctcaaaatgtttctttttctctttaccaaatcttattgattagtcggcactgtacatctattatggtatcgatttaatcatgctggcaccagtactactcatcccctttaatggtgacattgtaccgtgcttatagtaggtcttaagtattctggttttattttattcacttgtccaaactgatttttctctgttcaaaagttaaattcaaaaagaaaaatatataaaatagttttgtatgtgtcttttcctttattttcttttcgtttattttcttcctttttggtcaaaatcaattaagtctagttggtgcagctaacttaaaaatatgcattaattcttctcttctatgtttctttagatgccgccccattcaccgagaaatttgatcaaggtgttaggattcgtcagggagctgaggttgatggcttttgaggtaggctatgaagttgctcctgagtatcgccggatttcccatgaccccgacgaggagaagtgtcgtgttcgtgtaacgttggctagtgatcgtgaagaccttccgtccattaagttcgaagctggaggaagatcgtacagccaggcttgtcaagaagcagctctggtggccattggagagttgcgtcaacgctttgaagaagagttggattcatcagctttccagtatcatcctcacaagcctcatggtcaagactatggaacctatacctgtcctgatggtgaagagagtgccactctgatgcatgcggtgcatatgcttagtgctatggatgcagtaagtgtggagcgagacaaagcagctcatgacagggaaaattggaatcgaggcaagatttgcaagttggagagcaaggtgtatcgtctacagaaggaattagctgaacttaaaggagaaacgccgcctccaacacccaagcttcacctcatcgcaagaaagagaacctgtccgccacctcgtctccagttagcttcgaagattcgcgtgatgggtgaagctgtgcccgatcgtgctgaacctgtcatcgacatcataagtgatgaggaagaagaggaagaccctgaagaaagagagccagctactccagaggaagaagatccatcgcttcgttccgacgcaaggcggaattagtcgcttagattagatcgttgccgtagttcgctgtgttagattgcttgtttaagtttgcttgtgagtgtgtgggtttttagttgttgcttacatcatgggtgggatgtaacagcatgagtctagttcttttgcttgtcagagtgtaagatagttggtgagatagtgttaatgcaacttaaatgtaatcatatacagtaaagagcaatatagaatttaaattaattaaataactccgctctaagggtgtctctctgtcgtttctttcctgttgtctctgcttatcgtcagatggtgaacacgcgcactggaactggaagtggaagtggaagtggaagtggagctactaacaatggaggagatcccacgctagctcagattctggcccaacaaacacaactgatcaatctgttagtgcagcaggcacagaatcagcaggcaaacaatcagaaccagaatccacccccacctccccaaaacaagctggcagatttcttacgtgtgagaccccctaccttttcaagcaccaccaatcccgtagaagcaggagattggctgcatgcggtggagaagaagttggacttgatccagtgtactgagcaggagaaagtttcttttgcttcgcatcaactgcatggacctgctgctgaatggtgggatcattttcgccaaggcagggctgaaggagagcctattacgtggcaggaattcacggccgctttcaagaagacgcacataccagcgggtgttgtagctctaaagaagagagaatttagagcactcaaccagggatctcgttcggtcaccgagtacctccatgatttcaaccgtttagctcgctatgctccagaagatgttcgttcagatgaagaacgtcaggagaagtttttagagggactgaatgatgagttgtcttatgctttgatgtctacggattttcgggatttccagcagttggtggacaaggcgattcgtcaggaagacaagtataaccggatggagcagaagaaacgcagggctgcccaattcaaggcacaacagggcagtaaccagaggccgcgtctcgttactggacctcaagctccatcgtaccctcaaggaggatcttcatcagttgtccgctcccaacgccagttctacaacaacaatactggtaatcgtggcaatgacaaccgcaacatggttgttcgtcctgcagcaactccagttcagaaccagcccgttaggaaggaacagggaagcaagccaggggtgtgcttcaattgtggtgatccaggacattatgctgataagtgtcctaagcctcggcgcgtgaagaacgttccagccccgaacaactccaatgctccagcaccaaaggcacgtgttaatcatgttgcagcagtagaagctcagaatgcaccagatgtggttttgggtacgtttcctgttaactctatacccgcaactgtgctttttgattccggtgctacacattcctttttgtctaaaagttttgcgagcaatcatgggatggaagttattagtcttgggagacctttactagttaataccccaggcaatcaagtgttttcgacacagtattgtccttccgttattataggaatagaagaagttcttttcccgtcctcccttatcttgctagaatccaaagatctagatgttatcttagggatggattggttatctcgtcacagaggagttatagattgtgccaaccgtaaggtgactttaaccagtagcaatggggaaacagtttctttctttgtgtcctctcctaaatctcatggggtgatcttaaaccaagttgctctacaagagatccccatagtacaagactacccagacgtgtttcccgaggatttgccaggtatgccacctaagagagacatagagtttcggatagacttggtacctggaaccaaccctatccataagagaccatacagaatggcagcaaatgagttagctgaggtgaagagacaggtggatgatttgcttcagaaaggatatatcagacccagtacttcgccatggggagcaccagtcatctttgtggagaagaaagatcatactcagagaatgtgtgtggattatcgagcgttgaatgaggttaccatcaagaataagtatcctctacccagaattgatgacctgtttgatcaactggaaggtgctacagttttctccaagatagatctccgttctggatatcatcaacttcgaatccatgaggaagatataccaaagaccgccttcacaactcggtatgatttattcgaatgtaccgttatgtcatttggactcactaatgccccagcctttttcatgaatctgatgaacaaggtgtttatggaatatctggataagtttgtcgtggtgtttattgatgacattcttatttactccaagacgaaggaagaacatgaagagcatcttcgtctagctttagagaaactacgtgagcatcaggtttatgccaagttcagtaaatgtgaattttggttgtccgaagtgaagtttcttggtcatgtcatctcgtctggaggagtggcagtagatccaagcaatgtggagtcagtgttaagttggaagcaacccaagacggtttcagaaattcgtagtttccttggacttgcggggtattaccgcaggtttattgagaacttttcaaagatcgccagaccaatgactcgtctgcttcagaaggaagtgaagtacaagtggacggagggttgtgaacaaagtttccaagaactgaagaaaaggctagtgactgcgcctgtgttagttttgcctgattcgaggaaaggtttccaagtgtattgtgatgcgtcccgacacggtttgggttgtgtgttgatgcaagaaggaaaggtggttgcctatgcatctaggcaattacgtcctcatgagaataactacccaacgcatgacctagagttggcagctgtggtgcatgcattgaagatttggcgtcattatcttttcggtaaccgtacagagatatatacggatcataaaagtttgaagtacattttcactcaacctgatttgaacatgcgtcagcgaagatggttagagttgattaaagactatgatatggaaatccactatcacccggggaaagcaaatgttgtagccgatgctcttagcaggaaaagctactgtaatatgtcagaaggtcgacgtttaccttgggagttatgccaagaatttgaaaagatgaacttgggaatagtcagcaaaggttttgtggctactttggaagctcaacctactctgtttgatcaagttagagaagctcaagtgaatgatcctgatatccaagaaataaagaacatcagaagccagccggtctgttacaaccattgaagattccagagtggaagtgggaagaaataggaatggattttataaccggtctacccagaacgtcggcaggacatgattctatttgggtagtggttgataggttgacaaaagtcgctcacttcataccggtcaaaacaacctatacagggaataagcttgcagagttatacatggccagagtggtatgtttgcatggcgttcctaagaagatagtgtcagatagaggtagccagtttacttcgaagttttggcagaaattacaagtagagatgggtaaccgtttgaatttcagtaccgcttatcaccctcaaacagatggacagacggaaagagtaaaccaaattttagaagatatgttgagagcttgtgttctagattttggtggaagttgggataagaatttgccgtacgcggaattctcatataacaacagttatcaagctagtttgcaaatggctccgtatgaagcattatatggccgaaagtgccgtacgccgctcctttgggatcaaaccggtgaacgtcaagtttttgggacagacatattgcgagaggcagaagaaaaagtaaagattatccaagaaaggttgcgcgttgctcagtcgcgtcagaagagctatgccgacaatcgtcgcagagatttggctttcgaagaaggagattatgtataccttcgggttacgccgttacgaggtgttcatcgtttccaaaccaaagggaaattggcaccgcgttttgtgggaccttttaagatcgtgagtcgaagaggtgaagtagcttatcagttagagttgcctccgtcaatggcgggaatacatgacgtgttccatgtgtctcagttgaagaaatgtttacgtgtacctacggaggaagcagatcctgatcgtatagagcttcaagaagatttaacttatgttgagaagccagtcagaattttggaagtaagtgagaggaataccaggaatcgcgttatacggttttgcaaggttcagtggagcaatcattcagaagaagaagccacttgggagcgagaagatgaattgaagtcagctcatccttatatgttcaccagttcttctgaatctcgaggacgagattccgtttaacgggggtaggtttgtcacgtcctaaaaatcctaaatatataaactgtggtttaaatggaatttttagaaattattttaaaagcctacaagctaaactctaattttctaggaaaattttcaacataaaaatgagctacataaaattttattaaatactatgcttgttcctctattttctagatttttctgggaattatttgagcaagggaagtatttttaataattgaaacaacatttcacaaattgttttatttgaaaaagttcaaaaacctctcctttaggttattgggccgattttggcccaatactccctctttcccgcacggccgagccggcccaagccggcccaaaccgtcgccgccgccccctcctctcgggagaccgacatgtgggccccacatgtcggatccatccctaacctccagccgccggctcaagccgcccgagccgcctccttctccctccaaatccgcctcaatccggcctccttgagtccgattgattgaggggttttgatcctctcgttctcctctatcttttcccccaagtttcggagcaaatcgttgaggattttatccgaatcgagttcgtttcgattttatccctaaaaccgagtttggatttttcccgagtcgattcctctcgtttggagtccgatctcttcaatccaaggctataaataggaccacctcgtcgtcctctttcgtttgccccctatcccgagctctctagtgccccgtagcgtcgccgcatcgagctccaagtcgccgccgtcgccggccatcttccggcgtcgtcgcgccgtcgattccgccgtcgccgccgccttttctcgtcgccgttaggtgcgccgtggtgaggagaacctcggccgcccgtcccccttcgccgccgaccaccggagctccgccgtcgccgttaacccgagccgccgccgccgtcttcctcgtcgccggccgtcgtcgttcgtcgtttgccgttgtggtgagtaccatcgggttcgtctcgtcgtcctctacgcgtagatgtcctccaaatccccggccgaccgtcctatctccggcgagcttgctaaccctagccggccggccatggatgacgtcagcatgacgtcatcatctccttttttctttcttttttccaattttctaatagattaaaacttcggaaaatcataactaaataaccgtagatccgtttcaggtggttcaagttgctaaatttttctaaaatcaagatctacatgttaaaaatatccacatgtactgtttatgcttgtttttgtactgttttgttgatttttgtttaattgctttagtttccgacgttccggaggagagcgtttccgttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccagttaatttatggctgaagatgactttattttcctatgggttataattggattagcatgaaccttatatattggattggttcagctaaatgctatatgtaagtttgcttagccatgcttagaaacattagctaactaaagggattaattataaactatgttacattattattattaattatggttacattaaatggtagctcacgatggtaaatcgtgtgatgttaattaattgataattaaaacctggttaaggtgggttgtgagcatatggttttgatggttgtgctcatgacaattaagaccggttcgcgagctactgttgtgaaacatttatcgtgccaaccacaagccagcgtgggcaacggctttatcttttgtatagcgtgattcgttatagtgcgccagactgagaagtggcgagaagtccacgggggtcgctggggagtccatgccttgtttataagggggtgattatgatccaggaaaggtgtgctgtaatgggttatgttgtgcaaggggtattgtcacaactcctttccgaggtaccgtggtggtattgaggcacatggtaacatgatgtggggttgtgtcttgtgggtacagtggtacacctctgatcagagtttaatctattcgaatagccgtacccgcggttatgggtgagttgagcaatgtttttcgtgattagtctcacactactcattagtggtaataatgtggtaattaatttgactcctggtttggaatggataattcctagtttggaggtttaatttgttcaaccggggttggttgttcaaatgtggttgggcctatgcaacatgggtgtgttgtatagtgtttatttaatattgattaattatacaactgttttactattctcttaaaatatttactaaatgttgtttctgcaaatgagctatattatgccatcctttgttatcctgtgcacttgcatttttgctgtgtgacttgttgagtatgtcatatgctcattcttgcaatattcattcatcagaagaggagtatctcagtgaaggtgatgatctggaggattaggcttgttcttggttaagatgcctgtggagtggagtcgccatagctgttccgtagtttgttttagttttaattttccgctgcgtagaatgttatttttttgagaggaactatccacctctgtaatattttattatttgcgaatgttaaatagttatttattcgtactctattattaatttgtcattgtgtgcctcggttgattcctggacgagggtttaacacacatgtaagcgtttggaattttggatagaaattccgggcgtgacagtccggcacgcccagttgaagatagcgatccggaccagcgccgatgggctcaattgtgggagctccacctagaaaaggcgaaggatctccggcaacaacgcgctgcacggaaaccggagccccgcctcaaaaaacacggcgaacaccaccgttcggttgtcgacgggcttcggtacaacggctttccccggggcgaaagcctgtccttcgactagcgccccagagctgaccaacttcgccaattcaccgtcgtctatgagagagatccccaaataagcggtggagtcgtcgttgatccgttcaagatcgggccctttcgccgaagaggggttaggcttgcggggagccatgacgaagggtgtatacagtggcgaacagtgtgtgcagtggcgaacaaagggagcgaacgaaaggactgaagagccgaggagcgccgagagaagaacggaggaagagcgcgtgcgcagtgaaagtgactagtctggcagtaaaaagagaatgggagggggaatatataactcacctgagcgacggttcgcctacccaccagtaataaagcgccacgtgtcgcgagggtaggcgaaacggtaaattaccatcgaccgagctacacagtaaaaagcccgcaaagggaaggcccattactgttcctttctgcccaggaaaaataaaaaatatatatgccaccctccgaaggaggcgaagagcagcaaaataatatcagccgcacagataacaaactttatttgtaggaacaatgtaggtttcggcaggagcatcggtcgaaagggggcgccacataccataccacatggtttgcacggtctcggccgaagctccgatctcacccttgcccgtgaggggcttgttggcagtgtggcatgaagcccttcgaccaaatctaccaaaaccatgcgaacagtggagattcgagcccgagacatcgacgttagacagggcgaagttcccccatggcgaagactatggaacaggaacggcgaggggcgagagatcgtgcgagtaccttgtcaagccagaggcctcttgggcgaagggtgcaaggcgaagagtatataccggaggaagatgacttcgccacagcaagttcgcccccgcgagtgccgaagaagcctttccgacccatcaagcccagggaccgtaaggccggcgatcgcccgacggcccaccaggggccatgagtccctattacattatgcacccatgtaaatgtcccttttataagggcaaccatgtaaattcccctgtataaccaaaaccctagtggtaagaacctgtaatgggggctataaatagtcccatagggggatccaagtaaaaatttctcaaattaatacactttattttccaaccactgttgagtaaccacgtctttcgacgtatgcggttgttgtttcgacaacacaagtgtagactaaaatgactatatactagaaaaacataaatgattcttttcttattctttctccacttagtttagattattattttaatgagagtagtttggttagtttcttctgtgtgtcagcctaccctatattcgaattgattaacccctgtattagactttgatctatacaagtgatataaattattagcatagtactcgcttatcatatcttcccttgagattaaataaatacgatactttgaaatacttccgggtgaaatgctacagtgatatatccgtgtgcttgcggattatatatgtaatcgttaagacataccaacaattataatattccattgaattaaagatccattggagagagatttggtctatgagagctattttataaaaaagaaatgtagtttgatacattaaaatgaagacacaatgggtaaagcgagtgtagcacaactagttatttttcttgtggtggaaccagtccacccgggtaagtactagatttgacgttggcgctcgtatttacggctaattattcttttactaataggcgatgaacccatcaacaacaaggtgctcgtggtgacttcgtctatctcaagatatgtcggtacagtcttccagaagtgatcataggcatagggtgtgctgtgtgcgttcataggtgagtgtaagcgcgttgtaagtgcctgagtttgtaatgtgtttcttaaaaaaaaatgaagacacaatggagtttgcgctcggcgctcctactctgactcaggctcccaatttcaaatcttcccactgcaagctgttgaagttcacctcagaggagggtagttcggcattcttcctatggagaagcgactgctctttcctcagttcctcacagcttggcatcatcgtcgcacaagactcctcgcggcgaggaaaggcgaacagatcttggctgaagagcaaaggcgaccggatcaggaacaccgacgtcgccttctccatcacacattggccttcctcttccccatctctgccttgccagccgtggagaaggatcaggggagggaggagagatgccgatggcggcgacgaccaatggccccacggtgacgccatcgtcagcatggaggaggccggtgatggtgcaaggtagagggagacacggacgtcctagtcaaatgagtgccgatcgaagagggaggaggcggtgacgacccagggaacacagggaagtcgtaaagaacatgcacaaacttctctcgcttttccacttctgatttttttgtgctctttttcttcttttttcgtagggcgctctctctctctctctaaacacctttctgtatttcttttttttttcctagttttagtttttttttcttcaacataaactgaccaaggacccaaacaaaatattacaagctggacttcagaattaaaatataaaagttacacaagctcaaatataaaagtgcaaaccaaaaaattagtggattacaaaatagttttgctaaaatactgtcaccacatttttggcttgcttatagtcgatttctagatcatttgatctcctctaagattcgtgctgtggaaaattatgggatataaaccaaacaatgatgcaagacgttagcagctataaaaatatggtgacaaatttttaggtaaaaatacatcaaatgtaattagtagtacaaatttacacagctattacattgcacttacacaccacttacaaatataatatataattagtatgtaattttgggacttacatatgtaattgtaggatttacatatgtaattttgagacttatacattataaatacactaaaattatatatgtaattaaaggacttacaatgtaaatacatcccaactattttttggtgaaaaatatggtgccataaatataactccctagaatcgctatatttgtggcgacatatttcttccctcatcccagttagatttctaatcgttggattggctttgcggtttatgctgacctagaccggaacccatctcatcatgtcccttgtcacgttgacaggtaaattaaaatggggaggcccaaaatttttgaacaatagcatttctcaacttaaaataacagtacgtgaaactaaaatgatatatataattttaaaactcatattgtaaatatactaaaattacgtatgtaatttataaattacaatgtaaatatatgctaactattttttcatgaaaaatatgtcagcataaatataggtagtcacttacaaaaatgaaaatccctcgtcgcatatgttccttttttgcattcagaactcgattccaaaatcgaaatattttaggtcacggtatgagttggaaccggattcgggagtaagagtaaactcctgaacgtggaaagggggatcaattaacttgggtcttgacgtgagtgggattgtggactcggtctcatatggaaaccggcatgccaagatggatctgagaggttgacatgctttggaaacatcgcaccaaaacatctccagtaggttcaatctgttagttcttgccgaaccaaactgatccagtcgttttttcatatcctcttcaaattctactgaattcaaaatcagcctatcaattcaagctggctctaatcgctttggttttagtcacattctgaaacctaccatgcacgctcacacatgcatgtgctccagttacatcgtaattgtagttacatgacaaatatgtactccagttatattagttacatcgtaattatatacatttaatttgacaatttgaccttttcaaaaactaatttcgcaaatgaaccgcggccaaaacttagttcaaaagtaacccttttgttcagcgccaaatcttatggcgctgaaaagggttacttttgaaataagttttggtcgcggttcatttgtaaaattagttttcgaatgggtcaaattgtcaaattaaatgtaattatatatgcagatcctgtgtatgaatgaattgagtggataattgcacatgacatgatgcatgcataatgccaaaacttgggagactcgacctgataaagtctcgcaaactagtcccgattaaaaggcattatacatgacaacaaccgcccgaccagccgcatagtgttgtttctatttcaaatttatcatcatatatgtttattgtttaattatgcaccaaggccaatgatactttaaatcacatcaatcaaaacaccatgcgtatatttcccacgatacatgcatcgattaaaatatcatgacaattacatcattagcatgcacacgttctcctttgatatattaattatatttcgatgaaatccgtgtccatacggttatataaggatcaatttaagaaattttggattttattatattacgatcaatttggaaaaagggagtatcgatggaacagcacgcggatatacatgcaccaggacggatcaagaccttagctggatataaactgcgacaatgatagcgcaacaaccatccataattaagcggtcaactggacagataagagcaggtacaatagtaggctataagccagctataaacatattttaaagagataaaagaagagagagaaaagcagcgggctacagatcatgtagctagctgcagcacgggctccaagacgtaatgtatgtatgacaggtgggaccagttatttatagtatagcaagtaactattgtatgaattagctattacatttgttatagataatttgaagctggtagtgggctatactattaaacttgctccaacgaaaataaccaaggcgttctgagcaatttacttggcagcttgacctttggtttcttgggcgtgctggagttggagagcgcgcgcgtggtgataagcacaagtacacgataaatgagatccggaaaggaaattaacccaaacttccacctatgtggagattatgggtaccacatacccacatgacgattgacgagtatatccgactggttataggggataatttatacagatagaatatatttaggaaaagactcgggaattatgttaacttgtatatcaaggaaatatctcgtagtcttaattggttgcaattgtaatatatttgttagcctagttcgtaatgcatatgggctgcacattgtaatctcggctcatccccttatataaggaggggttggagtgctcctaggggcgtaacttttctcccggatcatcatatcaataatatactcggcaaaataattccccggacaggagtagagtattatatcttctaacacatccacttttttagcttgattgctatcccttttagtgttgccgaaattttgtttcgacaatctacatcataaattctctattcccggtgtagttccatccgtaggatgctttccatcattttcagtttcgcaaaatacagtctaaaaagaagagaaatttatttctagagctgtgctataaatttaataattagttcatcctctcaactaccaaccctataaattcccctccccaactcccgcgttcgccggtggctccggcccatgttcttttttttttttttagaattacacagtacaacgcagacactcacaacgcacgcgcactcacccctacaaacacacgcacgcaaaccctacccctatgagcatcttcgaagactgtgccggcaaatcctgtagagattgacgaagtcaccacaggcgactcgctgtcgacgggtacgtcgcctaccacaataaagcctactctagggaacggcaatgtatgtcctcggtagtcagtagctaggacggcatcaatgcagctcaatctcatgcagaaacattctagcagaaacattctagccgagtttagttccaaactttttcttcaaactttcaacttttccatcatattaaaactttcctacatacacaaacttttaacttttccgtcacatcgttccaatttcaaccaaactttcaattttgacgtgaactaaacacaccctctcatattcttttttgaagtagaagcacacgaactgctgtgaacatgatgctatgtttgaaacctcatattcttttccgcacacgaaaataagaaattccattagcatataattaattaaatatttacggttgtaaatttcaaaaataggtttatttgatttttaaaaggacttctatataaaatactttgcaaataatgtatcgtttaatagttaaagtgtgctagtgctaaacgagggagttgtaaaagataaatgagctttcaaatgcagccaattccgaatccacttaggtgtactccctctatttcatattgtagtgtgttttattgttgtttcaaaagcaaaataccttttcatcaagtttgtggaaaaatacatcaagataacgtcaagagtaaaaatacatggctggtggttgaagttgtattgtagtgtcacttatatccctatattgtaaaaatgcatatttagctccatgacctaacacagtaggtccaaacctcttttgaccatgtacaattgtcaacgtggtgttccatgctagcacatatttttgcaatcagccctctcagagggaggacaggttgcacaagagggcgagcaatgaacaccagcggtgaagccaatggaggaagatatacattggggtgaaacagatagaggtgtgcacaaaagaggaaccagtgcagtgatgaagacctcgagctctgccatcagcgaatcccatgacaccaaactacattgccgcttgatctagagggaaggagatcgaggggacaactaacatcgatgtggatccatggtgcctgaccgccggccctgccgacgagcttcaacagtgtgggatgaacatgaagtcgcctctgcatcgcacaagccgtcgacgggtccaccatgcctgagcaccagccacactagacatggtgctagcgaccatcggcgttgcctctgcgctgtcggacaggtggaggtgtgcactggtggctacatcaggaggggggaggagagaagggggcgatatacgtgaagaggaggaggttcacaccaccactacgctgccccacccatccctggcctccaagctctgcactagccaccctatgcatcggtggtgatggaacctccattaccttgctcatccgccgcacctgaccaccaccggcatcgctaagagtggacatggctggatccacacttgtgttcactgtctagcgtctactctcttgtgcaacccatcctattgttggggggaggggggtaaatgcaaaatgtgtgccagtggagcgccacatcagtagtgcagtcatacatggtcaaacgaggtttgggcctattgtgatacatcaaaccaaaattatgaatctaattatgtattttacacgatgtgggacctaggtgataccaccgtgtaactataagaaccgaccatgcatttcactccaacatcaaactagtttaattaaaatccaccataaaataagtcttgacagtgcatttatttagtattgtagatgtgaactatttttctataaattttctataaattgctagttgagattgtagtttgaactaagataaaaaaggagtaaattgcagtttgggtcatgtattttttacccttgttgcagcttggacaggatcttagtcatgattttcactttggactacataaccttgccatttgtttcactcttcaccacaccctcatcgtctccaagtcaggcagcccatcaccgttgcccctctctttgctgctattatcatctctcctaacatgttctcgttatgctatcaatgatcattagtatgctaatgaccaaattaaactaatcgtatcacctcacctagcatgctaattttagctatcaatacaagggaggacatggtagtgctcaaactcaagctcacgtatagtggcttcagctcaacgagctcaacgaggaagagaagagaagggagattgaggaaacactggtccaatctgaaacttgtgtgaagttgtctagtgcaaagtgcaaatattactttgcccctagtccaatgtgtaactctggtaataagaggtagcccaatgtgtaattcactcagaaaggagtaaatgagaagtagtaccctatgaattctgtgaatggtaggtagtactctataaattcttatatttgtggataaattttaatatctttacctggaacggacttgttgctgcttccatacagtcactagtttctgaaccgttgaataggcaaaagatttttaggacgacgattgctacagtgttagtgaaacaaacgttagttttaggagcatttttgcctcaagcatgtcgttgtagtatagtggtgagtattcccgcctgtcacgcgggtgacccgggttcgatccccggcaacggcgtttctttttcggcctttttaagtgtgttttcagcccatactgatttatggcccatgtatatacaatctaaaggtataattgcacttcaataagattacttgggtcccttaatttgttatcgagtctgagattcgtcggtacagctcatctcacaactcaaaataacatcttgaaccaaatataatataatggtcagttttggttgacacaagtgggacctactgagtctcggactcagtaacaaattgaggaacctaaagcgaacttataatattgcactttaacttactagtccaatctggtttgtatccatcaactgcaataccggatatcttgactcccaactattaggatatcttgactcccaactattaaaactggtgtaaaatgactctctcagtgaatataggcagcgtggtcggtaagcttctatcatcgatgcttcgccgttgccttctctccacttcccatgacatggcggtgggcgaggttgctgtgggcgacaagctccgagtctccttgaccctcttcttctcacaccttggcaacggccgaagaggctgcaggtagtgatctctatccatctcaaagtagggggtggtggcgagcagcgagtaacaacgaccggtgtaggcgatgacgagcgataaccataatcctacccaggcgatgagaggatagagtagagaagatgagtgattgaaatgtggtccccatacgttgacttagctagttggattgatcaacgaaccacgctaacgaaaatcacaccctcaaaactaacgagaaagtaattctacaccaattttaatagtttagattcatattatggttgagggatatatttgacctatacttgagggagttaaaatggacttatttctaatctaaacgaacaaatattgtgatccaacgcgattaagctaactaggggattgaaactaggccatgttacatatctattaccctaatacaacaaggcacaacatcgtcaattttgtgagcaactctaatggcttcggcttcgatgtattatgcatgtccggcttcggcttcaatatattgtgtatgtcttttttttttaacgcctacacggtagacatccaacatattcccaaaaaccaaacgcccctctagcacttctagcactctctctctctctctctctcaatgttgcatgcatgcacaccacttatttttttcaaactataaatgattttatctaataaattgtttatccaatctacggttaaatcattatatttgttacaattaaatgtttgcaataagatcccatgtggttatattttgacaaaaaaaaatcaaacgttgtttcaccgtttataaaagaattatttcatcatttgatcaaattagtttcaaagagctgcaccacagaaaatactgattacaactagtcccaactagtgaaacacaaaatatattcacaataataagtaattttgctaaaacatttttagacagtatgagacctattaaaacatagcatgcaccatttataaatgaaatagtgaaacattaagaaaatataacatctaaataaaactgtatatgtttaaaaaataatttggatacaattaagtaaaatcttgttgtaaagatttaattataacaaatacatcagtatgattatattgttaattggataagtaaaatagaagaaaaaaaaattgaagtttaaaaacgaagttgctcgttataagcatatacatcgtataggagcatctgaacacataggagcatccaagcaggcagcaggagatgagaaaaaaagaagggagaacgaaaaagaagggagtaaacatctacgggcatggagtggagacgcctgattttttttcttttctttttcatttattttacttgcctaacattttattctttccacggattcatcagtgctttagaggctgtttagatgggactatgtctaataaaaccaattccataaatatggactaatttgtgagacgaatttattgagcataattaatccatgattagcctatgtgatgctgaaataaacatgtactaattatgtattaattagggttaaaaaattatcacgctaattacctctcatttatgtaattagttttgtaagtactctatgtttaatactccaatttaatgtccaaacatccgatgtgatagagactaaagtttaatccgtgaatccaaaacaccaccttagttgggtattatgtgagtacgtttctaataagcactacgtatttgtaactattttagcattggagatgtgtactttcctttttcccagcgtcgacctagcaacgaaaatcatgcccacaaccagttgtattttacggggcaagcaaaactatgttccttttttttcaaaatataaccgttctatgcccttcttttccagcgaaatctgcggttaatagtcaagtcatggtccaaaacgcctttgagggacttttggtacaaatcaagctgcaaaatgtgtctagaacagatagtgccgtattacagaaatgaattgtccgatgacaaaacgcacagatgcaaaatacagtggatttgaaagagaaataactggtgtcgttcaagtttgcacattcaacaagaggtagaaaaggaaaatgaaaacgggcaatagagaactgaaatgccaaactagaatgcggaattttaatctagaaagatctacagatgttaaaatatatacactcagtttgagaacatacaagggagccgtaacaactatgagaaccaagtggagctcgggtgtgtgagagtacaatcagaaaagaaaaggatgtgcagcaaaagattatttactctatatcatcacctctttgctattggttataattggcctgagtattgtgttcccattgacaacctttgtggtcgcaacaaggaagtcatagcccatcccttcctgcgagtagatagaagtcacaaaaataaggaacttccatttttccctgatcaggagctctatttcattattcatgaggggcattaaacttccatagacaaccgaaaagaaaatcaagagccttattacgtcagatactacattgttcatcattagcagcttgattaccctccatatgtgcatactctaataaaagatcaattaacctaccgcgaagctcctgaatgacaatgaatgctgaaatatcttacgcacgatgccggtgtactaaataaagcataagcgagtagtaattcctccacataagggccgccgccagggtgtgggaagcaacctaacagacaatactcgtagccttgcagactggttcagttagtgagtaatttaggcttataaaaagccacaatgcgaatcaaggatatatttaacctataattactaattgttactatttgaaggagcgtaccaaaaagatattcccaggaacacaagtagaacagatgttaatgtgaatttcaaaatatcccaacttgacaatatcttggtgtcgaactgtcgatttgaggagaacatctaaaacacataaattattttggcaaaggatacctgagaactaaggaatcgaagagcagcaatctctgcaaaagtaaccccaccaataaagacaaccaaaaccagagaacgatgtccaaccctagaacaaacacacgttagaataaaaacagatgaagagaagaaacatgctacgaagtattaggaatttgacaagaacagtattttccatgtaaatgcaaaaacaaaaccaaaattcaacaatgtagtatctgacgttataaggctcatgaatttcttttcgattgtctatggaagttccaaaacaattgtgtactattctaacatgttaattcttaaggttctagaggtctaacagacctttgaggaccatgtatggagaacaatatggggatgacttgtagctaggagtgaaagtccaaccaagattagatatagctggttttcagcgaaatctattttagtggagcagatgatgtcaaattgatgatgacccaaggcgatagaagagctatggatcaatatagataacctccttattctgaatttctgatgggctctggagtacttgctggtaggcaacacagtatcaagtgatgaaataaagtcaagatgatccattaactactctagtctagagtttgaattgacaataacacaaacaatgaagcttagatctcagaccctgtttctggtttgctctcataagtttgtatcagatctctcataaatccctcatcaccactgagagcaaataatcttaaatagaagaaaccagcaagaaaatgattacacagatagcctgacattcagcataaattatacaaatacaaaagaaacatgaaggagatctcgtgcacaaagttaccatgcccatcagcatcaactggagccctaaacaggacactgaaggattgattttggctgtggctggcagtgagcactagataacacagagagaaagagtgggagcagcagcttttgtatgtgtaattatgcaggcagaacagaggatcagggaaggcagtagcaatgggcaagatagcacctaacaaacataataggctgtttcaaaaaaaataataataataataggccctattgggttaaaatttactaaatcaatcgctgggtagtcctcacaattgtacattcatgaggtctagggaaattgggaaacacaaatacttaactcacgtcacccaactcatctcaacatggcaagtagctgagctgcataaactagaaacttataactactaaacaacaaaagaatttcatgaatagaatacagaatttaaatctgaaaccaccttttttgtgtaaactttaaataaaccaacacaattctcttctaccacttctatcatttttggaaatcagaaaaacaattccatgtaactaaacgaaaatttacctgtcaatactctgttgaagccccaaaccttggtgtacatccaatgaagaattaatggccgaactaccctacagaaataaaagaaattctttttaaaaaaaattctacaaaagtaagcttttcataaagacaatatgcactcactcttttcaaatccagatgaggacctggcaatagtttcaacagttcttcaatagatcgcctgcatggcaacaagaaaaaaaaggtcactcaagcaaatcacttgcttaacacaactagacaacttacatactagttatgtgaggaagttcaaaagcaggctaatcaatatgcagcaatacattttgctcaggtgttgtggtaagagaagtaaacaataaggtctgtaaaaaatgcagtccataagggaaaggcaagaaagaagaaaattacaagccgatttcctagaaaatgggagaggtgaaatcttatgcaagagaaaagaacaattatttcccactaaaagttgaatttttttttcctctaacgttttaggatagaagcatatatgtaatagtgactatattactcccagacagagtaggagttttttcccttttattctctttgattttacctgaaattatgtttccaggacaacaaattcccagaaaaagatagcttctatgaaattgaacacatttctcattgtgtgaatctatgtttggccatgaactcttctctaagtccatttttcacactgaacatccaaatcattccatcctatttttgttgatacagtcatatggcagtggttttagttagtgcagagtcctttcatgcatgctttattgaaatggataccacttagttgggtccacatcaaagaaactcaatagaaggtcatgacaacgaaaaccaccaccatatcaacataaaccatggaataaggtttcatgtgttattttgactggatttcaaagttgagattgaagaataactggcttattagttaaggatgcgaattggaatccaagaagatttcaagagcccaagtcaccgtttttcatttctctacatggaactgttgaagacacaagaaaaaagctttctcaatgaaaaaggaagattaggacaataaacttaccatccagatctcacagcatgctgaacaaggcgaatactgagaggggcgtatccagaaaatatgtatgatatatcactagggctgagaacggaaacaagaacatgtaagtagtagttgttatcgtgaccaagataacaattataaatgacaagaaaattagtcactaaagattgcccagcaagcagtaggaatgattatactatatgtcagataataatatcaaagaatgacacagcaagaggcaatgcagagctttctgaataatctaagccaaacactctagttgctttctgtaacagaatgatcctatttttccagttgtgagttatctacaattcttattagttccagctcatactgccttatgcaacatattaaacaacatacccccagtttcagtatttgtagtgttcccactgcccccaatttggagcatatttattttgaagccaaaatttgcactaccaaaatttttgcattttaaatagaactttgggaatgcttcgctgtctaccaaaatttgtcaaccacacacacatgtggccaaaaaaatattggtaatacaaaaacttgcttaggttttgtcattaccaatattttggtagggtagcaaacgaaacaacattggttaccctgctgtaatagttgttttataatgtaaccaagacactagaaactaggaaagatgattggcaatgatctgtttgttttttataaatgcgtcaacaaaaatttcagacaccaagcaacaagcatgcatatctgtactcctttaaaaagaccgcaatagtggtggcagtgaatctgccaccccacctactcccattgcaatttttacatattaccccatgaacttcttaaatacataactaaatcgaaatggacagccacatataaaattaatgtggatagccacattttaggaaaatgtgggtaacatatttcatggaaaatatgatttatttattttagaaatattgtgatattttccttttatccgtagcaaagcaagggcatttatctagtgtgaaaccaaatagtaacagcattagcaaatggaacaaaaatgaatgcgtaggaaatgtaaagtttccagaagctaatactttgcagtatcatttacatcaactataagctgtagagcccttgtaataccaatccagttacttcttgattcctgcatagtagaacagcatactgtagaaagttagatgagaacaccatttaagggtctggaaaggactaaaacaagaaatctcgttgtagagacaatctgactaacctggcgcttaaataggccagccttttccagattgtataacaagggcatgtgctcaaagccataactgtgcagtatttcccgcctggccagggtcacaaaaacagatagaagacaatgttgaggacttattgtaagattgatgttgctggcatggcacaattaaattccaagagacgtgtacatgtcctaaatcacatatacccaaatagcatttatagcagtcaatcaataacttgatatacacagaattagtggttctagtaagtgaacataaaaaagcagtaaaccttcttcttttttgcgtgcgtaaaatatgccatattttacctaatgacgccaaacatgttatttctccctgtgtcccataaaaaaaccaacttctggctacaaactgagcatagcctatgtccagattcatagctagaagtagttttgttatgggacagaggtagtacttcctataaagcataccatgatttcctgtagatcccaatgactactagagctgaataaaatagtatcttagaaccctcgacccagtaattgcaagagatgtttatgcacgcatgcttccagcagcagtatcgcacttgtgcagaaaaattaaccaagacagtgcttagcaaaacaagataattcagttttcaacaccctacttatgatagccctgttcatatgggcaattgtacttcatattatactagttaaatgcacgtattaacaaaaaattcttacacaatgaatttgattggtacatcaaacatgtctttgcctctgtttaacatgtaagtacatataaatgcatgataatttggccaccttcgaatctttcacattgaattaaaattctgttctaagggaatattagaagaaaaaaaggatagcctattgtgtaatattgaagaacaccaggggacaaaaaagctgtgtagataggtgggtgacagtttgagagagatgtattcatcgatactgtacagattttgcatacaaaattgttttaaaatatctatgtcttaaaaggatatggatactagtgccagcaaaacctctacctttcacataggaaagaatgcatcatactactcaattcaatattacaataggttaactcaaacaatagcctatgattattatcttattctacatgattttctcacatgaaaaaaattcaattttcattaggcacaggacaaaatttcaacatttctaaagggcctttcacaacctctacgctttcacataggaaataatgcatcatactactcaattcaatattataatagattaactcaaacaatagcctatgattattatcttattatacataattttctcacatcaaaacaattcaatttgcattaggcacaggacaaaatttcaacatttctaaagggcctttcaaaagtaaccaaatcatgttacgacttacaaacactggcacataatgaagttaaatatatgatacattaaacaattgctccatgtgctcaagttttcttggattgtaaaataaataaataaataaatcattttggtcattaggagtagtattatggaaagaaatcataaatatagccctgttatgttataacttaataagattgcacacattagcttgtcaattgtccacatcagacatcaaaaacaacatattattgccaatagttagctacatggttaagtaggtaatgctgggtgaatccaccagttgctgtggtgataatgctcaggtggttttctaatagttaagattgctagaagacacagctatagatcggatagctacaaaaatatatgttcaaggctaaacgattggccaacacatttaggctgtgttcggcacccccttttcccaacccctctccctcgttttccacgcgcatgtttttcaaactgctaaacggtgcgtcttttgtaaaaagtttctatacgaaagttgtttaaaaaaatcaaattagtccatttttgaaaaaaaaatagctaatacttcattaatcacgcgctaatggatcgctctgttttccatgcgtactgttccggttggtaacaaggaatggcgaacacagccttaattgtcagcataaggctactatatcctcctagatgcaaaaatatgaactgataatggtcataaaatttaatacaaacaaaagcaatacacaaaaagtaacataaacatacctcaagtagtcaaaattcttctttggcaacccagcatttgtaagtgaaagtaacactagaaggcgaagaacattttcaataggctcctgcttatgtatcatctcttcaatgtattcaaaacatctggggatgagttagatattattgttacatgaattcaggggaaataaataaaaaaaatgatggcagttattttatctaaaatgacgtaaaagcaggactcagatctcataacaatccacagtttggctcaaaggaagactgttaacaagaaatttccgcgtgttaaagttgcaataagaacaatagctgagaagtacggaagattgttttggtctgcccaagctgacgtagacacaaaacaaaccttagtcacctttactatcaatttatgaaatctgaataacacgagcaggagagatggattccagaagaattcagagctcaatatatctcttgacaaagaatggtttgcattttgatggtcaattgtggcagtgagccaacccaaactgactggctggagaaaaatgggggggagggggggtagatctagggactagggagaagtaaaatataaatgaatgagctaatttacagggttgacagaaaatcttgatatgttgcccacgtcacaagaattgcattataaagtaaataaacatgaactacagagtagtagaaagataaactcacatttcaaagttttgcacctccaatattgtttgttcaatgtctaatcgggcatgaaaggaaggttttccagtaaatgattgcaagtgttgtgccaaatgaacatgcctctgcatcaatgcagggtgttagttaatttacacaaaacaagtgaccaactgacagcacttaattaactcacagctatctctggcagtgaatgtaacctcttcacaaagtccttcagctccgaaaccgattgagtctgttttcaaacaataaaattatttacataagttcctgattcacagattattctaacaaaaaagatagctgcctgatcgaatggacaggagagaattaaacaaactggaaaaaaaaatgcagataacaaaaaattcgctatagtacttcagaagaaaatgtatttttgtgaaaagggcaaaccgatgattttatctcaatatttatgtgcattttacccaaattgcctcagcaaacaccacctataacttcacatatagtagtcatattttgaccaacagaattacctactcttatgttaagcgcaccaacagatatgccccctaaattgacaaatcaaataattgacttttgattcagtatgtagtatatttccttcccttgtaaatgttaaactatagacattcagtaaaactattttcaaacatgctgcataaaaaggacaaaataatttaatcatgaattctaattttcaaaatcaatttacaaactgatatttgtatgagtttgacagtaaaatagcagaaaaagttgttccctcttagtagtatatgactgcactactaagagggccaataaatactaaagaataaacagaattatctatatcttacattggtggattttacttcggcgtaatcttgctgaatagatgttgccttttggcgcaagacctgcagcacagtttgcaatattactaaatgatggctgctacagaagattcaaattattagtaagctataatgatattggatgataaacagaaccaagaacagattagtataaaaactcctttacaaaagataaagaaaaaaacagaaggcaagcttagctaacctgaactacaacttcaaaattgagatctcgaatttccttgtacaacttatcactgaaaaggacagagtattaacacatatgtataaatccatattagcataaagaaactgatagttaagagtgaagaccatactgtaaaatgtgagttaaataaaaatgtacagaatttgagaaggaaaatagattcaaatatgctttcaagaaaaaaaaaaagagcatctgctgggctgcacagtgcatacactaccactacccaccgttctacactaccactaaggatattgcttccttagtggattccagtgacaagaaaaataactcagagttaccaagattctccagcgcctataaaatgtataaaaagttgctgcgcactgtgattggtacaaagactttaacttgttattatggtacaagtaatcatgaagacattcaaattttcaaaagattgactatacaaagtcaatgaaactaggacaccatttatttttcattagaggatagtcataaacaattatcacatgcatttgacatggtttctgagatataacttcaccaaccgacttttatcaaaatgaatttataagaatgtttatcaaagtggcaaggcaatgtaaggcatcagtccagcagatagcaggtatttgaagtaaaatacagtcactacattatcagaaatcacacaaaaataggaatgaggggttagttacaaataagtgaatactagtaggtagataagtgccacaaaatagttgtatgggggaatcaaactaactagtgatacactgataccctgcgcgttgcagcagggaatttagaaatacttccaaaaaaactcaatgaaaacaatatgtaaattgtgtactcgtaatatctaaatggacaatatctgttctatagtagttgatgtgaaagtgcatttctatatgacacttgacgcattgttaagtatcaaacattagagggatccgatgtttattagttttctaggtgtcatggttcaatgcatattgacctttatagcaataactacacttagtgggttgtaaatccatatgacaaatggatggttgagatcaaagcatgagagggatccaaaggctattattttctagatgattggctcgatgcatgtcaagtttttggttccaactatataggatatatagattacggagttccggatgtgtataagaaaactttgacaaatttcaggacatgtgttctaggagaacactcactttagcctagagggagtagaagaaactatgcaattattttcaaaaacaaaatataaaactcctgcatctaaagaataagttccctaagggacgacattaatagtagtgaagcaggaagtttcaaaatatatgcaaagcattgaaagatcaatttcttgcaggaaaatggcacgcagcgacacaacacaatggtaatgttatttcccatcctgggacgttttatacctacccaccacttgaaaagcaagagatgtaagcctgatcagaacaaaagggaatggtcaacaatgtgaagttttttctctggtccttggggagcattgaggtatatatacctcacagtattgatcaggaaactcctactcacactaaatacctataccaccagagaaaaactcaggagcagatggaaaggtgaatttccaatcctacccccacttgtgggatcagttttagcacctccctttctgaagaggtaccttccaagtagtgggaggcagaatacctcccaaagatgggagaaagagaaaccttaaaaagtttacacatatttacagactggaaatatgcatgcatatactaagaacacttgccttgaattcagtggaactttaacttttttaccatcttgttgggctcccataatagtggcatcaacctccacagatccattgtttatttgcaacatctgcagaataatgatcaaatagttcatgtgaatcgattgtaaaatttaaaccatgggaatgcagcattggaatagcagacattctattaaattggattgcattttatttagggcatatcacacacctaacagtaacatccatgcagacacaatatggaattgggtcgtgcactcctatctaatgatatgactgtacttgttgagagataattataacatactcacatataaacccaataggtggggaggagaataaatcaaaattcttaagacttatactggcatttcacatttcctatttgggacaacaaagaaaatcatagctcatggagtatgaaacattctgcatacaacagaaaggacattttaactttgttttttttattatttttgtaactttatttacagaaaaaaaagcagagggtgagggggtaacctagtgcacaatggtataatataagataattcatacccaagaatagagtttgctcactactaccacaaagggaattataattaaatgttagaatgtgatagacatgctaaattgtaaatttgtacagtgagaaccataatggcatgtagtcatccaatataaaaaggctaaaaaccaaatactaatgagttgccggccagaatggaaatttggcaatatttagtctacctcatctaataaaccttcatatgtcaactgagagcacatcggtgtcactaaatccacctgcatagaaaaaaatagatacattacaaatgtgtaacaaatcaaaggggttatcttccctaagtgtaatgtaatgagttgatatttggaaacatagagaaccatagatgcaaaggctcatataaatgccaaaaagaacaagaaatcaaaatagagtgtgacagtagttttcagagctgaaagtaccatataaaatgaaaaatatattttacctctctgtctaacaaaataacagtgtttatctccggagtccccatctaaatcaccaaaaagaaataaatgatcagcgaaactgaaagatctgagtcaaaaaagcttatcagtcggcattacatcatccatgttgacaggatcttcctgttgcatactattcagcaactctgcggctttggtggatgcaacacccttggcccgaacattgggaattactccaaaggcaaactggggaaagaaaggaatttgcataagtgcagtactataatatttctatagtgtatagatatttacgtgtgacggaattaaaagatgataaggttgcagatttgtagcactgaaaagtactctttaaactacagtatggtatagatgataaaaatttagtctgtccatagaatgcttctgctataaacaaatataattgaacttttgtagtacaccctctggtcttttgcatttgtcatcctagagtatgggccacaaattatgtgaatcttttaccacaagaaagttaggtattcacatgaaaacggtacagctagatttttcattataatactttgatatgattatgctttttgatgggaaatttgatatgattatgttactagaaaaggtgatggtgatggtcaaacactagttgttacgacagcacgaggggtcgcctagtcaactctaggacagcgcatcagccagaggcagaaaacagagatcaatgccgagatgaccaggattagaaaagtgtacagccctccagtgtctgacaagcttttcaccatcaccagcttcaccagattcctgtttatttcttacctctttgcttctagtgcgagtttaggatcagtgatgtgaggaggaagatgtgaaatgcagaacaggagagaaaactgagaatcttatgtttactgagaaataagagcatcctagtagggaggttagaactgggaagggataagttaagaaatcgtgaaggagggaggtagcgcaggtggacattgtgcagcttaagtggtcactcctgtacaaacatgtattgcatacatataatcttgcataggtgccttggaggcctggcacccagacttgctacgacttgcgagagtaccattacaaccttagtaaaaacaagtaaaaagaatggaaaaggtaaatgccaaaatacatgaaaggaagacacatacctctaacttatggatagcttttgcaacatgccaaacagaactagtatccccttcaataaggcattcctgaaaatcatgctccagtaagatttatatcaatattatgaatatactacctccgtcccaaaatataacaacttttagctatgaatctggacacatagttctctagattcatagcaaaaaatgcttatattttgggacggagggaatatgcactagtatggattagtacctgcagagaatgatcaagttcaaaacatatcacatcttcatccaatggaactagatacaaggggtactctccgagtgtcaatttctgatgaactttttcctcctccagaatctgcagtgcagaataaaatacagatcacaattcttcttgtcatagttcaactttggagatgcctcactgacattcatctttatgtttagtcgtaaaaggaggaattcaggtacaacaaatctcactccaaaggatgatctgtggttgcatatacatacataggtgtcttttgatggcttttttaaaaaaaaaaaaaagaattttattccttgcaaatgcacatctgtaggtggctaattttctcatgttgtcacgtacataaagtttgaggtaattattattttttttattttgtatatttttatgatcagtagcaaaatgtggaccactaagtaacatacaaataggaatttatgaagggcatttgacgaagtcttacagctataattcaagggttcaaagaggatgtgattactcataaagtactgttgcaatagctaagcctgtatagaagaaccaagcatcaagataggtcagcaagaaaaacacactacaatcaggctctagtcgctctactgataacaaaacaattaagttctccataacggcacgacacggcaactgatattgatccctaattcattcctccaactgtcagaataaggaaaacagcttcgctaattttggcacatgagcatgaacattgcgtatggcctgtttgccagtagattaatctactctgcgtactggtggatctcaggtgagctgattttaccgcattccattcaaaaactaatacatatgatcatttttgtagggagttttgtacccatcaatcaaatcagaaattttatgacaatataattgaagcaataataaaacatttctagagtatttggctattcgcactttaactacatatattttgtagattaggcaaaaactagtaaaagcattcttggatcctcaattgtcttgtcacatatttttctttattaataccaatatctgatatgtggcgttaagtcccaggaaatactaataaaagaagactgaattcctgaaaagggcttttataaatactgtgcatatggctcatgcttcccaagttgaattactgaaaagggcttttctttctgttttccttttttgggaggtgagtgacaggaattactggaaggtgacatatcctagaaagggttgttcacgatatgaagaacatattagtagactatgaattatctgagacatgattcaacctacactaactacaacacataccagttttgggcaaaattgtatttacatgtaaataagcatataaacgaaggcatttacaaagatggtacatggactataagataattgtactaaaattggaaagcatcattgggatgaaaggatcttaaatagttgcattcaatgttctctgatcaggcgatcagccctgctctcctaggcaccgatcaggatgatcaggacgattaatcgagggtggtcgattagtatatagcaggagtgtccagctggccatatatgctatatattactctctccgtcccagaatatagcaacctaggatgggatgagacccatcctaggacaatgtatgtcatgaatatagcaacctaggatgggatgagacccatcctaggacaatgtatgtggacatgacatacattgtcctaggatgggacccatcctaggttgctatattctaggacggaggtagtatgtactcaataatatataatctgtagtatatggtaaaaagcaagcatcatctggtcaaagaagaagcatcatttgctgcccatcatctgcccaaaatggaacatgggctgggctggcaggcccaaaattatattttctcagggaggcagcccatgaacgaaaactgctcgttttccaccctgatcggacgattaattgcgactaatcatcgattaatcggacgatcagctctctgatcgtctgatcgacttacctgtgcctgatcggaggtaggggagcgatcaggacaattaatcgcgattaatcggatgaacaaataacaatggttatattgcaagccttctttatcttccaaaataggtcactatctaagcatacattatgcggtatggcctatacgactcattcaatcttaattatcctgatttaaggcctgtaaggtggactttctttctatatggtatctcagtaacatataagtaacaatacattatactacacaaatttacatgtatccatgttgggagcgatgattgcataagttgtcattcttactacaatcagactaagaataattgaattgtgtctgaggctagcaaattattctaatataattgaatcctaagccacagatagaacaatagaaccagcaaagtacgaaaacaatagtcaccttttcgcaggcaactgtgcgccgtggcacaaagtaaagaaagaattccctctgaagccctttaggctcatcgttcttaatctggcttgcaattaatttcatgaacttcagctcagagcgtacgagatataggatcttagcgcactcagtttggaggggttcagcagagagaagccgcaactctgcaccatattcctgacaagcacaaaaaaccatgcatgagctgtgtgcatgtccaaaaatctatatatgttaactgcaacagtcgcttaattgtccatacatgaaatgcagtgtaagcatactattgatacaatgctaaattttacagaagctactaagttattatttaagatgaaaacagttgactgttaacatatacatactgtatgatcagctcatcgcacctttagtagaccatatatgttaactgtgagagtagcttaattgtccatacatgaaatgcaatgtaagcatactattgatacaatgctaaatttcacagaagctgctaagtcatttaagatgaaaacaattgactgttaacatttccatactgtatgatcagctcatcgcacctttagcagtgaggtctgcagaatcagagacagggtacccgcgagcttgggatcaataactacacacttcttccccctaatctgatacacaggaaaagaatacaaacttttcagtttccaccgtcaataacacgagtatgaaaaattgaaaatgggatgttgagaaacgcacactcttgaggatgtttagcaggtccttctgcgactgctccctgcatgccaccagtcgaagcacatcaaacatacatgttgaaattcacagtcgaagcacatcaaacatacaggttaaaattcacaggaacaaacacaagggtaagcagatgagtggggatcatcacgagatacctgagggccgcgagattgagaggagcattgtcgagattggggatctgagccatagtcccccaatccaactcctcgttctcagattcagaatcctgcttacttcagagccgggccaaacctgcggcatgcggtttcagctaagggttaaggcgaagagaaaaggtgcggggtagagaggggatggaagagaggatgctgcgtacgggtgctcaccggcgacgaggatgcgggcggaagcagcaggtcggcggcgcccgctgctgcccccgggacggagatcggcgctgggcggcgccggcggggaacgagctggcgcggagagacgggggagtcgaggccgaggggaaggaaagggggagagagaacgagtctactagagaagagagaacgctgggctgtccagcgccgggtgctttctatagcccagtgcgtgatcacagtctgaatccattacaggccgaaataagtctatttggagtccctccttttccttctcatgattgaatgcgcctccccatctttgaaacccggtgtaaatcaactccttcaataatttgggaagcggtttctgctgacgtgataagttggctgtggttgactcactgattcaataggacccacatgtcagccaatcagcgaacatcatctctctctatatattcccctcctctcttttccatctcaccccgaggccggtagcacaaatcattctgaaaagaccacgagcaatcgatgttacatgcctcgccagtagtgacatggtcgtggatcccttggatgcgtgcggtaagcttgcagtgcacgtgtgcacagtctcacggtacaggacatcgtccatagttgccacctacgaccgggaagctttccgtaccggagcatgatgtcgtagagtagctttagatggtcaaggtcacatagacatagcgctagagctatcgtcgcggatggagtctgcactagagcttcgggcttgcgtgctcctcatgctgcagctttaccaggatgtggtggtaatgctccatgattacatccccaagttgtgcctagacgtgctccggcgacctcggcacagtatcctgtaccaaactcctctcacttgaccaccatcacttcgacacggctaaaccaggcaccactgcttctcgctcaatcagcctcatcaacatttcacaactcaagcgctgcattctcgccagcctatccaagaatgccaacacgaacacctaatgaaggtataatcttgaccattactatctagattcatttacattcattttattcttgatgtggaaatcaccaatgtgcttgcttgcttgcttcctcctcaggctgatcgaggacgccatggtgcttctccatacttttagggattgggtgccaagggacaccacaagcttaccgcgcaagccaaggggcctccacggccatgttgtagccagcgaggtgtgtaacatcgattacttgtggtctctttggcacaatttgtgccgctagcctcagggagagatagaaaagagagtagaaaggaataaaggagagtcactactgtaggatcgaatcacaacaactaagccaaccagaggggggtgaatggttggtatcatagtagaaaaacccggaccggtcatcgaaccgcttggacccttggttcatcggttcaccggttggaccgctgggtcaaccggtctaatgctgaaccggaaccatcatatattatgcataactcccttcaaacagggagctcatgttagcctagtggtgaggatcacattcttgctcctcgccagccagagttcaaacccccaaagtagcactttttctcatttttaggcaataaaacgaacatgggccgccggaagtgaagtgggccttggaaggccggcccatctcctagctgacctgccggtttagtatagcctggtcgccggttttaagcaaaaaatcgtccggttcaccgggtttataccggttcaattgcacgggcggtctttagagcaaaccgagccggtgagagtgctggttccggttttttccggttcaaccgccggtccggtccggttttttgtactatggttggtatacccattaccaaccattcaaattcgaatttttagcggaaataaaagttaccctcaaattcaacgaatcgcggtctgaccgaaggtgttgcgccggtctaaccgaaagtgttgcgccggtctgaccgcctaatgaacgtcggtctgaccgatgaagattgactggtcgaaccgctgagattgcatgccactccctgtcgccgtggccggtctgaccgccgtgtgcccgccggtctgaccgaccgccgaaacctggtgaaacaccaatcgaataactcttaaagtggatgacaactttattgattatctctgtgtttacaaagtgcaccaacagcactccttacaaaaaatttcgactaaactcgaaaccctaactcaactctcaactccattgctctcaaaagtgataccgggaagcctcacgcttcccctctatttatacccgaggtaggcagcctaaagtcctaaacaccttaggaaaccctctagtataagaaacaaactttacataactaatcataccaaatttggactctttccaaattcgactccgcattccatacgcacacaatacctccatcgtatgccatatggaatcttcaccaaccacgtgcatcaactctagcctaagtatctcgcatgatctctgaccaccacgaacgtcgtcttatccccaagccgactcccggtccatcaccgtaaatactctcccgaggtatcgagtcacctacacatgaaataaacaaagaaaccatattccgagaccaagctatctccaacttgactcattgttagtaaacaacagtattgcatacgcatagtatccatctagaagccataatcatgaaactatcacggatatccaaacaaaaaacccgaaaccgaaaccgacacagagtcggcccgtcagaccgcgggctgcgctagtctgaccgcgcgatatacgccggtctgaccggtcccaacagacagcagtacctgtagatcacctgtaaaatccaatcatctccaaaaccacttcgcaaataaatttcaaataacaaaaccaataatctcctatgataattgttcatcacagaataataatcaaaaacacctttgattttacaatctcccctttgatgaacacattggcaaacccataaaaaatattttggtgtttggaaaaataaaaacaaaagtggtaaaaagcacacttcgtacaaacgtacacatcgtgctcgaaaatccaaaagaaaatttctctcacttttgaaaagaaagaaattcccaatcgaatcaaaaacaacatgcaaaaacaacatgctctccaaaaattttcaccttgcttctcccccttttgacaatgatttattcaagcataggaattatgttcattaatgacatatagcatatcatgtcatgtgttgcaataaaaagaagatgaacacatctataacataacaaacatgaattaaagtataaccatgaaccaaagattttacaattaagcttgaatcaacaatcaaaattcatgatttcatacgatttataatgcaacatcttaacaagcacataggttgaagaatggacactaaacacatatacctattgcatttatcactctttctcaaataacctttagcacaaaacaaccaagagaattttttactttttctttttcttgagcatttttgctcatatttttctcttttattccgggtgcgtccctgtcgtcaggattgtttctagggattcggcacccattattttgcttacatcgaatacgtccttgtcgtcaagactgtttccaaggattcggtattcattttttttcgtagttttattctcttttcacaatgagcaattaaagctatttgaggaataataattcaataaagcatatatatagagcatttagaaatcaaaccacatgctagcatcaacattgcatatttaagtgtcatgcatcatctcccttaaaagcaaaatctaaatctcatgaaaatactagaatacatacaagctatgctagagacaaataaaccttcaaagtattgttagcatgcacaagaaaataccatatgtataaacaaagctctcttttctcaatttttctcattgtcatatttttgcttgataaaaccatgaggtacaaactccccttcaaaacatgccaaaaggatgaattatttccaattcaccacaaagaaaagcaaagcgattagaatccaaaggtttagtgaaaatatcagcaagttgtaattttgtttccaaaaactgcaattcaacatctcccttctcaacatgatccctcaaaaagtgaaaacgaatatcaatgtgatttatgcgtgagtgttgaataggattcttagcaatgttaatagcactagtattatcacaaaagagaggtattttctcaaaagtaagaccataatctttcaaagtagataaaagccaaagaatctgtgaacaacaactagcagcagcaatatattcagattcaacagttgattgagaaatactagattgtttcctagaagactatgcaattaatgatgtaccaagaaaatgacatgttccattagtacttttcttatcaattctacaacctccaaaatcagcatcggaatatccacttaagcatatagaagatgaagtagaatacaaaattccaaactcaagtgtatgattcaaatacctcattattcgcttgaccgcttgacgatgtgaaacacgacgagaagcttgaaagcgtgcacacaaacacacagcaaaatgtatgtctggcctagaagcagttagatacaacaaagatccaatcatacttctatactccttttgatcaacagcttcaccatcttcatcaggatccaacacagctgtagaaccaattggtgttgaaattggtttgcaattctccatcttgaaccgtctcaaaagatccttcgtgtacttcgtttgatgcacaaatgtacgttgaggtgtttgcttaatttgtaatcccaaaaagtacgataactcacccatcatgctcatctcaaattccctgcacatagtcttagcaaactccacaaccaaagcgtgagtcgaacaaccaaagatgatatcatccacataaatctgaacaaatagttgattatcaccatgcttaagaataaaaagcgttttgtcaacttttcccattgtaaaacctttcgcaagcaaaaagttcttaagtctatcataccatgctctaggtgcttgtttcaagccatacaaagttttagacaatttaaaaacatggttgggaaaatcagaattttcaaaacctggtagttgtttgacataaacttcctcctgtataaaaccatttagaaaagcactttttacatccatttgatacaatttaaaaccttttgaagcagcaaaagccaacaaaagtctaattgcctcaattctagcaacatgagcaaaagtttcatcaaaatccaaaccctccacctgagtaaaaccttgagcaacaagtctagctttatttctcacaatcaaaccatcctcattttgtttatttttgaaaacccacttggttccaataatattttgtccagaaggtggttcaactaaagtccaaactttgtttctctccaaatattcaagttcttcatgcataggcacaaagtggtttgaacaagggaaaactaaaactagatgaacatggtagtattttttttagccttttctggactctaggtaatggaaatgaaaattaacacttggaaaacagatgatacctatcggtcaacctaatgctctaataacacttgatgtgcctaggtacccgatcttccaataggttcgacttggcgacatgaagacgttcacgttatcatctcggaacagctacacccacacatttagttgttatcaaccatgctctcacgtagttgacctcaccatgaaagtttatccctacaagcaattgaagaaactcaaagaataaggaagaacacaatctaaatttctaatgaatgattagcacttaaagttggggttccataaactggacttgttgatgacgaaactattgcatatattggcggattgactaatctaagaaaaacccgactctaacgatgacgactactaaataaatatagcatcctaaggttagctctagggcacaaaccttgttgggcagagatcaggatttgccgctgacaaccgtctcttacagcatgttaggaggcagattcgcaggtgtacgcgcgcatcttgtgtaatcgagtaaaataacgctcacaatctaactacaaccattggctgttgttttatttcattctttgtacaccgttacaacatagcagacttagcagcactcacatatatataccaacaaacacatatacatcatccaaatgttccaatcgagtaccttctttttgtacagccattagtggttgagacgaaataacgatcattgtgatcgatgcaaattaaattagccaagcctcttgttggattcacagaggtaagcccatgcgacaactgcagcagcaactgcaaccccagctgcagtttgcatcaacagggactttggtttctggcatgatttgtagatgaatgcagagcgaggaggcgtgaaccccagctcagatagcttcttgtgcgactctgcatagtccctgaaaaatgcatcttcgtcctacaaagaaaaatacaaattattgttagcaaatcaagaactcattaactactaactagagaatgctcaattgctcattgcacacatcattctggttaggtttctatttgtgcaatactaatgcaatctatcagaaagtttatagtttacaaactattgtgattaccataacaaaggaaaacatgacatttacagaagcactacgattttcagaaaagaaaaaaaattaattaccatcctgataagctacctgaaatgttacagtgaatagaaaagatttgggatataaatgcgatgtaccttggcatatagttcgacatagcggcggaatgtaggatcttcaacaagagccttgtcagtaggcaacttcagaagcccttctgaattctctttcagaagctcactgcattgaagcaaatggtgatatttaattaattctatagatggataagtcatatttaatattacatgaaataggagttatcaaatttcggaggattctttgtccaagcaccatcaataattaattctgtggagggacaagtcatatttaatcttacatgaaataggagttgtcaaatttcagtggatcctttgtccaggcaccatcaaatcctgatctttcgggacgagctttcccctgaaaatgaactattcagaacatgatctctaatttagctggaaaatagtagttgatatattatatacaccagtagaaagatgatgttgcatacgagagtatggccgcctgagagtgctactatgtccttgtctgataagcccatcctgtagaagacttccctcagatgcgcagcaccttttcaaaaaagtaaaatatagtacaagaaactaaatacctttgacatttttgaagcaaattatccagaaaaacaaaatttcgaatttaattgtatcatctgaactttgtgcatacaacatattggaaggtttcagcgctcatttcatttaatcatttataattagcaaaattaacccaagaaatcacagaaaaaagtatcaatgcattggagctgatattttattttagattagtagataggagcagagataacgggtcatgaatcaacctttcttagcatctggcaaacggccttcctctggggaatctgaagaatcctgtagataaatgagaaaaaaaaaaggagaactcaagatggtttcataagatattcagtctggaaaaaaaatcaatgtcgatgcatcaactcaccctcctgccaggaacataatctatagttggcccaccggtgacttcaacggcaacaactccggcaagctgaaattagaggtgatgagatttataattggtatgtgattggtgaagtttaccagcaggaaagtaggattgggcttgttcggatgagattgctgctgcagcgctgcagctgcacggcagcagcagctacagtgctacagcagctagctaacagcggctgtagaggctgcaggcagccaacagccaggccgctgccagccaacaggcagacgaacggctgggctgtacagcacagccaaaacagctgcgtaatcgagctgccgaacaggcccattgtaaggttacttgttagtgttcaaatatgcagctgagttacctgatacaggtcagcataggtaatcttgggatgcttctgtttcatcggttctgcaccacatgaaagaaccatatatatcatctcaaatcaaacttgttaaggtcagaacaaaattaacaacaacagcatcaaaaaacaagttcacatcctgaacaagaatctgacagaaacatgcacagacctagcagatcaatagcaatcttgatgcccgcattcgcggcgtggctgtactcctgcgggaacctgatggagccgttgggccctcccgtcttcgtcgccttgtcgtacgtgccggcgtcgtgccacctgcgcaaaaacagcggcggccggcggcggcggcggcgccagagcagacgacatcagcggcgagctagacatacacgatcgtggagcatagcaaggacagcagagacaaaggaagaagaagaagaagatgaaacggcaacgcacgccaggcggagcatgatgggagcgcagctcttgctggcgatgagggcgcgcaggtcgcggcgcgccctctcgacctccgccatgtactccgcgtccactaccggcgccgccgacatcgccgccgctgttgctgacgatccgaggagaggtgataggtggagaagggaacagaacagaggagctcaggttttggagcgacacaggggtttttgtaggaaaagcggggaggaaagggcgggaggaatcgaatggagtggaggtgtggagaaggcaagggatgtctccagaggaaggcaacgtgcccaggaatctgtgggagatttctctggtatgcacatcactgggcctacacacagccacggtggaaaatctcttgatttctgacgagattactgattcaggcctgggttagttactcgaaaatgtttccaaaaaattttagacacattaaatctttagacatatgcatgaagcattaaatatagattaaacaaactaattgcatagttagggagaaaatcacgagacgaatcttttgagcctaattagtccatgattaaccataagtgatacagtaacccacatgtactaattacggattaataaggctcaaaagattcgtctcacggttttcagacgagttatgaaattaattttttcattagtgtacgaaaaccccttccgacatccggtcaaacatccgatgtgacagccaaaatttttttttcgtgaactaaacaaaccctcaggtgaggaagtttttcgctggctctgtcctaggccctgtttagttcccaaaacaaaaatttttcacccatcacatgaatgtttgatacatgcatggagtatttaatgtggaaaaaaaccaattacacagtttgcgtgtaaattgcgagacgaatcttctgagcctaattgcgtcatgatttgacaatgtggtgctacagtaaacatttgctaatgatggattacttaggattaataaattcgtctcacagtttctaggcggaaactgtaatttattttgttattagacaacgtttaatactttaaatgtgtatccatatatctgatgtgacaccttaaaacaaatatttttttgccaactaaaccgggcctaaatatagaaaactagtactacattctagatctggataggggtcttattcagccctactcggctactccccctcctaaatgattcacaattttctccaatttaattccacctacttttttaatacatgcatcaaatttataagttaatttgaaagaagagtactaggaataaaatacacaatttgttttatttcgaaataaggacttacaggacgtttcaagaatgttgggtatgaaatatagcataatacatatccctcaataaatcagaaaaactaaatcatactactaaaagtgagacctctcttgaattggactaataattttatcttatatgttgtgcatggatacagagtgttttgtttttattttttgaaatatccaaatacctcctacaagtcactagtgttttcaaacttcctttgcaacttaattccatacaaaacactcataataagtttgttttttttccatcttcccacctctatccatttctagctatttctcacaccctatgaccctccatcactgtgagggtagttgctcctttccaccaaaggtgtgtgtaccatagcattattttacctttcacttttacacactttaattccaccaactatgtgacggtaagacatgataattatctcatttcataaaaatgtgtattgaatcttatgcccaacaagagaagacaaaagcaacttcactagccatgctgagatctacaaagatgtgagaaattgctaagcgcggccagaaatcagtgaaaactagacagaggtgggaagttagaagaagaaaatggacttgtagggagcatatgttgcacaaaattaagttattgggagagattgaaaagaccagttacttataggggttatttggattttttttcctttttgttatttaaggcacatgcccgtagatagattaaaatccatctccttatattacacaactgtaccttacacttcacacggtttactgaatttgcactatgcaaaacagcagaaatccaagaaaccaggtagtgacaaccttaaaacaagcatgatcaggcgataaatttattccacacgactccgagtcgaaagtactactctttcttggggaaaagatcaatataatcactagggccataaacgtcgaataaatcagcccagaatccgttcttcctcctcggattgcaccccatgtcccggcatagctgatcattgtaccagatgtgaaggattccgatgcaggatctgcgaaagtaaccacgagaatagcgcttcatgaacttctcccattccaggacatcattctgcatcacactgatgcttggcaacctgaagccaccatccatgaaatgtgccagccacttggcccgtaattctgatgtgtagagatttgccaagctctctgaatagccgataaccgcgagctgcgggatctttgggtgaatgatctccctgtgttcatgcagcaaattaagttcaacagtccaagatagaatttggaaattgtactaattaaatatttgttccttgcaaaaaacaattgttgagttgacctgtagagaggtacagttgtagatgcagagcctactgcaatgctctgaaagtattcagaagtgaacatctccttgatcttctgatcccctctgaacccagttccaaagatcactatatcgctctttatcggcgaagattggccttcgacaagcacaccttccttgcaaaagctaaatgtctttgatttcttcagaacaatgctgccttcttctaatctcttgtaatggtctttgggtgtaatggcaaccaagcatgtaatcaaagcctcaaataggctatggtcaggcaccatgtcatacttcttcattggaatggaataatagctttctgcaaacttcgaaaatatccatctctgaacatgtgcaaagaggaaaaacatgcatggatcagtcttgcttcaatttaaccagagaaagcaaattttagcagtataattaaaacagaattgccataccaatggagtcaagagggtggccaagatgctaaggagtaagccttcaccaggcttgtgaataagaagctcagaaaaccgattaagatacagctttgagatgtggacgccccatgcaaaatagtctggtatgatccaatgctttgttcggaccaccattgtacatggaatctcagtacctacacgaagaagaaacacttagtaagtggggaaaatttaattcagcatctaaagttgcacaagagaaaaaatactgaaaaaaatggttggaggaaatcagattgttaatttgtcagtaccatttacttctgcacattctgcagcaatgtcaagtgctgatttgaggtagccaacgatcgtgacacgcttgcccttgatcatttccttagaattcttggtgcccatcttggagtaatccatggagtggatcacctggccatcaaatgcttctggacctttgcctggaggaaatgttggtatgttgggcactccactgaacctcccaatacaaagtatgacaaaatccgccttgtgtgtctggaatatgagaagtttgagtaacaaatgtgtgactaaattaatttagggataactatgatgaattatattacttcctttgttttaaaatatggtgcatattttgttttatattaggacaagattttgaccaagaattactgtattagaatatcatttatgtgatacaaaagtataatcaagatcgagtaaatattagtggatatgaatataataaatttaatttttatgtaaaaaaaaggcaaaacaaagaaaaataaacacattagccaatggatctctctcggcatggatgctgcgatttgtgcaattggatgtctcgcgctagacagcgatgcccccgctgtgcgccacaaattgcacggttgcctctttcgcaaccagcagagctagcccattccaggatctttgttgatggtgaacaccttgttttttttctttggatggtgaccaccaggttataaaggaatgatctatatcgaagaaaagcactgagactgctcaatgtcagagaggataagacatcagaaatattgccgtgactttgggctaggaatcaagttgcgatcgacggactctggtcgtagaatcgcaggacacagcgaactgtttagggtgtgttcggacctctaggttcccaacccaaatccctagttttttcacgcgcacgcttttcaaactgctaaacggtgtgttttttgcaaaaaaaatttatacgaaagttgcttaaaaaaatcaaattaatctattttttttaaaaaaattagctaatacttaattaatcacgtgctaatggatcgctccgttttccatgcggaggcagtatgttcccatcatccacatgcgaacatactttaaacacttcaaaccacttccatatcaatagaaagcatattgaaatatgtttcagggtatagtaaatgttagtaggttttaaaagtttgaaggtgaaaaccactggaaccttgatcaaaccacgttaacgttgatcaacgttgaaatatgttttatggtgtcatgtgcttttgtttcttaaaagttgaaagcgagagagaactggttttgtaacttaggatgaaaaaatagatttcgaaggaagttacggcttttacttttttcttaaggaaagtagctgcatcaattactattaccacttaatttctttaattaacttgtctcaaaatgtaacaacttttagcaatgaatctggattagctaaaaatgcttatattttggccagattcataactaaaaatgcttatattttgggatggagggagtacgtttgatggcctatatacctaggggatatatttgttgaagctttaggttatttcattttctatattgcggtttcactagtaggatatataatagtgccaaactgccgtaaaaaccatataagtacatgtcaactttcttatgtatcgcactgatggtttctaacctaataaaacgataacaacgagacaagatcactactaggaaaaagattttttccaggcggtccaaaacagttttcgcaggcggggcttcaccctccggccacggctctcctccatccactgctcccacataggagagggaggagccgagccgctgcataagtgccgtcgtcatcgtcgttgcatcgacgaggagagccggcggccggatgcgagccgtcgtcgtcgcccgtcgtggccggtggcgtaggcggtgaggagggaagcgggcggcagaggaggcgagccattgtcgtcgctcgtcgtggccggcagcggagggggcgaggaggagaagcggacggcggaggcggcgaggagggatgccagcggcggcgggggagagccgttgtcgtcgctcgtcatggccggcgacggagggggcgaggagggaagctagcggaggaggagagccgttgtcgtcgctcggcgtggccggcggcggaaggagccgtcggcgcgcggaggcggtgtcgcagtcgtcgtcgtcgtcgaggaaggagcacgccggcggcgaggaggggagccggcggcgcgcggaggcggcatcgtgatcgtcgtcatcgtcgagaagggagcccgccggtggcgaggagggagccgacggtggaggcggggaggagggaggctgctgggaggatttttttctgagtgagagagagaggagggggagggaaatgagtggtggagaggagaggataaggatgactagattttttatgggtaggtacgatttttgcaggcggatcatataagttgcgcttatgaaaatagattttcgcaggcgtcgctgaagtggtccgcctgcgaaaatcattttcacaggcgccgcttaagtggtccaactttaccccgatttatatttttgtagacggtcatttggctccaagggtcatgttcgactgcgaaaaaaagacccgcacatcaggaaaaatgctttttttctaacagtggatgtaacctataaaccaaagcactgtgcgtctgtgccacacaatgatatttatatgtactccctacatccgcgaatataaatattttgaacagataagaaactactctaatatctgttattaaataaaggatgaatataagtggaagatggatgggataaagatgactggttgataaataatagttttaggtaattatacatattaatgaataaattttaaatgctagctgcaacatttatattaatagttttagggtataagtaggtcgatccgtgaactgcttataggttaaataaatggtaatccatcatgctgcttattatttatttaacatataaataaattcatgagccgatatatttattccctccatttcaataaaaaaggttactataagatgtgtcatataatgtttctttattagggtgcagatgtcatactagcctggcccaggcctgcatttcatgcccatgcacaaagggtgccacctagctagtctagattagggggtgtttagatttagggggtaaagttttactgtatcacgtcaggtattatatagggtgttgcatagggtgttctgatactaacaaatcaactaattacagtatccgtcagtaatctagcagatgaatttattaaacataattaatttatcattagcacatgtttgctgtagactgtagcaccacgttggattgaggtgagatctaagcatgcccttactgtgtttctgtgtaagattgctcgtctgattgaatcacatcggattctgcctctgtccatgcctatccaaaatgatatgatgcggcgccccgacctttttcccttgttcctggcgctatgcgtctcttttctcctagtagaaacacaaattgttccatactgataaatatctcctactagcgacgcgaacattctctgctgacatatgattttgattgctcgcggtaaaataaattaattaaagtgtccgcctacatgttttaaataataagtgtagctttcgaactgttgataaaatcgtaacttattttgacagaacttcaaatatcaaagacaaaattctatgcctacataaaaagtttgaaatacaaatttaggaaaattcctttgcacaagagtatttattttaataattatttacatataatttttgacaaaatgaaaataaatattattttattcagctttattgaccgtacccttttccagatttttattacagtctatttttattactattggcttttagatcgttaatgacgcaggtataaagcttccacttataaattatttttttccaataagtttgttatgtgtcataaatgtaggccaaacaatatgataaatgcaaatttggaaacttcctccatgcaaagtactccctcctttttttaatagatgacgccgttgactttttctcacatatttgaccattcgtcttgttcaaaaaatttacgtaattataatttattttgttatgggttgctttatcactcatagttctttaaatgtgatttatatcttatacatttgcataaaatttttaaataagacgaatggtaaaacatatgagaaaaagtcaacggcgtcgtctgtttaaaaaatggatgtagtagtagcgaaattctcacctcaatatggccctcaccgtcgaccacctctagccgccactcgccggagccggagccgaaagcgtcgccgttcccagcccactcatcccacgccgccacagcctcctcgccgacgccgacgtactccatccccgccacccggtggccgaacctgatgcagtcgagcacgccgaagcggcgagcgtaggcgccgaggtagtccatcacctggcggtggtccgggaacacctccgtcaccgtctccggccacgggaagtcggagtactggtacatgggccgcggcgtctgcagcgcggtgcactccggcgtccgcgcccacacgccgccgaggccggtgtccgcctcgaacaccaccggccggcagccgcgctccagcagttgcttgcacgccgccaggccgctcacgccggcgccgacgatgaccacccgcttcttctccatgccggctagtgggctactgggctaggaaaatacgagctgtgtgtgagttgtgtttggactctgaggagcgaggtgtatttatagttggtcagaggtatagctcattagctcagaatgtcagagatatgttattaactgtgtaattatatagtttttgataatgatgcatcatgcactaaattgtttatggagcatgatttgcttgatgtgatgcttttttttttggatcatggcggtactgagtattaaatgataatagcatgtttgatatatatatacttaccaatcattcttattatttttaatttgttaaacttattcaagataatgtattgaaaacactaaataatttagagtcaaaacttccaggttggagctcactactactactactacacaacaacacatatgagatatttctcatctgcc

SEQ ID NO: 71945 - DNA, 1364 bp, Oryza sativa
atcgatcggctgagttcgggcatctcatagtattcccaagcgaagcaatctctaaactcttttaagagctctatcagcttggttctaaactctggagacaaatttttgctaataaatgtcggccttggccgatcgcctggacctatgtctatttcttccaaatcatcggccgacataaaaccctgaccttgcttgtcatcgagatcatctactgtatccttagcatagacattcgaaccctccacgacgctctcaaagtaatagcttgggttctccatcttcgattggctgtatatcagaatcggacacttttagaacatctccatcccagacttttccagataaacaatcaaggccatccatctcccaaagggctaaatcggcactagcaacattaactgacctgtcggctggcacaatctctatcttgtcgccttgccattgaatcaagcattgatgcatagtcgaagggatgcaacagttggcgtgaatccaatcccttccaagcaacaagctgtacgaacccttcccatcgatgacaaaaaacgtggtaggaatagtcttgctgctgactgtcagctccacatttagaacactcttggtctctgatggattaccaccaaagtctttgagcaccatatttgttttgatgagatcctcggcattcctacccagctttctgaatgtggcataaggcatcaaattcaccgcggccccaccatcgaccatcatcttagacatcggcttcccattgacgtagccatttatatacaatggcttaagatgccgattctctgtcccctcgggtttctcgaatactgcatgttctggtgacaggaccaacttagccgattcctcttccaattcatcgacatcggcctgatcgatcccgaattcagctggcaatgtaaagaccatgttaattggtgccgctataacactcttcccttttgccaacctcttcacctcatcggctgcagcatcatcggctacaggaacctgattcttgacatgccactcctgtcttggttttggtttcctcagtcgatggttgatttcctcttcaacctcctgaaaacgctccctgctcctcaatctctggaccctccttttctgattctccgtgaaaataccagaaggacaccattgattcttcctgatcacctcatcctcttggccacgatcttgattcatcggacccaatctttgacgaacagggagtcttgcctgtctcagccgattatccctattacgtgatcggtttgagctctcgatgatatcactgcatccaaggcagttttcgatagatggcaacctcatcccttcattccagcagaatctgaagaactcgcaatcccaatgag

SEQ ID NO: 71946 - DNA, 26988 bp, Oryza sativa
catgctgatacatgattctaaatccatctgctgtgttgattgctgtatggctgtatgcagctgattcagctcaatccccaaatttcttcacaaataaactgcctattagcaagcactcaaccatacatacagcaaatgagtccgcggagaaatggttggattggaggggggaggggggaggggggagatgtggatcagattgagcacggaaaatcaaagagcagaacaaatcgctcgaaacaacaatccaagcaaaggaaggggggatttctggatgatacctgggttcgagacgaggtggggaggagcgcgtggaggtggaggggaggaggaggagagggaatggatcgaagaggcaaaatgatggggagccaatcgccgcaaagggcgcagggcgcatgtgtcacgtggagaagacgaccgtcacgtggaggagggggagaggacctggggaacctgtggggcctctgttcatctgacctcagccaacggcgtgcatctaccgtaagagcacccgtaatggtaaagtaaggtactctctataaaatatgtatatctcagcaataaactagattaatagtaaaccaccttaatagtatgtctatatgggtatctatagctctctaatccattgccttatttttctctatagactatctccaggttagtagatagctttgctcttctcttccaagtaagaaaatatgctgacatggatctcttgtagagagcctatagataatcattaagggtgccctaagggtgtgtttagttgaggaaaaggaaatttttggtgtcacatcgaacgtttgaccggatgtcggaagaggttttcggacacgaataaaaaaactaatttcagaactcgcctggaaaccgcgagacgaatcttttgagactaattaagccgtcattagcatatgtgggttactgtagcacttaaggctaatcacggactaattaggcttaaaagattcgtctcgcgatttcctccataactgtgcgattagttttttttatctatatttaatgtttcatgcatgtgtctaaatattcgatgtgatgtttttggaaaaaaaaattagggaactaaacgggccctaaattgaagggccaatacaggagtacgtgcttttttttatagagtaaattgcatcggcggaacatgaacttgtcaggtgtgtacaatctagtgtatgaacttgtaaaatgctcttttttacataaacttgtcttccgcgtgcgagctaaggtcaaaaggatattacatgactaattttgttgatttaggtgctgattaggatactacgtaaacacatatatatatgagaagattgctacttagacatacacctgttcaataaaaatatagaatgagacatggtgattgtagagaaagatataaaaaactgagcaattataaagggttagaaacatatgaaattcaagataaactagagaacaaaattataaatatagcttgttttatgtatactaactatatgtatgtacgccatatcctaatcaatatcagttaggtaaaattaaccttgccatgctattttggacctacttcgcacggattagataagttcgtgtaaaaaacaagcattttgcaagttcatatactaaattacacccacctaataagtttatgtaccatcaatacaatttactcttttttatactatcaaaacctcttcgaaaatcaattgagaacatgcatgattaggaaaagatatacagtttatatgattttaattgaaatggaaacatgaaataaagaattacaacaggacgtaggaaaattaaaaaataatgattatttaaatagacaaaatggaaaattacacggattagagaagagataaatacttgaataaaggattgcatgagattaaaactcaggctacttattactttaaaattctgtagtggtgaagatgactccaacctgataaacacgcgacttattaaccgtgggattggcagatcggatggtgctgaggatcccatcgcacgcgctcctcccctccgtgaatcacttctctcccccacaggccagatcgcgctcactatccaaccgtcgacgccgctcccctcatccttcgccgcgcccccaccacgccttcgccaaccgccactcctgctcgcctgaatccacgccgccgccgtcgcggatcgacatcgccgctcctcctatcgcgctcctcccccgccggcaccgcctccatccatccgccgcgtctcgccgccagtcgcaccaccgatccattcctcctctgccgcctgctctcccggtccctcccgccccatcgccccaacacttcccccgtcagcaccgcctccatccatccgccgcgtctcgctgccggccgcacccccgcctccatccatccaccgcagatcgccatcgcacgcctccgcctctcaaggtcgcacgctcatcgccgcccgacaccccgccgattggggaccgaacgctgaccctgcatcgacgccacaacagtcgacagaggggagatgttgaagacctcactccaacgacggctgcgcgcggcgacactaccaggcactgagggagagaatgcggtgcgaggtgcggcggggttgttcgtccttgcccagatcaatgccgccgccgatccctcactcgcccctcgcccaagtcggcgccaagggcgaggttcgccaatctgcttcccagccgcctcgcccgctccatgggagaggtgacacctgtgcccgcctccagcgctccatgcccccggataccatcggagcacgatccctccttagcttctgccggagaagggacgcatgcgccgaccttcagcactctacgcgccctgtggataattggttcgttctctttacgttgcaatccattcatttatcaagaatcatcattgtgagtgccgagggttattacagattgcaggatcactaatgctcttttttgcccataagatgttcaacgaaatgctgcttagccaatgtattaccagaaattgatttctctgtaagtgagaatgtcatattgtcatgtcccctatgttgttatttatactaatgattgcaggattctctctgttgttatttatgctatgaagtgctgggaagttgagagtgttgctaccaagcaaaaagattcaattgatctgttggagcaaactaatttggatctcgcagtctcaaaactaatctggttcttgattgtttcagagtggatgaaaataaaaaatggaatgatgcagtgaagattatgtaagcaatgttcgtgatatatcgatcctgaaattctcatagatggccattgcacaaatacaaaaatttgcaggttattaattagtgaacttcatctctgtaaatctgcataacatatgttaaagctagcccaagaattaatatgttgtaaatctgctctacagttgacactgcttacattttctactattaataaccctcagctgtgatagatctgatacctgcttaaaaatttgagctgagttttcatacctagcagtaggactaacattttatgttgtattgttcagctcaagatgaacaaccacaccaaccccaagatcaccaactaagcctatcctgcttcatgattgttgctgcaaactccaacatgcttgctgctggtgcaatctgagccggctggtggcagatgggagcctgccctatgttgttagcagctttcttcactccaagtcattcttgctgcctgtggtcttggtagtttcttttttgtgttgtcaatttaattattatgatttcccatgtgctcggctattggtgttcttgtttttatctgttttgtttcagggtgtcattactatggagtagatcatttttttcttatttttttcaatgccttgtaaaataaccaactagcagggatgttcataaatttctcccttttgtttggtttttttcagacatatatatataatgaaggcatatatacacaaaaggaggagctgtttgagggtctaaaggacaatagctcaattgactgggaagctgttgtcatatgctgagagcaatctgctaaatgttaaagaggtgcatctaacttttgtacccagtgaactgcaaatctgcaccttcatttttgattaatagtttctttggattcagatcaaaatagctcaacatgggaatttttctagcagaggatgggcaattcttggaaaatactatatatttcttgtcgttgaatgtgatcatgtcccattattttggcacttgctgccttgattctgttgcctgtgccagcccttcagctagctctctatcacacatgaatgcgtgatccttgatggttgtatgcagttgggatattttggtgagttcatcccccttccccaccccacctctctctctctctctcaaaaccatcatttatcttcactattgacttacaatttcacttctagctgatgatgatcaatcaaagctagctcatatgtattagtgagtttatgaaaaaaaggatcagatattcaataacagagtcagctccttccgaacgatggcaaaatggtacctttataattttacttctcaacacgcacacattttttttatgacgagtttgaacttttgttctccttgtcagattttatctgaagcaagtatcatatacttctgtattagaatatggacgcaatcatatatctcctaaggtttagtgcatactctcatatttggaagtgaataccaaacgtgtatgaaatagtgcattcgatttaatctattctctcttgggcatttattcgcaaatgcaaagatttctgtaatttgatcgtagcttagattatggcaaccttggctttgtggtttgccatgtcatgtactgatatatgaatgtgatgctttaattaacgttgaaaagccatgaattatgtattcgaacgaattgattggatgtgtcctgaaatcggttcagactttcgttctttgggtactggcgtgagacggggaaaaagacgctgaagacatcaagcataacatggagttgataaaacatcgtcgactgaatcatgatttgtagtttttttggattgccagatttttttcagtgttcaacaaattttcactcaataattatttaatatattttcacttaatataatttgaaattgatatatagcatttcccgttgcaacgcacgggcaccttactagttccatatgaatttcgtagggtcctcgtacgtatagtcctgatcctttgtttcaaagttttctgtaaaattcaaattcttcgtatttcctatgctactaaaaattaaaatgggcctcagaggatacgttagtcagcacgaggaaattgcaccaagaatcgtcgcagtttagttaatggaagattaacctccgggcccctatatcatcgtcgattagttgtgttaaaacagctgaaaaattaagaggattctatgaacaagttatattcatgattatgtaattacagacttaaaaagacagcaccactacatcaggggatgataaatccagaagcagaaattggccatcggcatgcccattttcttttcttttttaaggttcggcatgcctttataagtttgtataattgtatataggccatacaagcatcaattgtttgcaagattgcgaaagagattaagaaatgagaaaatgagcaaatccctgaagacatcagcatcagtaaacatttctgtagccatctcataaattattacttttatcaaggccacaaagtctgacagggtgttgcattacaaagctattatttttctgtactccctactagctcctgcaatgcccacaatgaacaacggcttgccagcttaatctgactcagaacaacatcatcaaggggataactgtgatgcagatgatggccaaggttgcaattattgatccctgatcaaatgctttccctaaacccccaaccctggtgaagtgctgaaaagcgaggtacccagccaatgccaaagacagtgctgcaccaccttgagttcccctgtgcacaggaaatgggaattggagcatgagcacaagaacttttgaaaaaagtaagatcttacggagtagttccctgtcaacagtgataaaaatgatacatatgttcatactgatattcatatactgtaatatgattgctataaattattacttttgtccgcgctacaggcaaagactaaaatttcttatgttaaatgtcattttgaaccttttgaaattgtttgtataggctgcagatattatttccagaacagggagagtgttccacacctcagattcatcaactggtaaggagcaacactcacgagcagcatagttgacaatggaagctccagctcacctatgacaaagcataaacatctgaattcaggctgaatgagggcacttcaactgaagttgttttcagcaggaaaatgttaatgatgaatagccttacaatattgaactttttattgttactctacctggaatggagaagaacaaacgcaccaaaagagcaagaaaagcagtccactgaccatagtcactcctacatttgttgatcaaagaattaagtaggactcaagagagtaccttgttttaaaccgaacaagcatttactagatgttgttaatgaaggaacataataggtattaaacaattatttgcacggaatagcgatgccttacttgatccatgagattacactgcaaggtgctagcagagcaaacagtggcacaaggaaagatttgtgtatggctgtgcctttagcaagcaatagcactctggaaaagacaaaaagggggtaaatgatcaaataataatcagagcgtactgggaatttacagtgcagttatcacgcaatcccaagtattaaatgataaaattaaacagtagacaattataatgagattgtatttgtgctaacttgattttaaaatggttatcaatcctcaagttgcatacatatatacataatttgggaggctatattcttttagcttattttttacatgggagattatacgtgttaatttgatagtccatttcaagattatgtctctgtttgtgccctgtccttcctcaaggttcaacaatcaacatcgtcacggtcagacaacaaaatcaagataggtttgcgcatgtccctatcgagtgacagctagaagcacatgaactaacacttgcacaatcattcacagttctcacgggcaaaagatcgaacagatgccaaaccccaaaatcgccatgctgtacagcggatgaatcgcatcgcattatccactattccactaccattagacgaaagtatgagaaacagaggcactcacgcggtggccccggcggagacccattgcatcgtccgcgcgctcaggtgcgccgacgagtggcacacggcggcgccaccccggcgaccgctcgccgcctgtcccgcccccagcagcggctgcggcttcagcggcagcgaggcgcatcccctgcacatcatccatcaccacaacaccgtcagtacgaacaaatccaccgcattaacccggacagatagccgcctcacctgagcgcgcccgtccgcagagcggcggcggcgggggagcccgccgcccgcaccgcagactgccgcagcggcggcagcacgggcggcgccgccgtcgggaccgcgaggcgcagcgagatggacatcctcttctcgaatccgaaagaagaagaagaagcagaagcagctgagctttcgcgaattgtgaaggtgtttttgtctccgcgtgtgagtgacgaactggacggcgaggtgagctgctgctgttattgaagccgtgggcacggcccaccgtgaccgtccacgtgtccgggcgggtgggcggcgacggcccacgagaggcctcactttcccgtcgcgggggccgaggcggatgggcaagcgtgcgcgccgggttcgagggtggtgggggtctcgtttttggatctgggcttgcttttctcgcggctgatgactcggcgagatgagatgatcgcgtaacggcgacggcgacgtggcggacaggccagcaggaggaggaggaggcgaggcgagcgccagcggcaacttctcgtgatttctctcggattttccctctttttctcgaagaaatctgcggggtttttgggctgaaccgtaacgcaacgacgctgcattcggcccatgatgcggtgggcgcgatgggctggaatagggttgccacgaacgggttgtattgggccggaccgtatgcttcccgctgggccgagatccggcgcgcgggcctccgctgctgccttcgaagcaagagggagggagatgtggggcggaggcctgtcgccggtaggcttgggccggaggtaccgatcgtcatcccttttagtgttccaccatatatatatctcttgtaagccgccgtgcggcgttgtaacctcacccttgatatagtgaatatattttgctggctggcgcccgtggttttttctctcatgttttgggagggttttcacgttaaatctagtgtcttatacgattaatctattgttttttatcgtttgtttgtctatcactttctaacatttttatcatacctcgttaatatgtgggctccatctacagaaactgctttcaaaaccaccaagaagataatttgtacccgtttttcaaagatgggaactgtgttatatccgattttacggttggatcaagataatgaatgagggatgcaaagtagacttaatccaaaccgtaccaagggccgtgcgattcgtgtcttttccggctgggcctagatgagagggagagactgctggctcgtgtagatcatcgagacgggtcatcacgtgtacccgtgttttttttatgcacgcattaattacaacgtgattgatgattgtaatctgctcattaatatacagacagggattttcccggtcttgaaacggcatgccaatttgtagggttctctaaattttgcagcgagtaattaatgagattgcacatacaattaattctttatgttttgtataaagttggggtcaaacaattcaaacttcacgagtaaatttcaccaaactatggatattttgacaaacctatcgtagaacaacatatttagcactaaattatcacgaagctacatatttaaggtcaatttatcataaaaacccccataaaaaaatatcatacaactatatatatttaaggccaaaagttataaaaaaaatacatgtggttttggttgaagtatatgtagttttatgaaatttacttaaactttgaatactataaactttaaaatagtcgtcttggaaacaccggcagaatgatgtacatattagactttaaaatacgttaataaaatccaataattactttttaaatgttaataataaaatatatagttgatatatattttgaaaaccttgtagttatcgaaaacaacaacaattatagaattgagggagtatgtaaggattcaacaatctttaacttgttactggtatattatacactacatgagaaaacattttctcgctaacacgatatcatggagtagcaccttgtttaagttttaaagacatgtagtcaacatggagaattttgaaagcttttagcaagcccaactaaaatcattgcattataaggggtttttttttcatgggtggccttagtcgaaccatatccatgaaccataggatgcaacactagctagccctagatatgcccattcgaaacaaacactactatctcattgcacgatatggaagtatagtaccatatattcctcttacacactataatcgcaagatgcctctttctcataaaccaataatggagatgaaaacgacgtcctcttctctttctcatgaatagtgacatcaataatatctcagtgttcacgtatatgctagaactaaaagccacagaatgagtcaaagaccatatagaaaacatgcctccttggtggcggcagcaagaggatgttgcttctttgcacataaggataacacatatcatcgatctcatcagtccagtttagtatcatcaataagtcggtgctaatgtatctcaacaacaagtttacttcattgtcttcgcgaactcatgttatatctcctcctttttataaagccaatgcatctctaggtttgaaaaagaactaaaatttcacctcacatttaattaaaaaaaatcaagtaataaagttaaaacatcatattcgatatgaagttgagatctagcaaatcattttatataaatcgttatgcaggatttctttttaatcatacgagaaataggatcttgcatagcctgatcaatttaggggtagcactgattaatatttttccggattttaatacttcctggtttgatttagtttttttatccacaaggctacaaatgttggtatgttcggcaatcggtcatgtggctacggctgttgcagcctctagctgtcttgtgcacatggcactattctgggtggctgcaggctacaacgtaaccgtaacccaggcgtttgaacaggtacgctacctagttactcaccgcacttggtttctataataaacaatatggtggacatagatgccatttatactcatgaaaatcaacaaatttatttcttaatacattatagtttgctttttttagttaaactatgaaaaaacacttgtgcattgcaacggatgaagactattttgatattagtaaaagtatatgtttttttttaattttgatagtacttatgtctaatttggaactcttattaagatgatggccatatgctgtatgcttgctttcttatgccctgtcaagaattataaagcaattaggagtctgtctctcatcccgagttagcatgcgagtattttttaaatgatttcttatacaactccttatgtatttcaaaaaatggatgaacttagaaaccgactcaaatacgtacagacgacgtaccaaaatatcggtgaaaacatcttcaatttttacaacaactaatttttttaaaatcttattattgttatacggtttagttaggataaaattcactgtaggaattcgcttggatttttttttttagaaaatcatgagctgcaattaggagttcgactttcatctcaagttagcatgcgagttcttttaaagagatttcttatacgacttttttttatttctagaagcaaacaaacttaaaattcgactcaaatatgaatatgtatttccaaaagcgaacgaacttaaaaaccaactcaaatacgaatgacgtatcaaaatagaatcttgcatagctcgatcaatttaggggtagcactgattaagtttttttttctcttcagattttaacacttattgtcttgatttagttttttttattcacgaggctacaaatgttgggtctgtccggcaatcggtcatgcggctacagctgttgcagcctctagctatcttgtacacatggcactattctgggtggctgcgggctacaacgcagccgtaacccaggtgtctgaacaggaccgcaacctacttccttaccacacttggtttctataacaaacaatatgatgggcatagataccatttatacccataaaaaatcaacaagcttatttcttaatacgttattatagtttacattttttttataaatatataattcaaaaaatagaagttatccgaaaatacatattaatacagagtccatgagtaaatttgcagatttggaggtgaccttatcaaggcaaatttcagtttttgtgtaagttactgctaaacacggaaggaaaaagtaaagcccccactatttattcctcctccacaatccatccatccatccatccaaccccagctatataaagctcggcgcagcggagggaggggaggaagggttttggaattagaagccgccgttgcgtgggagagcaaagtggaagcagccgaaaccgaaactagccgccgccgccgccttcgcctccgccgcgccgcgccgcaccactcgcccccaaggtccctaggggtttcccgcgcgcggagtgtggggaggaggaggaggaggaggaggaggaggaggcgggggggatctctccggcggcgaggatgaccggcggcggcgcggggggaggaggaggaggagggaaggggggcgcggcggcgggccccgtcccggcggcgtcgaggaagctggtgcagagcctgaaggagatcgtgaaccgcccggaggcggagatctacgcggcgctgcgcgattgcggcatggaccccgacgaggcggtcagccgcctcctctcccaaggtctccgccccctctctctctcgcgcgccctctcccaccccgcgatttcgcgcttgtttcgatgccccctcgcggattcttccctgatgcgcccgcgcctcgagttctcgtcgccgttagggttctagaagattcttacaaccgcgtgcccctctttccgattggggctattcgttacttgccgcgctctgagcgtgcgcaccacggatgggatgagtgggaaggatgcgcctattattttttcttcatgagagtcctgccgatttgtcatgatttatccgtttatgattgtagcatttgatagatttggccctttggggttcgttgaatccgttgtacatttgtagggtttctgtttagggttcctgctaaatgttaacagtggctagcgttttcctattctggagcaggggttaggtcgatcctgcttgttatttataggaatcgatctccttttgtttcttgtctttcggttgtaggaaggagttgagatttttgggaggaaagtcaaacagatgaatactgaacttttttctgaactttgaaagaaacagctatatctttggtaggattatgtaggatagaaggagtggaacgagttcattacttgagatttgctgtttggatcaatttactgacctgtctaggtaaatacaccatgctaaagttagttgttggattggaaaagagatggttgtggtaattttagttaccaggcttgaaaagagtggaatctttagattgggaaaggagatggaccctctggcttctcatattggctatgtttgaaaagtgggaacacattactgttgcttccaaaatggctatttgcattacaatacttgtgaaattaggacttgctgtttctgcagggtggtggttgagttttgtgttcattctcggggacagttcgataggtgttttagtgccttcgtttttgctcttgtcgctctttcctgtgtcatatcttttcataatttataaagaagaatgtgtgcatctctgattgttctatagaaacattccatcatcagtttttaggatgtgttgacaataataacatatggacatggggggaagtgtaactatcatatgtatatgatgaaaggggctattagatgatatttactgaatttcattggtcatatagtggtagtaagcaagaaactcaggtccacctttagcttatttatatcgtagtgtgccatttgaactcgtggctttatttctgtaggataagtttctgagcttgcagtgatttgtggcattagtcttgggctcttctctttgcaaggaggctttttattaattgaaactccatgcattttctttgatctgggaagttgaagaaagattaactgtcagacatagttggtagcctatctattccatctatgatttttccatggcatttttcttggtttgacttttacaacatgttacaagaggcattgtgtatttgtgttataactttcctgaacattgttagtctcctactccccttgactccttggtaatctattgctgctaagtttatgagggatgatggatgagccaggagtgggaattgccaccttaatatacctcatctgtgtagcatgtgaaagtcataatacagcttcctgaaatggcatagaggtgtcatttgggttttatgactactttcttgttcagagtttatatgctgtactgttaccacatattgaatatcttattttctgcacacatacttaatgaatgttcgaggaggcaagtgttaggttgttttgtcaaccttttctaaatttcttctcatattgtcatgccaattttatttttgttcaacattattttttgtatgcctttgttgatcatatcatccagttatttttagtcagtttaaactgtgatctgacaatgcaccccaagataaatcagttatatttatttcagttgctcttgcagttatgttaaaattgatatcttatgtaccgcttttttcagatacttttcaagaggtaaagagcaagcgcgataagaaaaaagaggtgtgccccacatcttgcattgctcgccttattttttgaccagcactcagctttgattcggttgccctatatttattttcatcatcaatagcataaagaaaacattttattcatgtaacaattagtttttgtctgattcccctgcgtctaaattaagcatatggaactaatcttttggagttttggttattttgaaaattctctagccttgatgaacttaccattatagtcatgggcactttcataggttaaagagattcctgagccaagatctcgagcggcaagtaatgctgccagtcgaggtgtaagaggcggtgcagatcgaggcgggcgaaacagttcttttcactctagctccattggtaataggaaaaaccaccatcagtatcttcaaggttatcattggttgtaatttcttttcacattttttttttgttcatttcaatattcagacaatgtggcttcaaggtcaatctcagggcctggtatgacatcaaccaattccactcagaagcaaacaattccaaggtaagagagcttcccttttgttgcatatattttaagaagggcttgtacagcaggtctgcctttttagaaggcataccatttttctagttgtcttttctctggagcctttatctgtttgcatttgatatgatccttttgcattattgttaattctgctgttatgtgtaaaatttcatgcaaacagcataggtttttttacaaacaattctcttgttagatgactatgactcaatagttcatatagttacatataattgttatctgagactatcgtttgtaatgttgtgttagattcaaatgaaccatatggaatatggatgaacttggatgatgcatcccacatgaaagttaatgcatactacaaattttatctgatgcgttgatgatttcataacgccttcttatttcactctggggaattcatgctcttttttatctgctgtagttccttggtaaacaaaagtgtggttgctgatggaccgtcggtacctgcacaatcatcatctgggtttcagcacggttggtctgggacaccaggtcagttgtcaatggccgatattgtgaaaatgggcaggcctcaggtaaagcagtcctctagcaagcctgcggttactgcagacaaaggatatactggacaatacccatctttgcccagtactgtaaaccagaatttgaaacaatctgctagcacagtttcaccaacaaatcctgaccaggggttacattctgctcaagattctattcatcccaaggatcacaaccactcagcagctgtcaacaagcaggcatatgataatgattggcttccacaggacgagccaccaccaggaaatcaatcagccttgcctgagacatccggtgaccaatcattatatgagtcatcgctacagtcatctacactggttgctggtgtgattaacccccatgaaaattctcatttggatgagaacagatcagctgcattttcttccgagagacacttggaacatcatggaggcgattctgaatatgatgatggactgttgcaagaatcgagtacctatctgcctcagaagaattctcatgcagaagatgaaggtgagtgtagatatgagtttatgaatttgcttaactttagcatctccatattctgtcctgctggaataacctggatctttggtgttatgagcttattgcattcgttagcattggaaaaggcagcagacaatttattagtaaatacttttggtattccttccagaatgccattgatacttgcgtaggtgtgagatgcaacttacaccctgtaattgacgttatcaattcctatgttaatctgggtatgttgaatgcatctctgttatgatagggtttagggaggcagttgttgcaactggcaagtaatcaactttactgaacaaaattgatatatgatggttcctgcatctttttagtagtagaataccagtcttcagatttctgatgtcatgctgttactttcttgatgaataatgaactttagactgtcgtgttatccagtattaaaagttctgtaaggcaacaacaggtcatgcagtttattgtgaataggttttacagcatatgttcctttctggttgcttgttcttttcctggacgctgttgcattctggctttggctgtgcatgacctgcatgtgaatactgatttctttttactattcttgcagttgagggctccaattctgatgtagcgttagccactgaaaacttccagggtctaagcctacataatgaagagttagttccaacaaaattagctgaagataaccctgcagttataattcctgatcacctgcaagttaccggctcagactgtgtcactttgagctttggcagttttgaatctggagcattttctgggcttctccctgttccatcaaggagcgctgatgataacaatgtggagttgcctgttatagaggaatctgtacctctagatcaaattgattcaaggttaattaagtttgttcctgccgtctttatttcactccacatattgcttgtgacatgactggaatgccatttttttaatcttgcagagatcaagactattatgatagtgccgcagttaattcgtcaggaaatgagaaccttgatactatcataggaactaacatggagaacattgatgtaccttctgtttcacagcctgatgtcctgagacaggaagtgcttgatcattccggtcttcaatataacctaccatctgattcaagtgctgcatatgcaaacactacacagccaagtacaatggagtcctcacaaggaaacaaccaggcgcacactctttcccatctttcaaacttactggtaaattgttttctttttcctataatcttcacttttcatcattcatgctgaattgctaacagtactaagtagctttagccaaactatgatcttgctacatacagtaagataactagttttaccttgattggaaaagagccaaataaaaaggtgccatatagacccattcttttgctcataactcttgtctcaagatattgaccacagatgtaaatcattgcttcattctggaatgtccagaataacattgggagctggtctttctggataccagtttttctgtcttctgcatatgcatgttattcaagtcagctaattgtgctcctgcataattcttattgaactcgtttattccccagcaagcaaattcattacacaacagcctattggggtcaaacattgcacctcttcgggacttggacttcagtttatcacctttgctagcagcacaatcaatgacaaaatataactcagctgcaccaactactactggaccagcaatctccatgcaagaggtaatttaactacgctggttcactttctcatggtgttttctctggattcatatttcatagaagtataactttaggaagaaaaaggctccacatcctttctttatttgaaagatgaatttacaagggtgtgatggtgttggaattttttattttgtgtgcatatacagttaatcattcagcaacaagtaatctctagttctctaattttcttcacacacatgtacatatttgtttcagactctgaagccaggagttttctccaacgctcaatctacccaaaatcttccaagtactagtatagcaacggggcctcctctccctcagcaattagtccacccttactctcagcctactgtaccactggcgccttttgcgaatatgattggttatccgtatttggcacagaactaccctgctgcttacctaccatcagctgccttccagcaagcatactcgagtaatggaccattccatcagtctgctgctgctgctgtaccaggagctatgaagtacaatatgaatgtgccgcaattcaagaacaacctatcggctacaagcttacaacagcaaccttcttcagtgatctctggttatggaggatttggaagctctagtaatcttcctggaaatttcactcttaatcagaatgctgcctctgcatcaacaaatcttgggtttgacgaagcattgagcacgccatacaaagatcccagccaatatatggccctccagcaggtaacaattgcaagcagcccttgtgtttctttggtaatttatatgctatataataattctgataggcacggctcggttcgaaggttttggatgagtgcttggcttaccggaaaaaacacttaattatcatataattaattaagtactccatttattattacaaatttgaaaaatggatttatttgtattttctaagaaaattctgtatagaatatgctttttcaaaaatcatactccctccatttcatattacaagttactttgggtttgttctacgtcaaaccttttcaagtttgaccaagtttatagaataatatagaaacatttcttacacatatactattaaaaaacaatcaatgatggatttaatgaaagtagtagctatataatctgaaaagaatgggacattagtcacaagttactttgggtattcctttcagggtgacaattctgcaatgtggcttcatggtgctggttcaagagcaacgtcggcgcttccaccgagtcacttctatggcttccagggacagagtcagcagggtggctttcgtcaggcgcagcaaccgcagcagcactcgcaattcggtggccatgggtatccagctttctaccattctcaaagccaagagcaccaccagaacccggccgagggaggcctgaacggtttccagaatgcccaatcacagccgtctcaccaggggtggcagcagcacaccggctactgaggcctttaccctttgttatagttggggttaagttgcttgccgaccatggcgtgcgtgtatcctgaccagctgcagggtttaagcagctcggactagctgagcctgtgcctcgagcgctgaggatggagggtccacgccattcaaccaacagtttcgagagtgtttttaacatgttcgcgtgtgttcgtcagacaagaatgatttgtgctttgttttgatagccgagttattatatgtgcccaagtgcagtcttccttgtaactcttcttgagacctaacaggtcaccgttctgatttctaagattagtatctatcatcttgacctttgctgatgctactttctgattatcacttctggagctgcgtcgatgctttggcttttgctattgcggcaacgcgttcggtgctgctgccggcggtggctgctgctgctgggcggcggtgttggcgatcacgaagtgcagagcactgttggggtctggccggaacgcccacacggcgacgtcgtccttcacctggacgccgcggtcgacgagccttgtggtttctttttgccggattatggtgtggcaattggagagcctcctggtcaactccatggccatcacgtcgagcggggatgcacggtagacgaccacgcgcacggcgagcccggggctcttctcccccttctccctcggctttggttctggcgatttctttttcttgtgcaagaactcctccaccagcttggcggcctcgcgctccgccgctgagaggagcggacagaggcggaggctggcggcggcttgcgggatgaggaagcggctctgctgcgccgacaggtcggaagcctccactcgcttcctgcagatgaagtgcagcggcaggtcgccgcgtaggcctagtagcggcagcagctcgccgcgtatccacgccggcggcgggggagcggcatcgtcatcatctactctttgcggcacggcggcgcgagggacgtgcgccgccaccgcctgcaacgggacggcgtcgatgggctccgctgcaatcggtgcagccgcgtcgatgagcatgggctcccccgcggcggacacttccgccgtggtaccggatgcgctcgtggaatttccaacggcggcggcgctgttcgaggtcgttatcgtcgtcgtctggggggctaattgggcggcagcgtcgccggggctgacggacgacggcgagagcgacaagaagccaggagccacctcttccctgaacctcgcgagcgacgtcgtgacagtcgcccacgactgcaccttctttgcgtccttacgcgctactatcgaactctttcgcttcatagcgttgagctactaataatttaacttgggtttaatctcctctaatcccaaactatttttttaataatggccaatcaaagagtaattacagttccgattcgacttaggctcgcgtcttttccgacttgtagtcggatgctgcgtccgtgctatgttctgtttgagcccggctagtcgtggaactggcccatgggcaaggcggacacagcggcgggagggacgtgcgccgccaccgcctgcaccgagacggggtcgacgggctccgccgcgtcgacgagcatgggcgccaccgcggcgggcggcgggcggcaggcactccttccgccacgctgccggacgcgctcgaggaaattccgacggcggcggcgttgttcgaggtcatcgtcgccgtcttgggggctaattgggcggcatcgcgggggctaacgctaacggacggcggcgagagcgacaggagccacctctttggggtccgtgctagtcgacacaggcacacagcccacgacaggaaatcagaatagctcgtcaatggggtcgccgccgccaccacgctgctgcgcagtcctaacgtcgcgcccaccatggttggcagttgctcgaccggcggctattcggtaatcgccggtcgctatcgtgcccgtgtcgtgccttttctaggcgatgtcgtgctgagtcgtcgctagtcgttacatgcgcttgtcgttgtcgtgttggcacgttggcccggatagcagcccaaacacgacatggctagacgacccatatctaaatgggctgtgttattcctagcccgttaactgtacatgcgtcgtgctccagcaggcacggagagaccgagcatagttgacaacctattagtgcaaaggaacttcgctgtcagttatgtgaacaaagatctttttttttttatgaaatgcttgttaaacccaagcatttagcactatcagaaagctcctcttacctttgctaaaagtaattagtccgcagtcactttcatcgcccaggattccgcttaacaaaaggaagcaagctgcaatggcgtgtgaagagtttctcaaagatgataagtttgtgggcgacaaagagagagataagtcaagggctaaggaacagctagttaggttgagtgcttggcaattgacagtttgacattattcgtagcctctgcttgtctgcaataagccaataacaacagcatcatgagagaaaaaaattaccattccaacgaacacagcgaaaaacagcatgcaagagagcgtttcctttaagcaaactgtgaagttgacattgtgcaatagagactgaatctgatccagcccttcaaaacttcgatatgtctaacttgatgttagtccttgagaattgagataatcagttgttcatagtttttatatgcatacgaaagatgcccagagcagctacaagttgacttccacgagcctttctttttcataattcattatgtaattactcgtaacattgttcagctggtgacatgcgatgcacaattaagaaaaccatgagaccacttctcctcctaggctttttctagttagctatataagaatattcagagacagcgaaactgctatgatctgtacatcttatctcctcctctttctgagacgaataattaatcgatcaattagtggatggatgctctcgcttaatctgctctctctcgctgagttcacaccgcgacggacggctggcccaccagatacacgtgagtacgaccccgcgttttttggcgtgcacgcgacggggtgcgtggagcgagcgagatcccccagcttactagcttcggtagcccgcggcgagcggcaacgcatcgcttcgcgcacacgcaatccctaccactccttttcgtcggcggatgcaagcggcagagaaggtgaggtacactgccgctgaaaaccgggcccagatatgatttgggcccacatgtcagcctgtggtgacagtgagtgctttggactggggcctactgcgtcgagagctacacgtgtcaagtgaggagattccacgaggtggccatgcaagcgatctactctagctacgtggaggtgttacgcatctgaattcgtaggaaaggcttcacttgcaaatcattgctactcctgctttcaatacagtactactgctgctggtaaatgcagatttgatattggaaatggcctattggcttgtatttaaatcttaagcattttcttaacaggatgtactgacttaatcatcaatgcagcatgttgtttatgaaaaaaatattgctatatttttgtagctagttgtttctgtgaaggtgaaaatctgagcagggaatatctcggtgaaggaagcaaaaacctcatgctctgaatgacccattttctttgacagagcccttgtttagtttctaactttttcttcaaactttcaactttttcatcacatcaaaactttcctatacacataaacttttaacttttccgttgtatcgttccaatttcaaccaaactttcaattttaacgtgaattgaacacaccctctgaatgaccattttaatagttaatgtatcatgtaatgagatattccgaccctctaaacgcaaagcacgtggaaaaactgcaactaaccattctgaaaaaaagaaaaaaattttcataggagtactagtttaataaggctcatgaactttgtggattaacatcccaatccaccatgcaatgggtccactctcgacaaataaacaattgagacgaagcaaacaaaaactttatgaacaagtggataatactataatccttcctccagggctccaactcgatatacttgccaaatactccgtatatacaatttccttgtatttaatgtacttgcaaaaaattaatgaaacctcgttacttcaaagcaaagaaaccatcggattcctaatcaggtacagaagaaatacgaacaaaaatcaattagtaaatcgcgaaaaagcgacgtcctaactgagtcaggtacgtactcctcttgcccccacgcaggccacttctccgggtaaatatagcagtttcccaccccactcaccccgatccaacggctgagccgcagccccaggaggatcggacggttggcagcgcgcgcacgcctcctcgcctcgctttatatgcacgcgcggtcgcctccaccgcccgtagtgctcggcacgtcggttgttgctgttgctgctgctgctcctcccgttttccggtgagctctcgtggactccgcttgacttgatgtgggggtgaatctgtttgataggtgggggggattttgcggtgttcgtgtgagttttggtgtggatctgcttgttcctgacttcctgtgtgtttgagggtaatctgggttatttttacgggttgtttttggtgttttttgaggagttttttggtcggatgggtggtaggtctggatggattgttttggggcagctttgatcggattttaccctgggttggataactgatcggtgtttttctgttcgtggtttggtgttgatttttcggttagtgcatcggtgttttctgtaactgctgctctccgattttgagttttattttttttctgttttccccttcagttctagcctcggttccatggctgaaccttcgatttgattttgtttttttttcttatttcgtgagttactaatcttcgatattatcgactaatttcactgtgttttaatcgtatcgtcagttagagagttgagatctaacagtcgttgtgttccagtgttttccccatttggatttttcgatctcatcactcctgacgaaaaatttctcatcgccttctgtttggtttggtttggtttttctcgcgatttgccgcagatcgcagccatgggaacccgcagcgtggccttggtgctcctcgcggccgtgctgctccaagccctcctccccgcttcggcggcggagggtttggtgcggatcgcgctgaagaagcgcccgatcgacgagaacagccgcgtcgccgcgcgactctccggcgaggaaggggcgcgccggctgggcctccgcggcgccaactcccttggcggcggcgggggtgagggcgacatcgtggcgctgaagaactacatgaacgcgcagtacttcggggagattggcgtcggcactccgccgcagaaattcaccgtcatcttcgacactggcagctccaacctctgggtgccgtcggccaagtgctacttctcggtgagtccctgttcgatgcactggtcaaggggaattctcccaagagtcttgttgcgattgcgacctgtgctaatggtggatttttttttccttgtggcgattgatgcagattgcgtgcttcttccactctcgctacaagtccggacagtcgagcacttatcagaagaatggtccgtgccttaaaactttccccaaccgtgctagtttatgttgtgactgtctgcctctctcagtttacttggatgcattgacaacatccttttttgctattactcgtatttgctctatagctggtggcatatctcatgttgaaatttgcccttttaatccaaaattggatgtaattgaaagaatcctacgtggtagttatttggattttggtgtgaaaaaaaatagccttgttagaagaagcaaaattggatttagttaaaaggatactagatggtgttatttggattttggtgcaaatcaaattaggaggttggttttattcaagttaaagtttgttttaaaaaaattctcctaaaaagatagatactagatttgcatatatgcattgaaaattacatcttcgcttggcggttatacttttagtccctctaaattgttcaatcatttatgatgaaaaggaaaatcattttatatcacaaagtatttatgatgaaaggggaaaaatattctgcatgggtttgaacaaaatacgtggattggtgtagccttaacatacttgaaaagggtatgatgttgatgtagtgcccacatggtgtcgcttgacattaaaacgatatgcagtcaggattgaggaacattgctgacaatttactatcgctgtctgtgttgaccacaataattcagatgtaccatcctatcttctaactagaaagatgcatggaagtttcttacattatttccagcacttgaaattttagtgaaatatcattaaaacataaccacttactttgctgtgatatgaaataaatgttttatttcttggaaagtggtatattcatatattcttacagtaaatttattgattttcttttcatttatttctaaattttaaccacccttttggtagcttaaggaaaattgtatgtttgacagtcctgttttctgttgtttcatccctccaggaaaaccagctgccattcagtatggcactggttcaattgctgggtttttcagcgaggatagtgttacagtaggtgatctggttgtgaaagatcaggtctgcactatatatctcggttaacttactgattattatctctgatcatattgccccaaatatttttaacattgttgcttcaccgctttaggaattcattgaagctaccaaggagccaggtcttactttcatggttgcaaaatttgatggcattcttgggcttggatttcaggaaatatccgttggagatgcagtacctgtgtggtaagacaacctgacttacgtgatctaagtttttgatttctcactgtggttcacagtagaagagaaggtgctcttttgcatatagtgattatatttgtatgaatcttccactatctctaaccacagttcatctatgcacgatacatttataatggtgaagaatcctagatattgacctgctgattaacacaataggctaccttcattctgttaaaaccacgtatctcaaaatatttggctggttgttttcttgcatatttctgttttatttttctcattatatatattttggcgcatttgtcatgataattagatttttcacgtatcatgcacataatatagcagatccatagtccctaatgatatgtataaatcacaggtataagatggtagagcaaggtcttgtcagtgagcctgttttctccttctggttcaaccgtcattctgatgaaggagaaggtggtgaaattgtgtttggaggaatggatcctagccactacaagggcaaccatacatatgttccagtctctcagaagggatattggcaggttggtcctgtttctgctaagttctgtagtgttttcgacatttgatgtaatgtttgcattgactttgtgcagtttgagatgggcgatgtcctgattggaggaaagaccacaggtactgactcttgtttttcatatccgatctgtctaaatgagaaataatcttacacatcgttacacctttgctgctatcaggattttgtgctagcggttgttcagctatagcagactctggaacatcattgcttgctggccccacagtacgtaataagcttttgtttatacttgttttttttttatcatgatggcctacatttttcacaacagtaat

SEQ ID NO: 71947 - DNA, 28583 bp, Oryza sativa
acaggctcatgagaatcagatgttggcaaaggaacttgagaacaacaactgtgagttgccggacaagtttgtggcaggtggcattattgccaaattgccaccttcttggacggactttgctacttctctaaaacacaagaggcaagagttcagtgttactgatcttattggctctttgagtgttgaggagaaggcgagggcacaggacaaccggggcaaaaagatcgagggaggttctagcgccaatttggtgcagaagaagaaccctcacgcatcccacaacaacaacaagaaagtcaaacctgacgtcaaacccaaggctacaaccaattttaagaagaaaggcaagggaaaggcaaaaggagattgctttgtgtgtggcaagcctgggcattgggccaaggattgtcctgagcgcaaggacaagaagtctgcaaacatggttattagtgagggcggaggaacattggggtatggtaaatttttacctacagttctctctgtctgtcactcacttgattggtgggttgatactggtgctaatattcatgtgtttgcggacatttccctattttcttcttatcaagttgggagaggttcctccttgttgatgggaaacggatcgcttgtggctgttcatggtgttggtacggtcgatctgaagtttacttcgggaaagatcgtgcagctgaagaacgtgcagcatgtcccttcaataaagaagaatctagttagcggctctctactgtgtagagatggttttagacttgtgtttgaatccaataaatgtgtcgtatctaaatatggaacgtttattggaaaaggttatgatagcggaggtttgtttcgcttttccttggatgatatgtgtaataaagttgtgaaccatgtaagcgatgatgatgatgagtccaatgtgtggcattcgcaactttgccatgtgaattttggttgtatgacacgcttagccaacatgagtttaattccaaaattcactttagtcaaaggctctaagtgccatacttgtgttcaaacgaaacaacctcgcaagcctcacaagtcatctgaggcgaggaagttggcaccactagaaattgttcattccaatctgtgcgaaatgaacggcgtgttgactaaagggggaaagaaatatttcatgacactgatagatgattgcactagattctgctacgtgtacctattgaaaacaaaggatgaagtattacattactttaagatctataaggctgaggtagaaaaccaactggaaaggaaaatcaaacggttaaggtctgataggggtggagagtatttttccaatgagtttacttctttctgcaaagagtatggaattattcatgagaggacgcattcctattcaccccagtcaaacggggtagccgaaagaaagaaccgcactctaactgagatggtgaatgccatgttagacactgcaggactttccaaggaatggtggggtgaggcaatattgactgcgtgtcatgtcctgaatagaattcctactaagcataaggaagtaacatcattcgaggaatgggaaaggaagaaattaaatctctctcacctgcgcacatggggctgtttggccaaggtaaatgtacctatagccaaaaagcgtaaacttggaccaaaaaccgtagattgtgtgttccttcgttatgctatccacagtgtgggatataggttcttaatagtaaattatggagtacctgacatgcgtgttggtacaattactgagtccagagatgccacatttttgagaatgaatttcctatgaaaaatgcacctagcacttctagtcaagaacctattttatcccctgagcactttgtgctgatagaacacattgatcaaacgcttgaggaaaattctgaggagaataacattgtagcaactcgaaagagtaagagacaaaggactgcaaagtcttttggagatgactacattgtatatcttgtggatgatactccaagaaccattgaagaggcatattcatctcctgacgttgactattggaaggaagcggtacgcagtgaaatggactcaattatgtctaatggtacttgggaagtcatcgagtgtccatatgggtgcaagcctgtaggatgcaaatgggttttcaagaaaaagcttaggcctgacggtacaattgaaaagtacaaggcaaggcttgtggccaagggttatacccaaaaaagaaggcgaggatttttttgacacttattcaccggttgctcgcttgaccacgattcgagtactacatgctctggcagcctctcatggtctactcgtccatcagatggatgttaagacagctttcctcaatggagagttggaggaggagatctatatggatcaaccagatgggtatgtactagaaggtcaggagggaatggtatgcaagctgttgaagtccttgtatggtctcaaacaagcgcctaagcaatggtatgagaagtttgacaatacacttacatctactggctttgttgtgaacgaagctgacaaatgtgtgtactatcgtaatggtgggggagagggagtgatcttgtgtttatatgtcaatgacatattgatctttgggaccagcctcaatgtgattgaagaggtcaaggactttctgtccaaaagctttgaaaagaaggatttgggagtggctgatgttattcttaacattaaactactgagaggagatgagggtcggattacacttgtgcaatctcactatgtggacaaggtcttgagtcgctttggttatagtgactgcaaggcagctcctactccttatgatcctagtgtgctattaaggaaaaaccgaagaatagcaagggatcaattgagatactcccagatcattggttcattgatgtacttagctagtgcaacgaggcctgacatctcatttgctgtgagcaagttgagccggtttgtttcaaatccgggagatgatcattggcatgctcttgaaagagtaatgcgctatctaaaagggacaatgagctatggaattcactatgccgggtacccaaaagtgctggagggctatagtgattcaaactggatatctgatgctgatgagataaaggccacaagtgggtatgtgttcacacttggaggtggcgctgtttcctggaagtcttgcaagcagatcatcttaacgaggtcaacaatggaaacagagctcacagctttagatactgccacagttgaggccgaatggcttcgtgagctcctgatggacttgccggtggttgaaaaaccaataccagcaatcctgatgaactgtgataatcaaacagtgattattaaagtaaacagttcgaaggacaacatgaagtcatccaggcatgttaaaagaagactgaagtctgtcagaaagcagaaaaactccagagtgatagcattggactatgtctagacggctaaaaatctagcagatcagtttaccaaggggctaccacgtaatgtgatagactgtgcatcgagggagatgggcttgagacccacttagagttgcacaatggtggaaacctgtccattgtgatcggagatcccgtgaatttagatggcgaaacaaactattgtgcaactgagagaagagaccctaaaatgagtttatcttcatgatgcacttctcttctaatctgtatagtaggatggtatacaccttaatgtgatccgagtggcttttcataaagaagagatgttggcctacagaacatcttagaaggaacacacctatatgagtccgactgctagtcacagtctatgagatctgggtgatctctagatactcatgaaaaggccaggagtatgacttatacgctccaaacagaggggatgcaaatggcagcctagtaccagttaagggtttgagtgaaacctgaatcgcacaagactgacaattcaaggcatagtccattattcagttgtgatctagtgtagctcttttcctaggtggaagttcaacttaacagtctccaccgaaacgctggtataacaaacaggatcagaatcgagagcatttcctgtgagccatgaaatttggtggggattgttagattaatggtctaggcccaattaaatcctaataaattccattggcccacattaagtgctatgggtaataataccaccttggaaatctaagtgaagaggtctcaacttaaatacagagctagtggagagtctctgttgaccggttgagatggtgctcggacaaccaggcggggcgaggcgaggcgaggtagacagctgctgctgcgctctctcgttttgtaacggacggtaataaacacggagaattgattttgtatcaatgaacgcttcggttacggaattaaacgtcgtgaattgattccgtcggttacggaattaaacgtcgtgaattgattccgtcggttacggaattaaacaccgtgaattgattccgtattaacgagcgcatcgattacgaaattaaacaccgtggttgatgactccgaacgttactctcgcgctcgcatatatatactccgcagcgaccagaaggattgacgaagttcttcctgactcttgcacttcgagttcctcctcctatgttcctgagctgcagaatccttccccggttctgttcacctgcgtgcacaggtgtacgggacgagcaggtgcctctggaactccgttcgcttgagaacttgcacgggtagacgggcgatcaagtttttgggtagcgcttcaagtgtggctgctcctgttctttgttcttcgacgacaacgttgcatcttcctctacttctgcttcaccatggcttctactggagagaacagaggagacaacatcaacggaggcaatacgaatgcctcaacatcttctgcaccattctctgggtataagattctaactttatttgattttcttcttgttatttacatgttcacaatgttatccatgggacttcaatcctatgtgaatgtcaacgatgtctatacttattttaccttaagcatgctcatatttatgtttagccttatcactagattgcttctcattgtgtatgtcatgtttattgtcttaatattttggattaaaatataccgaattatgaccaaatttccaacaggtcaaatactactgccctttttctgttgagaaatttgcttacatttgaatgtgttcaatggaattatttagtttggaaatactatcgaattattgcaatttgacaattgcttgaatttgacctgaaacagatggccaactgatgtagaccgggcctagtttaagcccgagcaggcaccaaagatttaagctgaattaatattctcgcttgctcaatcactgaattcaaaccgtaaaaattcttataaatgaccagacattaggaagtactggtaaggaagtcaggtgcatcaccattttacagctacaaaagttactcacaaaagcaggcattttagagtctcaagaaatagttcagctccttctccagacccgttctaatctacatttcgccttggctacttcctatgtctaataacacgttttttcatgcaaaatatttctatataaaaatgtttttaaaataacataaatctacttaaaaaattcaataattactccctctggttggacaaggttaaggttaagcttttataactttgaccatcaataactttaaaaatatttagtttaaagaaactagaaaaacatatatagatttgtctttcaaaacaatataataaaagtaaacatacatttatttattgtatatattattatagaaaaataaggtcaaaggtatatcttgtagaacgtgacattgctcaaagcatcaattaaaatgaaaccggagggagtaatacttaattaattctatattaatcattttcttgttttgcgtccggctaataatccgtttcaaaacccactttggaattaacgaagcctgaaattcaggcctggactgtcatcatgctcatcttttttttctctacatccttttatatgttcgatgcgaaagcatattgagtttacgcaaaccattcttgcaggacgatctcggataatggacagttcgtacgtagtagtagtacgttgggataaaatttggcaatcgaacaatcactttccagcactcgcgtctcactcaccctcacctccacattcattaatgctcgataggtgatggtactactactagaagatcccacccttgcaactgcaagatatccactgatgaccaattcatccaccactaattactcatctctacaggctcatgtcgtcgtctagcttcagttctcaagctagctagctagatactacttctacttcctatatatgtactcatatctgaatatctgatacagtagcaggcaggcgattcgtggtcgttgaagcggcgaggcatcgatcgatcgtcgccgtcgtggtcgcccaggtccagcaggctgtgctcgatcgcaattaatccatccatccaggacgtacgacggcgtcgctttcgccggtggcttgcaaaggcagcctctccggctttgatgggacccaaacgccgactcgctgtcgctgatcgttaccacctcgatcggtcgccgccgcgctctggaccaagctagctacccagccaacccttccttttgccgcgtactcgctcgcatgaatcgacctgatcttttttattttcgcaaacgcgcaaaatgatcatcagtatattagaagaaagtaaagttttaattacacaattgccgtggaacaaggacaaaaaaatggtctccaaaaccaccaaaaaccgacgatagaaaaaaattgaaaaccctgaagcgatatgatcatctgatatctccattagaagttcacgagtaattgggggagaatttaacgaaacttgatcaaagatgaatactaacaacaacctgctagcttcagtactgtgtatgcatatattgatatatgggaaacctgatcatgaacgaacggctggtgagatttgacacgcaacttgaccatttcttggttggtttggacatctcactagctagctgaactgctagatcgttcccaagaaaaaagcagatggatcgatcgatcattttgaccaaggaatatgcatgcagggcctatcaatacaagaacgtttgtacgacgttttgcaagctagtcagccagccaaattaagccttttggattcacctgcacacacgtacatgtcagacagtccgagtcggtgttaactcagtcatggagatttcgatgggtttggatgaagctgactttccttttgattcaaaggtagccatcgatcgacaccagcaagtaatagcagcttgcattggtcgacgccaattaatgaccggtgcaacggcgaccatcgcggttaattaactagctgttgagaccaagtgtcgttgagtctaagagtggattttaaactgtagatagaacgtttacacgttatttgcatgttactttgagggaatgttcactttgatgtcaaaaaaaaaccttaccaaattttggtattgccaaaattttgataggatttattatataggtgcaaactaaatgtagccacttttttgacaattttatcaaaatttgataagattaaaaatgatatcaaagtgaacatgccctagaaattaacttacctcattggcgattttgatgtaggtatacaagtcagcgagcttgatggatgcaattaagcagatggaaccggcggccgggcgtgtctcgcaagttcagttatctgcccttctgctggggcccttgaatatgctggacaacacagggttaattacgatgcgatgttcttaattagtagtttgcagctggactcatagtctcatatgcggacgtattcactggggccttaattaatgagaacttttactggtacaatatactaccagtatatactggcagtatataaaagggcatattaaaaatttgatagaaaataaaataacactttagtaattttctgttcagattgaatctaattgggagtacccggtcctggatcttatcgtgcgctaggggaggagcatactgaccgccatttgatgacgaagcacgtaatgatagcatgatttgatgatagaataacgaagaaaagacaaaattacccttcaaactttatactgcaatctaattaactaaaaaaatcaaatcaatttacaccgttagatcatatatacttgcagtatatactagcagtacattgtaccataaaagttctataattaattaattccgcttgcagtactgcactgtttccttgagcgctcaattttttgaccttcagagttcagacaacgagtctgcaaagtagcacgatctctcgctcataccaaagtaattaagcattgatctgatgacccagagagaacatatagaagcaattgagtaggagtgtgcgtgtgtgtgtgtttatgtatgaacaatgagctggagtgaggtagaacctcataaggaacataccaacaaagttcatgcatattgaaattggttgtatacacggactaatcatagcttcaattgttaggtccaaacaaatgcacttcctgcaattaattttgtctcagattttcagatatatatatatatatatatatatatatatatatatatatatatatatatatatatatatatatatatatatatatatatgacactcatatggggcaccatggtgcccgggcaccatggtatctaatgcacaaaatttttcaaattgtgagtatatacctagttataataatttgattcatacctatacttatcaacaaaacaactcaaatttaactttatttcacaatccatgattacatacctaactaattatatgtatggatgctatatacctataatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatagtgcccggacaccatggagcaccaaacaaatttactatatatatatatagtaaatttgtttggtgtatataggtgtttgttcgttgtagtactagtacatatatatggaagatacttctcaaagtatcggatgaccctccattttcatcaaacaattaattaatgaaaacaaacacatttttgtgtccccttcagtagacggtgatcatagctgtagatcaaagctagcaatctagctagcaatacctgggattgagacccagtgcagttgttaatatgacggtaactctagcagttgcaaggtagctgatggatcaaaaccagcggcccgaatcattaaaaaaaatattgttcacgatttactgtagccaattcctcatgtggcaattactttagcgtctaatgtgcaatagggtgggagagcaaatccaagccgttggctgcatcgatccaacggttataatgtgctccgactgctaaagttttagtactactacgaccgcactagatctcattccaatagctgggtaattaattattgttctataccttgatattgaagtacgtactttattgtatatgaccagggaatggattctaatttctaaaccctcaagagatgtaccctcgtttctgtcattcaatgtaaattttctttaaaaaaattgacaagatggaataatatgtatgtgatatatcacatattaattaagctagcttattattttttaaagaaaaacataacttttaagatggcatatgaaaaacaagagaatgtttgctcgagggattaaaatagtttcatgtacttcatctgcaataacagactcaagaaaccatagatgaacatgaaacagaaacgatttacagacacgcacatgcatgcctcttccctaacaacttctgaacgtactgatgatatgaaggagcaacaacaagtgtctcatcatgatcatgcatgacaaaattataatcgagctagatgcatcgcatgcatggacaatcgtgatgttgataccaagaacaatcatgcatgcatgaacatcagaagctagccctcgatcagctgctagctagctggtcccatgattataacaaacaatcaaaagtactactatgtacatactcctagtagctatcagttggagtcaattaaggaaacaagagcatgaaattaccactgctagctcatcatcagtattcagtactactactgaataatgccccccaaagtgcagtgcaagtctgcacgtacgagctcatgagaatcaggtacatgtacaacaacttctactactagtagtatactactgctgctgccgccgatgctgcatgctacaactaggctacttgctagatcatcatcatagtactacacgtaccatcgtcgtagaatgcatcgtatacagatcaatcgatcagatgttcagaaccaaaaaaaggagaaattaagttaacaagatgcaaatcactatcagagtatatcagtagccggccatccagctcgagctagtgatcatcatcatcatcatcgatcaacggtggttgttgttgttggcgtcgtcgttgtgcaagaacggcgacgggatgaacatgtcctgcaggaggccgtaatcctgcgccatgaagtgctgcatccggagaggagtagtagcagcagcagcgctccccgtcgccggcggcggcggcggcgtggtggaagcaccggtggtagaggcgatgatggcaaccaagccagcatgatcaggctgcggcatctgctgcatggcggcggcgtgcagtgatccgccgctcgccgccgccgccgccgccagctgcatctggtgctgcatggcatggagatgctgcgcatgcggcggcgccaggaggccgccgccgagcgcgtcgtgcggctgcggaggcaaacggtggccgacggcggctgcgaagtggccgggatggtggtactggaggccgccgtggtggtgcgcggcggcggcggcgccgaggaggtgcgccgtgccgcgcagcgtcgccgggatcgggtgcgtgtgcttcccctcgtaggtggtgatcaccaccgccgcgtcctggtacgaccgctccaccctcttcttcaccgggcacttctgcgtcgtgcaccggtagtagctcctgcacccatccatccatccatcacacaaacgtaagaaccctaatcaattatcaatgatccatatatatctcagctaccaaatgcattcatgattcataactaagttcttactcgttccatttcatattataaatcattttaactttttttctaattaaacttttaaaagtttgatcgagtttattatagaaaaatatagctacattaattttcaacacgaaacaaacgtattatcaaacatattaatttaaatgctagttttgatgaagctaatttggtgctatagacgttgctaaacattcctataaatttgatcaaacttaagaaaatttaattaaaaaaaattaaaacgacttataatataaaacgaagtacctgggaaatgggctgttcttgacggctttctggccgtacttgcgccaccggtagccatcctcgaggtggtcgacctcgctcttggtcatgaacgcgaaccgcggctgccgcggcctcttctcccccttccccttccccttacctctgcaaatgaaatttttttttcactcacatcaattcatccagtcatcagttcatcacacatcagctagctatgctaactaattaacagcaaggtcaattcaatgacagtactactatactacccaacaagctacatatttttggtgtgtgccatagatcgagcaagatcatgttcatactagctagcttaattagctgcaaattgagattaattatactaatcgatggatgatcagttgttggtccattcaaacatagtggctgcgtacagagggtagtagtagccgcgtaggtacgtatggacggcacggcggcgcgggcatctacacatgacgacttcagagttcacacggccatacatacatgcgtacgtatgtacggcctggtcatatattttggtaggatctactgatcaatttgtgatttaactgctagctagacaatttggaggaggggtcagggtcacatttacagatgcaacaaaaatctaggagtttaaagttgcaaggtaaattaagtttgccatgaaaacgatagatcgatgtgttcagttaaacttaaaacttggccaccaactgagattgatcgatatcgatcgatcagttgagttgataggctgaatctgcagactggtgtgatatattatcctaattaaatgcaattcatatattgtgtgtgtgtgtgtcgtaatataatgcttgcgaactaagaacgcaccatgcatatctcaaagagatatcagatgaagacaagaggaagagatcaagaaagtgatgcaaagactagcaaaaggcgtgagcaaaaaaacattgatcaacttttttctgaaagaaaaaaactacctaacgatcaagctcttttcgttttgtattaattgctcggcgagcatgtgctagctagtgagaaaccctagcgcatcgagttcacacgtccttgaccgaaaccaaaagaggagccaaaatgcacacatcttgaccaaaccaaagaggaaataaattaaaacgtgaagaaaattaaacatgctcaaatctggatacagtcattcaggaaacagacggaagaaaaatcaacatgaacacaaagagaaaacctgttcctgattattaatctttttttgtcacattaatgtcaccaatagcaccagtcagaacagaaaatcaaagacttcgccaaatcaacctttctaaagctagcaaaatgaatttcaagatacagttcaagatgggatgaatttcaagatccagttcaagatgggatgggatgagatgagatgagatgaaagaactcaccctttcttgttcttgtcttctccatcgccatcccccttggtcgtcgacgatccttccttgccgtcgtcgtcgccgccgtccccctcctcctccttcttgcacttcccggccgactcctcgtcccctccggcgccgccgccgacgccgcacgcctcgctcgacgtcgacgacaccgacatgctgttcggagtcatcggccccgccaccgccgccgccgccgcagcagcagaagcaccacccccagggaacaacccgacgccgtccaccaccagctccctcttcacctcctccagaggcgccacgtcgtcgtcgaactccccggcgaatgcctcgtagtccagcggcggcgtcgtcggcgcgctctcctgcatcaggtggtggtggtagtcgatgaacgaccacggctgctgctgctgcagcatccccggcatggcgccgttcggcggccgctcagcgaacagcgacgccagctcgtcgtggaacgggaagccctcgccgccgccgccgccgcccgacatggagctaattaagcaaactagctagctagctagctcagatcgagctaagctttgctccaaattaaactgatcgaaatcaatcgtgcaagcaagcaagcaagctagccctcttctccttggcgtttgctcacatatagatcgtacttgctagctagctagctagctactggctagtggtgtggtgatgcagtgaagagaaggagatgagaggtagacgacgagagagagatagagaggggaagaagaaagggagaggtgtgtatttgtgtgtaagcgagctagcacaagctgaagctagctagtgtgatcatgtgtggggatagctaggtggttgggtgagaggccaagggcttagttgaaaattcctagttaatcacgggctttgtcgcataattgaaattaacaaaaattaattgatttgatttgctcttgtcatgtgtactatacgccactgtactttgcatgcgcaacactagtttttctacccttagatcgagttagtattcggtcgcaggttttaccttctagtaacatcttgttgtttgctttaccaattctcaatgcttcatgcatttctctatattatcaaccaaacttttgctcttgtttaatctcttatacaaaaaaatgagaagaagaaaaaaagtgagtacaagaccatgtcaaggcttgtgagttactttacctttcactaactttctccacagctttctaattgcagagtcgtggatttattaaatgacatttggaacagtagtaataataaaaattattagggctcaaacaatgtcctaattgcgaacatggtgggaatagctagaaggggagtggtccaaggtcgtatagggtttagtcagcgacggccaccggaggcagccggtcaggtgagtcaacaggacggggctgcgtcaaaccattcaaaccattcaaacccatccctcaccggcacgtgtccgtgtcgctttgaccgggcccactcgcgtgaccgggcccaccgtcgatgggccagcttgatgacgttagcatgacgctgccgatgcctcctcgttccttctccgtccgatggcgatccgacggctgtggcgtcccgacggtggaaaagcgagaggccgtacgtgtcaaagggaaaaaaaacggcgtgcccaataaatcgtaaccgaaatttgcaagccaggaattcatcggctggcacgtattaaatgtgactgattttacttgttaatcacatttagtaaaaaaggacactactgctttacagctttctttttttacatgtgtctaatcttcagatttacagctttttttttaaccacgattacatgtgttgcacggaaaaatgcgaccaaatgtaagttgtaattttaaatctcgatcggataatgattcttcatcatgtaaagtggtagcctgtgtcaaaaagaaatgtttcattaattacctctcctaaacctgcacgtaactactactccgtagtaatttgtcagaaaaggcgtttcacctgacgaggcaggcaggccgggccgggccggtgcgacgacggctcacgctacagcgagacatgtcgcgtacgcgtcgtgtcacggtgcgaccgagtccgtgtccgggtcgcgaccgaggttggtcgcgggcgggccgaccacagcctggctcggcgtacgtggccccagatccggccgtccatccatccccccgccgcggaaaggaacccgggaaattttgacttagcttgggggtatagcgaccgatcgagctgttgatttcgctgccgttttcttcttttccggcaaaaaaagtttcggcttaattagtttggtccaacctgcggccgcgacgacgacggcgatgtcactgagatagatgccggtcagctagctccagcgccttcaggtttgtatcccatactgatcgagcagctaggatcgcccgatgaatttgtcatgtgttttctctcctatcaaagttttattagaagtatctcaaatgttttaaacgaaccggtactagatgtgttaatttcattgaataaaacatgagtaaaaagtttggtgaaaggaaggttgtaaacggagatgaaaatttcctaccaagcgtttctgattctagcgatatattgaatttatgtttataagtttttaaaacgttgtattgcaatggtcactaaatagttagatgggtggaaatatttaatttctactcaactgagaatcattttcatagagatgctaccgtttctaactgttttcgttcctcgtatattcataaaaaaaatttgaaacaaaaccaaagttgttttggaggaattatggtgaatgaatcgaatgtgggtactaggtaggtcataattcatacctatttatcacaaagtagttttatctacctgatgaattcggagtttttggtaaggtgaagaagaagaagaagaagaagaaatattcttcatcagtctacaagtggtcctgttggtgctgcggagattccttcgcgtagctagcacaacggattagctataatagaattttatcattctatatttttcagttcagattaacatatgacgtgaatttgactaaaatgacgcctagcttcagtttaagcaagactgctcactagctagccaagtacgatcagcatatataatcgtgatcaggtctatgggttggttggatggacagtttttataatgaaatcgagttgaatcgcaacgaccaaaccgaactgtctctgatgcagctgagctagcgatcttcatgcttgcaagttgcaacagtattccactctcaacaaccatcaataatgctatcgagtctgaaaacctgaacattgcaagaacctgcgaaatatatatataactggaatataaatattttctgcgttcgtacaggcatattttatcttctttatatatgttgattcgttgaaaagttgaatcccatcaacgtttggtccagatggaaatgctgcattcatcagtcaagggtgtatctctaccgttggcacgtcagaacaaccacaatattttcagtttttcagtcactagtagcatcgcatagcatatgcaactgaaaattcagagttcagacttgacaccaacacattgctgaaacagaaagacagatttaatttacaagtgctagaacagtagcactacacaatgggataggaatctttttgcagagtttattaatttggcggttgcttgtcattactgtcatcagttaaactaattaactagcgctagtaggaagctgccaaaccaaagtcaaatgcaaatctgaagatgtattggagaaagattagaaaacgtaccgatcgatatccacaaacaaggaggagattaattacctttatttctagtccaaataaatctcccatctgatgcgacctggtaataacaagcaagcaaaacaacatgcagttaatcagccagcatccaactgctaatctacaaaaaagcactgtctttttgtgactaatttagctagcatgctaacctcagtacaaacatctttttgcttagttaatccagtaagagacactgtgccgcgtgaggctcattggtttgacttgtgccaaagtcccaataggttcgtacataattatggattagaataagtttggtccaactccttgctcgattaagttaggacggtgtctacacctaatccgcaccattacggcaacaagcatcaagcaccgtcctcctagctagatatttcgtaattttttatttctctctagtttgccctaccattcacgtgaatttccatgcatctacatatgaacactcatcaatcatttttatccccacaagtttagctctgtactatacagagaatagtgtgcagtcattgcttcgtctgaaataattttggtgcttattcgcaagaggatttttatagttcttgagaaagtatcttgagatacctaaattttacattaaaattttggtatcttgagatacttagtaatttgagatactaaattttacattagaaaatatggtacctctaaatactttttcaagtacggtaaaattaccctattcacaaagaatgaactcacaaggaaattaaaggcataacttgtccaaaaattaaattctcctaccaagttaagggtaaaatgtactgagaaataccaaattttctagtataaattttgatacctacaaatattttctcaaatactataatatttctaggtattaaacacataatctagggttattcagagagagaattcaaagtgtaagatctttcttgtgctcatctatatagaatcatatatattgagggcccctttgaatcaaaggatttatgtaggaaattcataggattcaaatcctataggaaattttcctatttggccctttgatttaaaggattgaagctttccaaatcctatgaaattcttatggaatggcacattgcatgtggattttggaggaaatttagcaagagctccaacctcttggaaaatttcctttgagtctatctctctcatccgattcctgcgtttttcctgtgctctaatcaaacgaccattcctgtgtttttcctgtgttttgcaatcctctgttttacacttcaattcctgtcataatactatgttttttctattccttcgttttttcaaccctaacattcaaaggccctgatggattttctaggtgggcatggatcatgcatgttgcatggggacctacttaagcctgagaatattgaccacagggataatcaaggtgtacgtcttccgtacttgggtggcggattccaccatgagaaaaaaaaaacccaagcagatgaatgattccgcaggcgccttttgaacagtggaccaagctgcagactccgttcaaccaaacgaccggcgtctctctcgtctccggccagccgacgtgccgccgtcgccgtcgtcgctcgcgccgcaagcgtgtacgaaccttccgagtggtttccactcctcaaactgaatcgatcgaactcaactctcaactagcgctagtgggatctctccgaaatttgcaacttgtgcgggttaattagcatgctaatttgcagctctacggaggttagggttcatcggaatgagtagcctgcttgccgatggacaaggagtgcactgcttgctttcctggaaaaaagaattgttcttttgtctctcttttggatgcagaaagatggatcaaagtgtgtacttgcacgcaagatagacagatatttgtatatctgtacccctgcttaattagctacatcgtgtagatcattaggctgccaaacaaactttccagtgtgagattccaatgcaagcacacaagatcaaaattcttgggaatcatttatcagttctagatcactgtactgtgtcaacaattgtttaatatatggtttttagaggctgggtctgtgtttgcttatggggcaagagatccatagacaggggttagaaaatatcaaaacttatgcttgcaaggcatgaggcaatcatgaacatgacaaaatgtttattaattaattaattttcacaggcttgacttaatccggttaattggacttaacctccccaagtcaagtacagctcttggactgcgttccaacatgttcaacttggactactgaccatcatgtcactgtcttcaaatggtgtgcctttgttaaactaaactaatctacccaaggaaaagggtaattaaacatctcatatgtatatatctattgatctatataacaaccagttaaaaagaaggacacattaccttattttttagataatgaagtggtagttgccaattgcatccattgaactttgaatccttcacaattcaggcatctttggaaatttccttacatattgtactgatcaacaaatcctgaaaccttctagcacatgcatctgttccaacatcctgattcctcgatcgcaagatagattttccgaactattctctgtttgaaatgagcagcatctttgaaaagttcatttgatgaaaacaacatcccatttgcttgccctgccagattggtatgagacagacaaaaaaaaaagagcaaagtttttcctcggagaaaaagccggaatattttccttgttcaaacggggtgtactgatagacagcatcaggcagtacaggccgtataaattccacatttccactgtaacaaaaacatccaaatcgagcacgttttggagccgtcaaaaggctgaaaatgccaaggttttcaactatccggagtttaccatggatcacaagtcacaacctttctcagccaaggcatcgacctgaatgactgagtcgcaaagctggaccgattactctgatgcccgtaagaaaggttcagaaaagtttgcagctttcaagtgctagttgataggcaatgggtaggaatatttcacatttcaatatctcgtcacccccactgagagacaggatgtagaaaggttggctatctctgatccttccatttcaaagagaagccttttctaatctgaaataaaatgcactttctttatatcaggcttttgtaatatgaaaactcttattctgtagattctgaaagtgattttagttcagaattggagctgttggcagtagatggtccaagctaggatcaccttttatttaaagagcttatccatatctctggaaaattagttttaactgtaatcttatatctgtggatcttagaccaatttatccagtgctaagaaaactgaaaagcagctaggttaatagtactgggtgtaactcagtcactgggttgtcttgtgatttatggatgtatttcttttggcagaacatagaacatagtagtactagatatgtttttctcacattgttcataagctctgatgtgattttttagttttggctttaagttacataaaccgttcctgaaacaacaattattagaaaatcagtacctatcagtagtagatgttgtgattggtcagcagaacagatctaaaagttgagagtacggccttgtttagttctaaactttttcttcaaactttcaacttttccatcacatcaaaactttcctacacacaaactttcaactttttcgtcacatcgttccaattttaaccaaacttctaattttggcgtgaactaaacccaccctacatgatctagagaaggaatgcatgctgaactttggtgaacaaagtcaagagatgaccactgttgcaaagagcaattgtgtggagatccacctcctcattgttttctgttcttgtttcccctttggaccagtgccatgagcagcagccaataaaaattggaagctttcagtggtttcagcaaggctctacctcatgtgatctacccttgaaggattgttaaaggagagaccatgatccaggcagagttttttttttgtttaatatgtggcaggtgaatggaatttattctgaaataatcatgcttatgtttggctcttttgacttgctcctagcacatcagtatttcttttttcttctagtagtattatgatattatctgcctctttttctggggcagcagaactgcagggaatctgcttacaagagccccatacttgaaagttttcacactgctaacgctaggtttccaaagattatcttggcttggttctaaagggatggaaaataatttatatatatgtttcttctttcttcctaactgatgaggaattcttgtactttccattctcaactgcctgtcaataatacatcaaacagaaaaatatcgatctgtatgactgtatgataagcaattctttcaggcctccattaaccagctcaacagaaaaatacgaattgatgtgccgtagttggggattcagacagcggttggtcatttttggctagtttcagataactgaaacactgaacttgcagagcacacgtagtactcccggaatagccttcacctcgagtctaggtccacacaaaaattttacaccctatcacatcaaacatttgacatctgcatgaaatattaaatatatgttataaaaataactaattgtacagattgcgactaatttatgagatgaatcttttaagtctaattgctccattatttgataatatagtgctacagttaacatttgctaatgatagattaattatgcttaataaatttgtcttgttatactgatagattatataattagtttttttattagtgtccgaacaccccatacgacaccctatataatatccgatgtgacacgttaaaactttacacacttggatctaaacaccttcttacaattgtgcagatctcacatgaacagttgacacaatttttctgttcgatctgcagcaagctatacacacacgcgcgtgcgccccgcagcagcacagagtgcactcgaagtcaagccccgcgtgccatctccttcacactcgcaacccggttttacacagaggaattcgaacaagaacacagcattattgcaccactccactgtggtcactcactagctcgcatcacagccaccatgcagcagaaggcttagccagaaacgcgtcttgaagagatcgagtagagacaagcgtgtgcgctcgtcgcgcgatgcatatggcccatgccgcgccgatctcgtcagtggcaatgcacatagctagctagattcttctcttgtcgcaaaggtcaacgactccggtaaacttttctccataggtcagtgactctgtattaacagtttcaacccctacacacagtcgcatgcagctagtagtatacagtaatgtcaactgcaaggagttacccgaggattaagatatggtgcatcgatcagaaaaaaggaagtaatagtaaattgatgcacgagcacactcatgagtgacatgagagagatgtctgtccctcctctgagttgctgcatgcgtgacagcgtgatttgtgctagcttagctagctccttggttttggttttagcttgatccatctaaaacaatggacgacatgcctcccaaaaagtcagagcacatgcaagcccaatcagctgctcctgagtccagacagagatgtgtaggggccaaagtggcaaatcaaatctgaagaaaattcttactccgtccgtcctctaatataaatgattttaacattttacttatactatttgaccactcatcttactcaaaatttttttggaattattatttattttatttgtgacttactttattatctaaaatactttaagcacaattttttgttttttatatttgtacaaatttttttaataagacgagtgatcaaacagtgtaagcaaaatatcaaaaaaatttatattaagggacagagggagtatatgagtggatatattcttcagtaaaatgtaaagctcagagtaaaagactgaatctttgatgcagtaaacggaaacaaaaggctggggggtcaaatgctggcatgcagccattgtggcgacaatctattcatcgttttcttggtctaaggcaggatctcaatctcagcaaatggtacgggggcaaatgggttttgggttgttggaagatcgaagctagcagatgcttgccgatggtggtggtcaaaatgcttgactcgacttctctgctcggatcaatcgagctcgcctttaattacttttcgctgcactgtttactcttggactgatttggtttgaacagataagtggccgagattaactgacgaagaagaagaagaagaagaagaagaagaagaagtcgggcgctgtcaatttggattccacgtttcgtgctgcacggcggcgctaagctccggcgaggcacgccatgaacgacggcgtcgatcttgctggaaattgggggctcggagtttaaaattccgaacccccatgggttacagcgactcgattcgtggacaggaaaaatgcgaaataatccgattcgacacgtctgcaaactgtcaatccaagccgaacactcctgactctcgtcctcctcggccggcgccggcgacgacggcgagcgtggggaagcgtcggcgacctggttgggccgtacggcccagatcgagtggaggcctcgaatgggcaggcgacttctgttgggccgagttctgcctgtctttccataagttcactctcttttagttactagatgtgcgttgcaactgatagagccaatttaatttgtacatatgtgtcggtggataaataatccattgttcgtttccccgcaaaaaaaatccattgttcgtttatttatgtgcttatccaaatcatttattaccaaataaaagactatttgtgtgcaaatcttttatatacctgttgttaacgactcaaaaggaaatgctgtaaaataaagtatgataaaaaaacaaaaggttgaattcaaaattaagttctaaaatctaaattttggcttataggaataagcatcagcaaaacaatgagacattcaaacacggctacacgagcttgatttatcgtgcagctttgtctgaagttgggaaggaattgatgacggacagaatcaacaacttcgatcatcctttatttcggttgtcatgttttttccgaaaataaaattgattcttatgaattattgtaacggtatccctgatagtacgtatgagtatgtgtggagactgacttgaaatcatgctaacatgtgacatgaatcgtgccatgtaatacgaatagacgacctacgtgatatttacacggattctgcgagtatcattcgcttggtatccacatcacatggactctcttttgtagtccgcttgtgattcgtgacttcgcaatgaatgttacgtgtgacgggaatcggatatgaatgatgtagcacagttttgacaaaaatatcttcaatttttaaatcatgcagtcccaataggacatgcggcaagggcaaatcgcgcgtgcgagggcgttgcgggcccaatcgcggcggcgcgcaaagacgcatgtggaaaacgaactcaggcgcaacccccgattgctgcggacccaattaatttgcacgcgtctcagataagaggaatactctggtgtaagaaaaaggaaaaagatttgatagaaacataaaattaaaaccgattaaaaaaataacgtatcaaaattctgacagaaacatcttcgaatttcataatagtggagatgggtccaatctaattcgtatgcctcaattgtaatatcggatatgttcatcccccacaattatcaaaacctgtataacctcttctagctgtttgaaagcagttttcgttaacgtaacttatatattgacctaatccaactaatcgagtcagtatgtggctattcttttttacacctctcttacttttatcttcctttgtacaatctcttttctctagagggcggggacacaacgccgtgcatgtgcagtactacataggaccctctctcgacgccgatgagcttgagctggaggaggaaagaagaagtggggcgctgtaaatttggactcctcttgaggcacacggcatgaacggcggtgtcgttcttgcaggccattgggcctcggaatttgaaactccgaacccattgcgttctctgtctgacagccgttcgattcgtaggccaggaaaaatgagaaataatccaacgctacacgtgtggacatgcagtcaattcaatacgaacactccggcggtgccggcgccggcatcggcggcgacgacggacgacaacgacgactggggaatcgtcaaggagctcgacgacggcgtgcatggcgaagcgtcgacgacttgttgcgccgtgaggcccagattctgtggaagcctcgtattgggcggccgatttgtactgggccttgtggtatcatctggcccgtctggctatctttccagcctggcccagattgagccttctctctttacttcttctctaatgggcctcagtgtacctccgtagggcccaacctcgaatggatccaatactcatgggccgtgcggcccacgatatactcagctgcatgatttacatacaactcacacattattgttgttattgttgttgttgtttttctgcatgaattggcttccaaaagcaaaggtgcagtagcaaacaaaaaaaaatggaaacaaaagaaagaagcaaagtgcactgctccacgagttaagtggaaagccgtatctctgtcgccaaagctatatagccgcgtgtcaccggaaaacccaaagaatcaatccattaagccgattaattaattagccaggtttgccatcatcattggagccaattagtttctcatcggagcttgcaagctagctgggtgacagcaaggagcagaaaaatgttgcaaagcacaaagcccctctttgctctgttttgtcatcagtacttcttttttcatatgcatattgtacgagcagaaaaaagtgcttttagtctgaattatattgtacgagctgaatctgaatgtgatgtatggagaattagcaacaatggagtgttcgttgcttacttgctccagcttgttcacggggaatggcctaagtactccggatgcaaatcttctgctataatgcacgtgtagtatgtgtcactaattatgtgggccccacttacttctggtccatatgtcagtgacacctactgcatttgcagtacagcataggcggttcctatccggaacagaatactgatcacagaaaacaggacggtttattagcgcgtgattaattaagtatttgctgattacttttttcaaaaatggattaatttgatttttttaagcaactttcgtatagaaactttttgcaaaaacacaaaccgtttaacagtttaaaaaacatacgcgcgaaaaacaagggagagaagttgggaacatgggattacaaacacaccctcagagtactccattgcatgcactaatgcacacagcacactttcagtttcagcattcagcgagcaggaaaagaaatagggccaatttgaactgctaccctaccaaaatttgcagcaaaccaaacatctctactaaaactttaccaatgatataaatttggctttgcctataaatttgtctcttatgggcaaattttgtctttaatccaaataaacattttcaactctaccctaccaaaattttggtagtaccaaaacttgcccaagatttgacactaccaaaattttgatgggacatcaatccaaacatgcccatggtcttccaccatctggcgcttttgcaccatcctacgcgaaaaagaaagaagataaggggcctgttcactttgttgccaaaaaaaactttaccaaattttggtattgccaaaattttggcaattatgccaaaatgctaaaattttggcaggatttcttatataattaccaaaatttggcagcaaactaaatgtagccatatttttgacaactttatcaaaatttggtaaggttgaaaatggcaccaaagtgaacaggctaagataagaagaggctcttactttttttttctttttttctagaactctgtagaagctagagaaagcgtgaagaccgcgtgattttaagcccaaacgctttggactaaaaaggccctgaagatgtagacgatgagttcccccgccgcgtgaagccgtgaaccatctcagccgctgaagtggctttagcttttgatagcaacaagctagagcaattggctaagcaaaacaccaacttttactttcagtctacgtatcagagattcagagatgtgttcatgaaacagcttcatttcagggcagacaaaaacacatcatatatataacagctaccagatttactcaccggccggcctctgtttctcctaaaagaagcggagagaacagatgccgtccaaaagaggggaacaaaaaaaaggagagaaaatcgaacattcagtgaacacactcgcaaaagagaagcagaggatgtgactaggatacgatgtgataacgatgtgacaaatctgcactcagttcgctaagatggcaagaaaaaaaccaatgggaatttgtgaaatgggcatatatgttccctatctagaaagtgatttcttccactcggtttccgcgcgttaacttcgctttcgttcagctcagctaagctttgccggtcacctaccaaagaatctcctttacttcttttctttctgctgttgctgtccttctcctgcagcttcaggaaaaccaaagaattggaagtggcttagcagtgatcaactgatcactgatcagactagcagagtatgatagtatgatcaattcatcagtgtgattgtgtgaagtgtgtttatgccgaatatgtgttatgctaacaatggagtgtgcattctgcattgcattgcagaggcttgttgatgggaaaataacctggattactccactgcacttccagcattctgcacgcatccagagaaggaaaaaagatagctccaccatcctgcactttcgcatcatcccatgcatgaggccggccatttttgttctcccgaaaagagtagagaagaagacgaacttttctagaactctgcaggggctagggaaagcttttgccctcgtgaatctcctcaagtaacggccttttagcttttgatcaccacaagcttgagcaatttgcttggcaaacagtacaagcaacaaccccgcccccccccccccctccccttttttttttctttttgtgtgtactgataagatcagtgtacaaccgttcatgaaacatcctccctccgtttcaaaatgtttaataccgttgactttttagtatgtgtttgactattcgtcttattcaaaaaaatttaagtaattatttattattttcatatcatttgattcattgttaaatatactttcatgtacacatatagttttacatatttcacaaatttttttgaataagacgaacggttaaacatgtgctaaaaagtcaatggtgtcaaacattttgaaacggagggagtattttaaaataaaatcaacacgtgattgtgctatttcattgagtttagaggtaaaaaaaatacaaccaccaagaatgagtgtcggtgacatggggccgggggtatcgtgactagaggcttgggtagccgcggtcacccacgtggcctgaccccctcgggggggtcgggcctgagggtgacgtggccacccctccctctgtctccccgagggg

SEQ ID NO: 71948 - DNA, 1300 bp, Oryza sativa
ctactatagggcgaattcgagctcggtacccagtagattagatggcgatattgctagagattatgtaagatatatgataactcgacgaattatataaacaagattagagtgtcataaagatggaagcactaatcctaagaacgcaattcgtcataacgaattttacctcttgttgaagatcgaaatcgatgcagctcaacccgaaagcaagaactcgtcgaaacaaaactaaagcaaaaagggtggtgatgcgccaagattgtattgaatgtgtgtgttcaaaaattacataaggctcggggtctatttatacccgagaattacaagatatgcccatactggacacgaccattatctctaacaaactctaagatactataagtctttgcggcagacttttgcccacatttatctataaggaatttacataacatatcctaattaatagatacaattgccttcccaggactctatccgtgcgtggcaatcatcttgaaatacactaacttgaacccgatgtcgcatacaagttgtattgtcggaatcggctatatcggcttatttagcccgactcagacccaaccgatcctaaccgtagccgatctggattccagccgatccctgctctgcttccgaactcgatctccgcctccaacttcgctttgatcaagtcctctttcccgacacagatgttaccaaatttggttgttaacacatgccccccaagtccgggatattcgataatgttccggatttgccgtatgccgactccgagcgagttttgcactccgccgcttttgaccgttattccagcgctttaaatactaaccgttacccccgagaaatctcacaccgtgacttccgttttcaccgctcaagcgaaaccttttctctctcttctccggcgattcctccggtgcaaaggtgattcctaggcgacctcctcttcgacgagatctccgcccgcggccatgtcgtcctccgccagcccatctggtgcaccaacagccgagtacgctgaggtaagttctcattggctaaatccccttctttagcagcagatcgatcttctcttatctcatattgcttttcctcttttggttgcttcaaatttgtagcatctttctcaccaagtcgcaattcccagtctgacgcatgaaaattactactttcttggcccaatcggcaatcctgaccccaccgagttcattgttggtgaaaccaatagaatcccctttagactaaccaacccagatctaggtcactggaagaatactttcaagggtaccgagctcgaatt

SEQ ID NO: 71949 - DNA, 1281 bp, Oryza sativa
cagaaggcagccgattaggttagatcttgatgttggtctagattatataagatatctaccattctatgaaacttctagcggcttgattgtctagatatcactcttcttttcatacttaatactgcatcagttgagtttgatctattaagtcgtgcttagaatatcgatctctagcctgccttctagttgccgattagaatagcatcggagtttcagccgatcgtatctgatttaactatatttgttctatatgctatactgatatgttaaatctgccctttatatcaagatattgccgtatctaaacatgttaggcctttgtttgatatattattcttgctttaatatcctgatatggagtagtatcggagtattagccgatacatgcgagatctatctgatcggctatgctataaacatatatagtcctgttattgatatatgtttcgatctaagtgatttatactatctcggcatgatgaccgatctatcccaatcactttatttaagtatatatcgatatgaggagtatatatcatttatatctacagccgatcgagtagatttagttcttctttacttattcatgactgccgatcgatacacagatgacatcggcccaaagataagtgatatgtcatcggcatctagccgatcggctatcatttatagatttaactacggtttctttgcttctatttcttgttgattacaggatcaaatcaactggcacgctaatacatccgaaggcgagctttcgacctgcactggagttaagcagatctcccaggccatgtgttttctgtcaacacacctattacgcaggattgtcacaacccaaccaacagataatagtcttcctcctctggttgctactgctactacacaccctttcctctactacctctgaggagctaggggcacctggggttcatcgaggggagctggggctgaagccccaacgatgaattcacccttgcatgtcctttgagttctggatctagatctagcagatcaagaacaagacgctcataatccccttctaattaccttattcaatatcccctctaggttaagtcaaccattagatttagtcataattattatgtcaaccattagatttagtctaaatgtatccttagagcacaagccctattggacattacagcaaacaaccccctcccccactccaaaagtataaagcccagttcactcggtgctcccaacttctattcttccccattgagacccatgtgatacccatgccatatactgacatag

SEQ ID NO: 71950 - DNA, 2365 bp, Oryza sativa
tttagtaaatacattatacttacaaaaatacagatcattgttgtgctattggtagatacaagttttttcagttctactttggtaaataccatattttaccaaagtttacagcaactcttttttaacataattacaaactaagaatgatagctgacagttaacagatgagacaagaagaattaatccatgcatgcacacaaccacacgcaggataataaaacagtgacaatcactcaagcagcttactgatgaacatgagcaagcaatattaggtgcttatgttggttgtgtagccagtattggccagtcaaaacaagtggccgctaattgttggaaagttggccaactgggcaactgagccaagaagattatcaagccgggcatgcaaagacagaaacatgtcgcagtacacaagacaccaaaaggccaggttcatgttattcggtattgttgatatattcagttcctagccagtttttaccccaaaaagcaaaatttcaaaacatgttttatcaaacactaaataacaaatactgatcaaccgagttaaccagtgcggatcgggatagttgcgaaacaccccctacgctacacatcccatttgccactttcctagtgcatcccaaatttacccttctgttgattggctgcttctctctgctggatgctacagcagtcaatgcctaacaaaggtgctatctaccctgaagttactctagaaaaggaattgcaagggcgagcagaaatcatggtagtgacagcaccaaaggaaagttccagcaataacaatggcaagaaacaacaatgtctaagcttagctctccatcttcccgtcctcaactaatgtccctctctcctttcaatggtcaacacagcatggtccaaggcttccgcatgatgagtccacagtctcatggactatgtgcatcctctgaagctaccataacaccgatgcttactatttactcttcattcaacataaatccgtagtgttcaggtggaccctgctacctcttactgaaccatgatagactaactattaattcccgttggattgaacaacaatgaaaacaaacaagaagtaaaacggaatgatcaaaataacctctaggagcacctcccacctctctctctctcatgttctgaacacaaaagggcgtttactaccaaagtcatgaatgctgtgggaatcacaaaattacatactggacacactgtgtcataaaaaaaacactgatttcctgtgaaaaagttcttttaaacggaaagtaataaataatggatggaagtttgtcgcatcaaacataaatgaactgtcatatatattacctcaaacatatcccttccataagcagaagggtattcttcatcaccagggccaacaaaaccagcatcgacaccatcatcatcctccaatccacctagctcaacctcttccaccgcgttgttcccaaagaaagcatactgcgatgcatcaaacttggtagcgcctgcacagagccagagacaatcaaagagcccgggaatcagtactgaatggtacagcatctccccactcctttcatttaaaggtaaaaggagaagctattttgagttgggattgatggtgtgctccactcctcaagtgacaacatatttcgtggctagatctctatatacaactactgaaacgaatcaaacaaccaaactaaatcacttcggttaactagctaatccggttcatacctagaacacacatagcaaccacaagcataaaccatccgaaacactaataatccaatcaacgagaggaagatcttctccatctaggggcaatctacgagaagagacgaattgcattacccgtcgacgccgacgaagaaggctgcgccgccatccgcggctagggttgcaagttgcggcagaagatgtgggggacacacaggacactggcgcgccggccgaacggagcggaggccggagatgccggagcggatcggggagggagagagctcgagagaggagatggcggagaagacggcggaggcggaggaacgccgacgaggaggagccgagcccgctcgagagatagaatcaggtcagaggggaattttcttttttctttttctttttttttttggctggtatatgtgggagacgccaaaacgtgcgaactttttgggcttttttagattacgtgcaagtttgacgggagcggtaaaaataactgaatcgtatgtgcagttctgatgatggtagaggtgaaaagtgactgaagcgtgtgctgttttttttttcaatcagatcttatgtagttttgcaattatcaccctgctagaaaaaaatttcgagatttcaatcgagcaaaaacaaatttcagaagcta

SEQ ID NO: 71951 - DNA, 1100 bp, Oryza sativa
atacttacaaatattttgctttaaacactttatacttcgaaaatattataaacacaaggaattagcaggggatggaaacaaagacgtgtattaaaaaaaaccctatcgggcaaatagtaagtttatacacctaaagtttgtacacctgagtttacacatctgaagtttatatacctaaagtttgtagacctaaagtttataagtcaaaagtttatatacccgattcaaattacaattcggattccaatatttttttatataggaactttatacttgtaaaatttacactaataaaagtttcaacatccaaaaatttatagttgcagaaactttatacttacaaacattctactttaaacactttatacttcgaaacattataaacacaagaaattggcaggggatagaaacaaaaacatgtgaattaaaaaaaaacctatcgggcgattagtaagtttatacactttgcttggtttaattgatccatggtatgggacattatagcggttaaagagaaacagggaaatagactagtaaaatcattatcataaaaatagtatatctccattttttttattgcagaatctgaagactgctttatttcaactctgttactttcagattctgccgagctgttatctttgcttgcagagtgctcaccagtggcatccttgcttggaacataatctgaaattgcacaatttgcctcgctacagtccgagtcttcacgataactaataccatgttcctcaaaatcatccatactgcctgagtcacgtaatggaatttgttatctgcgcaacagttacatagacaccttgagctcctgaccaactgatttattagaaatcattgatacaagcagatagcggcaaggaaatcaaaaaggttatgcaaaaaacatgaaacaatggaattcagaaaagcgccaaaaaaagatactattcatccaggagattttattccgtccaagctgttcgttctctatatgctgaaggtactctctctctctctctctctctctctctctctctctctaccccttggttttcagacacatgtatgagcatttttggtgacttggtgtagtgagaattttt

SEQ ID NO: 71952 - DNA, 691 bp, Oryza sativa
gacttcatggagagaatctttggtgataacgctttagacctttaataaagatgtcataatatcgctttttgactatggacttatcttatctggaatagtgtagattccttatcttgaatagtgatctttgtcggggatgacaagatctttattcattatcttcgttgattatcgtgggtgctgattgcaccgtgtcaatctctgacggctctgatttctgaaatcactgagccaggcttctgtagtaacttttcttggagcattcatttccaaaatccggtttaattatgcgccctgctcccttgaagtattcataactttggttgtaatatttgctgataaaaatccttgtgatcttgttttggaaaaccagctgatattcataatctgtggtgatagcttcttcaatttctgcagcttcagaaaataatctccaattttcatgattagcaattgttgtatatatttcttcctcttcatccgatagtttgctaggaccgtcttcttgaaaattaaattgtccattcatgatatatatataatgaattgctggacgaacaggtggtgtgaattttggtggtatgaggagaagataatcctgtatcttccatttccaagtctcctgcagacatctttcacatcgcttccaaaatcagattgaagaatctgatcgagggttgcatagatggaa

SEQ ID NO: 71953 - DNA, 19958 bp, Oryza sativa
acggacgcggcactgcacggcatggcacgttgccttcgctcgcgccgctgccgctaccacacccacaccacgcgcctactatcccccccccccccccccggctgtggaggagtcgcaacctccgctcgctctaggatccgagtgactagctccggccgctgccgcagcggcagcacatgcagatgcagatcgacgcgcggctcgggtcgccgggtcgcgcgcgcgggaggtgtggttgcggtgtgcagttgcgggctgcggcggggggagtcgctcgctcgtgagtcgcgacgtgttcgactcggcgcatcgatcggtgcgcgggggcacggccgggccgggggagggggaccgagtcgtgtacgctcgggtacattgtccgttggtgttgccgggtacgagggagtacggtatcgacgaggagtgcgatgcattgcggggatgagctagaggggacggaacgagttatctaatcggttctgaccacatactccctccacccattccataatataagagattctgacattttgcttgcactatttgattattcgttttatttaaaatatttgtacagatattaaaaaaacgaaaagttttgcttaaaataatttggataataaagtaagtcaaaaaaataattccaattttttgcaagtaaaatgttaaaatctcttatattagaagacagagtgagtatatgagaaaagaggatttttttgaaaaaaaaataaactagacttatggcttgttattttattcaaatttcaattacaactttctcatttttttcgtaaacacacttttaaaaggttaaatgatacgtatttttcttgaacaagtttatataaaagtttttaaacattaattaaatctaatctttcatgtttgtaatagttaatactatttaattaatcatttgacaataagtttttcttattttgcgtgtggctgaaaatctcttccaatctaaaataacgaatgcagccttaggaaatgagccattccagccattttgcttatatagtcaaaattcaaagctaatacgagtaaaacccaaatcaagtgacaaacatttcaaaaggacaatgttaaaaaaaacacgaatattaggaaagaacctaatatcaaataattaaaaggggtgagatttcgaatttaggccagctagcctaccaccctgtggagctaggcgaaaaactctaaacgtttctctacaaggacaattgtttctaataaccacattccaaccttatctccaattccaaatttccaatcgctagtaacgaccgactatatatactgagtaacactagtaagactatttttagagagagaacgattcaatgattcatacatatagccaagtgaaaaagattggtatagatagggctaattaatcctgcccccgccgttttctctcggtttgttaatcttaaccgtggatgtcaacatcacacattgtgtaccaatcgccatctcaccacctttccttttgcactataaataaatccgaacggcctctgcttctcgaagcccggcctgtagcctcgcctcgcctccctccgccgccccggttacgcaaccaaataccgacggcgccgcccgccgacgagccttctcccttcgcgccgccccctcgcagcatcctcgtgccctcctccggcatcttcctgcgccgcgttagcatcgtctgtcggcgccgtcggaggttctgctcggagctcgcttccgatggacggcgcggcgacgggcacggagcgcctctgccctctaggatgaggggccggagacgtcgccggcggaggcttgtgcaagtacgagcacttaatattctcccctactctattccttttccatttgagaaaattagaagaagaagaaaaaaaaaactcggttactttatttctttgtgagaaatgtgggattcgataagatatggccttgctcgtgctgttctaatgcgctgtaactgtgggtgacggcggtgcgtttggtatttgttgataatgtattgcttcgtcgctgcacattctgcgagcctctgcttggaaaagcaaaccagcaatatttcggtgtaccatcactaactggagtagctgcggcttgttctgttcggttcagcatgatcttatttcagagtttattcggtggattgatatgaaaacgattttttgtacggattaaaccgcacggaaaataccgctgaactggaaattttttttgaagaaacggtggcccgtggaaatattttatatgatctgttccttataacatttgggtaggagactaggaggaacataatgtgctccaactgtgccacggcatgcaaaccatttacagatagcacagaagattgatgaactaacattatggtaattgagttctgctgcaatagtaactgacatagcttgagcgctttcgaaataaaatggtttaggatatcatgtacttacatatcatgtgttagtatgtctgcaataggcaatggtaacttcctgttcctgtggttaaacattaaccgagcttttcttgaaataatatactgatgtaattagcttatgatcccatgttcgttttattttccatttatttatttataggtaaatgatctttgcaactgtcctataaatataacttttttttattcaggtcatctatgctagcacacttgatgactgatgtcatggaagataattcttcatggacagctctttctattgatcacattagaatttctgcattcaatttcggaattgtctccgaggataacgatgaaggcaaagaatttttgctttcattggacactgttgttcctgatgatatcctggagagaattttcacgtttttacctatagtaagcatgataaggtcaacagcagtttgcaaaagatggcatgacattatctactcaagcaggtttctttggacccacatgttgcctcagaggccatggtactttatgttcacttctaatgaaagtgctgctgggtatgcatatgacccgattctccgcaaatggtatgatttagagcttccatgcatagataagagcagttgctttgtctcttcttcttgcggattagtttgtttcatggacaatgacagcaggaatgccatttctgtatctaatcctatcacaaaagattgtaagagaattttggagccccctggtgcaaagtttccagactacagcacaattgccataaaggtagatcgttcctctcataattacaccattacattggcaaaatgcaagcaagttccagaggattacgtccgatgggatttctctttatacaagtatgactcacagagtagttcatgggtgactgcggttgaggaggtgttcattggttggagagggggtgatgacagcgtgatatgtgatggagtattgtactgtttaattcactccacaggcattcttggtaatattgaaccgcgtcatagcattatcatgtatgaccttattgctgggccttctaaggcgtcactaatgcaatcgtcgatcccagcaccttgctctctcacctgtggacgtctgcttaacttgagggagaagctggttctggttggtgggattgcaaaacagaacagacctgacatcatcaaaggaattggaatatgggaacttcacaaaaaacaatggcaagaggtaggtcgaatgcctcataaattatttcaaggatttggtgagtttgatgatgtatttgctagcagtggcacagacgaccttgtctacatccaaagctatggtgcaactgctttgcttgctttcgatacgaagcagaagcagtggaagtggtccgcaaaatgccctgtgagcaaaagatttcctctccagcttttcactggcttttgctttgaacctcggcttgatattaccacttaattgtaatgccttccaatggaatcaggttggcagtcctggtctttgtgaatatatgcatgcttcattagattgttgcgtcacatgcaatgtgctctcctttgcttatcatcccacattcgtcctgatggatgcaatttcctttgcctcttttcattggattaattaatctttagaatgttgatctctctctctctctctataataatgcctgtttacaaatgtacctctattttctttaaaaacaatgcatagatctatgctatttatcacatttatctgaattctcaagttcagccatgtactgcctcgacaaaacctgcatacaatgtctttgcttgatgcaggccttagaacctgtccatataaactgaatgagctattgtccttacagcatgtctagacagataaattttgcagcgccataagttacatgtcttttcatcgcgcaacttcctgtatgtgatatctaaatttttgtcctttgcggtctcaagggacaagttcaactgtatgcgttttgtttcttgtgatacttcatcagtgatgggcctaccactgatgtttgctgctccggaacagtttgcacactggatgtacaaggcgattgaaagtcgtttgtctgtacactgaccagtcactactagctgattttgtagaatcatcatgggccaaatccaggtttcctcttgtaggagctggcccatccctgaaaccgccgtgactctgcatcgtgatgcaagtgtgagccagaggtgccattgatgagattccagctcgtcatcacagctcctctgtatgtagtgctcagttgtgacattaatagttcagccgtctcagcgtttctcagaatggtgtcacgcgctcatgctctgcatatgattttgttttgttgccttgcagattgcaatgttctctctctcttttcttttggccgtacgttttagctggttagctcactctaggtatggcaccatgatatggggccaattcgtctgctgtttttctttgttaatctttaccgtgtctctgatttgttaccagttctgcgtgctgttttaatcagaactagctgggtggcccgctcaattcgcaattgcgcggctagcacccaaacaaaatcatatattttttaagtatgattttacttaaaatttattaaatagctatctagctatttcattgtcttaagactttgaaagaccaaaccttatcatcctcgtgtttctaattatatagtttttaaaagtcacaccagttgctacctcttatgtcatctccttctctatttgcttgcttgatctaccactattttcattcattcttcttggaacctttaaaaattggattttatagtttttagagtttattgtcatattgggtttcatttctagatgtcccatcaaacgttgacattatactactctacggcccgtccactgtctcttctcattgttgtcattgagattttaaaaatcgaacataattattgtttgggttcattttttactttctagaagtcccgctaaaccatcaatggctttgctattgtactcctctacggctcgcccgctgcctcccttctttattggcattgagattttaaaatcgaacatgattatcattggttttttttttactttttagaagttcaaaacctttaaaaattggacttgtagttttattttttataatttttagaagtcccatcaaacgatgctacaatgcccctctacagcccgtccgccgccaactctttattgttgtgattctaaaaatcaaacataactgtcgttggaattcattttttattttctagaagtcctgtcaaccgtcggcggctctgcaactatactcttatacgccccgcctgctgcttctcctttttattatcattgaaattttaaaaattgaatatgattatcaattgatttttttttactttctagaagtcccggcaatcgtcttactcatttgcttcacggcctgcctgacgtctctccttttaatcgtcattaggattctatttggtgttttattaacaatttttatatctcatatcaaccgccaccactctacttctttataggcatgttacttaatttattttgtcatgtgttttagatggtcttttctttcaataatctttatttttatcacaaattttagttatttataaattgtattcctaattgatatcttatttttcattttctaatttcagaatttttttaaaaaattttagttaatatcgtattgtgttattttaatgtttttattttttattttcaatttcagttgtttcaaaattgtattcctatttgaactctcttttattttttctagttttagatattattttatttttattctaatttttaattaatctcgtattggattcttctttcaatattgcttatttttaatttcgaatttcagttatttttaaattatacttctacttggactctcctttttctttttttatttttctccaattaatgtgggaattatttttattccgaattttaattaatcttgtattgagttattatatagactcttattttaatatttcttatttttaattccgaatttcagatatttttaaattgtattcctacttggactctcattttcttttttaattttggattttattttatttttatttcgatttttgattaatctcgtattgggttcttatatggaaacttattttaatattccttatttttaattccgaatttcagctatttttaaattgttttttttacttggactctcctttccttttctgattttggatttttatatttttatttcgaattttgattaatctcgtattgggttcttatatagaaacttctttcaatattgcttatttttaattttgaatttcagctatttttaaattgtacttctacttggactctcctttttcttttctttttctttttctccgattaatgtgggaatttctaacccccacaacgaacatggtgcgtcatttcaaagttgttttaataatataatagatagatagatagatagatattgcttgacagatgtgtcctatcttacaggtttggaatcctttttgttggttaagaaagcagtaatcgcctgttgcttgctgctcttatcagctgtcacagacaaaccctttggcttctcaccctcttaaccttgttcacttttatccagaccagataatatatgaggtgagtgtttttagatgaacacaatgggaaacactgcgtatgcagtcatggaattatttttatctcttagattgttaatggcatggtgtttccttttctggatgcttacacagaaacgaaatacaaatagggaagaaaaaaagaagaagaaagggatgaagtacccgatttcattgtgtttgaatcttctcctgcactttccagtttcatcgtaccatttggccatttgagccctttaggctcgtgcttcgtgtccaactttgtagccaccgaattactgcaacttcgtggggattaatcgagattttgatgtgcactctagtctatcttggctggccatccaacttgcccttgtcctctacgggttgcaagtggccacgcacagttgcgttggtctacgcaccgtagatcacgccgctggtgtcgacgaatttaacttggttcaagatgtgccatgtgtgccgtgtgttgccttgtccgggaaagatggaaattctgaatgtgtggtttactagtacaaggattatttcatccaaagagggaaaaaaaatctgcgagttcccttcagtagaaaatgggtagcagaacattattgttttaagctgagttctagatgtgtggacagttttccatattcagatgaaattcagtccttaatttttcttctaagaaatggtttggttgagagggttagaaacagctgcaactgtgttttttctcctttctcaacgaaaggcaggattgctaccgtcggattgagaaggcaaataggtatttataatacagaaacgagtttacaggaggctataagtactaaaactcaggcctgtcgaaaaacacaggctgatgaatgatgattgaatgaacagagacaactgggccttaacccagtgcactcactactctgaataatgatcaaagcacttatttgcatgcatatctaccatgcagtaaaaatgaattctgacgtatgatcagtgttcattggaccacttagagctcattcagagtttcaggctaataataaaactaagactaaccgctccccgcgtcgctcttgcacagatttctcgggggcgaaaccctagccgcctgcgtcgccaccttccatccaccctcaacgcctcgccgtcgccggagctcgctgctgcaaaggcgagcggccaactgggaaggcggtggtgaggacatcgtgagtcgtgacccagcgaagctcgcccttggcacgagaggacggagcggcgcatggcgttgcaggtccacagcggctagagtcgatcggcaagggcgcaatggatccgacgctctcggaagtggatttggcattcccaatgcaggggcgcagacggcggtggaggttggcagctggagagaaggtggtggcggcagtggcggtggtgccggatctagagctcccagatccagttcgacagtggcgctgtgacaggaggaagcgcacggcgccggccgacacgacgacgtgtggccggcgaagcgcgtggagagtgcgacacctgttgtggggctccagagggaagaccatgatgatggccctggcatgaaggagcacgattagtggaacatggccggcgtggtggcgagcctgctatggtggagcacggcaaggtgaggtggtgcggtgacgagactgtcacagtgggaggacggaggcgaaggtgatgcgaccaggcggcccgtaggagacacgggcagcctggtcgagatggcggcaacaacggtagcatcataagaggggcgttgaggactgcgacaagctcctctctaggtgttggtcctcttgcggcggcgatttgccatcgcaagatggccacactggatggactagtgcggggagaggggattcatcttctctctgaccctcttcctctccagcccacccatgtggatgaatctggagcacgccagaggtcgagatgcttcttcgatggccggccggtggtgaggcgtcgacacggtggctgcgtgttgaagaggattagctagtagtgtctgttgaacttgacatgcacacattgacatgagaaagtaggaaactacaggcgaaagcctagccttcgggccgataacggcgacgcctgcgtcaccgcattcctctcgggacgttgttacatttctcctattctaatggtttctttaagtattaaccatgtcctggttctttaggacgggcggcggcggcgctcttagcgttgttcccttatttttagacgttgttcagaagaactattcctctggcgtgtcgtgtgcttgttttgttttcagtagcaggattagacgttgatgcgtggtgtggctatttttttctttttttttctagtcttctagaactacagacttattcttttttcctgatatatcaacgcattaccttgtgcgggttgtttcggaaaaaaataaaactaagagcagagtatcaccagttggagactggccagtcagtttctacttaagtagactctccaatctccatcatgtgactatgtctggatcactacaacttcttcgacgtatggtttgctccatggcctgaacaagttgactgggacgtgacctacgtgtcccgcctaacatttcttaagttcagaccaagcatttgcctcgtacatacgtaattacgtattccataaaaaacttcaccgcgtccaaagcagatgcagccgcgttgctacttaattatcaactgacatgagccaatgatacattgattctatagctgaaagctaatgaaatcactgatcaatggatcatgtcaaagtcatccctgattagcgggttgcgattaactggtggaggaaagtttctatccacaaattagaagtcgacatctctgcagaactggacctaatggtctacttacacgtgaattctcgcatgcagttcgtgatggtacaagttgtggccacacaaaaggctggacctgttctgttcatctcttgcagaggattttcacccgttttgtcttgtgtgaaaattgacattgcgtagtagtaaccggtaagccagcgatggaacttcagtcaacaggttgttctcatggagggattacttagcagtgtaggcaacaatgtattgaggccgtgttttctccttcggagaaaatgacgaatatggcttctgttcttaattagaactgtccttgttgctcatacatggattacttaactgagtagacaagttaataagagatcatatagagggatagtgcacagctaggagcttaggacgttcgaaaataacttccaatccaatcgattgcttgcaaagataagacgatgaaactaacacaatacggacttcgatgagaaaagggaaaaggggcgaaagtcatcgctatccaaaattctacaaagttcctttgaattggcttaggacatactccctctctttaatattatactccgtaagtcgtttaacttttttagtcaaagtttttaggtttgatcaagtttataggaaaaaattagcaatatttataacaccaaactagttcattaaatatactattgaatatattttaataatatgtttgttttatattgaaaatattattatatttttctataaatttatttaaacttaaaagaagctttactctaaaaaaaatcaaacgacttataatataaaacggagagagaaggaatttcggatgaattttaacatgagatctagtctcgtaaaaaatcatttatcgatatatcttcttattcatgtgttccttatgtgcttccctcaaacggtcatttctacatcatttctgccttttttttttaatccatggaagcccttttacgtggtgatcatcagaatttcgtatgcaaataatcttgatgatctttgtaaacatttagatggtatggttttacttccttgaagatgagcttctgattatatagtgtaataacataagacacttattatttacattggataagtaaacttcaaaagtgtaaaattttgccaaaattgaagtaacataaatcataaaagcataactttgttagatatttttgataatattaattatatgtcaaagttacatttaaatgattgtgttaatatgtctgaaacaccaaatatgagtaaggaggtttacttaagagtaaattgtaatttgagccatcttttattgtcaaaatgttactttacacacccttaaatcaacttttcttttttctactttgtactaggtaatttttgctattttttaaatatggatcacccaaatattttttctaactatgtctagcctccactctagcaaatatatagactgcacatagatggaggagttcggcggtgtgctggagccgatttgtttgaggttgttgatatatatacatagaaaagtttatttatgatgatccaaactacaataataaggatgtgtttagttcacactaaaattggaagtttggttgaaattggaacaatgtgatggaaaagttggaagtttgtgtgtgtgggaaagttttgatgtgatggaaaagttggaagtttgaagaattattttgtaactaaacacggagtaatattattattcgatccaaataaaaaacaaatagtttaaatataattcaaagcaaaactttaacgataaaataggactcaaattacaactcactttcttaatctattaaattattaaaacagctttgaaaggaggcaccacgtcctacattaatcggagaaaaagtaaaaaaaaagaaagaaaaggagagtccaagtagaagtacaatcttaaaatagctgaaattcggaattaaaaataagcaatattgaaagaagtttccatataagaacccaatacgagattaattaaaattcaaaataaaaataaaataaaatccaaaattagaaaaggaaaggagaatctaagtagaaatataatttaaaaatagctgaaattcggaattaaaaataagcaatagtgaaaaaagtttccatataagaacccaatacgagattaatcaaaatttgaaataaaaataaactaaaatctaaaattagaaaagaaaaggatagtcctagtaggaatacaattttaaaatagctgaaattcagaattaaaaataagaaatattgaaagaagaatccatataacaacccaatacgtgattaattaaaattcagaataaaaaataaaataatatccaaaattagaaaaattaaaagagagttcaagtaggaatacaattttgaaacaactgaaatctgtactattatataaattgaatatgtttttaccggtattttgttacgtcatccgtgtataagttggtttttaagttcttttgtttttgaaaagacatatccgtcatccggtgaaaaaaaagtgagaaaaaattaaaaaaatagaaaataaaacttctattgtaaaaaaaacgtccgactccgactcctccggtggaaaaaaaaaagagagacgacgggaaaaaaatcaagaaaaaacaaagaaaggagaaaaaacaacttctacccaaaaaaaaaaacgactgactcctccggtggaaaaaaaacagaaaaaaataagagaaaaaaaaacttctacgtaaaaaaaacgtccgactccataaaaaaagtccgactatctgcggagaaaaaaaggcaagaaaaaataaaaaaagagaaaaaaaacttctaccgtataaaaaaaaataaaaacgtccaattccttaaaaaagtacgattccctcaaaaaaaggactttttgtccgtaatcttctcttctacttctactatttttttaaaaaaaatctctactattataaaaaatttaagatattttgccggtacgtcatccgtgtatgagtcggtttataaatttgttcgcttttgaaaaaatatatatcctttgagttggttttaagttcgtccgcttttggaaatataggagtcgtataagaaaattcgcatgctaactttagacgaacagactcctaaccacagcttatgattttctagaaatatatagatccaagcaaattctcacagtgatgaatcatcataactaagccatataacaataataagactaaaatagttgtcacccgttgtagcgcatgggcttttctcttgaaaataaaaaataaaaatattaaaagaacacaatacgatattaattaaaattgaaaaaaaaattctgaaattacaaaacgaaaaataagatttcaatttggaatacaatttataaataactaaaatttatgataaaaataaagactattgaacgaaaagaccatttaaaacatatgacgagataaattaagtaacatgcctataatggagtagagtggtggcggttgatacgacatataaaaactgttaataaaacacaaaatagaatcctaataacgattaaaaggagagacgataggaaggccgtgaagcaaatgaacaagacgattgccgggacttctaaaaagtaaaaaaaaatccaatgataattatattcgatttttaaaatctcaatgacaataaaaaggaaaagcagcgggcggggtgtataggagtatagttgcagagccgccgacggttgacgggacttctaggaaataaaaaaatgaattccaacgatagttatgttcgatttttagaaccacaatgacaataaaaagtaggcggcgtacgggccgtagagaagcatagtggcatcgtttgacaagacttctaaaaattataaaaaataaaacccaacaagacaatcaactctaaaaactacaaggttcaatttttaaaggttcggaatttctaaaaagtaaaagaaaataatgataatcatgttcgattttaaaatctcaatgacaataaagaagggaggcagcgggcgaggcgtagagaagtacaatggcaaagccgctgacggtttggcgggacttctagaaagtaaaaatgaacccaaacgataattatgttcgatttttaaaatctcaatgacaataaagagaagagatagtggacggactatagaggagtataatggcaatgtttgacgggacgcctagaaattataaaaacgaaacccaacgtgacaaaaaaaactctaaaaactataagatccaatttttaaagtttctaaggagaatgaataaaaatagtggtagatcgagcaagcaaataaagaaggagatgacataaggggtagcaactggtgtgacttttaaaaaactatataattaaaaacacggggatgataaggtttggtctttcaaactcttaagacaatgagatagctatttaataaattttaagtaaaatcatactaaaaatatatgattttatttaggtgctagccgggagctagttattactattgcgcacaagtctgaaacaaccacccggccgtgttttagaaccaaagacagagagagaggtagtacaaagtatataaagactaaaggaaattagagtccacttcgaataattaatgcatggtttctgcaagcacaattgaaatagacaagtcaatgcatggtttcaagtcttcgttgtactgtgcgccaaactttcctggctagaaagtacactgcaaaaattgccatctagtttttcaaagttggaacggttcaattcaaccatgcatatatgcatccaccccctataaaatggccaccccgcaagccacaaactccaccaccaagcaaatcacgtagtccctccacacacctcgtacctcgatctcgaagcttaattactagttaacattaacaatggctgctaataagctcaagttctcccctctccttgccctcttcctcctcgccggcatagccgtcacctcccgtgccggcgacatcgccgtgtactggggccagaacggcgacgagggcagcctggccgacgcctgcaactccggcctatacgcgtacgtcatggtcgccttcctcagcaccttcggcaacggccagacccctgtcctcaacctcgccgggcactgcgaaccaagctccggcggctgcaccggccagagctcggacatccagacgtgccagtcgctgggcgtcaaggtcatcctgtccatcggcggcggcgccggcagctacgggctgtcgtccacccaggacgcccaggacgtggccgactacctgtggaacaacttcctcggcggcagctcgggctcccggccgctcggcgacgccgtgctggacggcgtcgacttcgacatcgagaccggcaacccggcgcactacgacgagctcgccacgttcctgtcgcggtacagcgcgcaggggggcggcaagaaggtgatcctgacggcggcgccgcagtgcccctacccggacgcgtcgctggggccggcgctgcagacggggctgttcgacagcgtgtgggtgcaattctacaacaacccgccgtgccagtacgccaacggcgacgccagcaacctggtgagcgcgtggaacacgtggaccggcggcgtcagcgccgggagcttctacgtcggcgtgccggcggcggaggccgcggcggggagcgggtacgtggcacccggcgacctgacgtcggcggtgctccccgccgtgcagggcaacgccaagtacggcggcatcatggtgtggaaccggttctacgacgtgcagaacaacttcagcaaccaggtgaagagcagcgtctgagctatagcctcaacctcaagcccccaagcctgagtaattaacttacgtgacacgtatacttattacttgcacagtggttgagttggactataaataagaggagatccgttcatacgcatctgtaatatagtagtagtaataagcagttatgtatgcacaacccacatggtgtactttgtgtaactctgtgtttgatcatgggagtgtatttgccgatataaattaaataaggagaatgatttgcattaagccagtatgttcgagtttggagagctgatcggctctgatccacgggatagccccagtgaaccacctcttcgtcttcggtgttaggtcgcgtgacctatcgcgaccaaaaataaaagaattcttgtacgaaggaccggacgcaagatagatgtcgttaggtgttttttttttttcaaatgaaactcgtgatcagaaagtcaccaacggagccataaacgtatacgcgcagggcgtatccagttgtactatacgccggtgcctagcgttaactgatgatcgtgtactacgtgcatgcatggtggaataagcgtaaaagttgactaatccaacaaaactcaatcggtcaattcgcgaagcggcagctgtctttctccccgtcagcccgcagagcacgcccaccggcgcaccgcgcacgcatgtgacgtgtggttccgctggggaaggagaaacgagggcacgcgagctccgcgactccggtctccggcgctcctatggctaagaattgaaaggcaaaagctactctcatggtcatggcgaagcttccgcccgttgcctgagcagattggacctgtttaaaagatttgttacttcactggggaatactagggatcagttgaccgattcaggaaatgaaaatcggacgtacacgcgcatgaaggagactccaccctagtttcttctccctctctcctctttaaatatttttcctactgaattacttatctaatctaagtataatttgattatattgttatattcgttattcgttgtaattaaatctttacagcaagatatcatatgattatattctgataaaagaaaaacatatatttcaaatcattaaaactcaatgttccatacgtgatagcaacatgttttaacacgtgtcttctttgtgtttcataagctacctgtccctcttttttctccacttcatgcatgcatttagtgatattcggaatgatttttctcctaactacatatccgatctatgatccaatcactaccattctattcattgtaattaaatctttacaataaaatatcacatgattatattatgataaaagaaaaacatatgtttaaatccattaacactcgatgtttcatacatgatagcgagtttcaacctgtctttattgtgtttcacaaaacttttaaatgtttaatggctgatttttttcaccatatataaattaaagtttcatctgcggtcaattgaaacatttgactgtccgtttttttacatgacattggacgttgtcctttttttacatgacatccgacgttcgatctagagctcccccctatttcacctacaacaaaatttttattcaacttgcagttgtactttttaagcactattttactttttcatcagtaggaagttacatcaagattcatgttcttttatttttatattcagctggcagttagcagttacactcagttatatagcacttgtattcagctacaatgcacttacacttggttatagcgcaccaaaattagattttactatagttttttcttctagatttatgatttttgacctttttttatttcattgaaaacagactacatccattgattgaaaattctgcaagattcaaaactaaaatctattgaaagattaataagtagtaaaaagaaaaggttgtgttgcaagttccacaacttcaaacacaattatttgcctcatgcagatatctatcaagccttacagtaattcatataataaaattgtttctgttcatacaatctctgacaaggaaacatataggcagtaatacaaatcaaagaaccctgcgatactcatgctacggattgggaacgatcgctcacaccattttacatgcaaggtaacatatttagcaacgaatatagaatcacaacaatggctctctcatgtcttgcacacaactcactaagctcacagttaaatgatgccagtaatgccagcgtggtattatcatcaggcctaaggttttgctggaagaccgtcaattcattcatgggttaatatctgtgcccgcagtcttcacatcaaaccttcctgacctgaatattatgggtggactgcgaccgccagataggttgcctgccactttgaacaagtgcaacctcctcgccttccttcaccataccatgtttctgtggaatatatatagcatcatatcaaatggtgagtatcgtatgtggaatagtggatatttggggcatggctattttatcagtctattttcagcaacaattgctttcagtggctacagcgcaaataacaattttctgcattctgctaaccccaaaagttctgaaaataaaacattctattattctaaaggcgaataagtcagctgcttgtttttaatccaatttatgttttacaacaaaataaatggtatgaatatgccattcacagcaagaccattattttggtcatttcaatgccttttctagttctatacttatttgtactggaaaataactgtgcctgttggttcgttggctcaaacattaagacttgcctcaattacggcgtaaattttttttacatctttttcacacttgaacagcaaagcccctaatggtgcaaaattatctcactagagagaaggcataatactacaatattatttggcctttaatgataattgatcatgccttaaaatatcaagatgcttttcaacatcgattttatttcccagtttacaggcaagctgtaataaatttcaattctgaggtcaggtgtcaggacattctcctgataaatgagtttaactaatgcctattaaagtgacgcagagaaaatcagaaggggtagaatatattagaaattaccagcaagtatgacaaagcgtcaccaaatgtcttctcagcatcatcagaaaattccatctggactggacatacaccttggtacaaagccaatcgttgtctaactctctccctacaaacataccatcaacactaattaggtgcttgaagataccatattataaaggaaaaatgaacaagagaaacatcatacttttagagagccaaacatttcagatcaattgtctgttataacgtcagaagtacatactgtaattatattatctaaactcagttgtcattgatcacaatctcataggaaatactatcagctgatatttaaccattacctaataatgtatcaggacatttccaaatagagccaatggctggtaaattaaaagggccttccatcttgagttcattttgctcctagactaaagcaaaccaatgctaactaaaaccatgagatatccatgtaaccatgtagcataacagtttttttctttactaggatgcaggccacaaaattacatatatcatttgatacaaatggatagctcatgtaatgaacacaattgagcataatttctttcttggttcacagaggttatcaactaagaggcttggttggccaaggcagctcctgccaaagtagtaccgctagtcattagtatatgatgttttggacaagtaaatgaactatcatttgcctaaagttgtttgttgtaacgacaaatattatagaccagaggaagtagtacagatggattggaaatttggatgtgctaaatggaaaaccataacataatcagacaaaaaaagttaacataatgtgtattttactgttaattcaagattatacaactagaaagaaattggggtttatcaagcatcagaacgaaaaaaatagaatcttactggtccgtaaaggcaaaaatggtgccagaagggcggtaatgactaagtaggatagccataaatcctgtcctggtgaaaaccacaattgatgttccaagagtgttggacatcattgttgaatggtatgcaaacatttcactcatgtgattctacagaaagaaatgtaattagaaaagggaattgaatgaggaaaaggcacaggggtatcatggcagttcagag

SEQ ID NO: 71954 - DNA, 12177 bp, Oryza sativa
acccgcaggtacaccaaacacacacttatcggggttcagttttatgcgggcggagcggagattctcaaaagtttccgctagatctgaaagtaaggtctcttggttgcgtgtttttacaaccaagtcatcgacatacgcctcaacattacgtcctatttgactacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccgggtggatgacctcacgaatgaacccggcctccaaaagtctagccacctcctcgcggatgaaagcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaaaaccaccgatccgtgtggtcttggatgggccgtcgcccaaggcaacctccttgaccgggacctcgtcgcaagtggccatccgctgcctcggggcggtgggggcagaagggccaagcctctcgtcaccaccctcgggcttggacgcagcagcgaggcggtccgcgcgctgctcaatgcaagcaagcgcgactttaaggtcgccacggacagagatggggccaccagggcccggcatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcaatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcaacctgccctccccgggcaatgcacggtgggtggtcagtctggtcgaaagtgagagcgacctccgaccaccgcgcccgacgcatcgcctcatgggtaggggccatggccagaagctctcgtttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacctcgccgtttgccggatggaaccaccggggacttgccctcacggcgttcctgcctcctgtcctcctcccacttcctcgttcgctcagccaggtttttgactgcacgacagtccgcgagatcgtggagggaggtgttgtggacggagcaccacctgccggcggggcgctccctgccgggagttccggcctctttctttttgtcgctcgcaggcctcccctttcgggtggcccgcggagcgccctcgacggcgaggacatgaccctcgtcgccggaacggtccgtcctcttcttcctcctcctatcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatacgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccgtcgtacttctcggtgatggtgggccggaaccttgggggccaacggacgttccgaagactcgccacaaaggctctacagccaacaccaccggccgggggcacggagggctgatcttcacgtccatgtcgaggtgacactctggacgaggaggctccctccgttgcacggggagtacgccggctattacaccggcgcccgatgttgaggcgggcatccggctccccatgctgatcctcccgagtcgacggtgtagacgagggagtggcagccgaatgacgtgcagccgccgccactcgccgcgccctccgccttgatgatacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtgctgccgtcgccgtagacgaggaggcgacgctccccgtctcgccgttctcctgcatcacctgcggccggtgacgctgcggacttgtcgaccctctcaagcgcctccccctgcttagggctttggcgcggaggaggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagctctgaaagcacacgctgagccccctacctggcgcgccagatgacggagctcgtggctcctcaccgggagaccgcgcaggcccccctttgccagttcggccgggggcttagggtgaaatctcaagctctcactctctctgtatgtggtcagattactcgtcggcaagacacacgagacacgacgatgtatacaggttcgggccgccgcgaagcgtaataccctactcctgtgttttggtggatctgtgtatgaacgagctacaaagtgtccgctgacttctcccccgttctcagctttcaatccgggaaaaaaatcccccctctaaatgggcaaggtcctccttttatatctcaaggggataccacatgcacctttctctttccaaactggactgttctttttctctttaatgggcggagatcggtacggtttccatccgaatgacacttcgatgggacagcccacacctacctccactcccggcggagacgggcgcaacgtgggatcgtggctgcccgttgctgacgcgaccagtgtcagactggtcattcttgtccaccatgtgtcagtttaacaagatgcatgtttgcccttcttcgtgtaacaccttgcctgtaatggttaggataaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgtaacccgaccccccctcgggggaaatcaggaggagggcggacacctcaccctcgggcccgacgtccccgaaggtgccaggccacgcgggcgattgcgtctacctcaagcctctggtcatgatactcccggtcccatatcaccgacaggaacattgagcaaagaacacagacttacggagcaaagcaactacactattgattcaaaccatggtgtttatgcagctgcataggattgccaggtcctaattggctgattctgccactaactagaaatactatacttatattagaactcacgttagatagatagagtagagcatatatagggggtttagcccctctctcctaaacacccccatagttgtgaactcccccatttagatccgagtaccatcttcttattggccttgtttagattctaacttttttttcttcaaattttaaacttttctgtcgtatcgaattttcttacacacacaaactttcaacttttccgtcacatcgttctaatttcttcaaacttctaattttagcgtggaactgaacacagccattggcttgtggcgtgtgtgagatgcaatgtgattgaattttttggaataccctcctttttatttgagaatttttcgtgcagctgtcaaacgctttcaatctggcggggtttatttgtgaccctcgatcggtcaatggccagtagcaatccatccgtccgttcaaatccctctctgggaaacggacgaaacgggagaggcgcggaaaacccccaccccccaaatcggagcgcggaggcgccgaccaagaaaccctacgccgcttgggcggcgatgatggaggcggcgccggacgaggaggccgggctggcgctccccgagggcgagcggattctggaggtcaccctcatctccgcgcaggggctgaagcctccctccggcctgcggcggcggctgctgcaggcgtacgccgtggcgtgggtggacgcggcgcgcaggctccagacgcggccggaccgcgcgggcggggtcgacccggagtggcacgagcgcctcctcttccgcgtccacgaggccgcgctcgccgacgactcccgcgccgccgtcaccgtcgagatctacgccgcgcccgccggcggctggcacatcgggggggactccctggtcggctccgcccggttcctgctcggcgaccacggcctcctgtcccggcccgtcgggtccccgtcgatgttcgccgtcggtgtgcgccgcccctccggccgcgtccacggcctccttaacgtggcggccagtctcgtcgccgcgccgccgtccccggcagctgcccacgctctccgctcatcccccgccgtctccctcagcggcctctccacggcgcccatcccagcaggccgcgtgctccgcgtcctcaaccgctcgtttccgacgcccccaccctctccgacggttcttacgaccaagaagcagcagattgcagccaagccgaacaagaagtgcgctgacaagctggacgttgcggtgaagctgaacaatggcgcagatgatcggagcgatgaggagcgtgaggagttgagagagatgggcggggtggtgttttgcgggccttgtatcctaccattaccaagaaagatccacataagcccctctgacgagaacctgcaggcctttgctagcatcttctccggcggagttggcattaccagacagagccctcgccattgaggagtccaggcatttaataggttcggttctttcagttgattccttgtggagatagcctgtttcttcttgttgtggaaaattagtttcttaaccatgaggatatagtgctgagttgtattatagcatctattgttgttactgcaaatatgtctcactgattcttttttgtgtgaatcaatggaattatagaattatagtgccacaatgaatagcgcggaatcattttgttatctgctatgctcaaagaacctcaatttaaggtttgaagatttcgtttgaagcaatataagcctgaatgcctgagtatttccactcatcttaatggcatatgtggatattttcttgttgctcaatatcaaatttatcggtgatagtgctattgtgaagaattgtcaaattggattattcctggggctgtttgctttcttgatgctgcagctgcattgcaaaattgttgcctgggttgatttgtagtagcattgcaaacttagatgttgtgaaaagttttaatgacatcatattattttcaagtattttcatgtgaaatatgtagccactgttctttaaggttaacttggccgtacatgggtattcatgtttgtcttacactttacctgatgaattatgttatgtacagacaattcataataactagacatatatctatcatttcactgcttctaattaatgtcttctgtggtcatgtggaatttagtaacagttgaacctttagtttaatctgagggactattgataattttaattcatattcagtgatcaaaagtacttaatcttagatttagtttgaaaggtgtgattgtttggtttagaggaaagatcacacattaatgattgatcagcatgcatagaacagtattctatggttttttttttacagactagctctgtgggatagttctcaagccttaatggcctttgaattattctgaatgatcccttaatgaaacataaaatgaacaaatgattattattataatagtgctgggaagattaataagcagaaagatacttcaatggtagaaccagaggattagtgcactaaaggcctgatgcaaacaagtccatagtgatttgttttcccttcttttctgagaacaaaaaatgatatcagtactaactactctgtacttggtttgacttttgaaaagtcaagtgttttggaatgattagtgtgagcttttttatgtggatatcatattagttaccatatttgttgcaaaggacaataagtcttaaaaggttgaagatgcaagtggcagattaagttcaggatgatgctatgaatgccatctggttctctcacaagtcacaactatcagcttaatttctgtaactttgtttgtattcttttgttgagatatgtttactgggtttaactgatttgcacgttcttttatagtttatgtcataattcttaacacacaaagcttctttatgatgatttggcatgtgatggttccaagtgtccaacagttttttgtccaagtcagtgattgaatgcagggaataaacatcacttgtactgttgtagctaattactatcccctgaatgtagttgatattgtttccttctaagtttacaatctgaactgcaaaatctgatagtattgtataggaatgctttatggactgggttaaaatcttgcaggccatgtttagggcccaaattcgaaatagtttctttagcctgtgactatttatgtctcgagcctgtttgtggctttttttttcatagcctaggcttctggggctttgtagtctgctgatatcgtgggacatctaattgtaactttgttgtatttggcttttgtattaccaattttctttgcattgattctgaaattacgtgcttcctcgttttctatcttacaaatgtccatgttccttttcgatgtatcggagtaagataaagacagttttggttaattgacaactcatggaaaagtatctgcagactgcaatgttaagttatcttctaaaaaccaaatggtatacttgcttaaattgttagtgattcttaatgcttccaaagttccattgtaggatcaaggcagatttggtgaagcactgagagataaagtgctgtattataaaattgtctggaggatatccaaagctcatattgtgaccttacgatctaagcattgggtggactatacatgtacagtgattttttaaccgttttgacagccctttccatcttggtattttatatattttttagcaaacggtaattcaatgaactatagcgtcaaacttttgagcatttcaatgtagttttgatatctttgacaataatttgtggactatttctatgtgattagtggatgctttctatataaacaatcctcttggttctgatgtaaagcattatgtgccgtgtcacttgaaaatgacaaaacaatattcagattctgaaaaaccatctgccttcttgactttgatgattcaagtatccagcaaggggatagcaagcaataaactcatgatgttaggtcatttgaagatcacatgttttaatagttttgtcaggatagtttgtcggctttttttgggttttggcacattttttaatttttttttctgtacctcgactattgagtatatatttttttgtcaagagctgtgctacagtacttatgatcctgtatgacgtgctgccaccaaaactatcaaagatgccattttcactgtacacctaaatggtggtttcttcaccatcaccatcgccatcctccattctaaagtcgttattatagtttccatcagttgggtcatatgtgcgatttctgctctccaaaatctgcctgctttctatggtaggatcctatgttccgatttagcctgttccctcgtataattgttttcctgttcactcatattgctttacaatgacttatcgactagggtaaactgtttgacagttcagaactggaaagggccacttgcggccgtcagatttacgtggaactcgctgttcctttgcttattgcgcttattggacactgcataattctccaaaaagaggccataaagaagtacttgacgattgtgacctcacatcaatggccacatacaaccatgtaccatctcctttgttttttccaggacttttccatctcccccttcttccaattgcgatccacacaatcctgattcaagttgcgccaccgacgtaacatgccgtctttttcctggtcgatcctttgattgcctgaattctttcttcttttttttctacgccccaactggttgatttggatcccattcgttccctctcctttaccggaagaaccagcccacttcttttttttttctctgtctttgcagcttttcaagtgcaatgttggagaagatttcttcgacggcgcgagctccaagaacctcacaaattgttccaatattccattgcacactcggggcatattggttggatcctattgttttagatgctgcccatttgctaaacacgccatgttagaggtctacttgtcctttctaggttccttttcttttgatgcgtttgcatatacggtatatatgtactagattccatggagcatagcaaaagataaccactgttgctttgcgggcatctcatagaagagaggagcttcgttgagttgaaaatgtttcaaggacaagtgatgcgaattctgtgtgatgccacaagtggaaagaatagcgcaaatgtggcaagcaaagcaatgcatatgcgctgcttttcctggtaggtatgtggcattgctaggtgcggtggtagatgtccaaggggaagaagcacaaggaggcagccgcctctagtggcctcgccactcactcacactgcccccggagtcttttgctctccaccacctcccatgtttcaaggtaaattcgtcgtggtggtttcatgccttgtgcatatcaagaaagatgtacttaaagttcctgatgccttgcaacgtactcgagtttatatatatatatatatatatatatatatatatatatatatatatatatatatatatatatagagagagagagagagagagagattatgtgacggttgattgtgtttcttccttagaagttcatatgctcacaggtgctaaagtttcggacagtcaaatgtatcggcaataccgtatagaggatgcacgttcattttattactccctccgttctataatataaaaatctagaaccagatatgatattttatattacaatgaattggacagtgatcattttattattttcttcattccataatataaaaatctagaaccagatatgacatttcatagtacaataaatctgaacaaggaatgtcctgattcattgtgctatgaaatatctcatctgatgcttacatttctatatcgtgggacacggagggaaaaactccaaagtttgtaaagtagactggtagcttcatagggtgtgggtgtccctacattctgcttatatacaatcacaaagggtatcattgctagctaaaaacagtcacagtacaaggtaatctctccgtcccataaaaaatcaatctagtactagatgtgacatattctaatactacgaatctagacatacatatgtccagattcatcatagtagatatacatatgtacatatttatcgtactaaaatatatcacatccggtcatatgtttattttttatgggacgaagagaatagatgagcaaccgggctgatttagggtgtgtttgagaagaaagagattggggagattgggaagatacgcaaaacgaggtgagccattagcgcatgattaattgagtattaactattttaaatttcaaaaatgaattaatatgattttttaaagcaacttttctatagaaaatttttataaaaaatacaccgtttaatagtttgggaagcgtgcgcgtggaaaacgaggtgctttctcaccctatatcacacccaagcgaacgcagccttaatatacacctagccaaagctacccgaccacaactgttctactaggggtcagtgattcagacattccgtactcatttgttcataccatcttcatttcaaaatattcatttcaaaatatatgatatggtttacttttcgtataatatttgatcattcgtcttattaaaaaattaatataaatatgtttaaagaataagttaagtttgtattttatttgatgataaaataattcacaataaaataaatagggacatatccgatgaaatgagctaagtgttggaaactcatgaaaatcatacttaaaagtttagtaaattcatgaaaaaaatactagagatgggtgtagatatgaaatacattctcaccaaatcccagctccaaactcaacttcgtttatttatgaaactttcagatacgatttttacgaggttttaacatttagcttgttttcacactttgaagatgagtgattaaatgttatgtaaaaaatcaacgacattataaatttggaatagagggagtatttgccttgcaccctttccgacagttgagcagacgaaagtatcgccgcgacgccgcctcgttgctttttactcctacgtggctacgtggtcgtctcctttggccttggccgattgatcgatatcaacattgatcttttgacgcgccgaataaataggtcgcgacgttcatgagaaaatccacccggtattggctttctcccttccgcgtaccggatgctcaagtgctcaacttggaaacaccgtgcttgcctgtttacacataatctttaattttctgcgatgattgcctgtgccctgacacctcgctgcccgtccgtactagctttataagccttgtttagataaaatttttttaacaaaaacatcaattacacagtttgcatgtaaattacgagacgaatcttttaagtctaattacgtcatgatttaacaatatgatgctacagtaaatatttgctaatgacagattaattgggtttaataaattcgtcttgcagcaggcgaaatctgtaatttgttttattattagtctatgtttaatactttaaatgtgtattcatatatttaaaaattttacacacataaaactaaacacaaccacagtgtagtgtgcacctaaagctgggcctcatgtcttcaggacaagcaaggttccattgttagtctgaaacagagataagtgaggcaggcagctgagaggtcactgtttttagctctccaggcgtccagctagttactgtgttggcgttcagagagtgacacacacacacaccgtggagcatctgcatgcgtcgggctcgtcg

SEQ ID NO: 71955 - DNA, 13362 bp, Oryza sativa
taatctaccatggtgtgtgaaatgcaataacagcagtaaggtatgaaactattttacaatttaataagacatgacatacactactagatcattagtgctggctacaaagggtatcacaggtggttgactaattcagaaagttaagaattttatcataaggatgtgtcatgctatcaataacatgcttcaattttgttatatatttgtcgacaaattttatcctaaaaatttgacagatgtaattacagtacaatcatagtgtaattacactgtaacttgcatgtaatttcactgcaacttacatgtatgtaacttgtatgtaactttcacatgatcttgaaccgttagatttgttttaagatttgtgcaagtgaggaaggaaaaaggtcacagcacacacacatgtgagaggattcattcccacgacctccgtttcaccgaaatagcatgttacatagagatttttgaaagacattttagttacatgcaagttacagtgtaattacatcacgatagtactataattacatttttcaaatttttaaaagaaaatttgtcgataaatgcgtaggtgatcccaacatgcttagcctgaattttcagctaccatattatggtgtgtttggtttgaagattggttccatccgtcatggtctactggtcttacataccaaggacagctgctgcctgatatattttgatgaataagtcagtcctggtgattggtttgtggggaatctaggcagaagtggctttggtgatggatgacacggacttgtgacgcagaccatacaattcgtattcggttatttagattaaacacaaatcaaacacactgttggttagagaatctggacaatctaagcaaggcttcaggtaagctcctacaagacctaaagcctcagtacagaggagatcaggagaagcttttattgtacttcctccgtttcacaatgtaagtcattctagcatttcccacattcatattgatgttaatgaatctagacatataaacggaggaagtagtaaacacagcaatagcttatcccagttcccaactagactgattctttttagcactgcacgagatttcaggaaataaacttttgttctgtatgcactatgcagttacttcagaagtcttgcgcatatttgtatgctgctacttctggagttttaatataatagtaagcctttgtacgcagttatttcaggtgtcctggcattatattatctacctaatgagcattaatagtcaaaactgtgttcattgcatcatatcttacaacaataactttctacagagcagaataaccaagaatgctctacagaaatgatctcctcaccaactgatagttcgagatgcattttaatggttctggtgcaagcaataacaaagagaacttagggaatgatccatgtaagcattccatattacagatcttccaaaaaatacacaagctatttatggacagacaggtgatggacctcactcgaacaaaataaaacacacttagatttagaaagtaccagccaaggctgtatattgcacataatttcagtttggtctaagtgatatgtatggattccaacaaaagcaagattacaaacgagaattaaacataaaggtatcaagcaaaaggcgatgagatataggcagaagaagttaacctgcagaaagccaggccataagtagcagctctcagtaacgcatgttggcgtgaaatatcaaactcatggccagcagcatctatacatgcttcaattgcctcaggcaaggaagaagaaatcaactgataattatcgtatgcctgcaagtgtgaattattgttaatgccacgtgtttgattttcagcaaaaaaaaaaaggtcatttgtgagatgtcaaaagagcaaattcccaaataagtttttttttacagcatatgaaatagcaaacaaccctgatataattcacaagttgcatactatgaatgccataaagtgcactaagctaacaccaagtccatgacaaatgtagaaggcaaacatgcactgcacaagacataggtatctacataagaaaaggaattaaacagtaccttggcactttgtttgtcataatgatctctagcatcatacagcaatgctgctggggacatgcttccaatgccaaaaattgatgtagtggaatcagggactcggtgtaggaattccatatttgagtttgagaggattcttacaccatcacactctggaatgagctttatgggttcatcgtaattatacagcaccggatctccatttggaccaaccatcaaaagagctgctgaccagtaaagaagcacgctgtccaatccacaccaagctatttgatctggtggcaatgcggactacaagattaaaaacaaataatgagtagctgtgcaaaagtgtacttatactatcagtaaaccatactaccgcaaaataaacacaaaaaaaagagcatatataacctagaattgctttgtttgcatgctatggcatctgcccatgattgtttaaagacctaggatcaacaataaatttaaaagaattatcacaactgctgcacaggttgcagttctcgttgaaaataaacagtgataacaataagattacaccaagaatgataaaaaaataatatgattgttaactcggtgagcgttgcatgtttgttgaacatatatgcatctttgattaaccagaacaggtaaggggggaaaactactactaccctaatgtatttgaggtgctatgttatcagacacaaaacagcaatgtaaactaggaaacaaattagcatattcaccgccacttcctcaaagtagtattaacctcattagatccattcagtatttcagttagctgtagtttgaatcaatctacatcgactgctgcacgcctagaacgaacagagtagacaacacaatgcattaaacaacttacatcacactcatactcgaagattatcttggagaaatccgtagggatgacgagcaggcgcccatcgtgcgcaaatgcggcaagcagcttcccattgggggaaactgccatcttctgcacaggtccaatctccagctccaacccgagtgtctgcacatcatcctcatcaaccgccagcactcgatcaccaaccgcaagcagtacctctgggctcccggacatgacaaactgcggctccaccacagccatgcacagcacctgctcgtcctggccaacgcaagggtcggcgaactcacgcgggtgagggtccgcggcgtcgatgtccgtggtcaccacgacgcggttgtcctccgtgaggacagctacgccgcctccccagaaggcagcgtcggcaacgccgccggaggacgtggggagcaggggcacgggggtggggctagggttgggcttcagatcagggaggcggaagcggaggagggacccatcggagagcagcgcgacgaggttgagggagctggagaacgcgagcgagtggaggcgggggagctggggcggccacggggaggacgcgatggggtggccggaggaggagtagaggaggaggcggcgccgcgacggctccgagtggagctgcacgatcttcgagtcgtcccggacggcggcgatcgggcccccgaacggcgccgcggcgacgatgtgcgtggagaggtcgaggcggccgagcacgccaccgctccccccgccgccgccgccgccaccggaggtggaggacgaggacgcggcggcggcggaagggggcgaccagggcagcggggagtagacggtgatgcggcggtagaaccggtcggagaggaggtcccactccgccgcgacggagacggaggaggacatcgccggcggcgaggcggcggcggcgtcgcgcgcgagatgggctgtgaggaaggaggtggactgtctcggggatcgagacgggacggttagtcccctgacatgtgggtccaatcggatgggaacgagctccacacggtagcccattgaaaagcccagatgagacgacaatgagcagcccacggatgcggggtgcgggagaaagcggcccaaacaaactaaccacacaagcaaaattataggagtagaagtaaaattgctaagatcctcgatctgcaagttgcacgggctgctattatagactacctagtgggggattaccacgtgaagtttataattcattgggagttagatttaatgcgcaactctgaaattttatatgtctatatgtaacattatatgtagaagtatatttatatttcatatacaactcttaagttctatttctataagatctggatttcatatacaacccttatattctagtattactatatgcttagattttatatacaactcttgacttctatttctctagacataattgaaatttgtatacaactatatcaattaatctatacttttaatttggacacaccatgatctaatgttaagatttttttctttgattaatgttgggtgagacgcgctgatgatggtgaatacgaattttcgtggcaggccgcattgcgcctttcgtggcagactaaatacgaatgataatagggtcaggaaatgctgggcatctgatccgcattgcgcagattgcccagctattgaatcagcagaccacatcgttctacgctgcaagttggcatctgagatttggaagaaaatcaacctatttgatcaggccgcccatcgttctacgctgcaagttggtatctgagatttggaagaaaatcaacctatttgattaggccacccagagtgcagatatactccagttcgttgaggagggactgttggttacaccggcgcatctaaaacctggatggcctatttgcttcgctgcttgttcacacaatttatggaaagcacgcaatcaaaaaacattcaaccaaagagagtatacagcggctgccgtgatgcaccaaatcagagaatgtctgcaaatgtgggagaaccgcgtcatgccacaatgccggactctaatgcgcagttgggctgccttgctagcatagcagctatatctccctactctttttatgttcttctttatattgttttctttttcgtttctctcttctttctcccttctttcttcttccttcctatatctccctactctttttatgttcttctttatgttgtttcttttcagtttcttttcgatctttgtacttctgttgtaacaccttgactaccattaataaaatggttataaggtagagcctctctacctttttcagtcaaaaaaaaacatatcgccgatgtctgatgagatgtggtggttgcgatggcgagcatccgtgagcagagcggcggtggcaacgagaagaccaggcacacacgagttacttagggtgacaagaagagtaggcaaatagtagttcttaatgcggggacaatggtggagctagtcatggtggtgacaacccccatagttgaggaagagaggcaagatgagagggaatggacgaaggaagaagattgggagaaaaaaaataaggacaattatattgaatcatggacaatgtggcaagtgagaggatacccacctcaactttgtggcaaatttactaagccacttaactatgtgaaaaactaattaagtatgctccaacttttgaggcaaactacataattttccctttaatgttaggccatgtttttttggaagctcaagatgtgacgagcaaaccggtgagaatatggataatttgggtctaatatttttactagcattttattcacagtatatgaaaaaaaattgggttgtttggaggagccagggattcttgaaggagaatctcaatttctatttcaagctatttctgtttatgcatgtttttttaagatagttctgtttatgtatgttggctggatgacttagcagttctcatgtctaccctaccccatgatgcataatctcttttgacgtaccacctttcctatcgtatcaagcttttgacgcgggtagcaatcaatttttatcatgggataaagcaattgaaaaggggaatggaaacagtattctgattttgtagagcatctctagttttgggtccatatgcaagcaaaggggagaacaactttcatggatactatactcgcttcatccttcactttttccccattcatgcctaaactataattgactgatcaatcttaaagaagtttaatgaacgtacggtatcatgatacgaccttaattacagatggcatcacattgttttttaactgcaaagtatgtctgaactatctcttttgataagttagaactagaagcatgttatgcgacattgatatcaaaactagaggtagctaaccgtgatagtgttatgatatactcatatatgtgtgagtttagtttttttgcgaaatgtacaaataaaatattctcccgagaagacgtagtatatgtgtatatgaaccatatacatatgtagcctagtgattacagtgacctgagtagcaccccaaggtcctgagtttaaatctccatagaagcgaatttcagattgggttatttgaggctaagtttctatttgataggctaagttcctaatttaaaaaggccgcatatatccagttggatgtaaatgctggttaaaaaaaatacccttctctaaaaaaaataaaccatatactactcgcatcaacataattaaatcctgagtggtaattcaatcatttaggtttagtctgcaagtagtgttttatttacagccatcattgggcataagaatgcccttttattttccttcacttggagaaaattaagttgcggttgttttttaataatggattttcattaattcagcctcaatatccacaaaggatatacacaaataaaaggatataaaagcacttagactcataccttaacaaagaaaacatacaaccataaaaagaaaaccctacgacctcggcacatccctcctttccaacacctctcctgaaaccgtcatattaggcgagtggaaatcgtctagtcgccaccgcccatagtgcgtcgttgctacaaacctccgctggtgccattttcatccgcttcaaattaagcagcggttgttaccatatcaaattgtttgaagacatgcagatcaaaaggccaactggtgcaattacaaaaataaagaagaaatacaccagcaactaaaatgtctttatctcaacctattggacttgcaaagcaagcatcttggctacctgaagaattgatttttttttttgcttcacttcaattctggcagcatgtacagttacaacttccaagttcagtgaacttcactgaccatttgtcttagaatgtagatatattcagattgggctcacaaacatgaaatttcagcagcaaatccgaaagataaccgaggttctagcgagcatagttggtatgatcgttttgcaaagcaactgcaatttgcaaacagatttataaagagccctctaacaattgtctctggtgttatttgcctccctttttctttgtgtacagataaagctaaactgatcattcttcttttaaaacggatctgttgtcacttagtggaaaagatacacttaacattgcatgttgtgcttatactattatctaaaaaaagaaacactgaaatgacagagtttgtgcaggggtcaggaaagcacttttttgtaacaaacttttgtaatcattctcttgaaacttattaggtgcaacatacatgaaaattcaccagctcatccgatattctgatcactgaaacaaggataaaagaggacaagcatgttgcatgtcttcagattaacataaatgcagaatgcagtgcctatggaagcacatcaattggacagaaactgtgggggacctgtatgggcactagcatatacaattatacatgtcatcgcaaaatcagcatcacagtttaacaaaaaaaaaagaaatatttcgaagcatcttacaaatctctattattcataagataaaaactgctaatccacaatcctaatcagagggcactaatgggtctcagcagtttattctaatcctggacccaacatgaaccgatttccagtggcgatcattggtgaattgcggttgttggaaagcggatggcgagcatcattacgcttcaaatgaaatgcattttcatgatctagctatatagctagctaccgactcccttatattctaagaaagtaagttggtgatcaagctgcagcaaccgtccgtgtatcagacattcagactatcagtgcttgcaacagcttgttgggctgaactgtatcagttttctgcaacaacatgttggtctcaattgtcctagtttgtgtgtaccacaatgcaagattggaaaatacgttgcatatcgtattcttggagcgatatgttggtctcaaatccaactgtatgtaagttgtagtgttctctggtactaacaagattcagagttgtggcattagggctctgtatgtagtgctaactttttaaaaaatgttcaagctttttgggatttagtgttgctcactgctaaagtgaaagaaatgtgcagaccaagatcaaatgctctgcctacacatctgcataacttgtgaaatgagcttttaccattgacttgtgaaaaagccagttttatcactgcatgcagagatgaaatggaacatacaaacaatataggactcattatcttaggtgtgtttagttcacgccaaaattgaaagtttggttgaaattggaatgatgtgatggaaaagttggaagtttgtgtgtgtaggaaagttttgatgtgatggaaaagctggaagtttgtgtgtgtaggaaagttttgatgtgatgaaaaagttggaagttttaaaaaaaaagtttgaaactaaacaagggctaaagcatcatgggattgactgaactttacaccttacagaggagaagaaccatataatggtggcatggagaccaaaggctgcaatgcattgaactgctcaacctttttcactggtctttcactggccatgcatggatccatggacaaactgagcattagaccaggatctaatgagtgagactgctgccttccaaactcccaagtatacaactcatagcatgtatgccatttgggaggccggcgtttcagtatgcatgctttgcgagtatataattttgccagcgtgtgacgtttgagttggagatttgtacaacattatcttgtcaattatcggtagtctcccatgtctgattctgccttggctacttaacgttaggcaaagctgggagaaatgattgtatttgggagtataaaaatggccagtcattataagccttgtcgcctaattgctgttcttaagcactttatctagctctttctataaacccatcatagcaaactttaactttttttagagtaaaagcgcggcatagacagtttgatgtaaacattaactaacaacttaacgttatctctgatcttgtggattccttcattattcagaaagtaatggttctgaaaaaaaaaaaaaggaagtgcaaatctttcactcgcggaattgcaggcaccagcatacaccaactaatttcacactccatccgcaattgatctgcctacgatgagtaaccgttacggacaatcagctcatttggtcacaaaacggttagttctgttaaggcatgattacatttacacgcatcactttttttgatgcatcactatcacatatgcacaccatcttgacatacatatataccgtcaccacttcacacagtaaaactccactcgtcataatactcactcgaccactgcagcgtcaagaaacgtaaccaatgatcatatggttttacaagtaaaaacattgagctccaaaaatgaacaactgcgagcgatagttagatgcaaaaatcctccaggaagagaagaacgaagttctcaaaaaagaaagaaagagaagaatgagacagtcagagtagggctcttgacatggactcgttaactgaacttccattagcaacgacttgctagtagctttgcggcttcatacgccatgcaaatctcccagccctatcaatcttttcatctttccctttgcagccaaaaatcacacggatcaaaatgaaagctactccgtagctagccaggaggtatcttggcaaaagccatacatggatttattgaagcatcaaacatgcagacagagagttggtgagaaggcaacaccaaatacattgtgaaatgtgttctatttatgtgaaagggcatgtagcggtgtagcctagtggttgcagtggcctgagtagcacacaaggttccgagtttaaattttcataggagtgaatttcagattgagttatttgagggctaagttccctatttgataggctaagttcctaattttttttaaaaaaactttatatatctggttggatatagaggctgggtaaaaataccattctctaaaaaaaaggtgttctatttcccattttatactgcttggggagtaaaaaagtgttccattaaatttgaaaagatgagttctatcatttctacaacgagatgatttacaatgatatttattgctatagaaatcacatctaaattgtagaaatccaatggatcgtatatatttatgatatcactccaattactagtagtagaatgttgaggtcacttttactagtgataatgttggtaatagaataccatgaaaaatgttaaaaagcgaatttctgctaccccagacacctggccggcactccagaaccaaacgtttgatgactctctgcttttgcgtttcagctggaagcacaacttcgcgcgtagctagcttagagcagcaaaccgttgctcaccgcaccgcaccgcaccgaaccaccacagcaaaagcctctctctctctctctctctttatttttttttaatacgcaagaagcgcatctttgtattaagaagaaataaatgtacgtacaaaacaggccaaaaagacgaagcaaggggatagagtacagaggagaaccaaaagactaatctccaactaaattttacgacccttctccactaacatgagctcctctctctctctctcaccttcccggcgcggccggcctaccacagccatcatcacgccatccacggagcggcaaaagctcggcgaaatgcgcccaaaagcgcctctcatttcatcagtatgatcaccacccccggttcccacacgcagcagcgcaaagtccacccccgtagtatatttgcaggagctttcgctgctgtgctcatatcaaaatctcccccacgggccacacgcggcgacaccggcacaccaactgagccctcgttgcttgatatagatcattagatcgttcccattggttggctacaaaggttgttcgccatcttcgtctctcctgggactggtagccaccgcattgtgaggagagatttcagaaggcgatttttggttctttagttcagagttcaggcaggtttctctttcatgttcttgggattctgtggcagtgagaatcttggcagagaggaagaaaggatgcctttgaggtagcatgaggtgaggtgagtgagtgaaggagaggggattcatacggatttgcagcctctcttctcctgccattgttcagtccgaggactgcattgtgtgtggttgcccttcttcagtttagcagttaatttcactgccaaggcttgatttgagggttcgtttttgaggaactcttggtgacttttatgttctaggagtggctgaattgactagcaaaatgtttgtatctgcaagaaagagactgttctttctgttcataagttctctacttctgtcgcttcttgcgccgtctgatggctcatcaaactccacagcgaatctcaatcaaagccacaacaagaccggacgtactttggaggtatcaatatttttcttgcatccaagatttctcaatcacattctaatttgtactagttctcaattatattcagggaataagtcttaagtgtttcttttaattgttttggtaaaaaatttgttagcttgctgattgcaacaattacgtttcttgcagatgacacccaaagtattatttcaactcaagatgcatgcattgttccactggtcttcttttggtttcttgatgcctgtagggataatactagccagaatgtcaagcaaatctaaaagcggcaggagcatcagagtccttttctattgccatgtcatttctcaggtctgcaccttctacaggacataacagctttgctttaaagtttaaaatgttcccttttcttgttattttatagaacaccagataatattgtgtctgattgagtgttgcagattgcagctgtccttcttgctaccggcggtgcggctctttcactaatgaactttgagaattcattcagtaacagtcaccagagagtaggattagcattgtatggattcatgtggctccagccgcttatcggtttcttcagaccagaaaggtagaagaaaactactttctcatgattcttacaaagttttgtctctaggatttatcctttttgtgtttctgcagaggtgttaaggtaaggagcttgtggtacttcctccactggcttcttggcatcgcaatttgcgcaactggcattacaaatgtctacattggccttcacacataccatgagagaaccacaaagagtgtgaagctttggaccggcctccttactttcgagctctccttactgcttttcttctacctcttgatagacagatggagctacatgatgaagcaaggaaatgcccctatcgagcagctaagacctaccgacaatcgcaaaacctatccgacaactcttcggaaggaattgggtatggtgcaagagtgagatgcccaaatgaaaagacaacttaggagggcaggtgctgtaaagtttgctgagaaagatggtaatgctgctcaatggtttggtaatttgttggtttgagaggtgtgccttgaacactgtacagttctatactttattgagattgaagaggattatggagccctctggtgctgtatcttgtgctgtgcatttaagattttgttacaaaccaccgtttgtactgtttgtgaaaaagtacagatatgcaacatttatatttctcaggcaagaaattattgtctactactatttacgttctttttgcagacgttttttttttcaagtttgcagggtcagtagaagcaacagtgcaacactttcccatgccaattctaaaatgattacaaatatgaaattatagcacatatattattttgtaaatctatatgcaagtatgcaagttgaatctctgtataacatcatacgattgtttcagtttcagaacatcattatcgtcgtgtttagatccattctatcgatgctccctt

SEQ ID NO: 71956 - DNA, 510 bp, Oryza sativa
agaggagatcccttgcttgccattggattcctctccaattcccttgactctttcaataaaagaaaggcagcatcctgcaatttctctcgatagtttaggaagtaactcatgctaggggatataactaactgtagcatgttaagtttgtagaaaaaggagctaattgtttatttcatggtaagcaaaatggaagactaagataacatatgattttcaactgaaataatgaaagcaaactagatatgtagcaaacatcacaaacagtaatagttatgcacctacctgaagtctccctgttgatagaaagaagtcctttagagcttcatgcttggaatgtctgtgagcaaaacagaaacatatgcaaccatgttgaaccagagctatgcatataaaagatataacgcaataatcagaaacaggacagaagcatcaccttgcatatgccataaacaaatcacgagccaaaggccttgcattgattacgccaaaaaaatccaatggagcactctg

SEQ ID NO: 71957 - DNA, 8055 bp, Oryza sativa
gtgcacctgcgttggttggttgcagaagcgcggggggctgttcgtacgtgcgcgcgtgtgcatgctgcatggagtgcaggcctgcgcaggcagccccgtgtgtgtctcctcgtgggggttcggctggctctgcaagcccacctgcctacacaaacaccaacatgcattgatgcgtgggagtatacaggggggagagtgtgtgtactgtgcatgtgggtgtggtactcgtgcgcagcagaaagtgcggaagggaaatcccgtcgtcgtcgtcgacgcccgtgtgggtgtgtggcagatgtgagagagaaaccatttttttctcgacgggcgagacagagcagagcagagagaccaccacaggactgggagaccagaccaccgcaggactggagtgaatacgaccgagaaaaaagagggcggggcgtgtttacctgtttacccgttctctgctctcgccctggcctccagctccctccaatcggcaatcgctagggcgtttggtttgacaggatcttttttttttctttctaagaaacttattttataaataaaccctcgaaaaacttatcaaaggaatggattctcgtggcgctagcaacaatcagcattatttgcaccgcgctccaatataacggcgtcaatgatattggcatcattcctctcgccccctcgtgaaagctaaatcactcatgtaaatagattggtgccaattacgctaacatcgagagtctatatgtaaaaaaagttgaaaatggatatttttttcataacaaactatttagaaataggtccttagcgcttaggacctatttgtaagaaaaaatattttagtttttttagattcttttttataaataggttctcggttttagtgtcattagcgtcaatcaaaatatattcaagttaatttaataaaattaatttagtgttgtagatgttactaattttttctatgaacttggacaaacctaaagaattttgactaacaaatagtcaaacgactttacaaataaaatggagggagtagcttctttaccctaagattttctcctctccttttccccctaaaactttgcctaaggttttatcataaagttgttagccattcccggatttggctagatctagcaagaacatgtgccaaagttagaaaatgaaccaaacatgttctaaccacgtttcccttttttcagaccttgttcggttatcctcaagaggaagggattgagcaggattaattttataccgcaattggtatgaaataaattcttttcaattctctcttaattttcacgagggatattaactgaacgatgactaaatgagtcgatctcattcaggccgtctttagttccacgctaaaattggaagtttggctaaaattgaaagtttgaagaaaaaaagttaaaagcttatgtgtgtagaaaagttttgatgtgatggaaaagttgaaattttgaagaaaaagttgagaactaaacaagacctcggcttatttccctaccatgggacaatcgaaggaacaaacaggatcgtgattcatgagtagccgcgtgcgcctacaagagaccctttcagataaacgagccaatagccggattttataaattaacatacgagaaaacggccctttcaaacacaatagttaatcaatttgaatcacatatagaatttgttcaatataccatttgaataaaagattgcgcgtctatggaatacatgaatccatgagagtttggacggaatctaacatgagatctaaccttatatgaaattcccttttcaagtattcgtttactactttccttgacgggagtaagcctaattataagttactatttaacatccgacagaaattttgggagcaaatctgtcaaattttgagccatatagtatgggctttaaaatccatgcacgctggatgtgataaaaatcaaaacaaattacgtgcggtgagtgtcgaaccagtcacaagtagcttccgcgtgcacacgtcccccactaagtggcacaattttttcaacctacgtaccactcatattctacttaaatacataattatatgctacttacattataatttaactatataaataatcatgtcgtagtcatatttaaaagaatttttggggatttttttaatgatagatagaccctaataataaagccaataattggctctatcttgtgtatatcatctataacaaacttttaaaacacagacacatcatttaagcgagctaacgaaaaatagaaagttgaagtttggagttaaataacgtagccttatttccataaagtttgttttaatttgtgctataacgacatacaaatatgcagttagttttgcttctctcttttttcttcttcaaacttaacacaaataatctggttggtaactcttatatcctgcggcatcaccttattgcattcgcttctattaaaacatttgtttaaagatacggagacccagtaatactcctatttactttagtactacctctgtcacataatagatgtcgctttaactttttactagcaacgtttgaccattcgtcttatgtgaaaaattagtgcaaatataaaaaacgataagtcatccttaaagtacttttgataattaagcaagtcacaaataaaataaataataatttcctaatactttgaataagacgaatgatcaaacgttattaaaaaactcaaagcgacaaatattttaagacagagatagtaaattactactccatgttgtggtgataatttagtgggtacgcagatctgaatcttgtccgatgaagttatctacgatttcaccgttacatagtatatggtgtttccccgtgagctgcaccgcactgcattgttttaaaatggcgttcccacacttaagttcgtcgcgtgaatgatcgtgtgaacgtgtttgtttgtgtcccctttgatcgatccgcggcacggaaaactttgatttggcacgtagcggtacttaaaactgaggttgatttccggtctttaattggtgatcctgaccgattgatgaatagtttttgttcgattttattaaacaaaccacagcaggcagcctcaacttctgaccgatcggcactttgatattggtcacagttctggatggatgttccccgaaccatacaggcatacagccataagcgtgcccatccgtggcgagcaaaagtgttgatgggctcatggctcgatgaaatcttcggcccgtagtccataaatgggtttcagaattcgcaagtgttctccctctcggcatcttcggcccagagtccataagtagttcaggtccttttaatttatcgctgagtctaacattcatccctgaacagaaataataggtatggcacattccctaactcacatgtcacagccattttagtctcttggcagtatagtgaccggttttagctgacgtgtcgaagggaacgcatgtgttcccacatgtcaatgcccaactgttcttcctcctctccccacctctcttcctcactcttcccaccttcttttgcaaggcggtgcacaacaggtggtgtgtagagggcgcgcggacaatgaggagtgaggcggcggctgccggcgggaggccggacgaaggaggagcagcaagagagcggatgagaccaagaggagcgagggggggttgaggatgccgacagaggagtggaggtcgccaacatcttcaaggttgtttccctcgccgatgagccaccatttgttctcggtgaagatttgcaacaggatccccacgcacttctccgtctgccggaacctcgcgcgtgctcctgcttactagcatcactgccacatcgccctggaaacagcctcttcctcttcccaaccttgccccaccccatcattccattcgccaatcacgccagtgttgtcaaactcgagcttgatggtttcgtccactcgtggccgccatcttatcgcttcccccacggtcactgctattgaggtccatcaaggtaggaggttgaagaggatggcgccctgccctagcggtcaccgccaccactgccgacctgtgcggttgccttgctccaactgctcctcctccacccgacccccaccgctccttctttcccctctcagtatccttcgctcctccctcattcttctcagcctcatccgctctctcgccgctcctcctaagcccggcctcctgcttgtcaccgctcctctccgcgcctcccactgcgctctccatgctgcccaatgcgcatcgccctaaagatgggaagagtgtcagagtgaggaagcgaggtgggagacaggggcggagctagagcgaaatggatggtggtgccacttgcttaatttactctactttatatcgagtttaaactgatgcgggtacctaagtttgtattgagggggtgcatacattgagaaaataatgaagtatagctaaaatttttttttgaccgggttcctaaggcacccccctaatatatactagctccgcccctggtgggagaggagggagaagatgtggccgatgacatgtaggtcccacttaccacgttagtgaaaacagtccactatactaccgatgaactaaagttatattgtgagttgggggatgggcaatacccggtatttctatccagggacgaatttcagactcagtgacaactgaagggatctaaagtgaacttattgcttttgtgatggtttcagcccatcggtagcggcttcggttgagagacacggacgcagtaaccggcaagcacctcgctgaggcccagctcgctttccacaattactcgtacatcgacatcggtactccttgggaagagcagctacatgtcgaacccgttgttttatggacttgggagtgatgcctgatgcggcgtttgctcaaccttgtggaggatttacgtgatcctcttttcctcagaggctcagacgtcagtgttcacgctgttacgtacgcccgcggtcgtcacgaccgcagcgagcgcagccatctccccccctcaaaaatattcagaaatgtgtgcaccgatagacacaccggacccttgctcgtcattcgcttgcgaactgaaaaccaaacgaccggtccgggtgacacatgcgttttgccccggtcagcaagacgaaaccaagacccggacaacgccaccaaaaccgtctcacgtcaaaatcgccaccggctcacggctcgcccgctctcgttctccaccttatcacccaacccgtcgtgccaatccacacacacacatcgttgcagcctcgcaccgcccgataataatacgaccaaaccaaagacagagcagcgcgacgcggggggcaacaacccgcagctaaccgcggcgacctcgtccgcaccgcgccacgcgaccacactccacacgcctttcttttcctttttcccccaaaaatccaaagcaacctcgcccgaaaagaagagagaacgcgccgcgccgcgccgagccgcgtgggtataattgaagggaagcggtgcgctcgctcgctgcatccagctcaacgcgcgggggaggcggagcgaatcggcggatcggtgggttgcgggcttgcacgtagtcgaggctcgagaggagggggggatggcggcggcggcggcggcggcggggtacagggcggaggaggagtacgactacctgttcaaggtggtgctgatcggggacagcggcgtggggaagtcgaacctgctgtcgcggttcgcgcgggacgagttcagcctggagaccaggtccaccatcggcgtcgagttcgccaccaagaccgtccgcgtcgacgacaggctcgtcaaggcccagatctgggacaccgccggccaagagaggtaccattactttgctctgcttccatcgtctccaatctcatctgtagcttggctatattcaccatcttcccctgcttctgctctctcgatttcgctacttgtagattgattggtgaccatcatccctgcttctgttctctcgttttcgctactagtagattgattggtgatttctagtagcacaactccattttcaatcaacgactccatttagtccatcattggtagaacgattcatgtgctccagtgagcaaaatcacacgcatggcttctcttgcgcatttccacaaaaacctttacgtgttcaactcgctatgcttcacttttgcgcaatggattggattggatatccctttgatatttggattgacctcgttggcttccccccccccccccaggtaccgcgccatcacgagcgcctactaccgcggcgcggtgggcgcgctggtggtgtacgacgtgacgcgccgcatcacgttcgagaacgcggagcggtggctcaaggagctccgcgaccacacggacgccaacatcgtcgtcatgctcgtgggcaacaaggccgacctgcgccacctccgcgccgtccccgcggaggacgccagggcgttcgccgaggcgcacgggaccttctccatggagacgtcggcgctggaggccaccaacgtggagggcgccttcaccgaggtgctcgcgcagatctaccgcgtcgtcagccggaacgcgctcgacatcggcgacgaccccgccgcgccgccccgggggcggaccatcgacgtcagcgccaaggatgacgccgtcacccccgtgaacagctcagggtgctgctcgtcttgactttgactcgctcaaactcatcgtcgtcgagctatgcaaattgccaccgttcacagctttgtttataccgtgtgttttcgtcactgctgattgatactacaaacttgagaattgggatcaaaaggttgcattttgaagacgtgtatttgttgatcagagatagcgacatgcattttgggaccggagagaaatgagagactaattcaagctcgacagataatttgcccaaattttgatataagccgtggcgtttcgagaaatgccacccagatagacgtgcgacggatgataatttgtgacgaacgatgcataaacaatcaaaagacgaatcaaggcaatcaaatggacgtgcgacagataatttggggcgaacaatgcataaacaaacaaaaggcgaatcgatgcaatcacgctccgacgaccataagaatctttttggtcctcccgagttacggaattaggagaaaacaaaatgtacagaagagcacatgttctgttctgatttttaatctgatggtagatacaatgtttgcctagaaatgacattgtgagtttttttgtcggtccgccttatgatacagatgggggcgaactgagtaatttaaaatattctacaccgaagaaaatgatcaatgttatggctgtacagtttaggaagctgagttactcccggatcacaacaaagtgagcaacaaatacaggtagcagaatggtctaccgtttcttatatacaaaattgagctgaatatttgtcggaagtaaataactaataagattattcctgttcgttatccacttcttcttccggttgacaaagctgtcgtcttgcagatggggcataaattctttaccatcaaccattgttttatgcaatcttcgtggtacctgtggccacagtcaagggttccaatgcattctttaacctgatactcttcctgcaataccaagaaaagatttttagaacaaggatatgtcgatttgactagactaaatgttggtggatgagaaaactacataatctgataatgcagataaggaaccagtgcaatagtatttgtttttctaagcccaattggaacttatggcttgttttagcaacccacacttgtccctcttaacacccattcaaattccttaagcgcctgacaagaaatcatgaatgatatttaccaagacgtactctcaagtaactttatacaatttgagcaccgtggacctgtccacctttgcaaatactaatttacactgcacatacttagaaatcatagtacatcttacataaaccaattctcttgtaagttttcccacctgttggaaccatactttatgggtgataaaatggaacgttgcatattactatgatataacactagccaattccacac

SEQ ID NO: 71958 - DNA, 8503 bp, Oryza sativa
accgggagtaaagagtaccccgaaccgcgcgctactcagttattatccgcgcactcctctcgatctcctcccctctcattactccttctccatcccttcctctcccctttgccctcccgttcctccccttcccctctttgagtggcggccgagcgggagcagcggcgcccggcgggagctgcggcggccggccgtctgggtgcatcaggcgggcgggcgggcgtggcgcgggctggcgcggcgggcgggcgggcgggcaggcgtggcgcttgggcgggctggcgcggcggccggccggccgagctcgtgcggaggccgcaaggatggtggccgggaggccggcggcgccctcctctctgctgccgattttttttgaatttttgattcattggatttgatttgtgatgtatgtgatattggatctgatctgggagttgtgatgtatttcttttaggatttgtgatgtattttttgtttgagattttgtgatgtgatgtattgtgatctgtgatgcatttctttctaatatgtaatatatttctttccagatttgtgatggtactttgatttggggatgatttgggaatatgatcggggatatttagggagcagatcgatttgagaaaaaaaaataaccgggactgctcctaccatctttagtcccggttggtggattttagtcccagttattttacccgggactaaagacgggtatctttagtcccggattcgtagtcccggttgtataaccgggactatagggggttcccaaccaggagtaaagcccctttctccaccagtgtaactaccaccggagaaacaactacttcggagtacttcctagcatgcatgcatgtttgcagcaggtcagcaatgctcttcagctgagtagtccttttatgtcacgttcctgtacaccatgatcgctagcgctatatatatgaatctgctagctttgctgtcccattcccatatactcatatttgccacatttaacacgaaacagtatgtgtgaatcttgtgacatctataaaaaccatacagaactgagggagagaacaatatacacaaattttgacaatttgaccctttgcaaaaactatttttactaccaaaatttattttaaatctgatcattttgctcaacgccaaatcatgtggcgctaaacttagacacctcagtgccacgtcagctggcgttgaatgccatgccacgacggatgggagactaagtcagcgtgtcaatgtacattcagcgccatgctattggcgctgaggtgtctaagttcagcgccacacgatttggcgttaagcaaaatgatcagatttgaaataagttttggcagcggttcatttgtaaaaatagtttttgcaaagagtcaaattgtcaaaatttgtgaacaatatacatgtacagcaaacaacacccgaaaactagagatttcaactggatcaacccatcgggattaaattacatgcagtaagatcagaaaatattaattgctaatactattcaccaacaaaagcttcatattcatacgacatgcacggtagactgcaggtagagtaaatctactgcagtgtttaagctgcatcacctagcatacaatcaaggtggatcccttgcaatgaacagagagcgagctctcccaatgctaatgcatacataaaaagggatcgatcgatcgatacacatacgtacgtacagtagaatgcaagatatattagaaccctagctagattgattaattattatctaaaaaaaaaagctagattgattaattgatcgacaagactggcaacacatatatatatatatatatgggccacttaactagtacagcaatgatacggattggagagataactaattaatctatagttacatgacaacaatgtagacggcgccctgctggagcggctcgacggtgacgcccgactcgtcgacgggcacaggctccgtgcggctgcctcctctgtagcggagcagctcggcctcgtcgccgtagtgcctcacgttgaagtgcgcggccgggtagaagagcggcggcgcggcgcccgcgacgctgacgcacacaaccgcggccacggaactgcccgcctcgggcgcggcggcggcggcggcggctccggcgccggagcaggcgccggcgacgagcccgaaatccgcgagacctgcaattggatcggtcgtggcagacacacatgcacagtcaaacaaacggcaaagctagtgatagtgatattaactgcacacgcatgcaatgcagaggaagaagttactgcggcgcggggattgagagagaaatcatcaaagaccacgaggaaatccaaggtgttgaactgtgacagtcactgagattgatcagagtttactcctactagtaccactcgatcgatgagatgataaaacttgaatgaaaagcgtcctggatcgttggccatgcatggcgcacggtgactctaggtagaaacgcccctgtaatgtgaaagaactttaagcttctttcatgcgtcgagcaggagaaatttgaccaccatcacctcagtcttttcaccaacgtacgtgtgtgctgctaccatactgtacgcgtgtagtactcccagttcccttctcctagctactcctaccatactgtacgcgtgtagaactactctcttgagagaaagaagccaccatttgacaagaccatacagcaagagtgttagagtggcacaatttatgagttgtgacctgtggccaaaaagccctaaattcgtagcggttactgctgttcatctaagggggtgtttgggagaaaggggctaaacttagcccttctctcaaaaagagacttatggttttaagagaggggcttctcccaaacaccccctaaaatgggtctcttttttttatccctcacctcctttaatctgtcaggtcaaaatcagttttcaagcctaaatctgtcagtgtaatctggttactagtactagtactcccagattaattattggatactgatagactagtgcatgtgttcgtgcaatgacaaatctaccagaataattttccccagagagatgatcaaaactactgcagttagcactatccgagcttccaaagtccagttttagaatcttatatggaatcttatgcttctattcctccaactcgagtcttttcatgaacatgtgaaatagccccatgcatgcccagatggattccattacggagtacttcctccatcccaaaaaaaaggcaaatcctagatttccgtgtctaactttaactgtccgttttatataaaaattttttataattcatatttttatttttgttagatgataaaatatgattaatattttatgcgtgacttgtctttttaatttttttcatatttttttttaaatacgacggacggtcaaacgttgcacatgcaaaccagggtttgtcttttttttggatggagggagcatgtgggagctgaatgcatctacatgcgatgacatgatgttccccatcaccatgaaatagcagtagtactagtagttcgcatatttgtaacatcccatcaagaaacctactcaatttgacctgatggagaacagctcacaaattttggtcttgtctaaatctacatgcttacaaaatgacaaatttcttcatctttactggaaagtctatctgcattgaagtgataagattgtacagacacacaaaagaaaaggattttacatggcctaaacttgtcttattatcattgccatgcctgggcacagggcccttgtttgagaacggctggtttggattgggccctaaaggaaactagtacagtacaatttcatgcatatacaattcttctttcagtaaaaaatttgtcattttgtagttaaatccaaacgaaactgaaattgaggacaacactacaagagaagttagactcccctgaagtgacacttctaattaatccatttaaacatgagcgtatgaatatgatgcatgcatgtgatactgaacaaaggggaaaaaatgccaacagataatctagctaaatggtggtgattcatgatttgaccagttaattaaattcttcatatcaaagaacaaaaagagtaccttgaaactgattgttagcgacggcgccagcagatatagcacttgcagcaaaatcagtcaggctagcggtggcggccacgctcgcgacggtgacggcggcgttcggcggcgacggcgaggacggaacaggaggcagaacgccagcagccgaggaggtaacgtccacgtgcacttgcggcgtggtgatgccaaagccgtactgtagcagaccgtgcttcgtggcgtcgacgtcgtgcgcctcctccggcctagacacggtggcgatcgacgccgcgctgctcttgccgaggccgagctgatcggcggagccgcaccagtgctggccgagcccggcgctccaggcgcagctcttgtggccggtgttgtttggcgcttgcacgtcgttgcagagcccccagaacatgcccgccgcgcccggcgacgacggtggctgcggagcgggcaccggcaggtgcatgtactggccgccaagaatggcggcgccgaggtcgacggccgacaggcaggggctctgcggccactgcaggaagaccggctcgtcgtgtggcacgatgccgtgcatcttgggagcaggcgccggcggcgactccagtggctggccttgatagagcatctgctggtggcacgccgcggcgagcggcgagagcaggtccatggccgtcgtcacggacatcgcctgcgtcgacgtagccctcgcaggcttgctggacccggacgaacggtcggaggaggaagacgacgacgaggtaggcgccgccacaggcgagacaagctgctgctgcggctgcaccggctggggcgccgggaggattggtggcggcggcgtgaacgacggcgccacggcctcccggtgcgccgccgccggcgcggaggcccggttgccgccgaggccgagccccgcgcggcctgtcccgccggagcgcagcttgttcttggagcgggacttgcggttctggaaccagtagaagacgttggcgtcgccgacctggccgtactcctgcagctgcatgcggatgcgcgggatctcgtcgcgcggcgggttgaccatgccggagttgaagatcgcctccaggatccggatctgctccggccgcgggttccaccgcggcttcgggtccggaaccctctcctcgcccactgcaagtacaaccacgaaatcccatatcaattccctcccgatcgatctcgatcccctgtaacctcgcaacacgaaaaccctacctaccatagtacaaagcgcgaacagtagcatgcacggatgcgcgcggcgagatcgatcgacctacctgacgagaagggcgacgacttgagggagtagccgccgccgccggcgctgccggcggaggagccggagaggagggagggcggcgacccggccatgtcaggctgcgtctgccacggctgcgtggcgtgcttcgacctgaacatgctcggccagtgcctgttcgacgacgccatgcccgcaaacctgccgatcgatcgattcaacccgatgaactctcagctcccctctgcaacaacacaagcctaattatactagcagctcgcgctcgtcgatgagagaaagatctatagctagccacagatgattctccttgaggcgacagggaccggccggattggacgagagagctaggagtagacgagctaggagtgttcctcttatctccctagctaggataggtggatggatggatggaatggtttcttgcacattgctgcctcttataatggcgagcacctacccttggtggtgcaaagtgtcgccgcccaataaatgccgactacttctacggagtagcgaccatctctttatctgcttggagatgcgtgcgagggagatgatgcagttgcaccgggagggaagcgatggggtggttgccttggccgtgtcgctgatgccggaagggtgcaaaggacactggagctgagcttcagtttcagcttcggctactaccctgcttggaagactgaacaaagtctgggccttccttccagcatttctgccatactacctcctgctggtaatggtgggtaatgcctttttgcatgagaggactcctgggacggtggtgatggtgacctagctagcttgggatgacatgtgtgtcgtcgccggttagcagcgtactttctgatcgatcgagtcatttccagaaacgaaagaatggaaattgcagttactgtgctaatcgtgcacggcaaatttacagggaaactgttcgtttcctccaaatacccactatgaaattcatccgtttcaaaggagctaggctcttcttttaaaaattgcaccaagaaggccctgttggtctagtagtatgtattgatcattggatgcatctctcattaaatctgcttcggattacaatttggaacgcaggattttacataaaggccgagtttagttccaaacttttttttaaacttgcaacttttccatcacatcaaactttcctacacacacaaacttccaacttttccgtcacatcgttccaatttcaaccaaacttccatttttagcatgaactaaacacacacccaaaaatcacatgcgcgaagaattagtttatattctatgaaatccctgcattaattataaaggagagaccttaaaatatgcttcaaatttaaaatttcaaaaaccgcttcaaattatgagcaggctctagtcatctcctaaaaacattgcacactttgcgcatggatgcctcaaataaacatgaagttagttggtggcgtgtcgagggcgcccgtttcttccaacattgtgggcttgcatgtgcctcttcacgtcaagaaaatgtgtacaaagtcacaaaaagaattttccatttggagatattcttttagtaacgaaaatgcatggtttatatttatggtctacagttggattttgtaactctaatgagacaatacaacacctatttttcgattgtactatggtctggtttatatagagtgcaattagcttcacctttggattccgtcaactttgtagtatatcgcatatgtttggaagttggttgaatggggttaaccgtaaagtaaaaaaaaatattgtttgttggcattgctgctatgttggtcggtttggctaagcagaaatgacttggcctttaatagttacatgctaattcttttgtgcaggcaattcttagggggcacacatcaaacgagactttggtcgatgttgcttaagaagagttcagagttctatttttcttatcgttggaactttataaggagaattaaagcgtaactttggttgtcctcttccttgctttttgtgcttttggtggtgtaatttcatcccatgtttcggaaggagtctatgtactcgtgttaggactttttggttgtgtaggttttttttatgtagaggccgggttgtttaatccattatccaacaacaaatggtctacagttggatagcaaaagttatatcttgttcacattgaaaagtcaaagacatacaccaagtacctccatatttaaatatatggtattgctaattttattgggtatttagtgatgacttttgactaataattttcaattagcgtagaaggacaaaatcattaatattccaaaagtatataaaggaaaatctacccataagttttttatatatgttcttagctaaattttttgtgctacctattgatggtgatagtttcacatttttaaccaattaaagttaataatatgatagtcctatatttaaacacaaggggagcactagttattactatccatttctactctagtaaagacaacatctttaaagccggtgtcgatatatctcttggttctaattgagctagtagttgttactgtatatgccactcacgaagtcacgagcggggtttacaaaaaccgtgcagttgtcacgcggttatcatgtatggtaaccttctcaaaaccacggcataccctgtgcacggtaaccacagtaagcgtcaaaccgtggggtggcggtaaccccatcctaaacggtttggtaaaccctgctcacgactcaatcaattagccaattgttagtactacgaatgttcagattcatagtttaaaagacactcttaatttagggacgaagctagtatagctcttactagtatatactactccctccgggttgataatacttgtcattttggacaagggtacggtctccaaaaaaacaactttgaccattatttttcattatattatgtataaaattgttaacaaatatatgatcatattaaagtactttttaagactaatctatatatgtagtcaccatatttaaaagacaaatattttaaaaatgatttataatcaaagattgtaaagtttgactttatccttgtctaaaacgataagtattattagccggagggagtactattatgcaatttt

SEQ ID NO: 71959 - DNA, 4834 bp, Oryza sativa
gtttcttccctggatttttcacattttggttcttttaaaaaacttatttcgcaagtagatccctagaaaacttaatccaaaaatggtgcgccagagtggctggcgccatcgttcaacaggacggcgccagcctctttggcgccgtcccaccgccgacgtggcggggcgatgctgaggtggctagggggagttttatttttgttttatttgtttgatatttttttcacgcttagggacacacaagaaccaaccatagaaaaattgaactcaaatggacgtaatatgtgacatgtagaatttttcctctcctttcctctctccgaactagtgcagaggagagagatgtgcaacttttttatttttattttattttttttgatatttttttcacacttaggaactcacaggaaccaaccacgtaaaaaataaactcaaacggacgaaatatgtggcatgtggaattttccaaaactccaccgaaaaacttctctcctcgaaaacacaatcttgcaagcggaatttggaggttttaatatcgccgaacccggcaaagcgggggagaatcggatgtaactttttctgtagatgtccgttcatatattatttgcctgattccgagtccgtatgagaaagttacgcctattttaatagatggcatattttgtccgtttcggtagagttttggaaaattctacatgtcacatattttgtccgtttgagtttattttttgtacggttggttcctatgttctcctaagtgtgaaaaaaatatcaaaaaaataaaataaaaataaaaaaattgcatctctatgtactgtttaacttatatatgtcatttcatgtggttatattttgaattagattaagtaatttatatagtggtagagtgcattatgtttaacatgctgatcaaagggttttactaaaggagttatggtctaattttagtgaaggtgcaaagtagactaagtggtatgctagatattttcagacttagctaagtggtagttcgagtttaaattttttttgtagttggttgtatcgtgatcctgagtgtgaaaaaacatccgaaaaaataaaataaaaatgacaccgttgcaactccatacagagaaacaggaatagaggcggcggcgccagccatgctggcgccctcctccctagggcggtgccagcatgctggcgccctcctcctgtcacgtcggttcgtgtgcgccacggtggcaggaagaccggttggatgacggcgccagccactctggcgccccaaaaaggactatttctgggataagtttttttaggggtctatttgcgaaataagtttttttaaaaggatcaaaatgtgaaaaatccagggtttcttcctgccgcacgggagagggctgcctacacgtaacgtatgtcgaccctgccactgcagattccctgcgctcccccctgcccatgcttgcatgttgtcgtcgccggcgctagccacgagatgaaaaggcgatcgagcgagacgacggagatggaacgcgaggagaagggaagggaaggcgcgacattccacctgcagagagggtttgacgggccgcgggcggacggaccgagctagtgcggcaagctaggcgaccgggatgtcgtgggcagcctctcagatcgcgcgcgacttctctacgtccatgcgaccatgggagcgagatcgatcgtctgctagcctggttttgagagttcggtggccctgcacgaaactaaatttaaagatacgaacccttaattttacatctaaataatactccctcttaccttgtatataggggattatgctctctcagcttgtctagaaatataaaggattttttttatcccgagacaatataagtacaacaacaatcagaaattgagtacttccatccgtttacatcaggaaaaaaatatatagagagaaaaggtacatgtagtactactaatcaaaacaggaaactattttaatccctcgagaggatatccactcgttatttgcatgtcattcaaatgattacaaaaaaaaatttaaaaaaaattaagaagatgtattaacatatgatatatcactccacgaacatgcaagttcaaatttaatttctacatctcgtaacgaaaaaaacaaatttgactgtgaatatacattaactagttgtagtttaatttgttttttttcgttgcgagatatagaagttgaatttgaacttgcatatttgtgcagtgatatttcatatgttaatacatcttctcaaaattttttcataaccatttgagtgacatgcaagtaacgaggggacatcccctcgagggatcaaaatccactccctctgcaaactgcatctcccaatctgccaaacatatctagttttatttctaaactagctggatggcccgcgcaattgcgtagctagcacccatataaaattatattttttttaatatgattttacttaaaatttatcaaatatttatctcgttatcttaagaatttgaaagaccaaaccttatcatcatcctcgtgtttctaattttatagttttaaaagtcacaccagttgctatcccttacttctgtcatattcttctttatttgcttgctcgatttaccactatttctattcatttttcttggaactttaaaaaatggatcttatagtttttagaatttattgtcccgttgggttttgtttttataatttctataagtcctgtcaaacactgccattgtacttctctacggccgtccactgcctcttctatttatcatcattggtattttaataattaaacataattattgtttaatttcattttttactttctagaagttccgccaaaacgtcagcgactttgtcactgtactcctctacggctcgtccgctgcctcccttctttattgtcctcgagattttcaaaccaaacatgattattattgggttttttactttttagaagcccaagcctttaaaaaatggaccttatagtttttacagttttattgtcttgttggtttcatttttttataaattctaaaaatcctgtcaaatgctgccactatactcatatacaacccgtccgccgcctactctttattatcattgggattctaaaaattgaacataactatcattggaatttattttttttttactttctagaagtcccaccaaccatcagcggctctgccgctgtactcctgtacgacccgcccgctgcctctcatataaatatttacgatgcatctacgaattgagtgtctagtttttatgtagaaatcaagtgccaatcctctacttaggtaaggatgcacaggcctgcagtcacaacaactgtacagtaaggccctgtttagatcccacacaaaaattttacatccagtcacatcaaatgtttgaacatttgtatgaagtattaaatataggctaaaaaataactaattgtacagattgcgactaatttgcgagatgaatcttttgagcctaattgctccatgatttaacaacgtggtgctacagtaaacatttgctaattacggattaattcagcttaataaatttttttgaccgggaattcagcttaataaatttgtcttgtggtttactgacggattctctaattagtttttttattagtggccaaacacctcatgcgataccctatataatattcgatgtgacacgccaaaactttacacccctgaatctaaacaccccctaatctgcatacaactgagataacaagtctatatgcaaccacataggatgagaataaacaatagatagtacaaataggttcgtttaaaatttgtgtttcaatttatatttgacctcaaaatacgaagttaacctctctctttttttttcaccagatagcactagaaattatgcatgcactacatataaggccctgtttgacataggtccaacttccaacttcaacttatctgaagctggagctgtgccaaaaacagtccagactctctgtttttgggagtgaagttagcatagctactcctaaaaaataaaatgcgggggtggagcagggtttttctgctccacagctccactccaccccaccctacctcaaaagacccactaccctttaactttttaacatatttacacaaaaatgacacttaactactctaaactcacccttctctctccctctccctcccctactcacctctgtcatggctagcgcacaagcggcttgtggggggacggcgcgcgcggggggcgggaggggggggggtgcacgtacggcacgtgaggccggcggcgggcgacagcgcacggtcaacggcggccagcggcgcacgagctgtcagggtttggggattttttttcttttttttaaaatttcagatctagagttaaaatgctagccaaacacttttcatcttgttttcaactcccactagagtgggagtttagagctaggagttggagtttagagccctaccaaacggggcataaggatgtttcattgttttctaccttcaaatttgatttcaaccaaatttctttaaaccctaccgctttattcctactacctaaccctgcagtaagtctggttgccatggttaccactggtagagaattgaaacccttctcaaagcacccggccctagagagagaaatttcctttagaacgcaactcttccactgttgctttgttttttgctgtgatccaaacagggcctctccactgttttactgactggtggagaaatcatctttggtcggtcggccaaattccacaatagtcccggttctaataaaaaccaggactaaaaagctttagtccctgtttaacaagttgagggg

SEQ ID NO: 71960 - DNA, 8996 bp, Oryza sativa
ccctcccagagggcggtaggcgactatttccgtcaattttcaaaatggaaaattatttttgtaaaacttttaataaaaaaaattataaataaaaaaaattcttcgtggcataacccatccgtgacgtgtagcagcgccccaggacaagatggatataggcctgtttagttcccaaataaaagcttttcgatcaccctgtcacatcgaatgtttgaatatatacatagagtattaaatatagaaaaaaaactaattatacagcgtgtaaattgcgagccgaatcttataagcctaatagtgtcatgatttgataatgtggtgttacagtaaacatttgctaatggcggattaattaggtttaatactttcgtcttgcagtttacaggcgtaatctgtaaattgttttgttattaaagtacgttcagtacttcaaatatgtgtttgtatatccgatgtgacacgcaaaaacttttcacccaagccatagcatgagatatgacctaagcagcgtacatgccaagcccgatgtagataggcaaaagtagtaatccctccatcccaaaaaagacattcgatatattctaacgtaacaaatctggacataaaatatgtatatattcgttgtattatgatgtataggttttttttgtttgaatgggggagtactattttaggtggcactcatacacaactgcttctttaagatgcaatcgatccaagtatttactacggtcacaactactactgccaaactaaaagaaaacaacttaataaaaaggttatgatttggatggctgtgtgtaaatattgtggttggatttttatccactatatgaaaaaatgatttggagatgccatgactagcatgtgtagctaggtatatatgttgaatgaagcatgttcacaagagcatgcagtgagtcagtgacatggagtccagtattggagggcttgtcaataaatgtttcatctatggtgaccacctacaattctaggccatgtttagttccaaactttttcttcagacttctaacttttccatcacatcaaaacttttctacacacataaactttcaacttttccatcacatcgttccaatttcaaccaaactttcaatttttgcgtgaactaaacacacacccctagtgaactacaaatccaacgcagcttgccgtcatcgcagacatggcatccataaaagtcagcttcggctttcaaatgtcacagatcaagacatcttgagctaccatcacaattgttgtacttcttccctcaccaaatccgaagatccatcatctcccataaatcgagactgtacaaaactgagaagaagcaaacaaagcttatgatatatctagaggattatggggaggggaaaaaaatatggtttctgtatctcaaaagtataggaacggtgggcattgggaatggcgttatcgtaggcaaactgtagtgtcactgatgtgaagaacagtctagagcttttcctgatcgatggcatgaagcatttagctatggcgatgtatgctgaggttaccaactatctcggcacgcactcctcaaccacgctgcccgaagggagatgccacgacatggcctgttcacaaggtagatgcggctcgttgtacttaacggccgctgcttcaggcacgtcgagactggtgctgtggaattgtagacttgctctgcactgtctacacctgaatcgcgctgacgctgcagcgatccccgtgcacgtgatcttcggggagctcgctgcgtccgaggcagccaccacaatggtttcatgctgccgtgttgggctccgatcttccgaggccctcgtgggaagtgaattgatggggagcacgtacatggagcaagcaagcctccatgtcctgtgtaccaccttcatcatcctttccttcagcagggtttgcaatctccaaattagggttttttttggcgggccgggggaggggcgaaagaatcgaaattttggaagtttcggaaaatttctgagccgaaattatttagaagttttacgtatttttaatgaatttgaattaacttcgaacaaattgaaaaaatgaaaaaaaacccgtaaatttcagacgagatttgtgtttacctgtgagtgaggaaatttctgaaattgtaataactgccttccggtcaaagcagcatttacctttttcagcttttcacttcactcagagcccgaagcaacaggttggtagtagtactcaacaatcactgtctagtgttagtttttttttttaaaggaacaacggcagaagattccgttctgccggaatttaattaaggggaaaaggaaaaagtttacaatcccaggaatgggatttcaagtccaaaaacaaaataaaacaatcaagggtgcctaaaggccgatcttctaaggtctagatcttccatgacaagatgagctacctgataaactgtacaggaacgattattgaaaattctcctatttctttctaaccaaatatttcaccaagtagttaacagtgctcctctaacgtcctgcttttgatttgtcgatccatcttgatttacttgatcccaccaagtagagatatttgccggctataggatagggactagtagatttcgccaggaatgaacgagagtccaaacttctctgacatacacacagtcacagaaaagatgatttgtatcctcgaatgtagacgtgcaaagacagcatatccagttgcacggccagtgacgccttagcaggttttgggctgttagggttttgtgatgaaggatcaaccacccaaaagatcacatttttagctcagctggtgacttccatagggcatcaaaatccaatcgtgcaaaagttcctgcaaattgataggagtaggcttctttactagagtaaaccctggaaggattccagttccagttaatttcatccggttgttgggagagttagatatcttggatcattccccccaagttgcactaggtcatgcagctcttccactgttgtgaattgtcagaaagaaacaatccaattgtttgacgaaatttcaaactggacacatcgttgctttcgtttggctaaacgaaaacagagaggagcaacatcctttggacataaaccgttaaactgtctagtgttagtagtactcagcaatgttagcatgtgctgatgccaatgactaaaatgcaagaagctatatgcatgtagatgcatcaacgccacaggatgaaaaactgtattctttcaattgctaacagttttccttgaaacacattgttttgatgttacataatcttttaatttccagctgggccacataacaattagcactagtgctaacacgctagtggagaaaataggaagtccttaatatttgatattgcagtggcaagcatcgcaaacagaggttatacactacacatccattaaactcactgtttctaccccttgcaggtggcgaatcgatcatctagcaccgccggcaggctctctgccatagggatctaaagcgtgctactaaccggcttgccagacgcatgcatctcaatcatgcttaggccttgttcggcaggcccatttccaaacctggcctggaacagttcctggcctggattgaatggatccaggtaaattcactgaaagtctgaaaccacatgtcgattgaatccactccttttcttaatccacctcttcaaaaaactgcattcggttatttcttaatccatctggaatgaagccattcaagctgccgacgctaagtccaaagcactagcaggatcagaagttaagcagagaaaaggcaaaggcacatgaagcaaactggcttatatatgtatgcgtcgttgggctctgcacatacatattatgcatatataaacctgagtatatttatagcagacgcatacatatgcaaagaacatgaagcaaagcactagcaggatcagaagttaacacacaacagaggaatcagttcagactaggtattttgccacatgggtacggacccttgaaatgcctgcagtagaaatgataggaccaattatagaaaaggcatgtgacattatgacattacagaaaaatggtcaccgtgtatttttgaccattttgttgtatgaaaatggtagatgggcacatgggggaaaaaatatttgagaagtaatttacacagcatcatatgcaaaggcgttaaatgcaatgcttgtcgtagcttcaagcccacaagaactaatagcatcatacatgcatgtatgtacggaatgtaactcatctatattccaaaatctaatatgaaattcattttttccagttaacaatgtcgatttcaatgtacccagataaaattataggatgtatagtttctaccaagagagaagggactaaagtcggcaggtttttacaatatgctatgtaactgtaagcaccataagcatatgcgataactgctaacccagttgaacggataaaagaagaaattcaaaatgctgctgtccctgtagaaattcaaacaaagtatacttttttatttctcaaacatatgtcagcacactacccacactaaaacagggaatttttttttactgaacttggtgtcatctcagccatttcatgtcatctcaagcagaaaacaaggacaggaactaacctttggtgatgctaggccatttcacttctcagccaaattaaagcagactctaagtcatcttcgtaggcgccggggagagaaaggaagaagacgatgcattaccggcgagaaggcagcagagagcgcggacgtcagatgggaagaggtcgccatcgccgtcgacgctggtgcgccactgcgtcgcctcctcgcgtcgccagccgcgcgcgctgtctcctcgcttcaccagccgcacgccgccgcctcgcatccggattggagctggagggtctgatgtgaggaattgatccgggccaggaacaggggaagggagggaggccaaaccggccccgtttccaatctgggccggccaaaacgaacgacgcttccgagccagaccagatttggaaatagaggccgtttcgggccttaccgaacgaggcctaaggcgttgtcagggatggccggaatggagcaggcggcgctcgcggagcttgcacatgcaccactccaaaagtgtatttgctatgaattaatatacgactcgaggggctagcggaaggagccgccagcgagaggatttctcgagaggtaagcaaattttattttttaaaattttatcgaatgcaagcaatctgccagcaatccagagaagaaaaaaactaaatggtaaacctacccctaatcattgagtttgtcaagtaataagaggaaacatattcttggcacacatgcttcccatgcacactccatgcacaccaactagcaaatgtcacgaaaaattatagaaaaaattgaacacatatttttaatagtattacacatacctatgaaatctcatgttcaaattcattatattttagccgtaacaaaaaagacaaaattttgacagatttttactcttaaaactgtcaggtttttctcctttttattacggctaaaatacaatgaatttgaatataagactctacagatatgtataacactattaatagtacatgtcatatttttttctagaattttccgtgatattttttagttggtgtacatggagtatgcacagaaagcacatgtgtataggatatgttaaaaaatgtccttattaaggaacggtccaaaattatttctgtgagtagtataatataactagtagagagtacagtagcgtttctcatataaaaatgctagatacatcactgccatgcgcagctcaatgtttaccccgaaaaacaaaacgaattatacaaggattctgacctgcaagcagtatactcgggcatcactatcggtctcatcttttctcttatacttataattatcaatcaaaatttaaattttcacctttacatttggagttgattttgagagctttttcattgaagtttaattttcaatatttgcttttagatcactgagaacttatatataaaaattttatttacaaattatttttcgtttgtaaatatgccgttgggccaatacttcttctgtcctaatatgttgctatctaggataggatttgatctatcctaggacaacgaatctggacataagtcctaggatggggtagcaacattttggatcagacaaagtagcatatagctggaggtccagcatcaaaagcagcagtataccaagcaatctagcattccgcctactgcaccagtcggccggcaaccactaggccgcaaagctcgatcgctcctcaccgtcgtcaccgacgtggcgtcttccaggtctctcagcaaatgtgttgctgagctggtggccacaccacctctcagtctcagctgatatactcttgagctgcctcttggtgatgcagtaggccgcagtagccacagctgaagaatgcccttttttttcacgaagatgctgaatatatatcccggtttctgcatccaagcgccgcctttgccagtcaccgtcaagacgcaacttttcatttggtcgacaggtacgtcggcggcgagagaaagaaaaagaaaaaaaaccaaagaagaagcctgcaggatcgaatctggtgccggcctgtggccttggaacaatgttccccggtccaatccacgctgccggccgctagctcgctcaggcgatcaaatgacacgccacacggattctccaccaatcgatctactttcagtatcaatctgctagcacactggctgactggataagatgtactcgttctatttttaaatataacaacttttaaaatttatttatcatgtcaagtaatatttttatatatttaatctgtatttcttctcaaaaaatatcaccattccacaattttttacctattttttcctaatcaatcgtaacctttatccattgaattttacttgttttcttaacaatctcttatgttatttcttatccgtgaagatatagatggatagatagatagtacttgttgtcgaaacatgaattcggcaataataaaaggggttagcgcacgagacctaaaagtgaatggatgcgaagacaaggatttagacaggttcaggccctctcaatgagaggtaatactctactcctgtttggggatttgaatccgccgggtgtagtatagatctgacgatcatatgtgctcatgcccctcagagggcctcctgcccaccttatataggatggggggcaggattacaagatagaaaccttaaccaatacggtatcggtttcctaaatctattttataatattatcaaatcaggactttaggccgctccataatataaaaggaaacgtaatacctaagtcatgatcggttacatattccatagatataagttatcccctatgactagtcggataaccatgccatgtgggtatggggtacccataatctccacagtagcccctgagaccttcacagtcagaaaaataatcttctctcgaactagattactccaaagccgagtgcttcaatcatcttcgccatgatttcccgagtacttttaccaaatatgaagactgtggagggctgaaaaataaagtcaggtgcatcgaatagatgtacctaatagatgcaccaactgaatggttttgataattgtagtcaaccaagtgacttaatattaatatatagcatatgcagtgtgaatccctgaataacatgatcgagtgatataccgactgctttgtaaaatatgatgcgtgcaacctaaagctgactacatcattgaatacacatagcaaaacagctataaagaagcttgtatgttgtgaataaataaatttccaaagtattgggcatacaccatgcgcacactgctttaacagatgtgcttgagcccctaaaagacacatggtttcaccacacctggaaatatatagcatatgtggtataaaatccgagtaaatgaactcataaggatttatcaatcgtttggaaaatgaccaaaatatataatcagcctaagccataatattggtcaataaaaatgcacacttacgtggcaaaaagcaatgatattgtatccaatcaattgctttatgaacccaaacagcgccttgacttatataaaaagtcagcggggagctatataaagcattactgtttggcaccttttaaaatgtattgtaccaactcctaaaaagttgagtaactgcggtataaaaggattttaaggtattgggcacataatcacgcgcacttttgccaaagcaaaaagatgcctaagtccctaaaagaacgtgacaggccacacctgaaaatatgagctgcagacatattaggcctaggccaaaaaatatacctttgacaccctttaaaggattacgcatgtaacatgctctcgagtaataaatctttcaggtgatatagaccaagtgtagctcatatgaatagcttctgatctgagtgattatcctttatgggatactccaaaatagatataacaattgaattccgactggcgcaagtattaggctgataacccatacggggaataataaatagtctagtctttgagcatagaaaatagacccatgatcatcaaattcatgttgcatgtatccggaacaagtccaaattggagatataatcctcacgcttgagttgatgagcccctgagcatatagcttgtccttctgtcatagtcaccattgtccattgatggtagctgacgcagttggcatagagacaagacgaccaatatagagataatattgcccaccagaggtggcaaaaatattgttagtagtgaagatagtgataccaatcaaaagtgatgaagttgtatagccgtggaggcgaagaaaccagtcggcaacagtcaggtcagccagcaatgaatatgaaggcgcccagcgataaagttgtgtagccatagcagcgaaataatcagttggtgacagacgatgcagctagtgaagaa

SEQ ID NO: 71961 - DNA, 685 bp, Oryza sativa
  unsure (1)..(685): unsure at all n locations
ctgcaaattgataggagtaggcttctttactagagtaaaccctggaaggattccagttccagttaatttcatccggttgttgggagagttagatatcttggatcattccccccaagttgcactaggtcatgcagctcttccactgttgtgaattgtcagaaagaaacaatccaattgtttgacgaaatttcaaactggacacatcgttgctttcgtttggctaaacgaaaacagagaggagcaacatcctttggacataaaccgttaaactgtctagtgttagtagtactcagcaatgttagcatgtgctgatgccaatgactaaaatgcaagaagctatatgcatgtagatgcatcaacgccacaggatgaaaaactgtattctttcaattgctaacagttttccttgaaacacattgttttgatgttacataatcttttaatttccagctgggccacataacaattagcactagtgctaacacgctagtggagaaaataggaagtccttaatatttgatattgcaagggcaagcatcgcaaacagaggttatacactacacatccattaaactcactgtttctaccccttgcaggtggcgaatcgatcatctagcaccgncggcaggctctcttgcatagggatctaaagcgtgctactaaccggcttgccagacgcatgcat

SEQ ID NO: 71962 - DNA, 7085 bp, Oryza sativa
tccttgcaagaagtcggggtttctgatcctcgctccgaacatctctttacccttggcgttcatttccatgtaccattcatggaatttgtacatctgtgtcggtagggactgcagctgctcaggcgtgacaagcggtttaccgagttcaaacttgtatgccacttccgccttcgggattggtgcgattcccaatcagctgatccatagttagaccggtgtctgaaatgaaatccgttatgccaaaatcttcacctgtcaccaagggctcgacctcttggtttggttgttctccaagctgagggactggtttggacttcttgtgataggctttctgaagtgttcggtcatagtccgatagctttaaggcctccttgtttgttgtggacattcccttgaagaagtttttcacgctcgggtcaatagttatcttcttttcaggactccgaggcttgagttgcctctttacttctcctgccacataagcatcaagctcctcttgactgcaatcgtacggcggctccctgtttttggtggcgtcaactttcgccttcttcgttgcccttgtgcgggcatgcggtggagcttagcgagaccttgtcttgggaggtgcaggcggacacggtggagatggaggaggcggaggagccagaggagatggtgcatgaggagctggcggaggagccggaggagatggtgcaggaggagctggcggaggaaccggaggagatggtgcagaaggagatggcggagccggagaagattgtgcatgagacgccgcttgtcgccaagggaggatgatgtactgcttgcgccatagtataatggcgtggcttgtgtctcgtagatgcgtctcaccgtctcctcctgggtagtccaactcgagatcctcgtacgcggcttccaccagctcaacctcgaccctcgagtatcctgctggaatcgacctgcagtggtaagtccctgaaatgtccgttgggatggctatttccgacgccaccttcacgtgatgagaggttatctattagtaatcaacctaagcagaaccttgcggaatgtacaagtcaaaaatcataaaactacgagcataccttgattgataagttcttgaagggaatatgcagctcacatggtgtccgctgagtgatgtcatcaacggggcaagtggtttcatcctgggtttgcatggcgtccatgctctgtgatcctacctgccccgttgaggcgcaactgctacgattgcctgatgggctaaccattgcaggaggaatgtacggctggggattctgggaccgatgtgcggccatgcattcatccaccttccttgccacctcctcttgcatgctgagctcgtagctcgataccctgtactcaagatttgcaatcttcgcctcgatatctctcttactcctcatccaactcctgtacgtgtggatgtcctccttgaatctaatcttccagggaatcacgcctttccctcgtgttcgtcctggatgctcgggagtctgtagggcgagtgacagctcgtccttctctctgtcgtgtcggaatgtgccctgagaagaggcttccactgcgtccgttagttgactggtagcctcgcatatcagatcgctaaagacaagggagccatcaactgggttaagcgttccaccgtgagcatagtaccagaacatcgatcgattcggccatttagcggtggccggttcgatactcctctcaatcaatcttgcctccatctcctcccacttcggcattgcgacgctatagccgcctgaccctaagtggtgatggtacttcttcttggcggcattttctttgtttctaaccatcatcggttgcccttgttactctgtcttgtaagcaacgaactcgtcccaatgatcccttagctttgggaatacgtcgaagttcggtgttagtcccttcaggatgtatttcttgtagagatatcccttgaagctctggaactattctgccattttcttaagagtccactgtttcactatgttctccgtacccgcagggagcgtgaacgtctcgagcattgtggtccacatcatctctttctctgattccgggacaaagctgtcattatccccgcgtgcccttgttctacgccagtacaccatgctgacaggcacgttatccctcacaacccaaccgctgtggcgtacaaaattcttggctgcttctgccggggcactaggtcaaccgtcttcgtccacctcagttatgatgtgccgaccctctatcttcttcacggcacctcgttgtccgcgtgccctcttctgtccagcggagggatgacttccactagcctcctcctcctcattcccctccgcatccctctccccgttcccctcctcattcaagtactggtttggaacctcgttcccctcttcttcgatccaatactggctgcttccctctgcgattatatcatatagtatctgttcctcattgcgatcagccatctgttcgtacaagaaatatttgctaagtctataggtcatatttgctaagcgtaatattaaaactctactaatcttatattaaatctctaataatcttatattaaaattgtaataatcatatatgctaagtctaacaatcttatattaaatctctactaaacttatattaaaattgtaataatcatatatgctaagtctaacaatcttatattaaatctctactaatcttatattaaaattgtaataatctatatgctaagtctaacaatcttatactaaatctttactaatcttatattaaaattgtaataatcatatatgctaagtctaacaatcttatattaaatctctattaatcttatattaaaattgtaataatcatatgtgctaagtctaacaatcttatattaaatctctactaatcttatattaaaattgtaataatcatatatgctaagtctaacaatcttatattaaatctctactaatcttatattaaaattgtaataatcatatatgctaagtctaacaatcttatattaaatctctaatacaatatgataagtctaataatctaataatctctaatactcacatttgctaagtctaataatctaataatctctgacactcacatttgctaagtctaatacaatatgctaagtctatcacgaatctctaacattcacatatgctaagtctaataatctaacactcacatatgctaataatctaataatcttatattaaaactctaataatcttatattaaatctctaacaatcacttatttacatcacttgcctgcgcgaattccttcgatggctagctaccacttcggcttgagggacgacgacgacgtcttttctataacattactaggaaaatgtattagtctaaacgcaaaggaacatatatcgtatttcacgttttcaactatatatataatcgtatatatatatatatatatgctaggtttaataatcgtttaattatctcgttcgtacacgtttcgctcccgttcgttctcacatttttagtacaagtgcattcacgttcgttcgtgtttcgttcacgttcattcgcgttcgttaacgtttcgttcacgttcgttaagcgttcattcacgttcgttcacgtttcgttcacgttcgttcacgttcgttcacgttacgttcatgtttcaatcacgttcgttcacgttcggcaatgtcggggcgcgcagcagtggcggcagcggagcgctggcgtggcggcgcggcggcggcgtttcgtggcggcgtcggggcgtctcggcggcgtggcgtggtccggcggcgtggggcggcccggcggcgtgtgggcgcggcggcggcgtcgtgtcgcggcagcgtggcgagctcgaggcgggggcgtcggcgacgtcgccgtggcggccgcatggacgttacgtcgtcggcggtggtggccgcgtcgaagtcggagtcggcatctgcaggaggcgtagtcggggtcggggtcagccgcgagcgtcgacgttggcggcagcatcggcaacgagctaggcggcggcagtttggagagagagagagagaaagagagatcgagagagagagagagaggcagtggcggctctcacccaagagatgtggcggcggcttcagcggcggaggcggcgaggaccgcaagacgacggcgagagacgacggcggcgtcggcgtggggttgccctaggcagtggcggcgaaggagaagctgagatcgattagaggaaaaacttctaagtgttggtggagaagacgagggcgcaccgggaatatatatacccctagatctttagtcccggttggtgagaacatccgggactaaagatattttcccgctatttccaaattctttttaaacccgattagggttaagaaccgggactaaagataatagcactgaattttgaatttcattacatatgtgtttctaaaatagtaaataatgcattacaattatttaaagtcaaaaaattaatgacaaaaccttcgaaaaattattgttatctgtagtaaactaagtggataatatataataagcacatgaatgatttaaaattgttaaaaattttaataatcatatataattagcatatgcatgatattaaattgttaaaaattctaattaacatatgtaaataccacatgcatgatttaaaactaataaaaattctaataatcatatataattagcatatgcatgatattaaattgttaaaacttctaattaacatatgtaaataccacatgcatgatttaaaattaataaaaattctaataatcatatataattagcatgtcatgatattaaattgttgaaaattctaattaacatatgtaaataccacgtgcatgatttaaaaattctaataatcatatataactagtatatggatgatttcaatttgataaaaattctaataatcatacataattaacatatgccatacaacaattgatttgtatggatattcaatacatccaaaatagtttacatcgtgtacacaacaattacggcaatacatcggcggtgacggttgaccgcacgtactttctcctcactattgttccttccttgtgatcgctacgtgagtaaggggtgtcttcatttgataggaggatgctagggtcaatcgtcaccgtgaaagggggttgcccatcaaactgatcgtaatcctcgtcagtcttgtcctctactccgacaatttttctttttcctgggagaaccacgtggcgcttcggctcgtcaggctctttgcccttttttcctttgctagacatgtccttgatgtaaaaaacttgcgttacatcattggcaaggacaaaaggttcgtccgagtatccaaccttgttaaggtcaaccgttgtcatcccactgtcatcaatcgttacgcctccaccagtcaacctaacccattggcaccggaacagagggaccttgagaggtccatagtcaagttcccatatgtcctcgatggcaccgtaatacgtgctagttgtaccatcgtgtcccatggcatcgatacgaacaacactgttctggctcgtgctcttcatgtcttgggctctcgtgtagaatgtgtacccattgatttcatatccctggaatgtcgcgatcgagccagatggtcccctcgccaggaaggccagttgttggttaatcgtctcattacccatgagatgttgtcacaaccacgcggagaaagtatcaatgtgataccgtgtaatccatgcatcggacttaccgatgtttctagcacgaactagagccaagtgctcctcgatgtaaggagccaccaatgaagattgttgcagaatcatgaaatgggctttacggaataaattgttgtctaccgtcattattgctttccttctgagagtcccctttccccgtagtctcccttcatggcgtgattcaggtaccccgattgggcgaaggacttcaataaattctacccagaattcaatgacctcctttgtttcataccccttggcgatgcttgcctctggacgagcacggttacaaacatatttcttcagaacgcccatgtacctctcgaaaggaaacatgttgtgtaggtacacagggccgagaataccgatctctttgacaaggtgacaaagcagatacgtcattatattaaaaaatgaaggtggaaatatcaactcaaaggtgacaagacattgcaccacatcattctgaagggcttctaatctatccggatcgatgaccttctgcgaaattgcgttcatgaaagcacatagttttgttattgttgcccggacattgtctgggaggataccccttattataattggtaacagctatgtcatcaacatatgacaatcatgagactttaggtttgcgaacttcttctccttcgtgcttattattcgctttatatttgtggagtatcctgacattaccttgatgctctccaagcattcaaacatactttccttctttgccttgctaagagtgtagctggctggactcaagtaatggcttcttttctcctttggttccgggtgaaggtcgccgcgttgttccatatgcttcagatcattacgtgcttccagtgtatctttggactttccatatacacctaggaagccaagaaggtttacacaaaggttcttagtgacgtgcatcatgtcgattgcgtggcggacgtccaagaattctcaatagggtaactcccaaaatatggagttttttttccacatcgccgtgtgaccatgttcgctctatataggctgggtgccaggcccctttccatacactactttaagatctttcaccatagcaaacactgttttaccgttcagatgttttggcttcgtacggcggtccaccgtatgttccaaagtgcttgcctttcttccgtactaggtggtttgctgcaaggaatcgacgatgacccatgtacacaaccttcatacagtgcttaagatacgtactttttgtttcatccatacagtaagtgcaagccttgtaccccttgttggactgcccggataggttgctaagtgtaggccaatcgttaatggttatgaacagcagcgctcgtaggttaaactcctcctt

SEQ ID NO: 71963 - DNA, 29283 bp, Oryza sativa
ttcttcgttagctgcccgtcaacttctcctggatcatctcatctaatcttgtatcgtagtgctttacaaacagggcatgcttctaggttctcgtactcctcaccgcgatataggatacaatcattcggacatgcgtgaatcttctgaacttccagtcctagagggcagactatcttcttagcctcgtacattgtctcgggcaacttgtttccctccggaagaatgttcttgatgagtttcaataaatcgccaaattccttgtcactaataccattttttgccttccattacaagaactctagagtggtatccaactttttgtgcccctgctcgcaacctgggtacaacgacgatctgtggtcctctaacatcttgtccaatttatgggcccccttttaactttcgcagtcctccttggcgtcctgcaacatctgaccaagatcattcgcaacgtcattaccatcagcatccctttcctcctcgcccgtttgatttccttcgaatccagcgtactgaccgaagtccggaatattgtcgttttccacttcatcttcttccatttcaaccccttgctctccatgagatgtccaacaaatatagcttggcatgaaccccgactcaaacaagtggaaatgaatagtcctggatgtagaatactccttctgattcttacacttattgcatggacaacaaataaaacccttatgcctgttagcttcggccactctcaaaaaataatgcacgccgtcaataaactctttggaccgccggtcagcgtacatccattgccaatccatctacatgaaatgaaaacaaatcgtacacaaataattattcgtacaataatgacagccatacaataatgataaaatcattacaaactctgtcaacagtcataaaataatgacatatcattattcatacaaaaattataaaatattacatcaaataattcttatttactatttctaaagttttaaactaatattaatttgttgtagttcttttaattttcattttagtttgttttctattatttaagattaactttcactattttttccttctcaactattttataaaacctttcaaataaactaaatttctatatattctttctttcccatacaaattttctctctcatcaacttacaacaaaattttggagacaaaaaagtgtacaaaacatagctccaaatgtaatatgacaaaaaaaacattagaggatgaagttgctaaccttttagccacctccgatttgtatataatcaccaaaataaattcactcgaaattttggcatgacctcttctcttttttgaagaaattttgaagcttgctcgggctggaggaggaagaaaaggggtgggactttagtcccggttggtgttatgaaccggggctaaagatcgccgggatctttagtcccggttggtaacaccaaccggtactaaagttatgatctttagtcccggttggtgttacaaactgggactaaagatcccggggggcctgacaagccctgatagcatttgaaccgggactaaagaggttggtgttaccaaccgggactaaagatcaaatatgcccgttaccctttttaaccgggactaaagatcatctttagtcccggtttttattgtaaccgggactattgtggaattcggccgaccgacgaaagatggtttctccaccactgatactatatggcctacctgtatatggcctacctgtatatcaaaactcaaaagtggactacattgcctaaatgtcgtggtcgtggtcgtgggtgttacggaatattatctcccagggagataaagatcctttcttgtgaaccaatctgaatcggagtagagataaggtctatctcatcctaagacccctatatatacaggggcagggtgtgacatatgaggttggcttgtactcagaagagatctataatgaagagagagctccaccctatatctgtgttcattgtctatttctgcaatgtttttaagggtaaagggatgggcgcgggtgttctacatcatctcacgcctctactgctatgggagtaacaggaaacggatccggtgatccgctaataggcgcgttggtttacaacacgttatcaacagctctccgttcactggtttgttgctccaatctgttattattattagattggattttaatgattgattaatctcttgatattttcgttgtttgcatgcactaccgcgagaggtgctaccgacgtgatactggtcggtcatcgcgttgcgctatgctaagaggagttgccgtccgtggtcggcggacgtccgtggtcggcggacgtggttggaggacggcgttccagccctgcaagacgcgagccgtgcgcgcctgccttcgccgtgggcgtcgattctcgccgtcgtctgcgagacttcacgtcaatccagtcggcaaaccccacaactgcatgctcgtgcgccgctgggcgatcagccgatcaccctgtgactcgcgtccgccttcacgtacggcgttggcagcccgcgtgttaccgtgccggcagtgccgcacgtagcggcatgcaggatcgatctatatgcatgccacgcatgaacgatcccatccatgccacgcatggcctgagtcggacgggcctgcaccaagcgggcaagcggccaacatgcatgatgcatgcactagtgagcagcctagcatgcatatgctagggtttgattgcatatcgttacgtgcacccgagacatactaccaggagatgaatacgtgcttccatcaagcacgctaatcacggtaattagtaagattggtttctaaactaatttactaattcatagatacatccgggcatgcgtctattaaggtatgcggtgtttttataaattgattatattttctcgtttttcatcatattatggatgctttgcttgcagtagatttgattatgctcttgatctagcggtagattaatttcctgcttttgatctatatgcatctattttatctgatgaaaactgaagaaacccgtgtgagagaaatcattaaaattgatgggataccctggactggagacgtgccaaattcggctgggccgaaccaaccgtctcgcccaccctccctcgcatctatctgtttctctctttctctgatgacgccacgccggaaacacggcgacatattctcagtctgtgcagtcggacttggagacatgttggccattgttcgctgtcgctgttgggtacgccatcggccttgcgtcgatgccgtcgcgggaaacagccgtctcagaaaaagccctaaacccatgtcgttgttgccgctggagttaatgctgaagtgaggcgccgccgccgttgacctcccatcgacgctgccgtcgagccgtggtgggaggatgatgggtcattggttgcctactatcggattaatctccgccgagacgatatggccggatgcaatttgtttgctgttgttggggtctcagttgctgtaacgccccgacattcgttagccataaacacagctaattcacaccgaggtgttatgcattacctgtgatatagtaccagtcccaggatacactagcttttacacgcagaataactgtggaatcaaagaaaactgttttattacatcactgggtagtagtccttacataagttgccaccatggacaggtccatagatgagcaacacaacattacagaaaaccataaaagcgacgacgcagaagcgaacagcgcggagaactaagcgactagcgaatagcgcggagaactaagcgactaagcgactatgcactaggcaaagaacctaggcaactaacttattccacaggcgagctttggggctaggcacgaaacatctagaagtctgttgacggttcttaaatcataatatctgaccgtcattacctacatataatgaaataaaacatggtatccaacttagtggtaggtattattactaatcatttccactagtgttggtgaaatatgtgtatgcaggtattttgagaagaaaacacatccgtcaagcaacaaactgcacctccgcgcattcaggatacatttacacggattggaggccccataagtcaagtaaacaactccaaatgggcccaactatcatgccaataggctgagggtctcaaaattagtgtccacgataaaaaatgggccgaacggagccgtctcgagttcggcccgaacactttttgtggccgttgatcgtgagattcgatgtggatggccctgatctcttcctaatgatggttggagggtagtttggtcgtttcccatacctgtaaccgtcatatggaggctataaatagagctcctctcattcattcacaacacacaactttgagctgaattacaagaggctcttttgtatcttttctacattagaataaggtagagagtgagggcaagctctggaggagtgcccggaagtttggcgctcatccgacttctacctcgacgagtgtagcttcctaggaggaattctggaggagtaccggagctgtcggtacactctgctccgggttcggagaaccttcttctattaagtaagcattcgtgttcctttcttatgttatttaattatttagtctgagtaagatatatttccatctttgcgggttcattgtttagtattcatactaagtgctctagtactaggactctggataaagaaggaagttcctgtacgagtattagagtagtaattaataacttagacgtggtgtctaggttagagagtattagagtagtaattaataacttagacgtggtgtctaggttagagattacctttgttttgtgtatcccatggatttgtccgaggtaggcggcaggtggtgacagccctgaattccgtcccagtaatcctccacgtttggatgcatcatagagctatagataggaaattacctttgcttagcttagaaaattaagaaacatagaaagtcctctctagcctagcctacctaccatcagttgttgtccttggacagtcttagtcttaggtagattacacacgttccctgagttcgatatccttttggggtcacccgaaggtgaagtgctacagcgatattccgtgcacttgtggatttatctgtggtcgtacgaaataccaacaagcatttctggcaccgttgctggggaacggttgctaatttatctgagtctaggtcatcctcatatctttatttttatttatttttcttttattcttttccttgatggagcaacccacaattcaaaacctttctgctcctcgggctgatctttgtgagccgtcctgttcttcaaaaccaatcctttctgatggctacgaaatcagtcctggctttatagccatgattcgagagcaaaccttctctggtagtatcggtgaaaacccatacctctatcttcgggatcttgagctagtgtgtttgtgcctatccatcgtaggcatgacacatgaaactctaaagtggaagttgtttcctttttctcttagagataaagcgaagcaatggtacactatgtctgtcaagaaattccacggtgaatgggaggagcttaagtgcaatttctgccttactttctttccattaacccgtgtaatcaatcttcgattagacatcctttctttccgacagaatgagaaggaatctctcggtgcagcctgggccaggttctcattgttaactcagtctggcccaaacttgtgtttacccgaccatgtgttgttacaacattttcgatacgggttagacaaggagtctgctacaaatctcgatattttcgctggaggatcgttcgcacacaagacaactgccgaaggaaaagaactcttagatctgatcttagagaacgattctttcggccaaagcgaagcatgcccggagatcgagattatccatgagtatcctctgcacgtggagtcggaacccgactcaactgtcgaatcctcattccagtcgctggagccggaggaagaagaaattcatcctccgaaaattccattccaattcaggggtgatctttatgaaaattatgagaacaccctgaattattccagcgaaaagaaggctcatcccaagcatgagccgttcgagaaggtgatgtttgtatcttcgttcgtttcttctgaatctatttcccatcttcatgaaactgaacgtccctcatcaccctcgatcaagcctaagccttgtccctctggccctcataatgatgttctcgtttatcatcatgaaacaacccaattcttgcacgatgtatctcttgagaaggaaaacccttaggccacggacaagcttgagacattgactctggaggacgagagaaaacattccacatatgagcatgaaagtttctctttcaaaaccccccaggattcatgctcacataaggaatccccagagtcctgttctgtggtcgtaagaaataccaacaaagtcttcatactcggctaactcctggagatactcctcggcggttgggacgatgtcttcatcttcatacactatagattattataaggggcaagggtgagtacttaacgtactcagcaagccaggggaaagaatgacatgtcggtttaacaaggaggctaggcttttatttgcgaaagctgcttttttggcaaagtgatttatttcacaaaactcctaatgagtgagtcaagttttagttgtcgggaggaggctcacgcctcgacccatttcacaagttgctttgcaacaacttgtcacgattaacgaacaacaattaatttgtttcttctattagcttcttctcactttcacaacaacacatagtccacacagacatctcagcacaacaacgccatcaaggccctaacaacacctcggtgtcggacgacaccccaggtcacatagacccgttgctaaccacccaggttagccgtctgccacacaggcggactctggaaacgttacccttcccaataaccacttcttcacaaacatttgtcaaacaaatctacgctatgagaaacaccttacacttgcccttgaccgtgggcacggctgttcgaacagttcattaatctctgcagaggttgcacgctttacccacacgagacgaaactgacatcgtttacccgtcggcaatgaaagttcgtgataaggcctttccaaagctaacccatgaaaatcgcatgccacctagttgggctaagatccatagccgagtatcaggcaatgatagccgtcatccactcaggaaatactgaggatgcctcctactcctactggtaccacgccacaatagaagcaaaaagacacccatgatgggcaaaaatgtgtaacacttcgtctcctcatcctcggcatcccacaaccattggcacaccaactcccatgtgataacaatttacttagccagaggcatcccataaatacccgtgtggtcgcactgtaacgtgtttggatggatttcccaaaggaattggtccttaacgacaatacgtagccaaaccacaaaggcatgactccgcatcatcaccactttcacaacacattttatttcacaactactcagtacaacgtaccggatttttaaacatgtatttggaataacccaagtttcccacatggcaaaacctcggtaatcgtataacaataccggcacaaatatttgtggagctatcaaatgtatggaatcatcaacctatgaaatataagtacgactactaggttggtccattggttgaataaacaatccgaggcctaacatgttaatcgtgtaaactaaataatgcatttttgcaaacaatgtatcattgaaaatataggggtaatgtgatcaaagaggcttgccttgcacagggtgcgggtcttctccctcgaaagcggcgtccgaagcttcctcgtacttaggctctaaacgtggaaacaaagctaattaagaaaagccaataaatctagctcaaatcagagaaacaatagtggcactgtgtagatttcaattttagaaaaatttaggaacttgaacggggtcaatcggagttacggttgattttctacgaatttctaaagaataaaagaattttctggaataacaatttttggacggtaagggaatattccgttggaatattccgttagctgggacggcagaagaggggacccacctatcggcgatggatgggaggaaggatgcgcgggcccggcttgtcagtgggggatggaggtaaaaggggcatggggtcagcctgtcagcggctcggctccgccttcttcttcctcctctgctcttttgctcggctcggtctgggatggcgacgcaccgcggcagcgagtcccggctcagcgaccggcggtcggggaggcggcggcgaactccagcgaggcaccgccggcaacggcggcgctaggaggcgcggcgcagcggctctaggcggcggtacatagagtgaaatcgtgagaaagagatagaagagagagatggtgatggtgtggggagaaggagctcgggctgcttccccttttataggcgggcgacgaggtggcgagctggcagtctaggcgcggagctccgggcgtagacggctagcagctagggcgggatttcgagacggatgagatggtgaggcgacggcgatgcgacgacatggcgtcatgcgctggtggcaatgcgacggcgaaacgaccgcgacgcgacatgaagtgacgcgcggagagcgggaacggctgcgagacgtggatgacgtatggccgacgacgactagggccgggatttggggcggtagggatagagaggggtgacgcatgcagtggtggcaatggaacgcgagagagagggagagatgcagccacgtcttagcggataagctccttcgcgtcgaagtaaacgagaacggataagcaagggcgattggataagagaatgactcagcctagggttaggggtgacgaagggtgaggtcgcggccgttatctgttggcgtcgacgcaacagcgaagggaaggcgacgcgatggatggagttaaaggcgacgggacggggtgacacgaggcaacgtggctccgtgtctcccggaaagaaaccggagcgaggtcgggcttggcgcgacgcggatttggcgcggcgcgggtgccggctcggtgcgggggtggtgtggcgcgggtgttggcacgacgcgcggcgcacaggagggtgttttggtgcaatgcgagacggacacgagggtggaacggtgcggcgactcgagttggcatttcgtcgaacactttgtgtgcgtgcactggctggtctgaggaaggagaagaacagtgtttgggctgggccgagtgggccggcctacttcgggagaaaggaagaggagagggtggagaggagttgggccgagggagagagaagggaaaggagaggaggcccaacatgaataggtgagctttcacatttttcccagggattttgagttgaattttgagaaggatttgaaaggaactcgaatttgaatttgacctagggtttcataggaatttgaaaggatttctatagaggatgatttgaaatctattttggcacaaaatcaaataagaaccaaattaactccaaatttttaaatggcaaacttttaaataaatgcaaaataaaatatgggtgctacacttgccgtcgttgagttcgcctcgccgccgtcatgaggatgcgcgggttgacgcggagctccgtcgtgtgccaccgagccgccgccgcaccatattgccacacgggagtgatgtcgtcgccgccgtcctgccaatcaggtagtggacgggtcatcgatgacctcctcgccgtgtgccgccctaactcccttcaaagtcgacagacgacggcctccgacgctgccgccgtgctcgaggggccggtgcaccgggcggtggacaccgttgcagacaatgaatgggaaaggggaaacccaaattccccccttctcttgctcggtcatttaggcttaccagttgggccggtctacctccgcctgaccgaataaagcccaacagtaacgagacagcccaaacaaattaataaaaataataaacttggaaatcctcatgggcctagagtttcggaaattcggcccattaggcattttgggctacactgtgcttgctagcccaaataagatcatggcctgaacggtaattcggcccgattaatttcggtttattgacaacttgcgtttaagcccccagagtgctgggtttttacgctatagttcactgtttaatggaattttacagtttgaaccttataattaacaagagattatattaattttatttgtgtggctatgtcttgttgcttaggccctgtatagtttggttttgcatgtgggtctccggactcgtaaataaccatgtaatggtgttttttaagcattgctttgcttttaaaattgatgcaattccaactaaataatctggagatggttttctaggttatgatgcttccataaattgtgttcatatagtgtagaattcaacccttggaagcattatgatgggtttattttcctgcatttatgtgtgatggttttctatgtggtataaatattgggaatataatgccaaataagaccaagtaaataatagaaaatcacttaatgcatggaaattctaggaaattaaatatccatggctatggataagaccactctttactgatacactcctccatacataaatggtgatatcgatgtgtctacaagatggagtcacgtatacttgttgttgagatccatgcttttgccgaattcactgcgcatatcatctacttgcgtgctgcgttctctgagaactgcatgaaacgatttggatgatagtgtgggtgatttcatgtaaaggccttcaatgactattgtatggctttgggcattaatatagatcactctatccctatgatcacactcaagaatgggattctgagtcattgaaatgtgtggaataagacaatgtgtttgggattcattgtgcctttcccctactggcttaacatctcaatcagagtatggtcggactacggtcgacattttgctttcccaatggttgagagcacgcttttctgatttggagataaatgattatacctcaattctctagcaacgtggagttgcgaggttcaatagtttgagatatttttcactcggtctagtgaaagatgtaaagtgttttccaggtggtggaatgacactgttcgtatggttgcccttggtgtgcacatatcttctcactattatttggaacctgatgtcttgcgaggacaccggaaaattggatgcaaatctagtggaataagcccgagggtagatgctgtgaataggcatgattcccactccactatagcgccaacagctaaacttgggtgttgacccagtcttggtcctcgcatggatctagcgctaatgaccacctttggttgatgccgatggttggtggtgtctgtctaataagttgttctgacaacgggagttgtattgctagtttagagcatgtcctaggagaacattggtcgactatactgttgccaagcagtttatcttttgcttagtttggaactttgtattagatcaatatttctcagataaatagcgttcttggtctttcctgttctattctaaagcttatcttcatgctggaattgataaaatgctttagtttagaataacaattagtgtatgatccgaggagttacaaccacttacacagttcagcgtaactgtatttcaaacaaatgttggctatgcactattgcgttttatcgcgctctcgtagttgatgactactccctggttgtgttggttgatcacccatgggttgatgaccatgcttgtcgcacactggcgtttttcgcgtgtggacatgtgcgagtcatgcaaaggttcgtcgtgttgcatgcgttgagcttgttatgccaacgacggttgcaccgacacattctactatttttgtggatatgtctgaatataatggttttattgtgaatattaccattgttggaggtattgattatctcccaatggctatgtctaggggatattagcaaatgtggtttgataattcgctcgtgcatcatacctaatacatgctgcttaactataacccaattctagagtttggtatgagtaattggggtcaaacttgggcattaaacaaactggacattaacccaactctgcaccacaaaaatctgcttggcagcgtaggctagtggccgtgcatttttgctatcatactccttgtcgagcgcatcggaatgcgttttgccaccataggttgccttcttaagcatatgacatgggatgtctaatgcacgtcgatccggaatcgattgtgagtttgaatggcacaaggtgagcattaatccatggagattgcatatggctaaagtatttgcatgttggttgcatatacatttggtagcaatagtggtttttgcagacttgtatatcctaactaggaggttgaggataacccttcggaggaaggaagaacactgtagtcatgccactgtattggtatatatccaggctcactttaatgcaaaaatctctccgattaaagtgcataatatttcccaaatatatcgccaccgtagcatacattcatgggagaacatttgtgatcgaggtgaaattcctaaatcctatgccacgatatggggattggtagtatgctattgtaagatatctcggcattagggggagagaattgcccattttggaatgcatgtacatttctttgagtgaacgcactaaatgagctgaatttgtatgtttagttcatactcctggttgcttggtgcacggagtttttgccaacaaaatcatatgaggaacaactggatagttgttaaaaagagtaatgctcccaattatggtaaatgtggatagacccgggaataatatcgtatccatataagacttatggaatttgatcatgttatgtgaggacgcctgctaacacgatccgtgggccttagtcagagcataagagttctcaccggatgtgagcatactcctctgattctcctagtggagaattcaccttcggaaggtgatatacctcataatgatgttcgtcgtggagacgacattcctagcaattcgcacatattatggtgctaggaatatggaacaaccatggatcgatcgttttgggaaatgacgaagatctggttaaatgtgtaagtgggaataaatgtgtcgcctcttgctaatgattctctgtgagagaacccggatctggaaaaagtccatggcatgagcatgcgatgctcaaatcgggtcaaatggaaatgcaattgaggctgaaccgaatcactaagtaaaagtcgcgaatgttgttcggatttttagggtcattattgagataatgaggtggtgatgtgcaatggttcaagtaggtccttgatgagacctctcccacgtaagttgaatgttccgctaaataaaggtattggcaaaatggcatgaaattaaatatgcagttaacggatttaggaaatccgtgaggtcttgaatagactccgtagtgaagttgcagcatgtaaatctcgtaccaatgggtattctgataagagtaccatttcccgttgggagaaaatctcattgatggatttttctctgaggggagacctcattgatgaatttttctctgagatacaaaataattagtaagtctgaacacaccatattgtataatcccttggagggattaagacccatttatgacccggtaagattgcgatgaggaacctgctaaggtatacttagtgttgttggctatgtgttatctcccatagtgcttaaattttcagactagctagttactctgatagttacaacatatctttggaaggcttgtagttgatcttgtggatctccaattgttgttgacatcgtcagagaaagttgcaatgatcaagagatgtgtttgcttggcacgtggcctaccgatgaataatgcggtcgagagatgtgtttgcaatatggggcgagatgttgccacaggcagcctagctagctagcttacgaccggcaccgtgcccgtgcagcagccgcaccgcgtcatctctcaaatttcggaccacgaactcgaaggcagccgcggctcctgtgccgcggagacgtggagacctggagaaaaacggcatctcgtcgcctccggccgccacgtgaattggctcgatcgcggcggaatggcgtacacgccagcgcgcgcggatcaggcggtagcagagcgctttctcgtcgcccggcggcactggcgggcggcgtcgagtggagtggaccgattgattgcggcagcgactgatggcatggcttgggtcgtgcctgtgacggcccgccacgaatagaggccttatcgcgctttcgtcccgtacgtgcttgggcctcgttcctcaccgcacggcccggaccattttctatcttgtgcggcacaagagtgccctgtatgtatacttgccacggaattcattcctggaacaaattttactttcgcttttccctttctcttttcctttgcgaaaacaaaaggagtagttattcgatctgtgatctgtgacgtagagccagcaacgatcgaatgcatatgcatcgatgatcattcgccgatcgcttctttcccgaaaattcattggcggatcgcttggctctcaagtaaaataatatagtactatttagtactccccgtttcaggttataagacgttgatcaagatcaaactgttttaattttgattttaacttagtcgaacttgaaacatcaaactcaaaacttcaggcctgttcaaattgtaatcaaaataaacattaccaaattttgacaatattaccatcctagcaaaattttggtatcctagcaaaattttggcaataccgaaattttggcaggatttcttatgtaattactaaatttggcaacaaactaaacgtagatatttttttagcaactttgccaataaatggtataattgaaaatgacaacaatctgaaaagcaccttcttgtaacctgaaagaagggagtacaagacaatacaccatgtacctatagtacgtatatagcatatgaaacgatcaaatgcctatatattgttgcttatcctattgctaccatatgatgcatcaatcaaacaaacaatactacgctttcaggttaaatatttctctcacacttcatttgattactcgtttgttgatctcaaataatatattggatcatacctgtctaacaaatttgccggtcaattcaggtctttgaccaatgggtttcaatttccatccggtgaacgacagcgactggttgatcagggcggcgatgctgctgagcttcaccctgcaggtgatcctcgtctttgtcgcgcccacgcgcaagcgctcctgccacccgcttccccacctcgccgtctggtccagctacctcgtcgccggctgggtcgccgtcgtcggcctcggcctcctcctcaacagcctcagcatcagcggcagcaacaatgggtcctcctccatcttcgccttctggacgccattcctgctgctccacctcggcggccccgacaccatcaccgcctactccctcgatgacaacgagctctggctgcgccacctcgccggcatgctgttcgtggtcttcgccgcattggtcgtcttcttcagctccgtcacgagcaaccccatggtcacggccaccgtcctcgtcttcgtcgccggcgtcatcaagtacggcgagagaatctactcgctctactccggaagcgtgagaggtttccgcgacaagatgctcggcgagcctaatcctggccccaactatgccaagctcatgacggagttcgagtccaagaagaacgccggcctgatggtcgagatcatcgtcgtcgacggcgagcacaaggaggcgctggagcaggcggaggtgatgaagaacggcaggaagagcgtggagacgatggcgtacgagctcttcgccatgttccgggtgctcttcgtcaacctcgtcctcagctacaaggagcggaggatcagccaggcctacttcctcgacctcggcgacgtgatgacggccgccgcggcgttcgaggtggtcgaggtggagctcggcttcctctacgacatggcgtacaccaaggcggccgtgtcgagcaccaggagaggctgcctcctccgcttcgtcgccacggcgtgcctcgtcgtcgccgtcgtcctcttcgtgctcatggacaaggccggcgtccgccacgtcgaccgcggcgtcacctacgtgctgctgcttggtggggtggcgatcgacgtggccgggtacctcatgctcctctcctccgaccggacgctggcattcctcgacggcaagccgaagctagcttggcttgcacgggtggccagggccgtgcggctgccgacgaggcggtggtcggagcggatcacgaagatgaacctcatcaggtacagcctaagcaagcccgaggaggacgccggccgccggtgctggtgctgcaggtggacgacgatcccgcgcgtcgtgcgctgcctcgcctgggtagccgacatggtgggcgtgagggagatcttggacgacttcttcttcatccggcacgagccggtgagctgcaggaagatcaaggattccaacaaggggaagaagtccatcgacgtcctcaactacgtgttcgatgggctcaggaagacggccaacgaagtaaggtactccggcggcaacgagatggaggaggtctgcgactaccgcggcggcgaggggataatcaatgagctcgtcggcgacatccagctgatggagctcaacgtgaacgacgtcgtgcgcgaaagcgtgagaagggagttcgacgagtgcctgctgctgtggcacgtcgccacggacctgtgctcccaccgccgccgcgaaatggaagtgccacggaacggcgacatccagagcttgatgtccatcagcgagaccctgtcggagtacatgctgtacctcctcgccaggcggccggagatgctgcccgcagcgacggcgacggccgccgtcatcgggctgctccggtaccgcgacacgcgcgccgaggcacgccgcctcttccggtcggcggcggcgtgggaccccacccaccacgacgcccagaggatgctgctcgaggtgaacacgtccaagaagccggcggttgtgaagggcgacgagagcaagtcggtgctgttcgacgcctgcatcctggccaaggcgctgctgcagctgggggacgacaccatgtggagggtggtggccggagtgtggagggagatgctcgtccacgcggctggcaggtgccatgggagcacgcacgttcggcagctcagccgcggcggcgagcttatcagcatggtctggttcctcatggcgcacatggggatcggcgacatgtacaggacccaggtgggggacgccaacgctaagctcgtcgtccttgaccagtagacatgcatgcctgctgccgcatatattttaatactccctctatttcaattcgtagcaacttaaaataggattagatccattttaggactacaaatctcgacatatatttattcagattcgtagtcccagatctaatcacattataagtagttatatattaggctagagagagtacatcacttacaagtgaccttccgcgaggcagcttgattcgttcttgttgtcttaggttttttttttttggtgtgtccattgaggatcaagtagatgatggcgactatgtgggttgttactaccatctggattgggaagattgattgatggcagttgaagtcgttcaactgtgttaaccgattgtaccgaaatttttacaatttggctcttttaaaaaactagttaaaaaataagccttttgctcagcgccaaccttaatggtgttgtgataaaacatctcagcggcataaccattggcgctgagatcttattcaaggtggcatgatttcgccatgtaatcaggcctcagtgccaatttagttggcgcggacctcttgacattttaaataaaaaaaaggccatgtataaacctcaacgctgctagcctggtggtggagcccttgctttgcatctggcaggtttcacattcaaatccctagttctactttttatttcctacctgccctcctatttttctttttaagaatttggaatgagcagatttgatgatttaaattattgcatttgtcttagtaaaatatttagcttaatatctactacgaatttacaacaaaacatgtgttttcttttaaaaaaaatggagaacaaaaacctaaaatggtaaatattatataagtgaatttcaattttcaatttcaaaaataaaatggattttgaaaccatgcaattttttaataaaaaaacttaagcagaaagatgataaattgagcactgggtaagtgagaaaaaaataggaggctatggggttcgaaccttgaacatggatgaagcagcaaagtggacttacaactgagctgtacccttaaatctaaatactatagtttgattctgtatacttatatagttcatcccactaagtttagttaatactatttctatcttctctcattaagccacatcaccctaattatttttagcatttgaatgatagatttatagttcaaattgtctcttctttcttctctcataaaactatacaatctcaattatttttagactcaaaattcataagtatcaaaatttattttagtttcaataatcatatcacatcttatttgtacatattaggcaccttaatttcccgtagcaacgcgacgaggtattcatatagttatctatatatcatacactaaggtcgtgccatctcaggtagaatgttagcaccaatggtaaacatctcagcgccatcatggttggcgttgagtaaacggctcatttttgcaattagctttttatacgagttattattgcaataaattttttaaaaggatcaaattgtcaaaatttcggctgattgtgagtgcatcactttggttgtttttggtgtgtggtaggtgcatttgatgctaccggcaagcatttgatgaaccgattgtgagtacaatggcgaagattacaaggtgaaaagattgatccattcatcgagattcgacaacaccgcactcgtatgtcatcctcttattagaggtgttatttcaggttttggatgaaaatctagatctatcttcatatagcaacagcaatacaacacactcatcaaatccttgttgaacacctagagtgagtgatgtgaaccattcctactatggataaaactattgttcacatcatggattaacaaaaagacataaagatcaattcgtccaagtgctgaaatccgattcggccacctgctatattgctgacttcaaactgtcaccaaatgtgcatatacgagctccgtttttggcccgtgagtacttgtcaagtcatcttttcaacagatctagcctcatctccaaattcatttctgtcggctgcaatcacagaaacaatgtgttgcatcacctataatgggtctatgggcttgtaacttcatctggacctagcccaggtggggctctcatgtggggtgcgccgcaacatggtggagcatgaccctatggaccccttggtcgtcctcccacctccttaaataggtaggtaccccttcagagtttcttgagttttgttgattagatttagcaacttgctacttgtttgtagcgcacgtgttggataaaccgtttgtctgtttgtttttggaaccccgccatattgttatttcagagtaaaaccttcatatctatttgttcttccaattcggtgtgtgttctacttgttcttacttgtttttcgattgcttataggatgagtgccctcgtgaccgggttgacgcgcaccgcaagatcgcggcgaccactagagacagtattgttgacggtcgttatagaccaatttcgaccatcaatacttctagaaataatggagacctagcaattcttgcatgcatttttatttagaaataatctggttccacttgtacttggtaaagtaattgtatataggagatcacttcataaatggaggagaaacgatggaaattcaccgatcaatcaatcagagcctgacatgtggtagacatatggatggatgggcccacaaacccattaaaacatttgtaaatgggcccaaccaacatgccactggccaagtatccatcaaacaacgtccaagaggaaggactgggccaggaggcctgccaaaggtcggccgaccccggcctggctccgttggcccatgcccaaaccaatgacggttgtaaccgatttgccaatggcagttgtaccggaattaacgcccacaaccgtcattctcaaccactattccaatacacaccaagaaagattcaagaagaagaagctctcttagtttactcactttgctctagtgctagtagagttagaattagaatagtctccttagttcttcaagtgtaacatcctgaaaattcctgacattaaaaatcactaaaattttgaactttttaaaactttttgcatcatgctggaagttatggttgttattgcttgccaaaccataaatcgacgcaatggaaaaaaatcaatctaaagatttacacccgagcaatagttacgatttacaacgatacgatatttattatcaatcccataaatatttatgcacatgaaagccaggccaaataaagtacaagtcaattattaaaccctgtggtataaatcacaaatcaaatattaaataatcaaaccatgttgatagcctgatttcatatttaacaaaaggaaacaacatagttgaatataattcacttgaatccaatctcacatgaaatataagtacacatgaaatgatgatcacatcaatggcccgatctataatagagtttctcactagaatatataattaatatttgaaacaccttatcaagctcctcatagcatgaaaatcactcatataaaataatggtcatataaataaattaggctttatacataaataagaatatgtgagtgtttaattaaacaattagattaatgttgtactaagtctcaatttatatttatagaatgagtagacccacgtaaaatgcattgttatacaaataagttcattcaatgtgctattgtaataataatggccacattaggatattttaaattaattttagaaccctcaaagcctccaaaattatctaggttaattttagatttaaaactcatttaaataatacaataggaaaatatataaaatatgggtaatattaaattttggtcaaatttcatctaaaataaaacatatattgggtaaaactctaattgtgtgaaatctagaaattatgggacaagttttaataggaaataggcctcaaaagtggataattaggaaaaagtcactgttcattatggcataggtgttcgatgtggttccctagcccttccccccctccactgacgagctccccctgacgccccgtgcccctgcacgcgccgcgccgagccgatggggcccactgctgcgcgccgactcgcgccccgcgccgccgtcgccgtcgccgtcgtctcgcgccccgcgccgctatcgacgccgcgtgccgtcgcgccgccttgcgccccgcgcgctgtcgacgacgccgtcacgtcgccatcatcaccgcgccgcgcgtcgttgtcatcgccgtcgcatcgtcatgatcgcctgtcaccgtcggctgcgccgcgccgagccccgcgccactcccgtcgccgccgtcgtgtcgcccgtcgcgtcgccatcgccatgcgccgcgagccgtcgccgttggcctcgcaccccgagccgccgcacgcccgtcctctcgctgcctcgcgcctgcgccccgccgcacggccgtcctgtcgccgtcgccctgagccgctgccgcgccccgagccccgtgccgctaccacgccttcgcgtcaccgccgtcgccatgagcgcctcgagccccgcccgcgccgcgcactgtcgccgttgcgccgcgccgtcccgccgccgcgcgtcgccaacgccccgagccccacgccgccgcgccgtcccgtcgtcgtttaaagccggccacccctccccgcgcctatataagcccctccccggctgcccattgctccccacactacccccaccacctcccctcccttttccctctctttcccatccccagcgttgccgcctcattggaagccgccaccgccgccgctgagccgatgcgccccgccgccgcgatgtgcctcgtcgccgcgccgtgctccgccgtcgacctcgccgccgcgtctccgtcgaccccgccgccgaaccggtgagcctccccctcccccaccgcttgccgtcgcgccgtgccgcccgccggttctagccgaggctgtgagagagagaggagaaaacagagaggagagagagaaaagagaatggaggagagaggttagagtgggccccacctgtcattaattccatccaatttcccttagaaaaataattctgtagaaaagaaaatcaagaccttgaccccacctgtcagtcactatagcttgtggataaggttgtattataaataaatgaattaggaacagtaccatttcgcaattattagaattaattcaaatttgaatctttacactagcataacttattcatttcagctccgatttgagtgaaacttgaacctaaattcataagctttccaatgatatataattcactatttgataaaatatatttataaatattaaataattaatatcaagatgatgcataatagtcaacttaaaaatatgctaataaataaaattagtattgtacagtagagtggatgtaataatatttgtctctaacatgtcttgccactgtaacaaccacacaaactaattttatgtgatgtctcaaatgaatggatgtagaggaaaatactagtacttatttaatattcgatggccatataattaaatccatggcttataggttatttaaatcaagtatagccttatgattatgtaactaaaatataaacacacatagatgaatctttaacctgtttaggagaataataacagagctagatgtggaggaatcactaagtaaattaatcgatgcaataccatatagaatagcatatatatgcctaaattgattaccacttattagtaactcaatagaaccggtgcttaaacttgtcgcatcacatatacaatatcactcatagaaactagctaatgtataattaaactacaatatattcaggaatcacttggagcattgggtagtacactttctaaataagctcatgtacagtaggcgaccaaaaccttatacgttgttgcacacatatattgtacatcccattatagttatacaattaatttatctttttcatatattaaactagggagtatataagaaacatgaatagtagataagtactaattataaatcttgacctcatatgttcatagttcaattgtaactccggattgttcattaagagataatctgtaactataatattataaacttcccgaatttaacatatagagcatggataattattagcccttttataatttataatggcaagtaaaatatgttcataattaaagtaaagcttccatcaataaaataataatacaaataattcactataattgtttgattgatcctaaatccatctaacaacagaacctctagtatataaccgtcctatttagatagatgcatacatagccataatccttccatagccatttgatagactaaaccaccgattagccaaatatatatgtatcccataaatgctatgttggttaactcctaaataggccacgatgacaatagaaaaattaagaaactttagccttagcatgattgggatccattagcaaacacgaatagtacattttgttgcgcatatttgattgttgtttgaatattggtttttctcgcgtattatagaccttgtgtatcgcttagtcgtgaggcaacgtctgcaacttccaggaggtgaaggttgatcaagattatatcaataataaggattatcctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaattgttttcgactggggcggacggaggatttgggtggtatctgggaaaggctagtaccgtccccggtcaattaaggactgagccatgaagttaagcatgaaacaaccccccgtacaccgtacttctcgaatgggtatagacctagcggattagatagccgagcggaggcagtatccctgcatagatggttcacccctgagtgaggcaggtgcgctacgatgggacagccgttgaggtagggctgagaggcgtgccctacatcggtgtcaccattggtaggactgccatgagtgtgtgagagagagaacttaacttgaaccataatttaatatgtgtgagacttctatttatcgggagcgccagaactcctcacactgctagaaacatggacgcctagagtgcatgaggatttaagttcatggagcgggtactggcaatgcgaggttatcgaaaagctatgccatgacgggtctcatgtgttaggatgagggtcatgtgctgggcagtcacggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgatggagccacatcccgataggagggaaggtggacatcctcagaaaaccatgacgattcaatggcgggaagctatccttgggatcacaatggatggtggacagaaccgtcgttgtttaaagtgaacactggtactaaaatttgatcagtctatgctaggttttaggcttgtgaaaagaattgtaaaattagctttatgcaaaagaacctgaagccattccttgaaataccctctatcatatgcattgttgtggtggcttgctgagtacggttggtactcacccttgctattcatatatcttttaggagagtgtttaagaaaagcccttgtcggtacgcttgcgtatccaataagatgatcggagtgcggtcttgttctaggtctcgttccccagtcgactgcctgtggcatgttaaccgggcccttatattattttgtgttccgctgttgttctctgatagttgttggcctacctggccctaatgtaagtatttaactcttttagcctgaattcattcgtgatatgttgtgattcaactatgtatgtgtgtaccaactattgatccagggattggtacggataaacacagatgatttccgatttccaaaatcgggggtccacatcaagtcttctggagaattcaagtatggttctagtaactcttccctctttatccgataatgaaatattcttctttatataatttggtcctttactatatttgcataattatttgagtaccaactttggtttacacttatctcgtattaattatgcggctagcttaccagagatatgcaatggtattggcttagtgttcatttatttgattgctctatgttatctgcagaggtgtagaatagtacttagtaatgtaagcatggtgcttagattactaagtatcattaaatggttctatatgccacggatctgtagaggcaggacgctgatgttgacaactcagtacgagtattcgtcgacgtgtgtatatagggctaagcaagattcatggtgcgggtattcctctgtatctttaattggttgaatagccataatggattgtcgtaaggaactcggcaatcaggggtggtttcttgatataccaggtgggcatagttagggggtattagccacatagttgtaccatagaaagtgtatactaaaatgactatatatattagaagtacataaatggtgcttttattacttcttctctgcttaacctagacttatattttagtaagagtattttaaactgaaccttctatgtgtcaaatctatccttatcctcaactgattaacccatgcataagactttgatttacataagtaagataagaatttatagcatagtactctcttaccatatcttcccatggaattaaataaatacgataccttggaaatacttacgggtgaaatgctatagcggtatatcgtgcgcttgcggatttatttctgtaaccataagaataccgtctaatatttctgccaccattgttggggatcatattcctagtaatgtcgttaagaaatatcaacaggtataaatatcaacaggtatatcggtgaacgtcgcctccatccatcaatcgagttatccaccacctctcatcgaaagattgggaacaaaccttcacgggttcatatcagtgagcttccccaaggtagctgatttgttcttgttatcttaatttattttgtttttgtttcatttttttggtatattcttagtaaacatagagactaggttaatttcatttttttatgaaatattcctgttttttttaaaaaaacaaccttgtcatgttatcttataaaaaaggcaaccttatgttatcaatatgatagttcctcaaaactagaatgtgaaagatggacaagtccttaaagtggcctcattagcagaaaacgtgtagtagatattatcttcttataaagttgatgcccactaacttctaaaactcaacatgcaaatgtgtcacatatcatccactatcaattattatccagagtattttaaatcacatgtgtaaaatcaaaggtgtttttgattattattctgtgatgaacaattggcataggagattattggttttgttatttggagtttatttacgaagtggttttggagatgattggatttacaggtgaatcacaggtttatcattttatgtggaccggtcagaccgggccggtgcggtcggtcagaccggcgtgtaatgcgtggtcagactggcgtgtaatgcgcggtcagaccggcgcagcccgcggtctaaccggtcgacgctgtgtcggtttcggtttcgggttgtttgtttggatatccgtgattatttcatgattatgacttctagatggatactatacatatgtaatactattgtttgctactaatgagtgaagttggagatagcttggtctcggaatatggtttctttgtttatttcatgtgcaggtgactcgatgcctcgggagagtatttgcggtgatggaccgggagtcggcttggggataagacgacgtccgtggtggtcagagatcatgcgggatacttaggctagagttgatgcacgtggttgatggagattcgatatggcatacgatggaggtattgtgtgcgtatgggatgcggagtcgaatttggaaggagtccaaatttgatatgattggttatgtaaagtttgtttcttgtactagagggtttcctaaggtgtttaggactcctagtatgagtttggttcgtggctttagggcgcctacctcgggtataaatagagggggagcatgaggcttccagttatcgctttttagagaatttgagttgagttttgagttagggtttagagtttagtcgaaatttttgtaagtagtgttgttggtgcactatgtaaacgcagagagaagtaataaagtcgtcatccactttaagagttcttcgatttgtttttaccgggtttcgacggtctaaccggcgatattatgatggtcagactggcggcaagcagcggtcagaccggcggcatacgagcggtccgaccggcggcggcgacaggtgcggcaggcatctcagcgattcaaccgatcgacctacatcggtcagactgacgttcatcaggcggtcagactgcgatccgtcgaattagagggtaacttttatttccgctaaaagttttcgatttttgggtataccaaccattcacccccctagttggcttagtttttgttatttgatcctacaagtggtatcagagtcttgttttcttctttggatttttatcggtctagagtttttgccatggctactcctgctaggttttcaactaagaatcatgttttcgatggaacggatttttctcattggtgtagtaggatgcaatcttacattatggctgaagattatgatatttggagaaaagtttctcatccttatgtgattcctgaagctattaatactgctgctgaaaaaactgcttttgaacaaaattgcaaagctcgcaacattcttttgagtggtatttctcgttcggattatgatcgtgttacgcactttcgaactgctcatgaaatttggaatgttttgagtaactttcatcaaggaacaaataacattaaagaacttcgtcgtgatattttcaaaaaggagtacattaaatttgagatgaaacctggagaagctttgaatgactatctttctaggtttattaaaattttgagttatcttagatctgttgatttttcttatgatactaattatccacaatctgagatttctcgtcactttttgaatggtcttgacatgtctatttgggagatgaaagttacatctattcaaaagtctgttaacatgtctactttgactttggattcactttatagaaaattgaaaacacatgagatgaatgttctttctaggaaagttgattctaagtcaagcgctttggtttcttcttcttcttattctttggatgttgatgctttttcatctaagccttcttttcttgctgtttttaatgtcacatccgatgatcaactcgaacaaatcgaggaggaggatttggcttttgttgctaatagaattctcgagctacgaataatgccaggaacaggaaaagaggtggtccaaatcgttgctttgaatgtggttcaattgatcatcttcatttgcattgtcct

SEQ ID NO: 71964 - DNA, 14971 bp, Oryza sativa
acatagtacttggccagtgcttctcaccatgtataatcttcctacctggctttgtcaaaagcgaaaatacgtactactctgtatcctcatacagggaccccgtcagcctggtattgatattaacgtatttcttgaaccattgttggaagatatggctgatttatggaaagagggattgaaagtgtgagatgagtacttaagggaatacttcacagtgaaggccatcatcttcgtgaccattaacgattatccagtaatgttttcagtttcaggtcaaattaaaggtaaaacaggatgtgtaatctacttgaatggaacgtactataggtatctcccgggttccaacaagcttgtgtacatgcggcaccggcggttcctacgcacaaatcacaagtaccacaagatgaaggcggagttcgatggcactgaagagactaatcctgcaccaaaacctacatcgggagaaaaggtgtgtgcaatgacagaaaattgtttgcgagtttggaaaaatgactaagaaaccatcaaagggaacaaagcgcaagaaacccgaaaagaatatgaaacaaggggatagtaagaagcaagatgatagttcgaagccagatgataaactccctcccccattcaagaagcattccatattttttaagtacctcccatactggaaagatctggaagttcggcatgccatagacgtcatgcatctagagaagaatgtgtttgacaacataattagaacattgttggacatgccaaagaagactaaagatggtctgcaatcaaggatggacctagtcgagatgggaatcagggaagagttacaccctcaaggagagaagaatgacaaagtatatcttccaccagcctgtttcacactgacacctgaggagaagaagtcattttgcaactcactccgtgatgtcagagtcagtcgactagtttccatgaaagatttgtcggtatctggttataattcacacgactgtcatgtcttgctcactgtgtttcttgaaattgcaataagggccataaaaccggagcatttaaaggttactatcacaaggttgtgctactttttcaacgcagtgttgcagaaggtcattagtctcgaagagttaggaaatctccgtacattcgcacatgagacacagtgccaacttgagatgtgtttccctccgtcattttttgatatgatggagcacctcattgttcacatagtgccgcagatggttgcgcttggcccattgtacctccatcaaatgtggtcatacgagcgttacatggcggttttgaagggttacgtccgaaatcgtgcacatccagagggatcaatggttgagggttatagtactgaagaggttgtcgagtgctgtattgattaccttaaagatggatatgcaattggagtacctgtgccccgacatgagggcagattgagtggcaggggaacgataggaaagaagagattcgtcacccatggtcacaaatcattccaagaagctcacttcagcgtgcttcatcagtttgctatcgttgagccgtacatcgatcaacatatcgaacaaatacgagctaacaataagggtcgcaccaccgagtggataatgaaagaacacaagcgtctcttcatagattggttgcgagacctagatttacctgagggacaaactaccgatgaaataactatgaagcggttggcttgtggtccatcaactacagtaaattcttggtagggatatgacattaatggatactcgtttagtacaagagcccgagataataagacctgtacacaaaacagcggtgtccgtgtggaggcaattgatgaagccggggaaaaacaatcatacttcgggtttattgaagaaatatggtaaatcgactatgggcatacaatgcaattccccatatttaagtgccagtgggtaaaatacccgaacggggtcaatgttaataagttcggtcttactgttgttgacctggcgagtgtgggtcacaaggatgacccttgggtactcgccaatcgcgtggcacaagtgttttatgtgaaagacccatcaaatttgaagaaagatatagtgctacccgggaaacaaaagatattgggagtggatggggttgaagatgtcgtagattacaatcaataagatagtatgccactttatagtcagtttgtacagaagattaagaatgtcgagacatctactcagaagaccgtgaagccttacatgcgcatggacggtgtggggaaaaatgttaaagggtaatgattgttgagtcgcatgtaagcatctaagaagttagtagttatgtaatggtggtatgttaggtgatgtgtgatcatatcgcaaattgacgaacaattgtactcaacattttgcatattagtttgtactaatttttatacaattgcactcaacattttgcatattagtttgtactaatttttatgtgcaattaccatttgtagggtaacatttacagttttttattttttaaaagtttttttaaaagaggtttaaaattttagtagcattttgttatgttcacttaccattatttgaaaacttattttaaaaagatttcaatcaatggtaagtgcacatataaaattgctactatatgttttttaaagtagtaatattaatgtttgaaacatttaagtaatatttacatttgaaaagtagtaatactaaggtttatctacttgtatgtacaattaccttttttattacaactactgtagacatgttcaaatcacaaaaataattttaaaataattctgaaataaatagagtcatccttgtaaaaatcttcgcaggcggaccgtccgcctgcgaagatcctttccctatataagggcaagcccgcggcgccaaaatttctaagtccaggcgggaaccctagaaattttggcgccgtcaggctgccaaattttttcacctccgccgtccttcgccgccacccgcctgcgaccttcaccatccgaccgtcgtcctccgacgccgccgaccgtcgtcctctgcgcgccgcctgccttcgagctcgcgccggctgcacgctacaccgcgccaccggccgtcgatccagctccaccgccgcccgctcccgtagccggccgcatcgccaccgcctaccgctccaccgccgagctccaccgaccgccgctccaccgctccaccaccgccactgccgtccaccgcgcgcgcgcgagctagcgctccaccgccggcaccgtccatcgccgccggccacttccccccccccccccccccggcccctccaccgtgctgccgaccactccaccaccgccggccgctccacagccgccgccgccatctctctctttctctctctcgcagtcgtccacgagcggcttcatcggcctttcgtcgtccacgagcgaagacgtcctcggccgaacggcttcatcggccggtcatcgtccacggccgaacctcgtcgtcgacccttccttcgtcgtccacgaccgaagctcgtcgtcggccgttcgtcgtccacggacgtgtgtgaatgtgggtgtttctttttatatgtgtgtgcatgtgggtgtgagggggtatatatgtgtgtgcatgtgggtgtgaatgggaatgaggggtgggtgatatgtgaatgattgtgaatgtgaatttgggaatgtgggtgatatgtgaatgaaattgggagggtatgttaaattttgcaagatatgtgtatttgtcaaatttttttaataacatgtgggagggtatattaacatttttttaaaaaaaatatggaggatatgtttgcctttttatttttttttaaacaacatgtcaaggaaatgtaattgttaattagtgcactacttgataataacatatcaaattttgtacaaatttgtttgtactaattaatttagcataatagtaagtactaattaataatatttcgcaatttaaatttgtttgtactaattaatttagcataatattaagtactgattaatagcataagtactaattaataacatatctattctagcataatagtaagtagtaattaatttcgcaatttaaatttgtttgtcctaattaatttagcataatagtaagtactaattaataacattttgcaatttaaatttgtttgtactaattaatttagcataacagtaagtactaattaataacatatctattttcgctacgtgttaatatgggaatctcagagaatttaaatttgttcatatgacattttgttaatatacagtttatttttgtacaaatttgtttgtactaatttgagtaatttaaaatgtggaggataacttttttttatgttagaggtttgaaacgatggccgatagtactaaagggactaaagagaaaggtttaggggagcaagagcagtcccttgctgctgtggttgctccggaaccaacggtcccaccggaagatagttccgatagcgacgtagctgacgaagacgatgagtactcgtcgccaagcgatccttgtccaagcccaagcccgaagagaaggaaaaagggcgacggtgaagaaggcgacaaggattacattccccctaaagaaggggtaagtaaacttaatatgtaaactgttcaccgtgactttcatgtataccttctcgtaggaaacggcgccacggcgatcaaaacggcagccgaagaaaaaagttccgtcgaaagacgacgaggtaccagctaacacaaccggctcaaagaaagcgaacggtcagcaaaggcgaagaaaaggaagggtgagagaagcgtgaatagaaaggatgaagggttccatattgttactcatgtttcgccaaaaggagagccgctcgcccctaagacggcatgtgcgaaattcagttcacagtgtggcataatagtaagggaaaagatccccatcacggtcaaggactgggatcatgtatcgaatggggataaggaagtcctatgaaaagagttgaagaaaatcttccagttcccggatggattagaggcagcagtgaagaattgtgcactgcaaacaatggccaagtcttggcgtggttggaaaaccaccttgaacaagaaatttgtgaagacgggacgcacactgtttttgacgtatgccaacataaccccgaatcaatgggacaactttctgatgttgaagaactccccagaagaaattcaaaggagccaaaagtatgcaaagttggccaagaagaacaaatttcctcatcgcttaggctccgcgggatacgcaccaaaggtggagcagtggacaaaagaggaggaaatgaggaagaaggggcaaccagtactaatggaggaatggacacagagatcaaagaactgggtaagagctagaactccgaagatcacggatgaaggcaaagtatcgtttgaagatccggagctgcagagcgttgccgataaaatagagaatttatccagttcacagaagaaaggatttttcaagcctaagagggagaaagatgtgctaagtacggcgctgggtactcctgagcatgggggaagggttcgaggtgtgtcaagctagatgagttggaaggaagggttcaaacatgacccccacaagaagcgtgaagcgtataaggataaacttagagagaaggggctgcggagtttgaaaggcaaatgatggatttctgcgtcaagcacatgcttttgcctcgccccgaaaccaaagaacctgagccagattaccccttcgatgacctcaaagagaatacaccctgcagattgcacgttcccattggacgctccgggaaaactcttgaggctgctacggccattgctatccctaggagaacatataatgaagagttcatacccaatgcgtatgccaaggtgcagccgcaagtggtccacgaagggtttgagtcctacgacattgacttcccgactgcagatggtgtatccatacttggggatgcggtcgatcttgtaattctctagcacaagaatgacatatccttttggattgggcaccgacgccacgcgaaaacctgtggtgccaaaaccggggttgggaaaacctccgagacctcctaagaggaaggtgactgataaggcggaggaacccgagatgtaaaaggaaaatccagtgccggaagtgccaccagagattgcagtgctggaggcagccatggagattccagtgccggatgtgcccatggagattacagtggcagaaccagaggtgcaatttgtggcatcagtcgggtcagaaatagaagaagtaccacgattcgaatgggacggtacagagccagaaatatttgaagacccttctcctacgaaagaccccgaggtgcaagagaccacggtccctgagaaggccactaccagttcagaggtgcctagagcggttaggagccacaactccaagtccaaagataagaacaaggagaagttcatggtaactgtcttcagaggggtaaggaacgtgccaagctcagagatgatgacccccagaaggccgctgaactagccgggccaacatacttggcaaccaatgattgcccggaaaagtacgaacatgggaaagcactcttgccggaatgggcactgaacgaaggaccatgggagatgaaaaggttacataccttctacatggaggccagcaagaaaggcttgggcaatataacagctcgatcgctggcagattgtttcggtgaagaaggttacgtatggctagatttctcatatctccacaccatatatcgtcgggataagatggacgtcaactacgtcggtgtttggtgcatgtgagtatgagttttaattaattatatgaaaaatatgtacaatacaaatccatgtgattgttactaacaaacttcttctgcaggatgcaatacatggatgctaagaagaaaaaagaacctatcggcttcttgaatccaactcggatctgccaaacacaacataccgtgaggctagcaccagggtatgaccaactgaagggcatgaatccaaaagagatagctgaatataagaagggcttgcacaaggagaaattgattactgtcacacagtacattggacgagccttcttgcactttcaaaataagagagtcgtcatggccgcttataattttaagtaagtccggtacatttatcttctgcacatatgtcttattttagctggtactaactaactatgttgttgttaatatgtagcgatcattatatctgtttactcatccaccctaaagacggaaccgtggtagtcttggaccctctcaattacaaacaccaatcatacaaagaatttctaacaatcttacagtagtaagtgattatgactcttgcatttttatatgaatgtattataaataaatatcctccttaatatgaaacggtacaacatccatatagtgcgtaccagtactacaagttcaagggtggagaacaaacccgaacaagggagaagctgctagtacgtacctattgaccggtaatattccactcacttaatgtaactgccatggaagcaccactgaagactggcttctccgaccttccacccgctaccaattgtttcactaattgcaaattttaactattcttttatgatatgtcctgaagtgtcacaagcaaccgcgaggaacggtcctttgcgggtattacgcttgcgaattccttagagttaatggaaggtacaggattaacgcggaggatgtaagtctctatactatgtgctagacagcttcacatatttatgatactaatatattgtttatcttcaatgcatgcagttgccaagattagaatgtcgaacaagttttgacgatacaggcatcaaaaatgtctaacgtgatatgtgccacttcatccaccatgagtgctgtcatgtgaaaggagatttcttcgaccaagagagtgccctagccacaagtgatgaattcaaggatcttcgggagtggaacaatgctatgccataatgtattaaatagatggcgtatttgaagtgacaatgtaaaaaaatattgtaatatatatattttggcaacacttttgagtaatgtaatatatgtacatttatcagtaccaaatgcttgataatcttccaatatatgtacataataatctacctccaagaatttttattcaataatttaaaagtaatttacgggcaaattattattaaatttcaatattttctacctatcttcgcaggcggaagtttttttttgtaggcggccgattcttcttttcgcaagcggaccggactagccaacgtccgcctgcgaaaattatcttcgcaggcggacggccgccccgcctgcgaagatcggcgatcttcacagtcgttggcttacaggcggacggctgccccgcctgcaaagacccttttcggccggttgcgataatgcttttcctagtagtgggcagcgactgatctgattcctccacttcgctttccaccatatcgtccgccatgtcgagcttctgctccgtccttgcagcagcagcgaggaagccgctgcgccggagctccctccagcggtgattcatgactcgcgaggtccggccgtagacagcgtggccaatcttcttccagcagtcgcccaggcggtagtggaggcgtaggagctcgtcgtcgtcacgggcagtgaaggggcggtggtagacgtcgcgggcgaggtggtggcaccacctgtcacggcacaaccttgcagagcggcgtggcatgatcctggcgaccctactccagtggcggaagccgttctccttgacgaggcgaggcaaccaaggatgacgtaccaaagtaccggtaaaaacatcttcaatttttataatagtaaagaattggtattttcttttttttcaaacttattttttgaatttatttgaaattcatcaaagtgagcagtacgcattcgagaggggatgcgctttgggtgccattattgtcgaaaggttatacatgaaaatggaatataggaaatgttgacactatggtatacgcaagattggaatagggagatagtttaggtctttagtagtataggtaagattggaataaggagatttaggagtataggatatattggtactagggtatacatgagatgagaatagggacatgggatagagagattcttatataagttctgacccctgagatcaacggaatagtcctattcctgtttatatgtatagctccaggatgtatcagagatagaatacaaaatgggagtaagctagctaatctagcccatttgtcatttaattcagaaaaaattgctacacaactcaattttgcattaatcatactttcctcttgctgttatatcgcacctcgcacgagacatgcatattacattgcgtttaaggtaataggttacacaaaaatagtcatatactcatattaatgccttattgccataccattatatgaatattattgtaaaacaacataatcgtcatgaccagatgattggaattaatattgtttgtacatcagtacatgaccaactaaaaggttgtacagctaaaacaaggaaaatcattacagagtacaaaataggccagtagctagatttcatcaaactgccatgcacgcgaaccctagcgcgaggctgccggccaggggatccatcacgtggtcagtggcaaggctgcaagaaccgaagctcgaggcaagagtgtccgcaagggtactgcgctgcaactctagcgacggcagcgactgatcagctggctcctccacttcgctagtttccaccatgtcgtccgccatgtcgagcgccgccagctccttccttgcggcagcagcgaggaagccgccgcgccggagctccctccagcggtgcttcatgacgcgcgatgtgcggccgtaaacggcccggccaatctccttccagcggtcgccgaggcggtagtggaggcgcaggagctcgtcgtcgtcgcgggcggtgaaggggcggtggtagacgtcgcgcgggcgaggtggtggcgccacctgtcgcggcacgacctagcggagcggcgtggcatgctcctggcgacccggctccagcggcggaagccgttctccttggcgaggcgctgcagccgcgcgtcctcctccggcgtccatgccggcggcagcttgaggcggacgatgcacctcgcgcgaggcggcggcggcagcggtggcgtcgccatgatcacctcctgatccatcgcgacctctcaatctgctcgagctgagagctacggcgacgacaagtgaggattcagatgaagaatcgcgattcaccggtcgatgatgaaagacagggcaacgccgttgcactgtatacatacctatatagcgctaattccttcattcgtgtcggattacgaatcggagtcggagtgattaattaattagcttagcatgcacgcgtggattaatcgctagcttcggactccgtatatttactaatagtctaatagtgtttccaatcgaaggaaagtattcaagtgcaacgtaacggtgtttactatcccgtctgacatttgaaacaaaatcatgagaaaatctatgaaataccatcgacaagcactttaatcccataaatgccatcgacatacgcaacttcctgaaaatgccgtcatacaagcctatttcttttgaaaatgccatcacaccgttagtccacactgttagaacgaaaaaaatttacaaaaataaccaaattgccctaactccaaattatactaacccaatccagctcccgataggcgacaattgcgaggcagcgctcacaggcggcggcaacgtgggccccccaggcggcggcgcggggctcccaagcggcagcgcgtcggcagcaagcgttcgtgcggcggtcccaggtggtgagacggccgctcccaggcggcggcgagatggccgccaagcgaacgcgtggcggtcccaggcgacggcgtggggctcccaaacgacggcgacgaggcggcgctcccagatggcggcacggggctcccaggtggcgtcgcggggtccccaggcagcgacgcgtcggccgcaagcgcggcggtcctaagcggcggcacagcggtcccaggcgacggcagcgaggtggcgctcccaggcgacggcgcagggcccttgggcggcagcgcgtcgttcgcaggcgcggctgtcccaggcggcggcacgggcccctaggtggtggcgcggcggtcctaggcagtggcgtggcggcagcaagcgttcgtgcggcggtcccaggcggctgctcccaagcggaggtgcagggctcccaggccacgacgcgttagtagcaggcgtttgtacggcggtcccaggcgtcaatgtgacgggcggcaaggaggtggcaggtggcggcacaaggagtgactcaagggcctcatgcatcggcacggtggtcgcagggccgacgagttttgacttgattattagtctgcacgttcaatgcctaaaatatgtaagagaaaatccatgaaatgccattttagataaactatttcagtgagtggtgattatgaaacacatacatttttaaaagggcatgtagcctagtggttgcagtgacctgagtagcaccccaaggtcctaagtttaaatctccataggatcgaatttcagattggattatttgagggctaaattccctatttgataagctatgtttctaaaattaaaaaggctgcatatatccagttggatgtagaggccggttaaagaaatacccttctaaaaaaaagaaacacatacattttccttgatgaagttcaagcaaccgtcattcggcacaaaggcagcaatcttcttcccattcttcaccagctgaacacgagcacacttacagatggcagagtttggctgcttggcctcaataccactataatgaaacagatggaaactagttcaagttaagaaagcatgagtaataaaattgagcatgagtgttgtccaggcgtacatcttctccaaaacaatgcccttggcatgagatgatccagcaaagggtttcttccactcattgccaaagtggctcttcttgtatgccttgtcggcccatctttggttcctgcggtgggtcttgagcttgcgcccagctcccataccacatgttttcttgcaatgaaatttcaggaccaacttaagacaaatgctacgtcttacgattttgccaaacatctcccgcgtgatttttttcctggcatttgacgtttttttggccacatgatctttgcacaaggcatagaagcccacgaacagcccagcagcccatcatcatgcctaaccctgattgctaactctaaccccggtccactcactgccccacacgaccacgcccgcactcgttccccgttcacatcacatcgcacacacgccacgccgcttggatctgggtccgtggccagcacccgcaccgccgtagcgcgcgccaacgacggtgctgacgtggccgtcttccagcagttggtgcgcccgccctcatctgtcccccttctcgtcgatagatccagccgcctctttgccttccccacacgcatggatccatcagtgacggcgacgggaggggctgatccagcgcccgcttggtgatcaggagctctccgtcactctcccacttctctcttgtttcctctactctctctctctctcccactccgatctggcaccccctccttccccgcaggccgcacatatcccaccgcctatctacctcacacgcgcgtggcctgatccgctccctctcccactgacaatgcgggcctagtctggcagtcgcggaaacggacactacggttgctgtctttttaagatgctatagataacaagaatataaggtcattcacaatgcatctacatggcatttggcctcaactctccaactagactgattgtatacgtggagaagaaaaggaggtggggcccatgtcttcactagcttcgcgtgtccgagagcctcgtcagaagaaaacagctttttcaatcgcatctcagcatctgcacgtgagaaagcatgacacaaagagagaagggggagaagctcaccgaaaaaaaggtaattacaaagagagaagggggagaagctcgccgaaaaaagtaattttagtgatggggctcgcataggaaaatgtttggtggggtccacctgaatccatgccgcattgtggagaggaggagcttcgctgttttctgtacgtggctgtttaggctcctcggaaaaacaggacgcattgctaatgccccaacactcattctaaagctaagagcacataacgtggcaaatggaacattccctgcaaaatgcccacaaatcaagagaagtgaaatttaatggtacagtgtactacaagcaacacaatctaatcggtctcctggacctgatggccttaatgttggtttttatagagtttcttggccttggattaaatctgacatcactcaaacggttcaagacttttatgtttcaggccaatttccaaaaggtatgaatgatactaatattactcttattcctaaaaaaaattatcctacttctcctgctgattttaggccaatcagtctttgcaatgtttcttataaaatcatttctaaatctttggccgatcatatcaaaagtgttcttcctgatttaatttcagattctcaacaagcttttataaaaggtcgtcgcattgcaaataatcttattattgcccaagaaatagttcactctttcaatttaaaatcttttaagtaaaatgcttttctgctgaaacttgatcttgcaaaagcctttgatcgtctagaatggaactttattgaaaaggctcttcgtcgtaaagggtttcatggtcattttataaatcttgtccttgcttgcattaattcggcaaacttctctgtcaatggaacggccagtcatatggtcacttttcagctgaaagaggaatacgacaaggttgtcctttatctccttatttatttattcttgcattaaatgaactatttgaaatgatatctaatgcaattcaaacaggtcaagtcaaaggagcttctttaactccaaatggtaccattattccggccctgtatagatgggactaaaacttttaagtccctatcacatcggatgtttgaaaattaattataaatattaaacgtagactattaataaaacccatccataatcttgaactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctcactcttcaatgtatgctgacgatcttatgattgtaggtcaagccactcctgaagaagctagaagcatcttccaaattattcaatttttttgccatcaatcaggtcaaactccaggttggaataaatcttctattctgttcagctctcatactcctatcctatcagtgtcactcaagatattttatccattttccctgtctccttaatgaacaacaattccaaacatcttggtcatcctctcattctaaatactaaagccagaaactctgcctacaactttatcattgaaaaattcaaaaccaggctgtcaattattaaagcaaaaactttatcccatgctggtagactttctttaataaaatctgtgtttgcttccatccctattttctatatgtctaccattttacactccaaaaaacttctatataaattaactgccattatcaggaaattctggtggacaggtaccaatgatgaagacagtaaaaaaggtatttgttggaaatcttggtctgacatttgtaaaccttttgatcaaggaggtttgggaatcagatatttactaactgttaaaaaaagtcttgttattcaatgtgc

SEQ ID NO: 71965 - DNA, 5289 bp, Oryza sativa
  unsure (1)..(5289): unsure at all n locations
cattcctaaatctactttttggagttctattctgaaaattagacatcttttggataattctatcatatggcaacttttttaaggtgatatctcaatctggaatcaaccttggtgttctgtttggaaatcccttcctaatcatattactgattctgcaatgactctttatttacctacaaaagtttctcatctctggaatgataggaaagaataggatatttccaaagtgtctcaaatctttgatccccaagtttcaaatgaaattttaaaaactccaattgtgcattctaatactgatgacaaactttactggattcataactcaaaaggtatttgtacttctcaaagtgcttataaagtcttatcaaccaactctatgttacctgctgctaatatttcaaatttgcaattaaaccttttaaagaaaacttggaaatgcaaatttattcctccaaaagttaaaacctttatttggagacttctcagaaatgctcttgcaactgcaaaaaatttgaacttcagaattcctactatttcaaactcctgctctcgttgtagtttgtctgaatcttgtgctcatctgttttttcaatgtgcttttgcaaatctggtttggaaactgtctgaatttcatttagatacaatcatcattgcatccatgcaaaacatcagtgatatcttagcctatgttctagctacaaacaactctgaattaagcctttaaaaagcttctattcttctttggatgatttggaaagctagaaatgacttctactttaaaaagaaaaactgggaacccattcaggttaattttgcagctcaaatcatgtcttcaaactttatttcttgtcttgatactattgatgaagatcatgaatctcaaaatcatgatgttaacagctggacttctctcaattctgcttcagtaattcgctgttatactgatgcctcctggcaggatggtaatactggtattggaatcttcatccataactctgatactcataaagccctatttattcaagctgcttctaatttcttctcctctcctttacaagctgagcatgcagcaatcatgacagccattttgatttgtcaaaagttaaatattattgatgttactcttcttttagacaatcaggaattagttagccttttgcaggttcaagactattattctcacgaacattattggagcttaaaccctttactttaagatcttatttcccttgcaggaacacaggctcttaacatcaaatggatttcaagacaagttaataagatggctgactttctagcaaaaaaagcaaggaataaatctagacaaaatctgaatcaaatagtttgtcaaaatatttcccacttatgttcccattctgactgtccgactaagacagctttggaatcttctccttttatggagaatgtatctttggttgatgtattatgcttctaagttcaataaagctctaaattctcaaaaaaaaaaagctactgcaaaatgaaatatttgtagaaaatttttttttaccatcatctgtagccatctgcggcagaacaatcccacatgaccatcatcagtgttaaccacacgaccatcttcagtgttaattaagacacaatcccatttcaaataatttggagcaagaaaactggcagaaactaagatcaagttcttgacaggctcctaacaccaaaaatattgtatgctaccatgcataggttctcagattcaagcatttaaaccaagggacgggtgattacacagcagcaaagaattaatatcgcttatgaaaatgtttatcactgacggtgtcaaatctgaccagcactggaccatcaataagctcacattacctacatctaccgcaatctcactctctaccaatccaagaacacacaacaaacgaatcaaccaaacatggcccatagctacacttcttattacaaactaaggcaaagagatagagaaaatgcttctagtgaagacacatgttaacacgagcgaacgcaacggatcgttgcagaaaccactacaatggacgaaagagaagggatcttttgcacacaccccatggcggcggagggagaggccgagagatctccgaacggcgatgcgagaggagggcttcaatgacggcggcggctgaaagtggagtgaggaaggaagacgagggagattctatagtagcaaatctcagcgatttagggttagcgtggtgcgcgctgagattcgtgttggggtgatgggtataatcccacagtcctcgtgaggtttggtgagagactacgaggcggctaggccagttcccggcccaccatgtcattcattgtgtgaacaggtccaaggcctcctattttaaaaaaaaaaaatttcgggccaatttgccagtagatttttagtttgttttctcaccttggacgtatataatcattccgatgagcattaaattttttttaggggccctatgaaaggatttgatccgtagaaaatttcagaggaaatatgacatgaagttctaaactattgtaactntggaaaaaatccaactacccctctaaactttgattggaagttcattaagcaccgtgtactttgaaatcggatatctcttactatcgaatttcatgcccgttctcgagcgattagccccgccacgtggcttcactcgattccagggttcgagtcgtgcgcgcatccgttggattagaaatcaacgggagagatccacaaaaggatctatttataaattttaatcttccaagggagtttatctcaaaatgtggcatccatcatccagattccagagaaatcctttcctcccctcgtctcgccgctttctcctccgccgaatcgccgattcacaagccgtcaccggcgttggtcaccgccactccacatcagtgcgcctccctcgccaatccccatcccctaaaatccctagcccacagctccaccatcgtcacttcacctctccgcgcctccgcatctcgcgagctgagcgttgtcgcctcctcctcgtctcctcgctcccttgccgcccgtccgcttccctggcgcagctctcaagtgggagggctgcgcgccggctggaagtctcttgactcttcccgttctatcgatccctgcggtgggagagcaccggcaaacagtggtcgtacacctcgccgatcgacttggctcgctgcggcggacgaccactatgacgtcgtccagcagctactgcatatcgactaacctcactccgtcggatcccccgcctggaggctctctgggacgacaatgccggattcgccggcgtgacgcggtaccgggcggacggggaaggctcgaacggccggttgcggtgaacgctccttggtgtttaggctggagatgataatcagggcagtccacaccgccgcaagaggcggcagcacggagatgctgagggggctcacccgacaccactgcaggttgaagtttaccacctccgtagaaagttgtcaagtgcattcctagcttacgtcaagatagagctggtgtcccctgcagggagatgctgttcaagatttatgagcaatacaatttccgcgatgatcgtccaggagtattgtccagcaacggatagtagaaacatgaaagaccaaccttttcccaccgcttatggggaatccttaaatagctatagttgcagctcatttttttgagagccacacaatgggatgctccgtttgctgttggattgaaggaatgatctaacaaattgtattattgatggtttgaaaagtgaggatattatgtttagagatgatcattacagaaactgtacaatgctcgtatatctgttcgcttgttttatatttttagatgattaaagtctctttgcggactatttttctaataataagaacattcatatattcatacattgggtctaattggactggctcatctacactttacatggcgaaaataatggcccatcaccaaatatgcgcgtcgaagccgctcttgctttctagttcaactccctgaattttctaataccatttatataagctcataacatggttttgcataattatttttatctaatttgtactttctctgtttcataatgtaagtcattctagtattttctacattcatattgatgttaatgaatctagacacgttaatatgaatgtagaaaatgctaaaatgacttatattgtgaaacggaggaagtatataatttagttgagttttatatctgttatattagctattcgaggcagctcgttttagcttttaaatacgcaagaccaacaacattcaaatcaagcttaggggataaaatgaacggtattataaagtgtaggtggggcatgatttttatttttgttttctcacctcggacatatataatcaattaaccattccaaatttccaattaaaattgtttttttggcctatgaaaggatttgctccgtagaaaatttcagaagaaatatgacatgatgttcaaaatcatgcaattttttcttacgcgctctttctaaactattgtaccttttcgtgtcttactaccatgtgaaagcgatcaagttacacaaatgcgtttagcaaaaagcaccgaaattcatatcagttagcagagtccaagtagtgcattgtacatcgacataattgaatgagtaaacataagagcactggaattactaataattcatgttttctgttggtaccaaatgtccttccacaagggaaaactcttacatggtgtcgtacagcaattctacagacacaagaccatagcccataggcagctttattatgttgtagaacaaaagaataagaaacatttgaagtacacagcctgctcggttgaattgatatcacaatttagaaacagtgacattttggggctaggagctgatttatatacctccagcccacggccaaccactttggtgaaccatataaatttcttcttgcaatttcaccttgtgacatgtactgttgcgcatacatcgtaatgaaaatatcatgcccaggactaggcagcaggcaccaagtcatacctccaattctgtgaatgctagatctcactgaagtgtcagtataccaacaaaatttgacttttgattagagaagaaatcaaatagtccggagctattatttacacaaggtttgttatgggatggtattctcatgctagtcatgtcattctgaaatgtaaggctacacctttggaagatgaagatcggctagtgacgaagtgagatcttctctcgattaggatctccgactttggagtgttgttt

SEQ ID NO: 71966 - DNA, 11986 bp, Oryza sativa
atctcgcgagctgagcgttgtcgcctcctcctcgtctcctcgctcccttgccgcccgtccgcttccctggcgcagctctcaagtggaagggctgcgcgccggctggaagtctcttgactcttcccgttctatcgatccctgcggtgggagagcaccggcaaacagtggtcgtacacctcgccgatcgacttggctcgctgcggcggacgaccactatgacgtcgtccagcagctactgcatatcgactaacctcactccgtcggatcccccgcctggaggctctctgggacgacaatgccggattcgccggcgtgacgcggtaccgggcggacggggaaggctcgaacggccggttgcggtgaacgctccttggtgtttaggctggagatgataatcagggcagtccacaccgccgcaagactatggaattggggtttaggtgatgcaagctaattccgtaaaactccacaatccccctaaagaactttgaggttgggagaggaaaaccaccatataagaagtgagaaaataccacgacctcgtgtgtgtcaggggtcagaaatgcttcgccgcatgccggacgccacccgatgatctcctttgccggaagaacgccatgtgctaccatctccttcaagttctcatccgttacatcggagggagcccattgactttcgaagctttctctctcctcggccatgggagcgagatggatgattagatttggagcgagggcggcagcgaatgaagaggatattggtgcgatggatgtacggaagatctatgcaagagaacggagcttcgagaggggtggaatggtgcggatttgcgaaccctagtttccgccggcgcagtatttgcattgtagcgggaagtggggaaaatggagaggatcgcggcggggaagacgaaacggcgctctattttagcgtttatttcactaaggtatcgggagatgcttatgggcctgggcctaaacaatactttcagcccaattttattatcagcgtggctggttgtgatccttagggacttaggtatatatttttgctttggcaaaagttgctcacgacagaatagcccaatgctgctaaaatcctttttgacgtagttagataattctttggaattactacaatgcaaataaaagggtgcccaacagaaaagtgttatactaattttgttggcctttttaggctacaaagctgttcgggccttattgagatgactaattttaaatggtcattctctcagcatgttatatgcttaccttaataatggcgtgggtcatagcttaggctatttagactcatcatttatcatgctttataccacatttgatgagtctttttgagagtttttactcggatttttatcatgtatgttggtttatagacctttagagtgtttctcactcgggccttttctatacctcatttttggcgcattaaagctaaagcagtcggctggatgttttatcagatgccacacatgcttagccatataatcccttgggtgattcggttgtaaaaccactcggatggatgttttgatgcactttgactatatgtttaggttttatttaactaatcacatagtcgggggctacacctaattagatgcatctactcagaagactaagacagaggaagttgaagcactcggattatcatttgaattacgagagaagactatttcatcgactgtaaaggtgtcaggggctactgtggagattatggataccccatacccatacgacatgtatatccgattaggtatggggtgccatgtatagatagaatatcttcaaagggaatcgggttaaattccaaacttctatgtcaaggaaatacccgggatcctagtcggttacgattgtatcttatctgtaactacctattccgttagggatatgggttgtactttgtaatacggacccctttccctatataaggaggtgtccgggtgtcttttggggcacgatttttctctcagatcatacaatcaataaaacactcggcggatcaatcctcgaacagaagtagggtattacttcttattaagaaggcctgaacctgtataaaatttcttgtctctaaacccatccacttttccagcttgatagccacccctttttagtattgccaaaatcttgtttcgacaagaagggtggtgacatttttttcatttctttttctttcttttaccgtgaattgggagaatgggaggggtatattttggactgagggcaatctggtcattttttgaaaaaaaatggttgtagcggtgtggaatcaacggtaagttgacggtgatggcatttttgggagaaaaaggcttgtacgatggtattttcagaaagttgctcttgtcgatggtatttctgggattagtgtactcgccgatggtatttcaaggattttctgatatcttggatactctaggatgaggtgctgattgttggattcggttggaaagggcatgccttgggagatattccaggtgtcaggttgaaggttgtgaaggtgtctgcagtgtcactgctcgcactcttcaaggagaagaagaagcagaggtcttagattacttttgataggcaaaaggttggactagactgtcaaggctctgaatgttttgagtaggaaagatcctagctatgttgggaatccccgtggtaactcaagctttataatcgagaattgttccttctcagctgttgctttggttaacagtactattaagagttttgttcccttaatctggatatatattaatattgcgctcgctcctcccttgtgtttgctagttttctccgtctttatatgttgattatatcattgattgtggttttttaggcaattgcacatttgactctattttaaagcgtaactaccaatttaaccctactttttaagtttactcatttgaccctattttctaaaagggaacatcagatgtgaccctatttcgtgaagccaagcaaacggtgttaataaaaggaaaaagagacgtttatacccttctcatttgacctagtttctatctacccagacttcacacgccggcgagctcccatgccgcacagggcaccgctcccttcctccgcgcgcatgctgtcactgcccgccatccacgcgctggcctccgcctccctccgcccacgcccctctgccgtcagtcgttctcgccacacagggcgtctctcccttcctccgcacgcacgccgtcaccactagccgtccacgtgccggcgtccgcctccctccgtgcttgtgccgctccctccctccgcgcgcgcgctatcaccgcctgccctccacatgctgggctccatctcccttcatgcgtacgccgccgccacccgacctccagcctctgcatgccggcgagctccggtgctgcacgccatagttgccaagatttgggttgggactggataaggatgggggcttggggatatggttgagtgtaataagggtattttggttatttggggtggtaaaaatatttttttctctgttttctatatgaaaccctaacggtagagttaaaacagggtcaaacggaaaatacgatttgagaaaacagggtcaactaagcaaacttgaaaatatatggttagtttggtagttattatgcttaaaaagagcgtcaaatgagcaattatcccttttttatgctcgattatcattgtgataaagttatttttgctcatgtccaatttacattagttaactatctttgatgccagtttacacttagagacatgttagattgtggagttcttcctggatttttgtcaacacatacattcgagaaaaaaaatcaaatgtttcatccatcttaatccagtaggtaagggatagaacatgatggaacgatcaaagaacacaaaaagaaaaaagtaaaaggaaaaaagaacctactaattacaatgctttgtttgtgactaaatataccgtaaacaaatcaggaaaactgcatatcttctatcacttgacaaccacataccaaaagaacaaaaatgctcaagaagtagcaaaggaacattttcttcaatagagcagaataagaattgtgtccatttttccattttaatttatttgcctggtgtgattttgcataatgtgacaactgagacaagaactcttcaacaaaaaagacatttgaagcataattgccatgacacatacattcattgaaaagcaatcctttttctacaagtcacactgctcgtttaaggcgcggagaaatttctttgattgcttttgattgctcatcccgccacttcgagcaaagtccacaaaaccgtgctcatcaacacacttgtcatataaggattccgtcattatgtctatgacaccctgtcatgtaaaattttttttgctagcatgaagttttaaaaattattaaagacaaatagaattgtaccatagggtttagcacaaccatattactagtatattatagtataagtagttttgattttttttcctgagttaaattttgttaggtttgatcaagttcataaagaatatcaagttcaacccaaaataaaaaagaaaccaaaatatattcaatgttaaatataatgagactaatttggtgctataagtgttgctttatttttatataaagttgatcaagctttcaacaaaaaattaataactttaaaaaagtcaaaacgacatataatttatattacctctatccctaaatttatgacgttggtgagttcatcatattactacagcataacaccttaaaggtgctggttgcaaacctggcatacgtgttggtttcatagccaagaccaattatccggcaccaatgacactaggtcattggtaccggttcctttgtgctctttccgattcaaaaaagaaaaaaaaatgaaaagagaagctagctccaagcatcggctcggctcgatgagtcgattctttcaagctgcccctaatcccatccattacatatcaactacaaaaatcctcatcccatccttcacatatcacatatcaacaacaacaattatcacagattacagatcaacaacaacacaagatcaagaactacacaagcaagatgaacttactctccccggtcccgccatcgttggcaatatgtgtcgccatcggaggagcggtgtggaggtagctgttgccggttgccaaggtctctctccttgccgaggtcgccggcgattgccctctgcatgccaatgccatcgccgccagacctggtggcacaatgggcggcggcgccggatgtagcgattggcagtggcaatggatgtggtgctagaggcgacagagcagtggcgcagagggaagagaggacgttgcagagggaggagaggacaagtgcgagacagaaagagagagagagagagcacaagcggatcggatatgaatggagtggatgcatgatgactttggtgggagttaattggtggctcggttcggctcaatttttttcaactgccggttttcgaagaactggtatctataatatattataggtatttgaaaaaatccgggtgccagtttttatttagaattgacacctataattgtcaaaagtgccggttacatattttttcctcatgtgaaggtgagaaatggtcaataggtgtcagttttaaataaatcggcatatatgagcaggtacctatcagggtttttttaagtagtgtataaaaatggaacacagagggagtagcaatcatctataaataaccatcacacgccaacacaagctgaagcactgtctactccactagctagcaccattactagcttagctagatcacttcaccacttgagcaatggcttccaacaagatcgctccccttcttgccctgaccctcctgatcctgttcttcgggtgtgcagtaactaactgcaccggcaagccagttgccccgacgccgccgtcgcacgacgatcacggccgctgcccgatcgacgccctgaagctgagggtgtgcgccaacctgctcaacgggctgatcggtgtgaagattgggcgcggcccagacgattgctgcccgctgctggccggtatcgccgacctcgacgccgccgtctgcctctgcaccgctctgaaggctaacgtgctcggcctcatcaacctcaacctgcccgtcgacctcagcatcatcctcaacaagtgcggcaagaactacccgtccggtttcacctgctaattatttgagctgcaacaatattcactagagtttatgtgtctcaataagacgagtttagtttcgtgcaatgtctgtctgttgacgctgttgagttgaataagcgtctcgcgtctgtttgcaggcagtactcgatcgatgtatgtccagttctaccgtccttgaccacctggttattctaacttgtaatacccatcttatatatattagatcgtttttatcagtaaatctcacaaaattacatatatttaattaaaggatcgcaaaactactacagacttaattagcttgaaatttctcacaaaactacagatttagaatgaagtgtcacataaataaagattaaatagaaaatttatcacaaaattataatttttgtaccaatttatcacaaaactagaatgttgatagctttaacgcgtgaagatagtggtacgaatttaaaatttagaatatatagtttgtgatcacttcaatattaagtatgtaatttcataatatttagtcttgaatatttattttttaaaaaaaaactaaattaatcactaaacctgtagtttatcataccacgtcttaaatatctagttttacgataatttgattaaaatatatgtagttccgtgaaatttagtctattcatattatcatggctcacacgttgatataatttctttgttttccatgcccgcataggaaagcacgacttatatgtatggctgtatctatatcatggtgagatagaacttatcgataattaccggcaaaaatattatttgtacacaagtttaagatacatttatcacacgtgctaactaataaatgtcacaataatagtaataaaataaaaataattttacttgtaagtgtaagcttctataaaaattcctcttagattcattatgttgataggctattttaatatgattttccatataatattggatttgcagtatattatggtagatacgaatccaagtacaataggtatacctaataagttatactgacacattactccctccggttctattttaattgacgttttgaacaatgacatggtctacaagatatctctttgaccttatttttctactataatatatataataaataaatgcatatttacttttattatagtgctttaaaagacaaatctatatatattgttttagtttctttaaactaaatatttttaaagttattgatggtcaaagttataaaactttgattttaaccttgtctaaaacgtcaattaatatagaaccggagggagtattagatatggctggcctaaaaagagaaaaatctagcaaaattgtacttttaaaactatcatattattttttccctgttgatttctgctgaaacacaatgaaattgaatttgaaaactaatatataggtggcataaaatgcatatatttacgatatctttttatatctattagttagtatatgttactagtacttttatttcgtcaaaaaaaatgccaacttctatatatatgaatccagatatatacaaaagttgttttttttaacggagcccagggagtacgaaatatggatgcataaattgaaatacattcatctggcagccctaatttccacgaacctaggcccatcacgaaaatgagcctaggcgcattaagtggacaacccattcggcatcgttgccctgggtaggtgaagtgtcaagtagctagagtacggcatgtgtaatcattttatggtgaatggccgccgtacgtcgatcgattggcgagaggaggcggcgccggtgcctacctcccgcgcctccgccgcttttcagcacacgatttatcatttgtcaatacatgcacgggacgggatgaatacgtacttgatttgaaattaatagaatagagataacttaacgattcggtgtagtgaattaagataattaattgtagccaatacaacagtatagtaaccccttccgcctttgtatatacagcatttggggctgctgtgaggtggagatagagcgaaatagagggtggtgccacttgcttaatttactctactttagatcgagtttaagatgatgcgggtgcctaaatttgtattgaggggtgcatacatgatgaaaatagttaagggtatagctaaaaaatttcttgaccgggttcctgggcaccccccaaattaatatacactcactactggagaaatgatctttgctgggtcggctgatttccacaatatttccggttctaaaaagaaccggggctaaatattgtttttagtcccggttaaattttttttttttaagtaccggttcatcccctgtcagaggcttgtgtcagggggctgaggatctttaatcctggttgatactactaaccgggactaaagattaccactttagtcctggctggtagtaccaaccgagagtaaagatcatttagatctttatttccagttagtaataccaaccaggactaaaaatctatctttagtcccggttgaagttaccaaccgggagtaaatatttctctcccatctctgatcggttaagtcccagacgggctttcttcctcaccgagatatttagataagattggatcgatctcaccccctctgctcctaacccctcagatccccttcctcctcctcccccctcctcccattcctcctcccttctcctccccctcctcccctcccatccggcgatcggcagcggcgggcaggtggggccgcggtcaggtgtggcgagtggcggcaagcggggtcatgcccggcggcggcgacggggccgcaagcggcggccatggcagccgacagcgtccattctttttttttttgataatttgtgattccctgagatgtataatttctttttttgtacaacttgtgattcattgcatggatcttagatgtatttgatttgtgtgtaatttttttaggatttgtgatgtatttgatttatgtgtataaagtaactttggatttgtgatgtgaatgatttgggatattactttgatttggggatttggggtttgctttgaggatatgcatggcactcgatttgggagaaaataaagggattaactctttcaattagcaaagaaacaatgaaaaaaaaagaaatggggaccgacggggactgcctatgctctctttagtcccggttggtaacaccaaccgggactaaagattgaactttactcccggttatttcaccccggactgaagatgcgcatttttagtcccagattcgtagtcccggttgttggaattaatagatgggccttatcccactcgaagattaattattttgaaaatcacaaaagcccacctcatgggatggcatgcatgggagtttagtatcaccttgcttattctaggagaggaggacctccttaaaagggaggatgccctcctagccacttgaagcatgtgaggtggagagaacagggggaatacacgcgtgctcgctcgcctcgcctggcggggcgggcggcacaacgtacgcgtcgaatggtccacaaaattggttcctcacccttgcgcagatgcggccttcttttgcagttttgttttgctgcgggaaatttagaaaaatccgttgcgtgaaaacggcgtggagttcgaataagttacgcgtgacttatccggttcggttacgcggagtggagatcaagcgacctttctctatataaaccgagccgccgcctccacgcaacacacgtgaaatcaatctagggtttgcctcctactctgtactgcgccgtcgcttgtagactactccattccgctcgccggcatgcagcggcgatcgggatagcatgtctccggaacctctgccttccacgtcctgcaccgggagaaggcggcaataaggtttttgggaagcgcttcgcacgactgctccctattcgttcacgacggctcgtctttctgtttgctcgcgtgatgcacgcctttgtcaacgcccgcaaccgcgagtaattcctgctgtgcaactggtcttccggtacccttggtacgtgctcactatgttacgcatatttgatctgtttatgctatactatctagtttacatatgtagatcttatgatatgttcatgctagtttacatatgcaatgtcatgatttatttatggaataaattaaattattatgtgttaataatttcaacaccggttggaaaatcgggactataggggttcccaactaggagtaaaaacggttttgtagtgactatctccacccctagctgtgaacatcgtcgagacagaatgagccgatattttgttagaacatccttaaagttcttttttttaaaaaaaaacgaccttaattactacccgctcgttatcacattagttttctgccatgaaattcggtgttattgaggaaaaaaaacgaaaagacaacccaataaatactatgatatttatagaaccttattgtctattttttttaaaaacaatattaatgagtttgtaacaccaggttttagcttagttgtcaaaaactattttacaaaataataccctagtgtcaaaatttttctggttctgtgcgtgtatctatgatcttgtgcgacggtctcaaataaatcattctttggaaccctaattatgatgcaaaattctctatccaatttagtttagataatggaacgcaaggcaacaaggatttttatactgatccagcacaccaagatgggtaatagcccaacttttggtgaccggagctagtgtattatatatatcatcctcatgagaataatgaggaggaaaaaaaacctaatctagtatgctagtatatcggtgcagagcttgggcatagtggttggcgactagttgttatcgacttctttgggtgttgactcgacgagatcggaggtgttatatgttgtcttagtttctctcatgggttttgacttgtcctactcctcacttacgtgcctggtatttataccctcagttgcccgtttgtccaagtagaactagggaaaaaagtatgatccgagtagtccaagcagcgcaagtaggcctatgtatttcatttattatctaggaatccttccttatctattccagactttatctaggtttgtttctgtattggacttggtctacagtggtcttgcgaggtaaatactatatatagggtatccaatatccagaacgctgacaatattcgaacaaaacatactatgtacaccatgaattttatgttttgtcatttgaagaaacccttgcatgggtgaagaaatggggagcgtcttcatggaatacatttacatttatgatcagtgaagttggttggggaccaaatcacggccttcctcaagtctactccaacaccaccatgccattattgagccatagaaggcaagagatacatggtttggagtcagattcgggtctcctaacaacattaacttcaaacagacttagctgctgattaagaagaacacttcggtcttcctcctaagctgtttggaattttctaaacaaaccacgtcaaagtcagtttttaggtattggacttcgtaattatatcataggctaaacccaaaaggtgtgccttataaatgttttatattttccactaagaatgaaaatggccaaatgaattacctagatttggtatagaaggagggcaaaagagaaatcatagacactaacgacgccaaaggaaaaggacatatatatatataggcccattaaaagaggatatggatttttttcccacggagggaatgtttactcattttcttacatgtcattttgatggactact

SEQ ID NO: 71967 - DNA, 1315 bp, Oryza sativa
atatgtatatacatatagatatatataccatgcacaaaacagcgccatgcaaataaaaaaaatggtacaccgatctttagtcctggttattttactcgggactaaagatagctatatttagtcccggattcgtagtcccgattggacaactgggattaaagggggttacgaaccgggactacaaatagtttctccaccagtgtattttaactgggattaaagatcgtcatctttagttccggatgcttgatcccggtttgcatcctggaactatatgaggttacaaatcgggataaaagatggtttcttcacccgtgatcttttgttaatcgggataaaagatggtttcttcatccgtatcttttgtttgttacggatgggcgagctgttacagatgatacttgagccgttacaaatagacaggtttgtgttagtggctgctagttgcatgcatgcacgatgtatctgcacgcactggtttgtccccggatggaagatttggatttgctgcggaatgggctagttgcttgcgacaagtacgatacgatttttccatggaggacataggcacatatatagctagttgctaaattgattaattaattttagccgccatgcattcgtacgtgcagagcagcaagccaacaatcaagtccggtagttcattttacgcaatatcaatcgctccatcgatcgactattattgtctttttcaacaaagagttcggttttctttgctgtctatgtatatatgtttattccggttggtatatatgttcgtaagcacgatgtgtttttttcaaaacatttcgatagcaaataaagttgttttaaaaaattatattaatctagttttaaaatttattttagttaattaatacataattagtcaccccgtttgacatgtgctgggagaagttcctaacctcttccttcccgaagttaattcaattcttggaaaaaaaaagcttaattgattggcccaaagtaattaaattcagctaagtcgtagatcaagcaccttatatttatctattatattattaaacgaatagaaaaaggagcctttatgttcgctctcatggcctagaaattctcacattaatcggagaaaaagaaaagacagagtccatatagaaatacaatttaaaaatagctgaaattcggaattaaaaaataaggaatattagaagaggagactagagtccatatagaaatacaatttagaaataactgaaattcgaaattaaaaaataaggaatattagaagacgagacaagagtacatatagaaatataattaggaaatagctgaa

SEQ ID NO: 71968 - DNA, 9985 bp, Oryza sativa
agtatagagtccatatagaaatacaattaggaaataactgaaattcagaattaaaaatacgaacattagaattagaagtagagtatagagtccatatagaaatacaattaggaaataactgaaattcagaattaaaaataaggaacattagaagtagagtataaagtccatataggaatttaaaactaactaaaatttgaaataaatataataaaattaaaattagagtttagagcccgtataaaaatacaatttacaaataactaaaatttgaaattaagaaaaacatgggaagaagaatttaaagtcaatataggaaattcgaaattaaaaattaaagaatattgaaatatgagtttagagttcacatagaaatacaattagaaataataaaaattcagaaataaaaataaataatgttggaagaagagtatagagtctatatagaaatacaatttatagaaaattcgaaattaaaaaaaaagaaatattaaaagacgagtctacagtccatataggaatatatataatttacaaataactaaaatttgatattaaaaataattaataactaacacgtatataaaatacaatatgaatattacacattagtagttttgtaaagttattgcaaaatttaaaattatgttgtcattttaatatatttgaataatataataagaacatatatgctattatatgatagaaaatataatgatactagccgcacaatctgcgcgggccaccatgctagttagagtaaagtatatggtcggtccttaaacttgagagctaatgtcacttaggtaaataaacttgaaaaattacatatttatgtccacgatcttggtttaatgtatcacaacaggtccaaatgacatttgactgtatctgaccgccaacgtggcactccacgtagacaccaaatttacatccaccccctccgcaacacaaaatagtggtaaactttcacttaggccattcaacatgtgtatgcaagtgcagaagacgctgcaggttggcagcgaatgcgcgaagggcggtcttggagagggccttgttgatgctggcaccgaggagtccgtcgtcatcctcttgctgcagatgcaggagtaagcatcgtcgcttgccagtgccgcggtggtggcgcgcaccaggcgacggagttccatcttggcgcgacaacggtgatcgtcgctgctgagcagcacggccgtgctgccgcatcggaataggcactgcaacaacatcatagtcctctccttgccggcgtgctagtgcggcgccagtgactccgtcgagactacgagcgctaccaccggtcgcagcaaccgcgcacacatggcattttggcctttgggcgatgtccaacgggaccagcctggcgctgcaaccccatcccggagaggtttgacgccgtgacgtcctcgcgcatgcggtaccacctcacacagtcctggagtgttagcccaaaaccggaaaacgttggctcaacagggagaaagccttgctacaccccaaaagttagctcaaagaggtgggggttggctcaacggggagaaagccttgctacaccccaaaagttagctcaagaggtgaggggctccccccacctttaagttggttcaactccccctagattagagatgtaggactattcccaacaatctcccccgtcacaacataaagttggttcaactccccctagattagggatgtgggactattcccaacaatctcccccgtcacaacattggtaccccttagccctgaccggtccaacacacaggcacatacaggcctcacacccgggatgtgggactattcccaacaatctcccccgtcacaacattggtaccccttagccctgaccggtccaacacacaggcacatacaggcctcacacccgcggtccactgaccagccccacacacgggcacatacgggcctcacacccgcggtccactgggctttgggcttacaccgccttgagtgtgcacaagcactagagattgttggattggccctgataccacttgttagccccaaaccggaagacgttggcccaaccgggagaaagccttgctacatcctaaaagctagctcaagaggtgaggagctccctctacttttaagttggttcaactccctctagattagggatgtgggactattcccaacatgaacgagaggcatggctccaggaagaagctagctgataatgttgatgatgagcacgttggcaatggggtagaacccagtcctaccgaggagctcccggatggcgctgtcgtagaaagcgtccatctcatcgaccgcgtcccgctgtgcagcgagctcttcgtgaccgtcgacgaagctccgcagctcgtaggtccagcagccgaggcctacgccggagatgaggcggaggaggaagcgaacctccaccattccaagccgcttgttgtgttagacaatcgcgccggccagctccatcagttattcgtcttcaccatgaggccatccgcttgcttatattacaacgatgtacttcgaagggtctaagtgtaagtttactgccactctgtgttgtggagggggccggatgtaaatttggtgtctacatgaagcgccacgttaggacagtcccaactcataacactagacatgatttccataaactccacatcatcaagaaactagtactaaacactactcttccaatacaaacaccactattccatacttcaatttaatgctatgtcttggatgttgtgtagaaaccatgtctcatgcaagacatggtttccttctctttcctcatttattcacttgcaacatcattttttgtcctaggtggcaacttatttaatgctatggacaccatcctagttattgggttgggaatgaccttagcagtcagacacagtcaaatgtcgtttggacctgctgtaatacattaaaccaagatcgtggacctaaatatgcaatttttaagtttacggacctaagtgacaccacctctcaagtttaaggaccggcatgtatttttctatatttattaactaccatagttgagttgacacacatcatataacattagataaagaaaattaagtacatgcatgctccctctgttccaagatatataaatacttcagtaatttctttcatgaaaattcaggggaggggaaaatctagattacctttcattatcctcttgctgacacctgggtggggttgtcgacatggggagatatcttgtacattttatcactgcaaatacctcttaatattctaaatagaatatatttgaagacaaaatttaaatgcttgaaataactagcctacaaatgtacattcattccgctaattaattatctagataattgaatcacactgcagaacacattggagcagagtttgcaatttcggatctgaatttctaaaatacaccgataaattagtcggtgtatacaatataatataatcttatgattatgtgccttgttgtttgtttggttataaaggaaaggatgatcttatagtagatctagtggttgcaatgcagtgtggaccatcttattctcagggctaagttttagtaaccccttcacgctgggctggaatggcaatccaaccaacgggattgcatagtttggcctaaacgagagtacatagtttggcccatgtactgtgggccattttgactaaattcaatcggtcatattacatttcaagaatttcagcgtcgccattgcttaggtgcaaggtccatattggtatacgtgacacaatttgaggacatcatcatatcaaatacagatctattttcatgctttcgtgggtgacatagcaaacatataagccacaattatctccagataacaatatatataatgggttttacatattacaatctcaaaaaaaaatcaacttacaacaattgaattaaagtaatttaatggatgatagatccgcacatcaatttgccaaaagaaacaagacttattcacgcggaatcatgaaaaaaaggctcaatcgacaaccaaaaatcacacgaaattaaactccagaacattataatcatgcagctcagctcagcaagtgaaatcggacgggcaggtcttgccgcacttgttgagcatgatgctgagatcgacggggaggttcaccctaatgccaagcacattcgctttaacggccgtgcagaggcagacggcagcgtcgagatcggcgatcccagatagcagcgagcagcaatcgtcggtgccatgtccgatcttcgcatcgaccagcccgtttagcacgttggcgcacactctcagcttcaaggtgttgatcgggcaacggccgtgctcaccgtgcccaccatggtgtgatggcgtcgggactgcaatgggtggagtcgggacgacctgctcgccggagcagttgggtgtgcaaccctgcacaatgacggcgaagaggaggaggctaagggcaaggaagggagcgatgaccttggaagccattggtgtctgggatcgaatgagctagtgttactcagtgaataagtggtcttggctgctatctagctcgtgtcgctttgggttgatttttgcttggggtgtcatctgctatttatagctgaactatagtacgcttgcttggtatagatagttgcgtgcatgatgcatgggtgataattgcttggttttcatggatggatttgcatgcaagcatgggccagtagttggcgagagatatgcaagttgaattcttaatttcgatgaatagagctatgcagtcatgcacagcaccaatcaaacaatcatgtccagttgtacaatttacacgatactagcaagctagctgagtacccatgcttttctatgaatagaaattacattataatatcacctaaaaaataatatcagcatcctagtcaaggtattctacttaatcagtttgtatcgttgcgaaggcataacatccctctatatatatagtccgcaaaatttgttacaggacatccaaaaaagtgtaattaactagggacaccgcaaaaacgcgtttatgctatagtatactgtaaaaaggtggtaattagctgttagacacccatgggactattttattatattcagaggaattggagaaagaaacaactatgaaagtatagttttaccccatgaacccaatcgagcctcactcccatgctaggatccacctgtcagggaatatttttttcctattctctctccttctctactcattcttttttcttcttccatgaaacaagaggagggcgctggtgctccgatgatcaggagacggcaacgtcagcgattgaacgtgttcattttttctttgcatccgaggaaagtggtggcaagtagagggactttgagaggaggccagaacaacgaagggaaaacctcagctctagctggcaagggaggtgacggtggcagcttgatatggtggctaaaggaaagaggaaactaggggaatagagtcacctcgacgaggcaaagctggtggcgcgagggttttgccggcaaggctccggtgacggagatcgaccgacagccagcatggcgaagatggagttgttgcaatgtccagcggcggcgttgttgcgccccgtggaggtcgagataccggcgtgctgcatctgttggaaatggagtcgccatgttcggcaatggcgccgacggttcccgacgaccgcgggcctagagccatttcgtctggcggcggtggcggcgatgctgtgtcctatggaggtgcagatactggcgtgccgtgtccgtcagagatggggtcgccatgtccgacggcactgacggttcgcgacgacaacgaacctgaggcattgtgtctggcggtggtgctaggaatctacgtcccgatgacgatttttttgtattattttgaaattatgaaaaaaagggatatgtatcggagtgtatctaatatgtgtctttatcgaagtacgtatctgatactgatacgtgaggtttgtgacgtatccgtgcttcacatacatttagttgagccatgtgcaaacttctctttaatctatgtttctctctattttctctgaaaataataaaataatgtcatgagagaccagcagctaattatgagttttttgtggtgccctacggcagatgtgtggtcttacggtgtccctcagctaattatatgctttttacatgtcctgcaacaaatttgcctacacattcactgcgtcagtgcatccctctccggaaaaggttgacttgtaatctcgcgtgtgtaccctttcattgtatgtacttacgtaatcatgatgaagccgagacaccagaaaacttaggttgtggcatagggctgctcggggatggtgacttggtggtcttctcgtgggtgcgcagaactgatggactggctgcataagacctaatttgaggctttcttgtaagatggggcctactcttagtctatgtttggcatcagacgtttctaacctccactccttggttttcatgcaaataccatattattttgcaaaaatgatacttttttttggcaaaaatgttctataagaaacttgctttaaaaataccatattaatctattttcaagattattttggttaattcttaattaatcatacactaatggatcactttattttgcgtgcgggttggtggagttctcaatttccatctcggaacgcaaccttagtctactcaggaacaaccatgtgttctacagtctacaacatagctaactacaccgggcaagtcacctattcccggaaccatcttcttctacgggctagcttcagtaaccggtcgaattttatataaccgggcaacgccctgaagccagatcaacgccctgaaactctgatgcaaggtctatattggtgtgcgtgacacagtttgaggacatgatcatcttagatacagatatatggattggtctatttttttggctcatggatgagagaaagcgaaaatgtaaaccattaaaatatcttccgcataacaatatatctatatagataatgcaatgggttttgaagatttgcattctctcaacaaaaagatcaacttacaacaatcaaattaaagtgatttaaggatgatacaaccgcacatcaatctgaaacaaaaaggagacttattcacgagggatcatgcaaacaaacctcgacacccaacaatcacaccaaaataaactcatgagcattataaatgtgcagctcagcaggtgaagtcagacgggcaggacttgccacacttgttgaggattaggctgagatcgacgggaaggttgaccctaatgccaaggacgttggccttcacggcagtgcagaggcagacggcggcatcgagatcggcgattccagacagcagcgagcagcaatcatcggggccatgcccgatcttcacatcgaccagcctgttgagcacattagcgcacactctcagcttcagggcgttgatcgggcaacgcccgtgctcaccatgcccgccgtggtgcaatggcgtcggcactgcagtgggtggcgtcgggacgacctgctcgccggagcagtttggtgtgcagccgcgcacaatgacggcgaagaggaggaggctaagggcaaggatgggagcgacaaccgtggaagccattggtatatccgagagatcgagtgagctattggtactcagtgactcagtgttctaggctgctctggcttgcgtcgcttttggatgatttgcttgtggtgtcgcctgtcgcctggtatttatagatgagctcgcttcgtatatgtagttgcatgcatgatgcatgtgtgagataccgagatatgataattgccagtagttgttggcgagagacatgacacgttaaattcttactccgtaattatttcgatgaatagagctatgcagtcatgcagagcaccaattataatcaaacaatcatgcccggttgtacatttttcacgatatcataatttctggatctatcaatataatattgttttttcagagtttcttgggtctcggatgttattctctgttacttatacttgcacactacgggcctgtttggcacagctccagctctagctccacccctcctagagctggagctcagccaaacagtttcagctccaccaaaattgggagtgaagctgagtggagttctctcacaaaatgaattagagttgtagagctgggtttaggcagctccacaactccactccagacccaacttctggagttaaatttaggagttggagctgtaccaaacaggtaagaaagcttatttcttcgtcctagggagtaattaataacttcagggagtatatatttctccgtccttggatgcattatttctccgtcctagggagtatactccctccagttataataaataggagtatatataatgcatccaagcgtgtgcgacttgctgatcagctggctggaaatttaaataaggcatgcaagtcatgactggtctgaagtctgaacaaatctgaaacgattttgttatatatttatcaataaattttctcctaaaatttatcaaacatactatataattataataaaatcatgtaactacaattttttcatgattttaaaccattgaatttttttcaagatttgtgcaactaggaagaaaaaaacatacagcacgggcataggtgaggtgattcgatccggtgacctccactttgtaaaaacagcatgttaccatgggactttttaaagttacatatacttgcattatatttaaatgcaagatacactatatataatgttatatgattatattatatttgtacctgtcaaattattgacagaaaatttatcaacaaatgtgtataaacagccccaatatgctgagacaatatgatttatatgtccacaatataatgtgctgaccatgcccattaatctctttaatcatcccggtctagcccattaattacccaccagtatttgttcaacaaagttacctaccagtaatttatacctacactgtctaatttattatcctaagagagttttgacgtaaccaaaagtatccggccgacctggctacgtggcttatattagcgtggtcatatatgttgtattgagaagcattaagtaaaacatgcaccatgaactctttgcatgttgtgtttacaaattcaaaattaataaatatgatgctgtagcagtcttggactttcaatttagcacttattaaatttaattccaaaattcaaaactagtaattagaaaaatgttcttcatatgtactttgcgttcaatcgtgtccactatcataaataaatccagaagtaatgcaatgcctcgattttcgttcaaccgttaaaactattttaatgaaaatcatatgctcaataatttgattctttaagtgtatctaggatctagtgccatgatctcaattaaaaactaatctttttgaaccaaaatctcaattctcaagtaattgatatgaaaaaaaaacttatggatgttgaattcaaattcccttcgtaagctagctttgtgtgcgtttattactctttgatattaaagtcttttagatagctagacgttgccagtgagcatccaaggttgtgtaggcttcgatttcacctctgtgttggaagaaagcaagagtaaaatcgagtagtgtatttgtgtaaccacgtaaggtaatgggttgaaagagacccagcctttgtagcccctcaatagagacgtaggattggtagatccaaacttcggtaaataaatcacgtgtctcctctcttggtttgtccgttattgccttgttcatattgtgcttagatatatttgaatgcttaattaatctacttggtgattttatatctttcttatatatcttgtttgttaccttttgattcatgtacatattgtttgtttgagctaaaatttcataattattgttttactctcagctgtcggactttccggttcatatcggcaacttcgatttgaatatt

SEQ ID NO: 71969 - DNA, 9764 bp, Oryza sativa
tgtaggtaaaaacaaagaagtgataaaatctctcacctagcaacttgagctctgataccacttgatgcagcagcaggggttcccgatctttcgataagaggaggataaacttcgatttgggggaggacacgacgttggcgatccgactacaactaccacagaggtgctgcgccttagcaaccggtacactgactccacgttgttgctgttcttaccgtgccaagaacaaccttgaacctgcaagcaatcgaagaactagcaagaacaagttgacaaggaaacaactcacgtcacttgtcaagtgatgaaactgaaacaaaccagaatggggttctgaatacaagtatccgggtggtctagccgacacacgcgagtacaaggaagtagctgcagctaaacttacatccaaacaaaacccaaagtgcaaaatggtggctgctaggagtttatataagtggaggaatgatcaggagaggaggtgggagcaaaccctaggttttgtggacccctaatgggctgtaaagatacaaggcccaagcccaagtttctgatgtgaagaattattttcgtcattctgagcagcctgggtcaaatttgaggccatacatagctgaaagtagacgatgagatatttccaacaagtactcatttgccccgtttgccctccggagtgaagagcattgacttcatcaaatcagcattgctagtgttgcttgcgatctggttcctctcccatattcctaacaacaagtagatcacaacaactatttagtagcacccaattctgagaagaacttgtatgattagctaggaatggttttacctgataattaagttcacgagctcgagctctagtcattggtccttgttgtgcaataggcatggttgtatcgttggaagggatgtcctcatcaatcctcctccagcttcatcggatgcatggcaatcttgaacaccgcgcgcgcatgctcaaagaagagaacctgcaccaccacacggagcgggatgagctcattctgtgcctcgtgcgcgcacgccttgtccgacagctttcggcagttgagcaccctgcatagtcgttgttggctagccaccgtagttggcagatagaattaacggggatgatagaaaagtggatggaaaatgcaacggagtggtatagttccaatttccccaaattccagtgacacgttgctgatatcgtgaatagtagtaatatttttctaatttggtatatttgtagtggcaaggagctaattaacccttgagtctacagagaattgcatagttgatttagaccacagtaaagctcgactgatttcaaagcttacatgttctctaacggaggaataccacatgagtattgaattattacgtcaaagtgaaaatctatgaaatgccatcgacgagtgttctaatccaagaaaagccattgacgaatctaacttccaaaatgccatcgtgcgaatcaacttctctcagaaatgccatcaccatcactgctctgtcagctctactccattggacatggtgtaaagaccattctgcccttgcgaaggctggataatgtatcggcaaaactactgcctgatacttccttcgtttcatattataagactttctagcattgcccacattcatatatatgttaatgaatctagacatatatgtgtgcctagattcattaatatctatatgaatgtggacaatgctaaaaagtcttataacctgaaatggaggtagtacttttcttttttactggaacggaggtagtactttggtaaagagtggattttttcttggaatatttgcaccaggtaatattcttcctaaaacttaaactgaaattttcaattttcacacaactgaaactgtccaaattttaggattactattcctaaaactgaaatctgcactatgatatacgaactcattttcgagttgtagaccaaaatttgtccaaatttattgaatgtcaggaaccaccaaaattaaactgaatgacaaaatagctaggcaagaactcatatgaacaccactatatgctcagaacagtacaggctagcagaactctaaaaaagtcgatcttgaaaacaagaggaaaaatacaggcaacaatattgcgggtctatgatataaagtcaagcaaagcatatgaacaacacatcccaccacgccgccgctgttgctggaatctcagaatctctgcgtggcaagagcaagccacaaacaaacagcagcaatgctacgagttagctaaagaagaaggcgaggaagaagaaaatcacccatatatagcccgcgacctccgcgccggcgcctgcggcctcctcgtcgtcgcctgtgaccgccgcaccgctgcctacgaagccagcgctgctgcctgtggagcccgcgccgatgcatgtgaccaccgcgccgccgcctgtggagccagcgccatcgccgccgcctaaggaccctgcgccattgcctcggactcctgactgctccttgcgactgccgcgccgataccgccatgtaccgcccgcgcctcctcctggaactactgcgtcaggcatagcggcaccaccaccgtggagtgctgcctcgccgtcgtcgctgggcggaagagacgcctgaatctggtttagggttgtagaagtgtggagattatggataccccatacccatacggcatgtatatccgactaggtatggggtgccatgtatagatagaatatcttcaaagggactcgggttaaattccaaacttgtatgtcaacgaaatacccgggatcctagtcggttacgattgtatcttatctgtaactacctattccgttagggatatgggctgtactttgtaatacggacccctttccctatataaggaggggtccgggtgcctcttggggcatgatttttctctcagatcatacgatcaataaaaccctcggcagatcaatccccggataggagtagggtattacttcttattaagaaggcctgaatctgtataaatttccttgtctctaaacccatccacttctccagcttgatagccacctccttttaggagcagggatcacggtgaacgatctattcactcgcctcccgactgacacaccgactgacacagggagcgtcgggtcgaacaacctcgctccccacgtcgaaggcgtcccgtcgatcatcgcgatactatcaaccagtgatgtgcggcgagaggccacatcccccaccattcaccagatcgttatgacgacgatgtggatggagttgctgccttcacaagtgacctacgccgagtggatttgctggccggcttcaaaccgactggaattgagaagtatgacgacacgacaaatcctgagtcttggctcacagtctacggtctcgcaattcgtgcagcaggaggagatagcaaagccatggctaattatctgtccgtggccctagcggactctgtccggtcctggcttcacgggctgccccgtgacacgatcggctcctgggcggagcttcgtgaccacttcatcgccaacttccagggcacttttgaatgtcctggtacccagtttgatctttacaacattatccagaagtccggagaatcccttcgagattacatccgatgtttctctgagcaacgtaacaagatctctgatatcactgacgacgttatcatcgccgccttcactaagggcattcgccatgaactagtcggcaagtttggccgcaagcctcccaagactgtcaagcagatgtttgaaaaagccaatgagtatgccaaagtagaagacgttgtcattgcatccaagcagtcgggcagcacctggaagccaaagaaagatgcgccgactacaggggggagtggaagtgccaatcacaaggatcgcaagcgtaagcccgaggaacttgtggcaactactacaccatcctcccgacagcgctcacacgtcaacactttcgacaagatcatgaactcccaatgcccgcatcgtccgaattcaaatcatgcggccaaatatttcttcgtctagaaacagttcgcagagcaatacgccaagaatgcacgcaagctgactgacggagatcaaagcatgtcaaagaagaaggatgatgaagatgatgccccgactggttttcaagactcccgcaaggaactcaacgacatctttggcggacccctggcttatgaatccaagcgaaagcaaaagctgaccaaacgggagaacaatgttgttcagcccgatacaccccaatatcttcggtggtcagagacagttatcaagtttaaccgctcggatcatcctgaccgagtggtccacccggatcatcctgaccgagtggtccacccggggtggtaccccctagtgctagacccagtggttcgcaacgtcaagctccgacgatctctcatcgatggtggcagcgcactcaatatcctttttgccaagactctagacgacatgcagatccctcggacagaactgaagccgagtagtgcgccctttcacagattcatccccgggctatcttctactccactcggccagatcactttgctggttaccttcggcactcgggagaactttcgcacagagaacatttgctttgaagttgctgactttgagacagcgtaccacgctatactcggacgcccggcgttagccaagttcatggttgtcccacactatatctacaggatgatgaagatgccaggtcctcgaggagtcatatccctgcggagtgacatcaagcaaaccgtcacctgcgacaaggaaagctgcgagatggcccagactcgcgagatcacgctcgctcgagaggagatccgactggctgcatcaacagcaaccgaaggagaagtgcctgcaatgtcacgcccggaatttctatccaaaattccaaacgcttacatgtatgtaaaccctcgtccaggaatcagccgaggcacacaataacaaattgataatacagtacaattattactctaattaataagcgaacaaaatgtcattacagaggtagatagttcctctcaatcaataaagttctaagaagcggaaaataaaagaaacagcgcaggcgactcctctccacaggcagcttgaccagggctactcctaatcatccacaccaacagcatcactgtagaactcctcctctgatgaatgattgcaaggtgagtatatgacatattcagcaagccacgtagcaaatatgcaagtgcacgggatagcaaaggatggcataatatagtctcatttgcataaatagcatttaacaaatatttcagaatttaataaaacagttaaataataattaaacaatattaatccaacgctatgcaacataccctgttgcgtaggcccaaccattctgaacaaccaaccccggctgcacagttctaactccaaaccaggaattaaccattccaaaccaggagctaaccaagttattaacattaatatggtgagaaatgtgagactaatcacgaaagacattgttagacccgcccataaccgcgggcacgactattcgaatagtttaaactctggccaaaggtgtaccactgtacccacaagacacaacctcaacatcatgtcaaccatgcgtcgcgatacttgacaagtacccgaatagagattgtgacaataccctctatataatacaattcaaagcagtgcaccgttcccggatcataatcacccccttaaacaaggcatggactccccagcgacccccgtgggcttatctccgccacttcacagtctggtgctctactatgaaccatactatacagaaagtaaagccgttgccaacgctggcttgtggttggcacggtaaatgtttcacaaccgaaaatcgtgaaccggtccttaattgtcatgagcacaaccatcaaaaccatatgctcacaacccaccattatcaggttttggttggcaaattgattaattaaccaatcacgatcaaccatcgtgagctatcattaagccatcattaaataatagtgaatcataagttatcccatttatatgagctagtgtctctaagcatggctaagcaattctgtctaatatctagctgaaccaacatataaagctcaactagtaaaattataataacccaaggtatcaaggaatagagtaatcaaggacaaaagggccataacaaaacaataggttatttccacccaatgacattcaaaaataaatgcaatagttgaatagaaacaatagctttaaacgggatcaacatgctcaaaggatcgtttgggatctgtgtgacttgccttgctggccttggaactcttcaaagtcttctcctgcaaattcggactctccgggaacgtcggaatctaaagagaaaagaacaaaatcacccaaatagcacataaacaagcatgagcagtacatgtggatatttttaacatgtagatctcaattttagaaaaatttagagacttgaaccaactaaatccgagctaagatgaattagttatgaattttcaaagatttaatcggattaaatcatttatatagattttaattgaattatgacgcaatattgaattatttttgaacaggaaaaggggattattgcgtcagcggctagggttcacggtggaccgggtgcacggcggtgactcacggaaacgaacggccgggattgatcctatccaaaatgaacgaccgagatcatcttgatctaccgcgggtctatggcggacggcatcgatgacgtcaacggtgacgccatcaccggtggtggctcggcctcgcgtgctcaccggcaaatgacggcacggcggcgcgaacggacggcacctacgggttgcgggcgacgcggcgaactcaccggtgaccaaaacggcagcagatggtcaacggacggcgacagcgatgaggaagaagcggcggcgaccttcggctcgacgacgacggcggggctccggcgatctacagcgacaacggaggggcggacgaggtcagcgacgacttgatgatcacgacggcggctttcccgagcgacgacgacgaccggagcgacggtggcgcacggctggacgaacggcggtgacggtggcgctaggctacatggcgctagagctctaccggcggtgagagacgaaagcgagggtggcggcggagagaggagacatcgagggtccttttatagcggctagggggcggcggcgaaggcccacggcggccggcggcccgaaggaaagtctagggttcggggagagagacgaatccgattcgagatcgaatctaccaatttccaaacgatgttagccgacgattccaaaagagaaaaggtagagtggatctcggggatcattttccctctatcaatttcaccggatcgggaaagggatgaacgaatttggaaggagacggtggcgcggctcggctagggttcagtcgggcgacggctggaggttgacgacggccctgactggtgggccccacctgtcagcgggcggatgcgcgcgcacgcgtgagcggcggctcgcttgcgggcccggcttgggccgagggagggagagagagatttgggccgactttcggcccaaagccaaaagaagactttttaaaacttttccaatttaaattattcatgaaattcaattccatttattaaaaatacttccttggctcaaataaatcccagaaaatcaaggaatatagaatcaagcaaaatttttaataaaattttatctggcccaattttatattggaatttattatttaaaattagatcttctcttctaggcttttaaaatcaattctaataattccaattaaacaacaatttatatatttaagatttttagggtgtgacatgcatccaagatatcaaagagcggagaaggcgatgccaagactaagaaaattcctctagatccctctgatcccactaagactgctgtaataagcgctgagttagattgtaaataggaaagcgcgctcatcacctttcttcaaaataataaagatatctttgcgtggaaaccatctgatatgcctggtattcctaaagaggttattgagcactctttacatattaaggaagacgctaaacccattaagcaacgactccgccgttttgcacaggataggaaggatgcgatcacggaggaattgaccaagctgttagcagcaggcttcatcaaggaagtcctacatcccgactggctggcaaacccggtcctggttcggaagaggacagtgcaatggcgtatgtgtgttgattacaccgacctcaacaaatcttgtcccaaagatcccttcgggttacctcgcattgaccaggtagttgactcaacggccggctgcgagctactcagtttcctggattgctactcagggtatcatcagatccgattaaaagagtccgactacttgaagacttcattcatcacaccgttcggggcttagtgctacatcaccatgccttttggattgaagaacgcgggagcaacttaccaacgcatgatccagagatatttttcaactcagattggtcgcaacgttgaagcttatgttgatgacgtagttgtcaagaccaagtagaaggctgatttgatcgcggatctagaagagacctttgcaagcatccgcgccttcaggatgaagtttaatcctgaaaagtgcatcttcggagtaccgtcagggaagttgcttggctttatgatatcccataggggcatacaggccaacccgtagaagatcaacgccattctcaacatgaaaccgccgagttcccagaaagacgttcaaaagctaactggatgcatggcggtgctcagccggtttgtctcacgactcggcgagcggaggatgccatttttcaagttgctaaagaaaaccgacaatttccagtggggacccgaagtgcaaaaagcctttgaagacctcaagaaacttctcaccactccaccggtcttaacttcaccacatccgcaagagccattgttgttatatgtgtcggcaacatctcaggttgtgagcacggtcctggttgtcgagcgtgaagaagatggccatgttgaaaaagtccaacgaccaatttatttcgtcagcaaggttttagccgactccaagacaagatatcctcaggtgcaaaagttggtatatggtgttttaattaccgttaggaaattatctcactattttcaaggtcactcggtcacggtggtcacatcgtttctactcggggacatacttcataatcgcgaggcaaatggacggattgcaaagtgggctttagagttgatgtctttggatctatccttcaagccgcgaatttcgatcaagtcccaagccttagcagattttatcgctgagtggactgagtgccaagaagacatgcctatagaaaagatggagtattggactatgcattttgacgggtcaaagaggctttcaggcaccggagcaggagttgtcctgatttccccgacttgagaaaggctgagctacgtattgtggatacatttttctacgtcccataatgtggcagaatatgaggcgcttcttcatgtattaaggatcgcaatatctttggagatccggcgtctgatagtttgtggagattctcagttggttgttaatcaagtcatgaaagagtggtcctgcctcgatgataatatggctgcttatcggcaggaggtacgcaagttagaagataagtttgatggcctcgatctaacccatgttcttcgaaataacaatgaggcagccgacagactggccaatttcggttcg

SEQ ID NO: 71970 - DNA, 581 bp, Oryza sativa
cctttgaatcaaaggatttatgtaaggaatttcataagattcaaatcctataggaaaattttctatttggcacattgattcaaaggattaaaactttccaaatcatatgaaattcctatggaatgacacattgcatgtatattttggaggaaacttagcaagaggtctaacctcttgaaaatttcctttgagtctatctctcttatccgattcctgtgtttttcctatggtccaatcaaacgatcattcctgtgttttttcctatgttttgcaatcatctattttatactttaattcatgtcagaatcatgtatttttcctatttctctactttttttaaccctgggattcaaaagggccctaatgatgagacatagtcctgatctttcgatagatactgataagtcgtttgtggagaactcatcattgatgtaggatcgaacaacaagaactaaggtcctgtttgtttcagcttaggattattataatctggattattaagagtaagctgaaacaaacaagtagattattatgatagattattataatctataagccatattactataatctaataatct

SEQ ID NO: 71971 - DNA, 3806 bp, Oryza sativa
attcatcgatagtgtggttttgtgaaattaaactaccaaaatatatgtacttaagtgccaagtgtcaaaatatgtgtggttttctgcaacttaaaccataaaatatgtagttttgtgaaatttactcaataaaaaatcagaataactgtcactagcaagaaaatgtagaaatgctgctctcagtatcactgtgtttgtcagtctcatgagatatcatccaccctccatcactgtgatctgttaccaatttcctggacgaatctgtccagtgatttggaatctgaatctgaatctgaattgctcggggattctgctgacatcaccggcaaacaatggtagcctgacatagattggagtctcataccgaggtggtagctgcaccatggacatcagatcaaaggtttcccttgccatttggggagggattaccgctacctgaaggtatcatagttatcgcggtaacctcccaattatctaaaaatcaagagggttaacgtgcgaggttaccactaaccaacgagttcagagcaaagcaaacaagagatttgtctggaactgtacaatctaccactgcgtacaccagtacaggggctttcagcgagatgatcatccatacaaaaattacaggaagagtggcaggctggcagctgctagctagattagtgtcagagcaattcgtttatgaatgcattacaatcatttcgtactggagagattcatacagcgttcatgggtactgaaactgaaacaagcagccgcactgagatgtttgctccttccaaatctcaaaacatttccttcgttgaaataatccaactgaactaacttaaagctccttaactgtaatcaaagtgcactaaacctgcaaatgtagctctgtaaccaacagtcatcacaaaagtgcactagtaaatatgttctttataacaattattcaagggcatgaacgaattaattatatattagaaagttgatttaaaaggttctttaagaaatgtcaatggaaaaaatttacaaaaaaaaaacatacatttaggagcttaggaagcatgcagttccactagactgcaagataaggactgcacatgatgttggtcatctatttttcctatggagggtttagatttaaagctacagtcagtaaaagtgaagattttttttggcttggataataacttggatgatctgaccgttgaattttcatcggatggtcctagtgtgcactagggactgcaggtgaaccgaatccatgcccgtgacaatccataatccataagcagaaaaggatgacttctcgttcagaaaaaaaaaaagatggatgaaactattatatgttccttgcattgatcatccagcacgtcgtcgtcctgagcaagctgccttcattttccaggacatgggtgcggaagctcggcgattctgctggcatccgagctcgcacggttgcacaaataaactcttcattgttcacgtgcccctcttgctgtacatgttgacaatttggcatggcgcacaagttgaccaatttgctcgccattgtcaggctcgatgcaatctcgaattcaaatgttcatcaaatccctcctcaaccagtttacggcatatgcagtgtccacaaatcaacatacatgcacgaatttcagagaaaaggtgttcaaatttacagctgaacatgtagtagtaggagcaaatgcaggtttggcaggggtacatttccggcaaaacaatggtggcctgacatagatttgaatcatacaaaggggagagctacatcatttacatttggcagagtcaccatcagaagattcgccagattggctaattcttggagaagttaagagcaaagaagagatttgccttcaattctactacatcagtgccacgagacaatcatccatacaaaatgttcctgaaccactagaagaagaatggcagctggtagctaagacagtctacaatcttacaaggtcctgcctagctagttccgggagcaattcgcttacgcattatcccatttcaccctggaattcaagaatcaagatccatgtcgcaatcaaactaacagtcgcaacgagaagttagagatgttgtgattcactgctccttccaaatccttccggtgacacgcagtttgagctccttcttgtcgccaccggagaagaacaaggccatgttccgctggatgataaggccgtcgtagctgtcccgaactttcctgtgactgtctctgatgcttcgggggacgccttgccaggtcatcttccgaccactgcctccgacctccaggctgtagctatagttcttggcttctgcatcatctcccatgaaccgtaggaaggcgatgtagacaggtgccatgcccaactggaatgcctcaaagtgcaggcaaaagtactggccgaaacagctgaaaacctggatagagaatccacatttagttatagcatacttatcaccgtggagaataaaagagaagttaaaagattcaaaacagttgtacaatcatgttctaaccaggaaatgatgaattgaagatagcaacttggcagtttgccagtgttgcaatatccaatttaaccaagctagtaagcatgcacttatcgaacaaacagaaattcatattttacgtttacgaaaaaaatatctaacacgagaactttgcagaattcatggagtgtaaacaacagttggaaagcattgacatactaactagtatacatgtcaatcaaatttgtatgtgcaacctagtaacatgaacattgtgaggtgttcttttcataaattacagagcactgagaaaattaccgtgagcatccaggtagcattctcaacttcatgaggatttgatttgacataacggtgattgaaggtgcttccgttgtgcatgtcaaccttatgatcatctttcaagtgacttactagatactgaatgtcaccagcaacagtgcattcagatccagcatatgggcaagtatagggcctgtattggcactgtgactcatgcttcagcttgcagtaataaggatatatgcccaagcacccaaagttctgatatttgcatggaagctctagtgatgcagctaccttttccagagcaaggcatcttatgttacccaattcatgtctgcaagttgggcagcggttgtgaaccctgggcttgcatccggaacatagagtatgaccattggagcactacacacagtgatggaaatattgttaaggaatgtgcttacatattcaatttgctcttcagggttaatgaatgtacagttttcagaacacttgggcttcataaaaatatcgaactgaaacctatgttagctcaacctaaattaaagctaaaataacatttttactccaagtccctaggcagtgtttggcaaatgtctaatggaaatgatttcccacccatctttaaatcctaaccattcattctcccccatccatttaatcctaacccttcattcatttcccaatcccaatcccacctctcatttcccattatccaaacacacccctactgtataccagatacaagcatgccaaaagcctataactatgctagcataatgtcactggatggttcagataaatgtaatgtaagtgtagttaagagtttggtaacaaggtgtacctgatgaattggaggatacatggcatttagacacacagggcattccagtagctcacgcacattgccagagaccatcgcattcggttttggtgaatgctgggtgtgatcatcaacaagttcagtaacatccagcatctcctcgttctttggaggatcgataacttcagaatgg

SEQ ID NO: 71972 - DNA, 1724 bp, Oryza sativa
aacatttttgttagtctccaaaataagtacacgatagccacgagtatgtgcggggtaaccaagaaacaatccatcggtagaacgtgcctcaaatttgtccaaatttccagatttcaagacaaagcatttgcaaccaaaaacacacaaatgtgaaactttgggttgatgaccaaatcgaagttcataagaagtttttccaagtttagatcgcaagaaaacttgatttgaaatataacatgcagtgttaatagcctcagcccaaaattttctaggagttttatattcatccaacatcgttctagtcatctcaaccaaaaacacggtttttcctttcaacaacaccgttttgttgaggaacacgaggagaagaaaattcatgtttaagatctctttcattgccaaattgttcaaaagaagcatttttaaactctccaccattatcacttcgaattctattcaaagaaccaggaaattcaagatttaatcgaagaaacaaaccacgaaagtgttgaaaagctttgtgcttagttgccataaagaaaacccaagaatattgagacaaatcatcaacaataccaacacataccacttttcttcaacatattgcactctagctggaccaacagtgtccatatataatagctatcccggtgcatccgtcatcacagaaacaataggagcatgtgaagtagaaaccatcttagcataacgacacggtgtacaaaccaaatcaaagtttaggcaaactacgaacaagatccaaaccacttaacctagtgagatgatcaaaatcaacatgtccaagtctacgatgccaaaacatcacatctttatcaaacttagcaaccaaacattttatcacaggtgaaacaggatgttcaaaatcagctttaaacactcttccatatcgagaaatattcagcacaaaatcaccacgagaatcaaaaactttacttccagttttcttaaagtgaacctcaaactcttcatcaacaatttgtgaaaccgaaagcaaattgtactttaaatcctcaaccaaagttacatttttcaaatcaaaattttcatttaccttaaccaaacctgtagcgagaacggtacttatagaagcatcaccaaagataatcgattcagtcttggatgcctttttaagggaggagaaccaatttttatcaccggtcatgtgctgcgaacaaccggaatctacgatccacacgttctccttccttgccaccaaagcctacacacaagcagaagtcgaagcctcagtactggggttagatgataataaaaatttaggagtccagtactgagacacacgaccagaagatccaataggcatatatccacgagcaaaatcaattttagaattttcagaaaaattcctccgatgccagtctgaccgtagtacagtggccggtctgaccgggggccggtctgaccgccgctgcaccgacggtctaaccggtgtccggtctgagcgaggctctgcagccggtcggacccgtcgccggtctaaccgcggacccactgcggtctgactggttttctcgagggaaaaactagatttcgccactttggttttgcaaaagcatctctctctcctttttctgtttctgagctaatctgaaacaaaaaccaacaatatgtccatctttgctaaaaaaaaacaagtatatttttcacgatgattagacacattgatagcactagaagacttagca

SEQ ID NO: 71973 - DNA, 9442 bp, Oryza sativa
actaccctcgtccacaaatatagtcgtcaaaaatattatatttgtagacgaatgtagtaaattgcaattgcttcagacattgaaaaaaagagtgatctgtatcattttccttcccaagaaaaactgagaaaatcaccaccaaatagacaagttcagaactgcaagatcaatacaaactccatcgaacgcatgattaacagaatgtcagtcatccaaatggaaaaatagcagtccaaatgcatccttgtctgattgctcgcttccacaagaacaatcacgtttacaacaggtagaagttaatttagcagtcagtgtcagatagggtccccgccttgtcctttgttcaaattaacgacaataggacgtgaagatcactacaaacggccaatcaataacctgtgctgccgatccaagaattagggtaaatttgatctgtgacagctaagtttatgaaattatcaaactttatgcagttaacttgtaactagtgtccctgttgatccaaatagaaaatatttatcatatgttacaacaaacaggaggcagacaatgccaagagttgatactggataggatacatggccatggccttacaggtttacatgaattcctacctttctcctacttcgaaccagaagaaaacagaactgcgagaatagatagcccgcacatgttgcagcgccagtgttccattagtcctgacggccttcgcacccccctcaatgcgggtgcgaacaacagttacaccatgtccttgctccttgagtgatgagaacgaatcatactcaatcgctgtgctaattatagggaaggacaaataatccagaggattttgctcgcactggagcaagcactcctcaatagttaatctaccacttcgatgaagcaaacaacacccaagctctgctctaatagtgagatttgcaatcttgcaggtggaatggaactccaacgcactgctcagacaggcaagtggaaggtattaaaatcattgccgctttgacgaaacattagaaagaacaaaaaaccattgccacagaagaaaaatgcatacttgtcagagccacgcgaacatgttaacactgtgtcgtcaggaagctcacccccgccaatctgacagtaagcaaatgacaagcgtaagctcaaagttgcatcaacaacaaaaaagaattgctgtgtaatgcaagaagcatttcatcagaataccagatcaaactttcactcttgagatataacaaacatgaatggaaaaacttacaatgcagagaggcttctttatttggatattacgtgcaacatgtgtgccaccagcagcaattagaatagtatccccaggcctttaaaacaacgcaaataaaggtcatccataagaccataaccccctctataacataatgaacattgaacagtcagatagaacacggacctagctgcagaaacagcagactcaagatttggatagactcctggctctattgtatttctgattggcctctcaacacgcaaccacagtcgaggatggcatgcaaggaagcgccatctgtggcaaacgagggcggtgttatacctatctgcaggttcaaaaatgaaatgctaaaaaaagctcatttaaagtacataaacagcgtcacattatcaggcaataaatggtagcagggacaaaatcaagcacgccaacagtgagctaaaggtttgatatacctagaaatagggacaagattgaacatccaaacttaccaggtggagtgttgctaactctaggggtctaccgatcccacagtgaaggcagatatacaacaaaattatttgttttcatataaaacctatttcatcaatagagatgtaaatagcaatatttagcatgaaatttcggtcgaataaagcttctaaaactcaaaagatgcaccttgtagcgacgttcatgcaatttatatgatttgttcacccattttggcaattgttgctattgtagcgatgttcaccagttcatgtgatttgttgtctactggatgagatggcaataactcacatgaacatttgctccaatagcagcaatgccgaaatggatcaaccatcagtttctcaccctagaacctagaacaacacatcagctggaccattatggtattgcggttccacgatctcactgtgtaaagttgtaaatccaagagtaatcaaaccatgaattcgcaattgcgagcacttaagcaaaccctacgaatcatcccctggagaaggtgcttagtgacatcttcatctattagacaaaattaaatttcactacaattacataatagaccccatactagaacaatccagcaaaactccaatcgagctaaagcctaaagcaggtctaaacccccaattttggcccgttcccatttcccctccgtcccaaatcctcgaacattttacattccccaaagcctacgccaccaaccgttcgcagcaatttaccaatcggcctcaaattctcccataacaagattagggtaatcgtaagactacgaacgaatcgaacctgggattgggctgaggaagctgaagatgtgcatgaggcagccgtcgtccaggctgttgaccggcgcctcccccgacggccccgccgccgaccgctgccgcttcggaggcatctctccgaatccctctcccccccagtacggcgtgcggcgccggcggcgagcggcggcgcggtggcctgcggcgagcgcgaggtcggcaacggcagctgcacgcgcggcacgggggatatctcgccgcctcgacggatccacgattttttccgccatcgcgggccccacctgtcagatggcggttggtcgggcctgtccacgtggctgcctccgctgcgtcggatgggcttggactagaattaagccaggcccatattgggccataaaagtggacgaattacagtctttaggcccagttaactgtttgggtttttaatccttttctttttttggctgattaaaatgcagatttcacatagatttctgtcggtatattttttaaattgttgaattttctgcaaaagtattttttataaaaaaatttattcgcacgtgtcaaacaaacgcatgtgaatgcacggtgttttcgactgaaaaacatacttcttccgtttcacaatgtaagtcattctagcatttctcacattcatattgatgttaatgaatctagatgtagattcattaatatcaatataaatatggaaaatgctataatgacttacattgtgaaacggagggagtatatagtatacttcgtacgattgtgtgtgagtgcgaaaaatgtggttacggaaagctttactccccttttgtgttgctcccccacttgcatttgttgtgatccgattatttgtaattaatcatgcttgtgagatgcttgtgcaaagtgcaaataccatctttgcggactaatgtgataatcagcatatgtgcattggtgcgattattctactgcccttgctttacaaactcgatacacgtacaggttgattctttgctattgtcgcgaagaattagagtatgttttatatataaaagctttgctaaagcttgggacaaaacaatagtaatgcagatcacgagttcttgaatgaaattttgtaggaaagcttaatgcctaaggaagttagctgtgcagcacatatattcatcagtgatttgtcatttgtgcaaagtgctgcaaatgtgcccataactttgcaagtttttctccagctctttcgaaaaatccctgctctttataattcctagtactagcttgactgtccatttgtccgtgtaatctcgtgtcgtgtgttcgccaccattgccactcagagcgcagagaagagatcgatcgatcatgtccatcaatgccgtcccgagccccgtcccgtccgcctccgacgacgccgagagcctcaggaaggcgcttcaaggtgcgtgctctcacatcgccattcatccatggcagctgcgttgcgtgtcgtcatctagagtcaatggtttatagctatacagctgttcgtgaactttggttgaaaattagaattcaataatttttatgatcttattataccgtgggagtttttattagtttttgtgtgtttttttgtttattcgtatgtgaggtttttattgaattgatgtaataattggctgtggatatttgagtaaaggccagaactatattccattatatgaaaaaatccatggcaacttcctctctggattcttcgactcttcgtgttgttcttgctgttgtcgtacagtgcgacatggacgcatggtgacgacgcgtgttgcatccgcaggatggagagcggacaagggcgccctgacccggatcctgtgccggcgaacggcggcgcagcgggcggcgatacgccgcgcctacgccttcctctaccgggagcccctcctcaactgcttccgctacaagctctcccgccattgcctcctctccctcgatttctgggtactactaagctttgcctgatcttccataaacttctctcttctgaattctccaaatgctgtatatatttttttttctcaatcttgagatttcttggttcagaaagccatgatcctgtggacgatggacccggcagaacgggacgcgaacctagtgcacgaagcactgaagaagaagcagagagacgagacctactacatgtccgtgctgatcgaggtgtcgtgcgcttgcaccccggatcacctcgtcgccgtcaggcgcgcctacctcgccctcttcggctgctccgtcgaggaggacgtcgcggcgtcgccggcgatccaagaacctctgaagaaggcaagccaagatcacactgcaactcacaatctcatatcatgttcagataagttcagagaattcagacaaggagacttctttttttttccctaatcgatcgttgctggtgtgtttctgatctgcagatgctggtgaggctggtgagctcgtaccgctacgagggagatgagtgcgtcgtcgacatggacgtggtgaggatggaggcgtctcagctggcagaagccatcaagaagaagaagcagccgcgcggggaagacgaggtcgttcggattgtgaccactcggagcaagtcccagctcagggcaacgtttcagagatacagagaggatcatggttcagacatagctgaggtatatgataactttgataagattaccaagcaaatcaacagcatcatcatgccaaacttgataagattaccaagcaaatcaacagcatcatcatgccacaagataagcaaaaaaagatgaagaaaacgtgtgatcttcattgctgtcttgttctttcaggatattgacagccattgcatcggccagtttggcaggatgctgaagaccgccgtgtggtgcttaacatcacctgaaaaacactttgcagaggtgaattaacacctaaaaacccaactcagattagcatcgggccatctttgtaatcacagtgataattaacctgttctgttcttgcacatgctggttcaggtgatcaggcactcgatcttgggattggggacgtacgaggacatgctcaccagagtaatcgtgtcgcgtgctgagatcgacatgagacacatcagggaggagtacaaggtcaggtacaagaccaccgtcactcgcgacgtcgtcggcgacacatcgttcggttacaagggcttcttgctggcgttggtcgggagggaggactgaagaacaacgaaagaagtgttccaatgcattggtatatgggaatgacatgtggggtccagacccacatgtcaatgtgacatacgatggtatttcgactttgtgatttttgagatgtaccaggcaaattgggacaaataaaggttgtgatttaataagttgttggtcactgatttgcaaaaaagacagagaatggatttcacaaaaaccttttaagacactcaaaacgcaaaacctaaagtttcaaaaaacctcagggtttgggggtgaaatgttacaagaaacccaaatgtttaagcttacaatgtcatttttgctagtatatttatgcgtaataattaaaaagaatatatgagatattcctagcctcattttaacgagcattattacggtattatgattaatgtttgtccatataagtaaccggtcaatatgtcattattagtatgattgtgttgtatttttttcaatcatataatgcaaaagtaagaaaaaaagacgaagtaaatgtgatgggtatgtattttgagcctactaatgtaaacatatccaaaaatattatatttaataatggaattatgagtacgtgacataaacatgcgtttcttgaaacactatgatacctcaaaacctggggttctttgaatcaaatcataatatgtgttgttttgtgttacatgtgcttcaaaccctggggttttctgaaatttaaggatcagtaaaatttagctagaaagattttgcaaatagtaacaagggatccatttgcaaagaaaatatatgggagtaaagtggtacagtgaaaattcatgagttttcgttctgtaagctcgtctggatgggcctatacatcagtggcccggcaatgaggcccatccaatgcaggcccaccatcgagtgtcaggagtcaggaccgctgctgggtcccacattaaacaagcggctccaaactggcatctccgccatgagtccatgacacgtgggccccaccctttaccgacagagagcagcaaagctcacgaaattttacgcctcccgctctccgtttcgaaacgctccccattcccccatccttctctctctccacctaaggctcgaatcgaagccgacctcctcctccgctcgccgccgccgccggcgtcgtccgcggcgagatggcgccgcccttcgtcttcccctcgaccctccgggacctggagcgggacggagacggcggcggcgacgacgagccggccctccgcccgcagaaccccgtcgccgtcggcgcactccgcgccgccgacctcgaggagttcgtcaaaggtataaaacccgctccccaccacctccgcttcctctcgaaatcactccatcgcttgccgtaaatcgatggtttggttgtggcgtgcggtggagctgagattgtttctcctgtatcgttcgcttcgtattggtggttgtaaagtgtaaaccctagttcccgttaatttggcctcccgcgctctactcctagtttggttcttgcatgtatttaagacccaattaaagtcaaatccctgtgattctgtggaataagagttgtggactgttgatagacatttttggcgcaagattttgctgcatttagcctgtagagtcatttcaaagctaactattgcaaggcatatcctttttagaattttttttcatcttgctccttggccattttcatcgaagtggattgtttatttgttttgcttttagaatctgcagctttggatatgacagggtttagctagctcatgtgtagtaatggaactaacaattgagtgttcttgcttttgacaaaaggttcggcctctatttgtgtcccacaaaaaaaagttttttcttctacatgttaaaattcgttagaccagggagctttgtggcatgtagggaaattaatgcacatgtttgtaagaaaaacatgcacattcatctgtgcatctgtaaatatttcaaactgtgaaatgataccatccttacctagctctgggctatgaatgccttttgtaagtttcatctccattcctcttcctggaaaagtttgtttttattttaggcattcacatcaccaaaactgacgattcattcaaggacatcagacaaaaagttttagtcccattcatctattcatccaaacttacaaagcttttactgggctaaaatttctcaatgtgcattttgtcacaaactagtgcatattaagcttaatgtaagctgcatgtggtttgttcagcaaagtattcaatttatctcacaatcaaagtactaactcttattgaatcaattttgtaatattccaccctgtttgaatgagcgtgcagctgtgcattttacatcgtgtatcttttgaaccaaaggttttctctgaacgagctaattctttctttcattttttttcttaaattataggcacatcgtttgacctgtctgacaaggaactcttctgcatcgaggagcaggacgtgtttgaccgcgtctattccctcgtgcgtgacttcacttgcttgccccctgccctcaagttcaaccttgttgagaccttgcgctccaatcttagtgttctcctcccaaacatagactccctttcacgagcttccatgtcatccccttctgatgggatcccagtaactgatcgcattgcttcgcatcggaatgcccttaagatctactccttcttcctcctctccattgttgttgctgaagaatcgggagctgatagttgcaatggccctaaggtaatacctgtgcaaaagttacaatttatttggactctttgtacccttctaattttaactgaacttattatgccatgtggacttaggtggcagtacatggtcggaagaagaatgctgtatatgcttggaattgggaagcacaaagaggccgcatcatgaatcttattgctaattcacttgaagttgacctatcactattgtttggtccaggcggtgctgatgaacaatatctctcttttgtttcaaagtaaattcaagaaactagctgtgttatgctttctgtattcattccttatagagttatagtgatgttgctttggatgaatatgtgtaggtgtacttttgttctctgtgagaaccagaacgtgctgaaagatgaggaaataagaaatggcttgtgccgaataattggtgcaattgctacgaagcatcaaagagtatctcaaacaagtgcatctgtcttgcatttgattcataaatttgatttcactgtcgtgcttctagcggaatcagttgctgctgcagagaaaaggtttggtgatggaagccttgcgattttgctgataagggaaataggtcggactgacccaaaagattatgtaagagatagtgccggtgctgacaatgccgggagattcctagtagaacttgcagatcgcttgccaaagctcatgtcaaccaatattggtgttctgatacctcattttggtggggaatcatacaagattagaaattctcttgttggggtcttgggcaagctggctgcaaaggccttcaaagatgttgaaggcgatagtgacgcccattctttaaggctccgaagtaagcatgctatgctggaaattttgcttgaacgttgtcgagatgtgtctgcatacacgaggagtcgtgtgcttcaggtatgggcagagctgtgtgaagaaaatgctatttcaattggcctgtggaatgaagtggcatcagttgcttcgggcagatggaggacaagagtgc

SEQ ID NO: 71974 - DNA, 1248 bp, Oryza sativa
tgtgtgtgtgtgtgtgtgtgtgtgtgtgtgtgtgtgtgtgtgtgtgtgtgtattcatgatatcctataataattaagaacctttgcaagatatcagtgttaaggaggtagattccctcaaagtcgactttgtatcaaccacatgcgatggtgcttggtgtgcctacattaagtctcctgagattttaattctaaacttgtcgtatgtcaagtacaaatggactaacacatgtgaagtatgtacgctaacatatgggactccatgcgtaccatttgaaaaaacagaaatataatacttaatgtatgtacatcaaacttgtcgtatgtcaagtacaaatggactaacatatgtcaagtatgtacactaacaagaatataataataaaaatgaagaggattcggacgaatagtggtcatatcatatcttaaaccatattttttaagcgggtgcatatagtgtacagatgcggattgtttcggatgtcggaaatagtgcagagtctgttaggaaacggattaaatttatcggatattacgtgcgtataaaatcaatacaacatcaagttagcaagcaaggaacaataatataataatcaataaacaacccatcataataattatgtgtttaagtgctaaacaatatgaatacatcatgtccataatataaaaatacagctacacaagggtgacatgagacagtaaaagcctcggactgagaaatctatgttaattgatgaattaggctattggatggaccaacttatgttatatgcaatagatagagtggttacatgttttgataatttcggattatctggcaaacgacctatcggataatttgatagaaaggtcggataatccgcatccgccggattttagagataccgtatcctcatctgcgtctgcatcatactatccacatctacatgcatatccgccggatttctgaaaccccataccatattcttatttcgaacggattcaaagcggatcaaatcagatcggatcggatattacccaatccgttttcacccctacacattactcagagattgcatcattaccgattttttttaatctgcaaatagccattccagctagcactgtatggccgcaatcacagatacaataatatattttattttcctttccacacacacatacacacacgcatatatatatatgtatatatatatatgtatatgtatatgtatatgtgtatatgtatatgtatatgtatatgtgtata

SEQ ID NO: 71975 - DNA, 7493 bp, Oryza sativa
ctttgcccctgtcactctcacacgctcacttactccttaagcctgagcattctggtgcatttgcatatttgcattgcaccatccagctagcttccttgggctagtttagaaaatctttctgatcgctagcgcagcttcttccaaaatcaaaaactttcttaaacagttcagtattttctaaattcaaaaaaatattgtagaattcataaagtaaactaaaagtcagaattttgctttcttagcttattcgaaattatcactagatggatttccatcaggcgtttctcagaatctaaagcgactgacccaaagaaactcttggtctctatctaccctgcttggtgtgtgttgatggcctaaccatcaagacatgaaccaaccccgtgacactaaccaaccctggtctttgataatccctacattgattaacaacaattgattgatcaccttaggtgacatgacgacgaaaaatgatgtttatttgtatgggttagtaagcatcaactgctcctggggtttaactaatcaaggtgatcgcttcaccggcactctggtgacatcacaatatcgcatgatatgattttcagtgaaaagaagtcgtttttatgtcatctctatctatactttgcatttttttccaataaaaatcagttgttttccgttaagattgtactctgtacgactctatagaaattttgtgcgctagggcccatatggattatggcaatggagattttcatgattttatttgtccaaaatgaaccacaagtacgaagaagatgtatcgtgaacacgtggatatttatattgagtcttgtagtataagtggcttgtatttgctcccttctcaaataaatgtagttagtcaaatctcaaaaccttaaataattaactaatataaaaatattaggattttacatggtaaaatgatttgcatagatttattatgaaaacgattttaatatagtaatattcttaatagtttttatctaaaaaaataaatatatagttataaaaggtaataatgaaacacttgtattggatactatgtcaatgtctaaatcgacaagtaaaacggaacgggtagtagtagcagttatggtgaaatcacgtcacttgcttagataatccagaatttgactcctacttttatttctacgcgtttgtatttaattttgaatttgaactcatgacctgtgaactgtaaacctcaataggaatataggatgacctagtaggcagaactaagtcagcatttttgtttttttaaccacaaatactgactaacattaaccggcgttttttttttgtgaagctatatagggatcataactttaagatcgcccaaagcttaaattagttggatctgacaaaagtggcacggattgctacttcgtttgtcagcttcgtaggatccattgattaattagcctgcgtcagaaagttagctcacgaaaagtgtactccattagctaactttcctttctccaaaagctcgcattacaggacacttaccaagtgctcacaaagtagacaaaaaatttgttggtgtttcgttttttttcctctctcctttttggtgtacctagtttcaaacaggagtaacataattaatttcaaacagaaggaacatattattcagcatacgtgtacacggcatttagtagatacagtcatacagagtactacttggttgagattagtctagttggtatcgtacctgaagaatttggtaccggcaaaacttggattgaactgatgtgtatcttccatccttctgaaagtgtattatcttcaagaagagaattaagattgcttagtggtactgattaagctcgttcttaaagcattatgctgtccaggtacaatgtgttttattatagggatgctaatgtgatgttacataggatccgacttctgcattactgctagctgtgcatgcatgcagctcaaaccatggtctgaaagtctgaaagactgaaactattcaacgagtgaatgcatccatcgtatctcctcttatttcttctgtttttgaatggaccctagttctttttgccgtcatggtgttggttttgagaagatgcaattggtgggttgcttggtcaaatcgaactgagatggcttggaaacccctcaaaaaataatgtacacatggacccatccccaatgctgaaaccaccttccagcctagcattgccaactcaaactaggaactccccaacctcacaaaccaaaggctatgcccacacaacactagtactagaatgcaacaaacaatactagctcaaggatagactaacatattcctcttttccatttttttttgcgaggaattgataaactgacttcactctcattatatttcgtcaatattattggtattcaaaccagcctttacaaaaccacgtggttacctcatgatttaccgtggtaaccatgcacgaccggttttttaaaacctcacattttttttcttggttatctcccgataaacacatggttaccgcattaactgggataccatcaattagcggtgaccctactaaatttgcaagaaaacttgatacaaacttataaaaagtgtatttcgtcaataaccatcatatgcgtggcttgaaactaaatggtcttcaatcagttacacaatataatttcttaccaaccgatatagatagggacatgaatgtaaattaggcttctccagaaacacggagatgataacacacgatatatgattccgaccgctaaaaagacatatagcactaaacagttatataacaaaaccatatggacagatttttcacattttgatgctctctaccgatcgatggtcccaccaaatatgctggaagatgttccatcatcagtgatgcttcttgctggccgggttgctctagcatagctcaacctctaaccgccactagttttttatactcttctctatagccatttaagctctctccctgcagcttctcacaatccaaaaccccaaaaccttctcattttttttgtagaccaagccaagctacagccaaagccaagcatggtgcaacaacagcagcagcagcagcacagaatctacatcctacagttcaggaagggcgagcaggatcaggaggtcgcatgcaaggtctcgacgccgcccaaggccggcaccggccgccgtgtcatgtactactaccacgactacggcggcggcggcgccggcaagaacggcaaggcggcgcagcctagggcgttcagcatgcgccgcttctttgggctgctgctgctgtcgttcgtctcggttgggacgctgttcgtggcgcccgtgtcgttcttctccttcgtgcactccgacgagggtggcggtggcgcggccgcggcggcgcggcgtgcggtggaggtcgccgcggcgccgtgctctggcatggggaatgatagcctttgctgtgaccggacgtcgacgcgggcggacatctgcttcgcgcgcggcgacgtgcggatgcactcggcgagcgcgtcgttccagctcgtgtcgtcgtcgtccgggaacgcgacggcggcggcggtggaggaggagaggatacggccgtacacgcgcaagtgggaggcgaacgtcatggcgacgatcgacgaggtgcggctccgtcgcgtgcccgccggcggcgcggcgcggtgcgacgtcgtgcacgacgtgcccgccgtggtgttctccacgggcgggtacacgggcaacgtgtaccacgagttcaacgacgggatcctgccgctgttcgtgacgtcgaaccacctccgccgccgcgtggtgttcgtcatcctcgagtaccacgactggtggatgaccaagtacggcgacgtcgtgtcccgcctctcggcgttcccgccgatcgacttcaccgccgaccgccgcgtgcactgcttcccggaggtgatcgccggcctgcgcatccacggcgagctcaccgtcgatcccgagaagacgccggagggcaagagcatccgccacttccggacgctcctcgacgacgcctaccgcggccgcatccagtacctcgagcggctcgagcgccgcgccgctcgcagccgcaagcgccgcgccgccgcggccaagcccaccaccacctccatcgccctgccgatcatggcgcctccggcgaagcaggcctcgccgtcgccgccggacaggcctcgtctggtgatcgtgtcgcgcacggggtcccgcgtgatcgagaacgaggcggacgtcgccgcgctcgccgcggacgtcggcttcgacgtgcgcgtggtccgccccgagcgcaccaccgagctgtgcaagatataccgggagctcaacgccagcgacgccatggtgggcgtgcacggcgccgccatgacccacttcctcttcatgcgcccgggcaaggtgttcgtccaggtcgtgccgctcggcaccgactgggccgccggcgcctactacggcgagccggcggcgcgcctcggcctccgctacgtcggctacaagatcctccccgaggagagctccctctcccgcgagtaccccaccggcgaccccgtgctcaccgaccccgccggcgtcggcaagcgcggctgggacgtcaccaagaaggtctacctcgatcgccagaacgtccgcctcgacctgccacgcttcagggaggtgctcgtcggagctcaccggcacttggtcgccggcaagcggcggcgccggcaaagagagagccagtgatcgagcaatcaatcgattgatcgtttgcttgatttgacccggtttggttaaccaaattaactactcccatatgctgctctagctctctctctctctctctctacacaatttttttttgctttttttttcttttcttgttgttactcaaacactgacttgacctgacaattctttgcattagattgtgaattgatgtactttgtggttttacacgtttcagttctatgaacttgatgtgaatatatactcaataaagatatcaaattacactgcatctgtacttaacaatatctgaggtgtgcaaattttttttgcaatcttctgtggtgatatctcagatggtttttagcatgcaaattgcagagacaagttgatgcttgcaggacaagaactttgaacagcttgctgacataggaggatctatctgaaactcatgcacggatcactacaaatttttggaactttggcaggttcaggcgcgctgggatagagatggatgctaatccccgtgtttcttatcctaatttccagcctggattgggtttccggttggttgaaacatactaatcagcttttgtttagcgtcaataaagactgctaattagtggccataaagctatctacctctacctaagtacccatcacacacttggacagctgcaacacgacgccactacacagtgagatttagtgatcgatagatatatccatcgatgcatgatgaacaccttcacctacaagttctactccaagaaacggctagctttgatctaattgcgaatacactcatcaaccaccaatgttttttcaactctggatgcaaagttgaacggaatatttttcttttttttacttgcaagttagcaacaaccatacctagaattctacaaagctaataataaattaaaagaagtgagatgggatatagatagtggtggcaacggtcagtggaatctcaccatcagatagataattccaagttgcaggcttgcagttggcgatcactgttccttatcctcctcgttctggaggcgaaaaaaggctatcatgcgtgctcaattaccttaccactatctagttcaaatacactagcactagtgaaaatttagctgaaatgataattccaaagtgtgaggttgcccaaatgacatggacgtcgagacagggaatatggtcactttgggggtacacgcacgtacgctgagccgctgacttgaggttgaaggtagcatctgctacgtctgattcgagccttcggttgtgtggctcgatttgttgctgtgaagacgacgacgtacgtgcggtatgtgcagtttcactttcagttaccctcgcaagaatgcctttacttctactgtaccactacttgtgctacgtttgttgtgaaaccttaactagggccgtgtttagtttttaaaattgaagagaagtttgaggaaagttggtagtttggaaaaaaaagttgggagtttacgtgagtaggaaagttttggatgtgatataatgtgatggaaagttgggagtttgggggaagtttggtgttaactaaacatggcctaggaagagtattactccctacgtcccataatataagggattttgagtttttgcttacacactttgaccactcgtcttattcaaaaaatttatgcaaatataaaaaacgaaaagttgtgcttaaagtactttgaaaagtaagtcacaaaaaataaacagtaattccaaaattttttgaataagacgagtagtcaaacagtgcaaacaaaaactcaaaatcccttatattatggaacggagggagtactacatactccttccgtcccataaaaaaccaaactaatatcagatgtgacatattctagtactaaaatcctggatatacctatgttcaaatttattatactagaatgtgtcatatcagtcctggtttttttttttggacggaggaagtaggtttaagatgtctaaaaatttattaatttgtagtcgcctaaaattgaagtgctgtgtgatgtggaattttagttcattctatatggttttacattattttatgtaagttctatttttttaatgcaagtttgtaaatttctatgaggcataaatttcatttaatgtacttttgaaaatttttacatgttagaagaatttattttcaacaaccgggaagtggtatttaatactcctactaggggaatgatgaaaaccattagattgatatcaatcttttaaaaattaggtgcttttttttttgaaacaaggtgcctaaaatgtaaacagacaataaacgtgtgaaaactggaaaagaaaagaaaaggaagaaaaagataatgggctaaaagcccacgagcgctcacttgtagagacggatggaagacccagtgcattaggcccacaatgctcgcaaagtattttcccctcccgctccgctcgtcaagcacctcgcaatacgggaaaaatatgtagagtaaaatacattttaaattttaatggtagtttttagattttatttttgactagaaaaaatgctcgtgtgttgctcactggcgctattgacgatggtggtgatttcaactcttggagggtgttgacggcttcggtgcaagaaagaagaccacctcagcttgttgtgatgactaacatgcctgtgagcggacgcaatgttgacagtgggaatgccttcacattggtagatcggtagagaccatggcgaaatccgggacggcgacacctgtgggcgccgttctcttcttggagacgtcttattgcgctttcccgt

SEQ ID NO: 71976 - DNA, 1436 bp, Oryza sativa
tcgactttacgcctaccatggggacagatatttttgcacgtgcattaatcgttagcaaacatattatcagttaatattggttttgatttcattttcttgtaatatttgatggaacattatatgctgtcaaatttcatttttctaattttcaagagtatttaatttggatgagaataatataaaaaaagggatagaatatatatggtttaatgtgatatttttttaatcaaaatatcgttgacatattcatatttgtaaattttctatgaaaaggcgagagggtggaccgatcgtttgtatatcaatttaattttttatttaagaattaggcgggaaggattaatattttcgttagtggtacgtagtctttacaaagtacgtacaaaattacctcctgccgattctgaccttcttctcctatgtacgcatgttcgtgtcatcatgctctggtactggccatgttcaccacgttcgtacttaggcaggagattaggaggaaggggttgactttaaaacaaatataatttaatggttaaaataattagtccatatttaaaagtgttggatgtattttttttctaagaatacaccagtaataaattaacggatgcgttaggatggttgtataggagtgtcaatatatatagggcgtgttcgattgctcgtatctaggttggctcgcatcgtgggagcagagagatgcatgtttggttgcctgctcatgtgtgagagcctgcacccgtgggtgcaaaaagcatcgcccagcaaggatgaggagggaagcttaaatcaaccaaacaaaatctccaataaaaagtatatgtaatacaatcaatcaaacaacatctgaccatagcgaggttgatttcatacagataaccaaacagttgcatgtgtatgtccttagccaggcccaactctacctggatgagggagatgaaccaggctacgtggatacgagcaaccaaacagccccatagtgacttaggttctgtttggcatagttctaactcttaactccaagttatctagatatggagctatgtcaaactatacagattctttattttttggaacgcaactagcacagctcctccacaaaattatactacaggggtagaactgaatttttgctgctccactctatttcaaaagacccactaccctttaatttttttcatgtatttacacgatataccactgaactaccccttcacacccctctcctcatgttctctatcctccccgtcttcctcccttgagccctagagcggtgactggcggcagcggtgttgatacgaaaaacacacactggcctgggagatctgcttagctcctgtgcaggtccaaaggttgatgagatgcgagcgtgccagtcagtttgatcctgcaactgacaagatatgtaaacagtagatcaaatagccgatcggctg

SEQ ID NO: 71977 - DNA, 2818 bp, Oryza sativa
gaagtcgaatctgctacgcgtttgcgagctcggcaacaatgactcatgtaagatttcgtcttttgcgtttcgctatggtgtggggttttaagcttttcgatctacacggtttgtcagtctagcttgcccttgtctcaatgagtctagtggtcgtaacgtaagagctgccgtgttgacggggcgcgacgtgtggcaacgatgatatgagcctagttgagttgtgcggcgcggttttgattgttgccctaaccctggtgtttcctggtgaagttggagttgcccaatcggtgttggtgtgatgacgacaacaccatagctgtgtcagtgtgtgggggccgtatgtttgtctagtttgtgccttgttagcagctttggttgggtgttgagttctgctgtcctgttctcattgtcgtggtagcttagattagttggtggtgttgtgtgacagttacggtttttctcaattttccctaattaactgtgtattgtaaggtttggtcccgttctctttaaaatggagcacaatcttctttatataaaacgtcggcaaaggcttgacaattaaaaaaaaaattgcatggatctcccatccacctagaaactggtgagttcagccttcagcccaaattttcttcagtatccatttaggcccacaaacgcatgagtatttgcctcaggcccaaaattttatgagaattggccttgcggtcagaaacacgttaaaataactgatttgtccaatatttcttgataataaaccttggacataaacgacgcacacattttagatcaggcaaaaaaacatcaattttaaccaaaggcaaaaaattataccaaaagggcgtgtatgttagccttccacacaagaaaatcatggtttatcctttattccagaagatccagaaattttgccattatagcagaaacagatgagtattagccttggctcaaaaaatttcaagaccagtgagcattccatcctaaatttcgtgaccattagccttggggtcaatacattagatttctgctcaagatttattgattattaatcttgttgtgcacttgtgctaaaaatgcacaaatttagactcggtataaaacatgatattttttcctttggcctaaactttttggtgctaacctagagcctaaacatgcataaattgtagcctcttacgcagaatttcatgattattaacgttggggtaaaaattgcatggatctgccatcagcctagaaacaggtgagcgttggcgttcaaaccaaattttacattcggcacaaaaattcattagaagcctttgatgcatattaacataggcactctgtccaatttttcatgattattcaccttgtacataaaaatagataaatttggactctgccgaaaacacatggattttaaccatcagccaaaattttagcccccaaaaacgcatgtactttctctgtttcatattataaatcgctttaactttttcttagcatgtacttcctttgtttcatattataaatcgctttaactttttcttagttaagctttaagttcataaaaaaaatatatagtaacatttttaatacaaaacaatcatatttaatgttacaactaatgaaattaatttagtattgtagaggttgctaaaattttctataaaacgacagaggtagaattgcccttctgcacaagaaaaccatggttcgtccaccattaagaaaacacaaatgccaccccaagcacatggccctgttcttttctccaacaaaagttggattaaattttgaatactcgtggcacgcttttcaaactgctaaacgttacgttttgtgcgaaaactttatatatgaaagttgttctaaaatatcatattattctatttttcaagtttgaaataactaaaactcaattaatcacgtgttattataatcttattttacgtaaaatatttaatctttatcttcgtctttcagcacattcatgctacctttgttggcgaccctggtacgataaaagcggctcataaacggcgcattcattagggacagacaggtggagtaggagaaagaaagggggccatacaccacaccacagctcaaaagccaagtcctcctcggctcgccgctcgcggcgcctccctctccttttccgtctcctactccactccaatccctctccggactcggtctctctcccccactctttttcagtttttccccaccaaactcgcctcgccctcctctcttccttcttcttcttcctcctccgagtaccagagcgcacgaaacccctctcgaattctccgctctcctcccgccggtgaccccatccgaccgatcgcaagccatggccgccgccgccgccgactccgccgatcccgtcatcaccaccgccacctgcgcgcactggtaaccttccggtctcccgctaccagtagtaatctgtcatctgccattctgctgactgctgcttgtttgtttgctgcgtgctgggtagaggagctatgtagcaatcccctaggacttggctttcttcttctatagggcatttttttttcaggctatggtttacagctacagctactatgggagaaggcagtgtttagggttcttggttaccaagctggtatttttactgtataagtgacatctctagtctgtacctgatatcatggttgctttgcattctcagtaaggcctttgtctaattctctaatgatccgggaaggaaaactggaaaaccccctgacagtcaatttcatgtacatcagcccggcgaaaaaaaaaaaaaacgattacatgtacattggcccgggtgaaaaaa

SEQ ID NO: 71978 - DNA, 627 bp, Oryza sativa
tcactctgtctcctctctcattatcctctcgcgctcgagtgtgtgtggcgagtgccgccggcggtggccatgaacagtggtgggcgcggatggcagcactgagcggctcggcagcggacgccgacggcggtgggtgtagcccgcggactgagctgttcgggggcgggcggatccacctcggccagccttgcaatgggcggggggcggcccggttgaccgtgaaagcggaggatccctcaaccttcccatgaagcttcgatggcggcctgaagcgaccacgatgatgaggaggcggccgggaggggcgccaccggtcccgagcgcacgccgggcggaaccgcaccgttctggccaacgacgatgaccaggaggaggcggacggtgccgcaagcccccgggcatggatctacgcccgtccgctgccgacaacgaggaggcaacggcggtcgggagcggggccgtccgtttcgggcacacgcgcgccgggcggattcacaccggtgccgtcggattctaggggtcctttttttcgaaattttattttttttgaaatctatttttccatgccggcgacataacccgaccgcacaccaaaatcgaataatcccgcgtgggctacttaaactg

SEQ ID NO: 71979 - DNA, 10744 bp, Oryza sativa
ttaatctatactgtcatattatgaatgcagatgatttgctcactttgccaaaaaactgtacaacgtgagctatgggatcttcataaaggcttacaatgcccacaaaggatgcttgcatgccaatattgtgactttgaactacctgcagctgatatttatgagcatcaggtatagttgtgtttcgcatcagaagttactattctgcaaaccaaacaaccatccatcttctttagaacatcactttctaattatactagtcacttggtacaggacgtgtgtgggaatcgaacagaatattgtcagccttgcaggaagtatgtcagactgcgggaacagattggacacgacatccagttccattcccaacccattgttgcttcagaatcttcaaggtaaaagcatgcttctaaattatgcattctattcatttaagttgacatggttcaatataactttcagttagattagcattctttaccagcaaaattagtcactgatacttcgtttgtagaaactggtagatatagtaaggaagtttagcttaccttgtgatagtttaaatttcagtgacagaagcacgctggaagaagaagagagttatccagcagaagaacaaccagtacgacccaagcacactcatggcttacaacgcaagcaatttcttgtcacaattgtgatagctggaatttcaattctggttggatcagttctgctaaaaaaggggtggttatcatgatatttccaacataaacatgaatttgccttcttaatgtgcaaattccttcgtagcctatgggcagggcagagatccttgaactacagtttgaagtcattgtaggaatgacctgactgatatgtttttttttaccagaaggtatttctacatgctggcagctggtaatctatgtaaaaatgttatttacaagtacgaggcttacttttacaagggatcaatgccatctgttttgttgttgtcttgttgatatgtttgttacagagatgctagttatttgattgtggattgtaacaacttacctttcaactgctataatatttgaacgtctccaatggaaggggtagtgcatggaagcgaaacaagtgcttattgcacatatgatttttattcaataagcgtagcaaaatatacggtgcccatgctagaatgggatgctatgtcatcctacaaacagagctaatttaggggagatacaaaccaagttttctggatgtatctagcagttaacgttaaataatgtcaatcctaatatagtagagacaagtggcagctataaacaaccacaatatatatttatctttcttgttggaatgaaacatgtttgcctgcattttcagctattgacagttgcttttcttcaatttacttgcggtgaatagtctgtagttgattggttccatatcactgattataccgaactgcttgttgtagaagccccatagctcgcacctgtttcatcaaggaattttgtcagcatatcagacacatgtcaacctaaataccacggtgtatcagaaaggacgtaccagtatgccaagaactgaaacggggcatacttgccgtagatattatccaattccttctgaacagaactgatggtgcttgctctcttgtgaaactgcagcaaatttcaggcaatacatgaacatgacatattgaaacctatcaaccttagaaatctcaaagcaagatactaggagaaaatatacctgctttaaatgcctaattgtctcagtgtcagctgggatcatgtggaaaaatcccatacacatgagcacattggcacgagtgaaagggccaaatccggatattgtggataactcttcattcagtctatcataggtggatggggtagttgataggccttctacagttggtacagacattttgcgtatttcttcaagcttttgtaggcatatctttccttctacaatgcttcgtgcaagcattacaattcgtctggctcgatatccaagattacaacgcttcgccaaaaagtcctcatcaaggtttgccaattcttccggtgtaggaaaatctccaccacaatcttccaagcaaagttcatatcgcaatttaagctctgaatgatccaatgagacctcagatgtgttgcctgtttcatttgcagatgaaggcaagctaaataagttttcgtttgctgtgttagttgctagatttggatcctccaggcataccatcttatcctcgttaaattttgtttctagcttcacacggacattccgcttattgctgcgcttccttttacattccctgattggaggcgtccttgactgaaaattttcggtgctagatgaagatcttagctccaactgaagctcacacagtgcagtagacattgacaaggtccttgtccatctgcagttgaacagcacggttgaatgcagctacaaatactagaaaacaatgcacttctgatgcatcaaatttcatcaatgttctttacaattcttaaacagtccagctatacccactcattcatttgcacagcacttatttcggaactcttcttatcctatcttctttttatctaagaaatgtttcaggcaaatagtagtagcaaatattcctagcgaagcaaaacatgaggctgataaccagttcttatcaactgtgaacacgatataaattagtgactgcattgcaacaataccaccgtataggatctgttaatttttaatctaattgtcagcacacatgaaagatagcaatccctaaatatcgcgacatgtttgtatcagaatttcgcatagatgtactagcaagggaaggcaaggggagaggaagactgaactggcaattgcagaggaggatgcacttgatcatgtcctcgaagagcgtgggcgagcggaagatgcgcccgaaccccacctccctcgccacggcgtgcatcgcctggaactccgccacggccctcccgtcctcctcatccagccgcagcatccgccgcacttgctcctgccaaccaaaccaacgaatcaatcaatcacaatcagcagggcgcgaacacgaaaaacggatgctaaacccataccaaacacttacgaggatggaggtctggtcgagcggggagagggcgtcgtcgtcgggcgcgccgaggacggagacgaggagggcgtcggaggggcgcgcggggtggcgggagacgcggacggcgacggaggcggcgcggtcggaggcgaggcggagcgggcgcaccagcgcgcgcgacgcggggtcccagcggttgggcgccatcatgaacagcccgtggctgcacaccgccgcctccaggtcgaacggggcggcgccggggtagggcggcgcgccgcctagcgggagctccagctccagctccacggccacgcggcgcgcggcggcggggtcgccgccttccggggacggcatgggcggtgattggggaggtggggatcggggcgtggtcgagtgatcgaggcagcaacgggggttcgcatcgtctgactactgtagcgatcaatcctgtgcattcgcgtttgatccaacggctggaaatgaagaatggcggagagtgctgtagctctctgccattctagttgccatggcagagtatacgttcccagcaacgggcgggtcgctgtttcgctcttgtgaagaagctaatgggaaaccattttatgagcagtagcaggattgattgggcaatgtgcagtgcggttgaaggcggtttgggcttttggtttttggatatacatctatttgtgtctagttctgtagttcacgctaaaattagaagtttggttgaaattggaacgatgtgatagaaaagttgaaagtttatgtgtataggaaagttttgatgtgatggaaaagttggaagtttgaaaaaaaagtttggaactaaacaaaggcttagagatttggctgagctttcttgaatatgttgaattggagatatttgggttgaaatgtactactaagtagtttgtatgtgaaattaaagtaaactagtgttgtgtttagttccatccaaagtttggattttggttgaaattggaaatgatgtgactgaaaagttgtgtgtgtatgacaggttgatgtgatgggaaaatgcaaagtttggaggcaaactttggatctaaacacaccctagattgagttattttgaaataaataatgaaactgatgtcatctgatatttaacttatacatccgtttgtaaaattcttatagtatcgtcttgtaacttaaacaagtctgttttgtatagttttaactttatcttcatctctcctagagttggagtttaaccaaatagttttggtttcactcaaaaagggagtagagcaggtcgaagttttctcatagaataaattatgaatgtgaagtgaggttcacggtactctataattttactctagattcaactcttggcattaaatttagaaactatattctatatcgttattggagttaaatttagaagttaaagcatgctaaacaggccatagaaagcaccaatgcttttataattagaagattcataataatagaatttcctacacatataatgtttacggaatcgttatacttctgttgacagaaaatacatccccaaatcttgcagattttggaccactagatgtgcttcacgattcgtgctccagttgcatcttctccaactccggcgacttcttcttcttcggcgatggcgacaacccaaactccggcaaagggccgacgaattagggtcccggggtgggggtgggaggaagagggaggagttcgccggctttagagggatggccgtgggaggcggtggatcgggcaggcggcaaggcggctgtaccgctgccgaagcgcggggtcgagagcgggcggtgggcaggggcaagcggaaagagtgttagaaggaggcagccggtggtggcgccccaccgctggcgacggggaagacggcggcacgggatagctcgtcgccaccggcttgtggaaaaggagaggagagggagagggggccggctgggggggcctcgccggcgccgttgacacctttcagccagtcggcgaggccgggtggcggcacggtggggcggcagcggcggcggtgtaggaggcgcgcggtgctgagaggaggggagcgctcgagtgacttgtgtggtggcagggaggaaaaaggaaaactggttagggttttgtggacattgcacgaatctcaaatcaatccaatgttctgaaattcacaagatattaggagggattttctgtcaaatgaggaatagacagttggtttattattccaaacacaaaaaagaaatttacagttactagtagggtgcccgtgcgttgctacaggaaattttgatcacgggaaaaaaaaatctggcaatccaaaagaaactacgagttgcggcggccggttgtgtgcgggccggcgggtgggcggcgattttcgcgtattttttaaattttttttgctcttcgattaaatcttcattgcccaatcatttttcaaagaaatccagtgatgggatgcaatcttcgaacttacattttttagcacagcagatcaatattgacaaggcaggaagaaagtgactcaaattttgagctatcattgtgttgttatattttgatagtatctgtccagccagatggtttatatcgggaacaaagatcttcctattaaactttgaggaaaaactttttaagaaattttgcgattaacaactaacaaacgctcaaattctattattttgcagaatctgcctctagttgagctggtctccggcagacatacaatctcaaggcaataagtatacatgttgtaaattaaaattaaaatttctaggtgtaacaaaattatcacccttttgtatcctgaggtttattcacatgcaaagcaccggagttcaataaaccatgaagatgcttctttttttactttagaagttgtttctaacctagctattaagttcaatatgtcactatggtcctaaactgatcagtcctgaagttgttctttacactccagcaatgcttatagatgtctagttgattacaacttgatttttactccacaaatttggcatccatgaaaatgtcctctctaattgagctatattaattgatcatttgtagttggggatagaaactttagaaaagttgattgaatacccagaatttgtggggactacacccacatgctttgcaaatcaattctatctgctatagtgtttccaaacatgtattgtatatttccaaagtaccaatagaacagtaccaatcagaccaaatgacaaaatgaaccgtgaaaaaactgatactaaaactaatttacatagaaaggcttcttagttttcaatcacagaaaatgaatgcctgtcttagtaatgcaaactccctaatcatctaatttcactgaaaggtagttggcattgaagtggcatatggcacaaaaggccaatcaggatcatcagaggatggcctcctgattaccttgtttgcatcccaacagtataccaaaggcatagaacatatggatctctgtctataggcaaatccccctatgttatccctgtcagctgcttcaaataaaacagctatatcagtcctgtattatgtgccatttttgcacatgatttagctgattttggagttctccagacagtaaaatttataaacttgacaaagtaagaaaccccaggcatctgaaactaaaactaaattatataccattattaagaaaggaggaatgtgatcacaaaacaaaacacagaacaaggaggaatgcgatcagtttacctagagcagcaggctaagttagtgtcagatgcgatgcaaagggcaaagttgagaatttttttttaaaagtaaaacagcaagagcactttatgtgtcaccttgctttatatggcttcgtctgaactttggttacctaaattgcaccgcatatgcacttttctacacaattaggttgagcaaaagctttcagacctaaacaaatcagaaactacacaagtattcacaagcagagttcagttgttcagtaatctatctccaagagtcagttgttcaggtgttgcagtccaaaccttttgcaatgatgagaaatttgattagttgcatacattatgatatagttattgtacttaaagtcaaccattctcctcaaatttcatgcactttcacagctattacctggcaacttgacagtccttctgagagagaagctcgcaacctgcaatctataataagcatcagaaaatgggattgcaatttggcatttcaaagttcacacttatagtatatatatactccccccatctatctttgatcagaatataactttgtgaccagttgtattgcctgtgatttctgaaggatgcaacagagcactatatcaccctcaatggaatttttggagcagagaatacagtctgccaaaaagagaagaacaaagacaaattagaagaaaggatgcaacagagcactatatcaccttcaatgggattttaggataatacagtctgccaaaaagagaagaacaaagacaaattagaagaaaggatgcaacagagcactatatcaccttcaatgggatttttggagcagagaatacagtctgccaaaaagaaaagaacaaagacaaattagaacaagattgaatccccaagccaacacaatacacgtgaactcttggtagatgaagaaaccgctaaaagtggaaattgtatctcgtcgatgcagccatatccagggggagctcacgaatcctacggtggcggcgtcgagaggcgaggcggcaggatgaggaggcgacacaatgggggagtgatggctgaacaaatgcataatagccattgataatttaatatcaggattatttacattatgctggagacggcaatcgaatgagaagtccatttatataataaattttgcgtcacacatgcacataatctgatttcaattatctcactgatgtatgctattagtgggagagaggaaaattaagctgcaagtatatataagcaaaaagaaaactgctcaccgagtccaggcagacttgtcgtaggccatgtgtgtaggcagatcgagtagtcgatcaggggaaagggcggcgaggccttcccggcgttcggctgtggaggctgaatgttttgcctctagcttcttatcaaaaattacaacgaagatcccgatcgaccggcgtaggggaaggcgatgtgggaggagaccgatggctggtgatttgggaagtcgcccagaagctggcgtcggcgatctggaggcggaaatcggcggccgcacgatgacgacctcaatggcgatacgaggcggcgcgatgacaggtcgccgccggcgtcgcgagtcgatctagtggcggagatcgaaggcggcgtcgacggcgttgcgagccgcgggcgacgatggcgatctcgaggagtagtagtcgccgacggaggtgggtgggcagcgcgcgtggcaggtgtgcagaggagtcggcgtcggcggcggggaggagaaggagtaggagtagacccgtcggcgtgatctggagcggagtcgacggcggcggcgttggcggcggttgcgggtgggcagcggcagcgtcgccggctggggcgattgggcgaggtgaggaggcgacgtagggaggagggcgaaggacgcggatccgagagaggagcgagcgtgggaggagatcggtcgttggatacttgatatgcaaattggatggttgagattacgcgtgtctgtcagatgcgtctgctatgtcaggaatcaagaccaccactacggattttttaagtagtagagatatattaaactctatcacatatcgggagatacgacaagttatggcagatcataggtataacaagttactagtccatacatcaggattcctaaaattatatgaatttatgagaaattacgtaatgctattctcaaccatgcaacctggaaattcttgaccgaagaatgagacaggtcgatgaaagctcaacgcctgaagggacaacggtgaggtgggggcacaaccaaagggttggaaacgggagaaccaaccacctctcgcccagccgcgacaccgcaccccgctcgcactcgcacgtacgcgaaggaaggaagaacccacactacccaccccctatccacccacccatcctctccctctcctctactccacaccctccgcttctccactcctccctcgcgatggcggtcacgcgcctcgccgtggccgccgccctctcggccgcgccgccgtcctcccgccgccgcagggccttcttccatcactcctgccgcccgctcccttcgtcggcggcggcggcggccaaggcgttgcgcgcgtcggctgcccccgccgtcgacgaggaggcccccgcatccccgcctccatcaggtgctcgcgccctcgctctctattgctccagatttttttttagattggactgttccgagtgttcagtccgcgccgtgcgagctcgcttgcatttgatctgatgctgtccatggagctgaagacgatgatttgctgttcgtgcagatcttggcaagggagtggagaacttggtgatcataggctctggcccggcggggtacactgccgcgatttacgccgctcgggcgaacctcaagcccgtcgtgttcgaaggctaccaggttggtggcgttcctggtgggcagctgatgaccaccaccgaggtggagaatttccctgggtttccggatggcgtcactgggcctgatctcatggacaagtaaacattgctcatttcttcgcatgtttttgagtttatctgttgttaatgttgtgttcacttgctcatatcgggccatggattaaatcagaatgcggaagcaagcggagcggtggggtgctgagcttcaccaggaggatgttgagtttgtgaatgtgaagagcagaccgtttgttattcgtagcagtgatcgtgaggttagcatcattgtgctcttcctccttttcgagttatgaactttccacttttcacaaggtgtcattgttggtttatggtaatacaatgttcttgacaatagcgattttcacaatgttcttgacaaaagtattagtatgatttaaacaaaactatcatccatttaattaagaatataacaaaggagagctggtcaagttgtgtcgggaaagcatatcagtatacaatttttatatggtttacttaattagctcttacaatatttgcctagtcatgtgctttagttctttagttgtgctgtaacttctctttctataagtataatgaccagtttgatatagcatatagcagtcgtctgttataattaatagtgcacagaactactttggacaaatgtttttgctgcgctcatcccagtgagtgtcctatacaggtgaaatgccatagtgtaatcattgctactggtgctgctgctaagcgccttcgattacctcgtgaagatgaattttggagtagaggtatcagtgcatgtgcaatatgtgatggagcatccccactatttaagggtcaagttcttgcagttgttggaggtggtgatacagctacagaggaagctatatatttgaccaaatatgcacgtcacgttcatttacttgttcgaaaggatcagctacgagcatccaaagctatgcaggaccggtaaggaactttcaagtcctatccctagtaaatgtatatatttaccttcaagtgactactctgttcatgtaaatatcttgcc

SEQ ID NO: 71980 - DNA, 4627 bp, Oryza sativa
atactccctttatttctttgatcaatatgatttagctccattttcggttttccccacccaacccctccattttttttattctggtttgacgtcataggcactctaaatgctggcccacacaaaagcccaaaatagattcaaacgaacggcccatagaaagcccaaaacacaaaattgattcggcgtttcaattgtgtttttgcttctatttttatcttgaggagcaatgcagtattttttttttcttacacaggggatggaggcccaaaggacttgtaaaataaaggaaaatgcccacccaaggtctctcaacttgtcatcgagttacaaaatcgtctcccaaccataaaaccagatataaaacatccctcaacttacaaaaccgttcactttagatccttcggtagttttgaccccggttttacctgacgtggttagcgtgggacccacatgtcatgatgccacgtcatcaccctcatccttcctcctttctctctctctctcacatttctcctctgggcaagccgaccggcggatgggaggagatcgccggaggtgagtcaggagaggaggaggttcggcggccagcgacgaggtggaggtagcggcggtggctgcgacgcagaagctggccaccgcgcccgtgtcggacgtccggggtgaagacggcggcggaggcggccggaggagagccctctcctctagtcctcttgaggagcacagccggcaggggaggagtgttgacgcggtgggtgcaccggtggctagtgggggaggagggttgacaaaccaagccatggcgatttgacggtgaggtgccggatagcttaagttgtttgttcagacttcagagcgccttgagcatctcctcgatgctgctggtggtgaaggcgacgccttccttgaggttgagcaccttgaccacgccgtcctctaccaggaacgcgtagcagcgagaccggacgtcgtgcccagcaggcttgtcggggaggtcgagctcgacgcccaaggcgtgggcgagctccccgttgctgtgagagaggaggagcaccctcatcacggcggcgaagaaggcgagccacttgaggaaggtggtgccgaatccgacttggggcggtgaggtcggaggcaagagacgaagaggcgttgagttgcgatccaagttcatttgcacttaataaagtccagcttctgccggagcgaagtggagaccctgccggacatatatatatctcttataagccgccgtgcggcgttgtaacctcaactcaatatagtgaagatattttgctggctggcacccgtggttttttctttcttactttgaaagggttttccacattaaatctcgtgtcttatgtgattgatctattgttatttatcatttgtttgcctatcgtttgctaacaagagggaggactttgttggcaactttttgtgacaagtcgacaagcacgatcgcaacacctaaacgccttgcggtgatatggagtcgccaaccaccttgatctagccaaagggccaaatcaagatgggttttgtgaaaacagctaaaccggctagcgaagccgatttagagatcaaaatcagcctctaggccgatttagatcgatatgaggataactacccgtctcgtgggcaaaacggaaggttttcaggacaaacctacaaagaggtgtcgcactctcgcagcggcggtggacggtttacggtgcaaaccgacaaagatggactaaactagggtaaaatagaaaaacatggtaaaagaacgattcaagtagattgtatgcagggggtttacaatataatgaaccggccttgtcccttaaatagaggttggtcttgccctctacaggcccttctccatgtccaactcaggatagaaaccaaagaaaacacgaaacctgccttcccgagcaaggaaacccgagacccgacgaaaacagactcggactcagaccctgacggtctgtccgcccacatacctgcggtcagaccggccctactagccggtcagaccgcccacacacttgtggtctgaccggccctgtgaaggaaacccgtcactttccaaactttgacaattttttcctatttcgtccataggtgtcaaatttgggtgtaaacagacttcacacttggagccagatctgacgacacttcacacatggagctcgtgattcagcgtcgctggaccagcgagacaagaagcggtgggcgacaatggcgcacgcgagcggcgttgcttctcatggcatacgcgatgaagtacagcacaccggagcgagcaagccaagggcatggtccttcccaagctagagaatcagaaaatgccgctccttgtcctgattttcttccttgtcctcggtgtactttaccccgcggcagcggccaaagagtagttcatcttcaacgagttcaccagcacaaatctcatcttcgatggcatggtgatggtgactctgaatgggctgctcatgttgaccaacaacacaaacaagcaaaggccatgccttgtactagtgcctgccacttcagttccacaagatgcccaatagcacggggaatgcagtccttctccaaggccttcgtcatcatgttcgaggaaatgagcaaccacggcatggcgttcatcatcggcgctcggctccaatgccgcgcggctgctgctcgtggtggagtccgcaaccgctgctcccctccagctcccctgacgacggcatcttggtgcagctcgtcggagttcatcggcgggaagataagagagggggaatgaagacggagagggaggaggcagggccagcgagctcgcccactctgcctgacgcagtgtggggaggaaaaaggagaaggagaaaggaggaagtagacgaggatggcatgtgggcccacatgggccatcaatttttttaattattttctagtgtgactgacaagtgggcctcatgttttttttttagcaaatgccacgtacgtgccacatcaatgacacataggacaaagacctagtcaaaggagccacgtagacgccacgccagccaaaaccaggaacaaaaccacacagggacctcatttgtaccggttttaaaaattgaaggatgcgttatacctgtttttttttcagggacgattttgtaactcggtgacaagataaggaatcttgggtatactttttcttaaaactaggtgaaaccccgtgcattgctgcgggactttagtatgataacaataaaaaaaataacgtgtaagatagctagataatatcagattaagtaaattaatgtggtttatgataatttaaatttaaatagtatgtagaatggtgattcaaatgtaaaaagtaaggtggtatgtctttatggaagaagaaaagtagggagatagtttggaccatagattaatcatctaaaggctaaaaacaattgatgtgatatgacttaattagaggaaaaaagaagaaagataatttggaccatagattaatcatttaagcactaactaagtgaggatgaactatataagtatgtaggatatcataaaacattataaagatatacattgaaacattatgtgaattatgttggatgataatttaacatgtttgtatttgaaaagcgcttaaattataaaaactataaagatatagcatatttgcatgatgtttaaatgtgatgattgttagtggatgatgatgtggcatcttgttaattagtggatgatgatgtggcatcttgttagtggataatgatatggaatatttacatgttaagcttaaagagttagtgggggataattttatagtaagataggataaagcataagcaaaccagtcaaaaggatcacacgggggcttttttttttttcacagtcaaaagatccacacagtggcccattttattgcacaaggtccatataaataagcccaaaatattaacaagagcccgaaacacatatatgcaaaggaaaaagtacaccgaagttccctcaacttgacatcgagttacaaaatcgtcccccaaccgtaaaaccgaatacaacgtatcccccaacttacaaaaccagtgcaaattaggtccctcggcggttttgaccctggttttgttcgacatggcagctgagtcagcgtgggacccacgtgggccccacgtgtcagtgtgccacgtcagcaggccggccactctctttctctcctttcctcctctctctctctccctctctctatcagccttctctctggactgggccggctggcaggcggatggagaggaggcgtcggcagccggtgacgcagcggcggcggccggggcagcggcgacgacgacgcgagagaaggtggtggcgtccctgcgtgtgcgagctcgggaacggagcagcccaggaggcgggagaaggaggccgacgacgggcggggaaaaccgaacgagctccctctcgcctccgacgacgacgagctccgccaagaacgtcatccctccctatcggcggctgcgatgaggtgcgcggcgtcggggacggaccacgctgagcggcggaggccggggcggtcgcctagccaccgcgagacgtccaccgccacgggcattctggcggcgccatgagcccacaatgaccagcaagaggatgggag

SEQ ID NO: 71981 - DNA, 19632 bp, Oryza sativa
  unsure (1)..(19632): unsure at all n locations
cagcaatcccaaaggccagatgtctggtattcaactgaagagaaccgacacgggagaggaatcagttcttgaggtgaaaggtctattctatggcataggacacactccaaacagtcagttgttacaaggtcaaattgatcttgacgatgctggttatattttggttgaagaaggcacagcaaaaacatcagttgatggtgtatttgctgctggtgatgtgcaggtaactccatccttcacttcatgtatataacttctacatggctgtaatgtgtttcattcttgaaatttgaatataaccctgccacagttcatatgtgccataatcattagcatgtcatgtcttggtggtcttgtagcacaccagcacatcacgtcttcttttattgaacactagctggattggaatacaaatatgagtattctagttttaatgccttttcaatgtttatctgcaggatcatgaatggaggcaagccgttactgcagctggatccggatgtgtagccgctttgtcggtggaaagatacttagttgccaacgaccttcttgttgaatttcaccaggtactatcttgtctgcagcatatatttctttatggtgactgatgcttctgcgaacattatctagctcaatatttgttgttccatggaggctagctgttccactgtcaaattttgtgcctatgattactggtacaccagacactgcagcaatttctgctgttgatctttttcctctaattttagggtttctagttgccatatacagcaattctgtgcagaccatgttgtgcttttatttcatgtataaaatttgaggttggaccttgtcagcatgtattggtattgttatgtgtaatcgagaatatatttattctagaaatgtgaaaggatgaaactaaatctatttgtcattgtatatgtatcgatcaatgcacatttagcatttttaattgaccatctctagcaaccggtcaggcttacaagatacacttcatctttttattaaattacagcctgttcgcgaagaaaaggagaaggagattacagatagagatgtcgagatgggctttgacatttctcacacaaagcataggggacaggtacctaacacatttgcttgtactgtggcttcatattggtgcaaacatttatgtgaaaactgatttgagcttgcttcctttgcagtatgcactccgcaaagtatatcatgaaagtccaaggcttgtctgtgttctatatacttctccaacatgtggtccttgcagaaccttaaagccaattctaagcaaggtttgttcttgaaattgaaattgggctctagtcgtcacaagtcatcactctagacaaataaaatgccttgatatacagctatctgattggccctccagtccatcgatcattatgcattcatattgacaggccatgttaacgttcatttctctgatctaccaatatgaccaatcaagttcatttctctgatctacaatatcgaatcattaaagaaaatccatttcaaggtgctaactttgtgatgttcttgtggtctggacaacacaggttttcagtgcttcttgataaaccttgtagaactgatatttatagttgcttgactaacatttgattgccgcaccattctacagaagttccgttctgttagtcatgcttgtgttagttttgttgttaacgttgctagttgctacttggcacttgctaatattgatatctttttcaggttatagatgagtacaacgaacacgttcattttgtcgaaattgacatcgaggaggatcctgaaatagcagaagctgcaggcatcatgggaacaccatgtgttcaattttttaaaaataaagaaatgctcaggttggctatcttggatttgtttatctgctactagtctatataaacatcagtcacttcattgctgcctaattaatatgatgcaatggaatcccttctgatcgtttttaaccttggactatgcaggactgtctctggtgttaaaatgaagaaggaatatagggagtttatcgagtcaaacaaatgagctgaacccaacatacgattcaaattttaaagtgtaatagtcttcttttgcccatactgactatttctagctgccaccgtggtggccaatttttggtcaaaaattttcagatgggccgggtgtagtgcggttcaagaggaaattagccggtcgctcctattgaattcaatcaatgtaacagaatatattcttttgctgtacaacaacgtattggtcgttgtcttgacaccgtgcaaactcctccctgacaatatatacgtcttaaagattttggacagtgtgtgatctatatgctgaacataatattcatatgcttatagtgagcttgctggaaagataccctgacataaaactattaaggcattgtttttggaacagggaaattttacattaaatttatagaaaatggataggttcatgtgaaaatccaatgaaattaatatgtttgaaacgagccttttctttgcgtagcagagcagaggatggttgtttgggaaagcttctgtggcattgcagtttctttcaaaatctataactcttcttaaacagtcactgttcactatattctcagaatcagaatctactacagaatctaaaaatgaccagctcaaaaaactataatttgaagataaagctaaagactccagaaaataagtccgcagggccggccgaacactcaggagaacaccacgtttttccagtctcatctcatccttacgcgccgaccgggcggccgactccgccgccgccgccgctccaaaccggcaaccaaaaacgagcggcgcacggcaaaagcaatcacaaattcacaattcacagctcacctcggcgaggcgccaagccaagacgagacgacgagtcacgccaccacgcgtcacccttccgccgcgccggtgcctcctccagaatcctcctccgttttatccccacccaaaaccggcgaaccacccgcccgcccaatccccgcctcaaataaccccccctcgccgtggcccccatccccaacaaactaccaaaaacgaaaaaaaacgtaacaaatccgcacagccacacgccacgccacgccacggccaccgccgccgcgcgacgcgacgcgaacccggagaaaacgggggcgaaggaatccgccaccgcaatggaggccgcggcctccccgtcgccgcccccttccagggcgtcgccgctgcggctcaacccggccgcgttcctcctccgcaccaccaccaccaccaccaccgtccagccgaccacatctgccgacgcgcccccgcccccgccgccgacgcggcagacggccggggtcgaccggctcatctcgttcctctcctccctaatcccccgccgcgggcagcgggcgaagcagccgaccagcccccctcccaccgcggcggcggcggcggcgatgcggagggcggcggagagggaggcagaggcggagcggcagctggtgggtgcgcggtgccgctgttccggccgtacgtggcgcagctgccgtggcacggcggcgcgcgggcgtggctgtcgcggatgttcccgcggtacgggcactactgcggccccaactggtcgagcgggaaggaggccgggtccgtgctctgggaccgccgccccgccgaccacctcgacttctgctgctactgccacgacatggcctacgacacccacgaccaggcccagctcctccgcgccgacctcgccttcctccgctgcctccagagcagtcgccagacccccgcccgcgacggcatcgccgccgccgccatctaccgctccatgtgcatcttcggtcagtcaccaatccaatccaccccttcttgtttttcttccccatttctctgttgttcttcgcccaaatcatgcgaagaatgcatcgcattgcgtttacgaatgtgagatggatcgatggatgattgtgcagggctcaagacgatactgataccgtaccgtacgaacctggtgcggctgcaaaccgggccgaattacgccgacgccttcgccgatttcgtcaagagggtcgcctcgtcgtcggggaggccgaccggtggcaacaagcagagaatgtgagagcatttgtgatcacaatggcgcaggatgaatccaactaattggaattggatattcagccattcaggtcgtcgtagtagttgtgtatagctcaagttttgattcgaacccggcgaggcggcgtcgcggcgaggggattgtttgtatcctgttctaatgggtattagttgatgagaatcttgggatcttcactgtgaatatagcttagcacatgatttattatatcaaaatgtagcctcccttgatatcaaaattcagaatcaatggatgcaagtttctatttctgaaccaaaatggatgcaagttctatttctgaaccaaaatggatgcaagtatgcaacagcaaagatggtggtatgttaaggatttagcctaaattagagagcatataggcataggaatgttgtactagtatctgccaaggaaagacatccaggcatccagcattccggaagatctaactaactttagagaattagagttttgtcccgatgggcttcagaaatttacatcatttcagtttcagtcctacatatgacatcctgaatcatcgtaagttcgtaactaagaaggctttcagcgatgtataaatatgcttgctgctatgcgaagaacgcatgttggttacagaacaaaggctatgttaaagctcttcgtatttcatttgatcgaagcattgttccgatgggcttcataactcagcccaatttccagggatcgctaatctatcagactatacatgaagacatttcgtactagtaagggtatatataaatggcatgcacttattcatacagtttgcacgtatgagttaggatctaatttctcacataagcatgtggaaacaatctggggaagtaagtttgctttgccttgacaatcgaccaatacagaaagaagcaagggatatgaacaatggccatggcgaggtacctgcagaaaaattaatggtgttgtcaggacagcaaagttccatggatggtatggatgaacagatgagaaaacataccatagaggagcccctgacgatgaaaggtcaagaaatgggtatggccacctgaagaatatggaaacatgattacaacgtttagaggtaaactcaaaaaacattttcttgtggcgtgcaacaacacacgagcggcactaaatcttaatacaaagatacgcaagtaagtattccccaaaaaaacaacacatgagccgttgtttcaaactcgcactcaatatgcacatatcagtatgctagaatagaaatataagggttctttttgttatgactcaactttaccaattagagcacaacagctttcatctctttaataaaaattacccctaaacttgatcagaaggtggttcatatatgtacaaaatgtcccaagagatgcaataaatttcgctgagaagtaggcagggtcggtgcagtctatagatatcctgggttaattgccacatggtcacatgttcagaatgcacatgtccatactccatatctcttggataaactatgtcatatgggcatgctcatgtacagctcattgcagcattctataaaaacctctccactttttgttgtattttttgtaaacgaatattatagtgtgagttcccccttttcttaaagtaaagtatcaaataggatttgaatacataaatgacgctctaacttttgtatttttcttagtgtatacttaataaaatggcacaatgaaggggaccaagacattccattacattgctttagtgtaaacggcaggggagaacctaccaggatatagctccacaagcatgaaggacccattggaaggttacataggagcagctccaaaatacaaagaaagccaggcggtaccaggggaagggctgaaaagagtgaaagcaaccaggtgtaaaataatcacaccaaggtaaaagaaagaacagagtgattttgtcttaccatattgttgagaaatgtgtctatcagtaaaagaacagcattaagagaatgcatgccatcagtgatctgcatgaaattttaaagaacaagatcagccaaaaataagattacatcaccaattctttatttgaccagctacaaacacctgtgctgtttattactgttagattgcctatgcttactactactatcatcttaaatgtttagcacatactagatttggatttacactatgattcttacagctcagtataacaagtaattgtttatatgccactagaatataataggggagaaaagccaaggtaggagttatttcttttattgaatagaattgatttgccaacgataggcatttggttggggggatgaacagctgaggctatacacatcctgaaatttttacataccaaggaaagtccaaacttatcacggtaaaagaatggcacaagtagtccccaaaatgtgatatcagtcagcattgttgcacctgcactagtctgtaaaatagattacaattagttggcgatagaatcacacaatttgatagcaggcatgaactcagtatccgtggtacaggtgaggagattatttttttactaggccaaagaaattgatgctagtttgtgttgagtgctaaataacatggagaacataaaatgtagctatggtagtagtttgagttgcatagccccaagcaatcagctgatgaacttgctctaacttagcacatgcactgaatatcaatatgacgtagtaagaaaacataagtgttagtattgtatctatattccttaaagcagtatcatttggatttagatttgacagtattgagtatcgtaaataaagcacatagcatgtccataattacaattctagaatgacaggtgagttcaaacctggtaaatgatttgcatgcaacgtccccataatccagctcttttctcatttgctatttgttcatgatagtttgttatcttctcctcatcccttttcatctcgccagaagaagtggaaaactcacgattttccacatcgtcactaagaaattcatgggattcatcagctttcttcaagtttttctttgagtaaacccaacatccgtgagctgatatagcagttgcaaactaagaataacacactcaattagtgaaggcatcaaatgataggcaagctagaaaagaaagaaacgataaaatagcacatatgcagattcaaaaagataaaaggtggacagacaacttgggaacaaagaacataccgcaaaatatatggtgactaataaaaaggtccacctgcaaagataattcaggagagaattaattaaagtcaaaagagcagttaggttcatctaaggaaaagggaggaaataataaaatcaagagtcaagactgcaaacaactacaagggggctgatcagctgcatgccttctaaagcaacaactaccagaatatttaaaacatttgccagatccatctatctgacacggggcaattagttcagtgtggccaaactaaaagcagaaagctccaaatctacatagcagtacagagatactgtaaacagccaaaagtcaatggatcaatgtgtggatcacttcgaatgctactatccagctatgtcaaatcactccgaacaattctcgctggtaaacgctaatttctacaccacattatagaacagctagacgctcgcgtatgcttgtatggacgatgtgtacgatgtttgtcttagattattcgaggcaatcaagcttgctcagatagtggaggaggaggacggaggaggccgtactgggtgtagaagaagaagacgtcgatgccatggccgacgaggaggcggacgaggagggcgacggcggcggcgagggcgaaggcgcggtagccgaggagccagccggggtggagacgcgcccagcaggggacccacaggtcggtcccgcggaggggcgcggccgccctgcgcagccgcgggagcagcgccgccgcggcggccgtcggcagcacgatgagggcgccgcagacgaacacctgccaccgcagccagtacgccgcctcgccgtcctccgccgccgccgacgacgacatcacccccccggcgacgcgcggttgacctttgcttgagcctcgcgtcgcgtagcggcaatggaggtgcggcgcgggggaattttggggtagttggggttgggttgttgacggtgtgcgacgctgcgactgcgagtccgaccgcgactcggcgagcgaggcggtgaagttgcggaagtagacgcggagacggagattggagggaaaggttagcattcggccacggattggctcgctttccgggcccgggtgcggttggaacgcgttaaaacggcaccgagccgtggtcgttttctcctcactcgctgctcccctgctctgcttcagttgcttcgcgcgctacgccgatggatcgggattgatcgggtggggcgtttgagtttggtggtgtgacttggggctagataactttgctaccattttttttcgataaagttacttaaaaaagtagttatatttagtttgttgctaaattttagtaagtatatatgaaatcttgccaaaattttgacaaacttatcaaaatttgacaatgacaaaacttgataaggttgaaaatggtagcaaagtgaacgagcccttgatttacgtagaaatttcataaaattcaaatcttactaaaaattttttctttaaccatttgatataaaatattggagcttttcaaatcatatgaaataactcattgcatctagattttagaggaaacttcgcaagattttcttcctacaattttcttcatgtctttctatttcattcgatttctatgtttttcccttcaggccaattaaacgatcatttttgtgttttgtcctccatttttcaattcctttgtcctgtttttctttctccgttttttcattccatcggccttgtctcgtctatgaaacttatcatgccaagcttaaccagcgtttttttggcaatttcatgctgttggtttgaagagcaaatcaggcgccaatttctattgggagaattcaaacagcaaatcaggcgccaatttctattgggagaattcaaatctaaaggtatgtttggtagagctccaactcctagatttaactctatgagttgagtctagagtggagttgtggagctgcccaaacccagctccacctctctagttcattttgtaagagagctccactcccgctttaggtggagctgaaactgtttggctgagctctagctccaaaaaagatggagctgtaccaaacagaccataactttgatgcaagtttagagtagtctcaagtctaaacaaatgactggatgaacttgcgtagatttgctgttcatctggattgagcttatgtgttctgctccaatttggagatcaccataatcaaccatgcaatgctaatccagtagatcgatgataaatacgataacatcaaggcatcgactatcgagaagctcgagggtttgtaatattgataacttacagtctcgcccatagctttcatgaacaaggtggtggattgctcagagagaagcacaatgacatctcacgtttggaaaatattccatttggtcttattactgcttacagagttggacgcataacttctcatttaccatagtcagagagcatgcacagacatacatggaggaaaaatgtggcagcagctgatatacaggcatacagccatgccatcccagcaaaacagaaataacttctgggagctagacaacgaattccatcggtagcccagcccattttaatgacagcttataacaatgtatcttctgcatcttaattaggtcaaatgatttttttttccctgggatcagtttgctgtgtcaattgtcaacattaaagaaaaccagaatgcttgtgtctcattatgcccattatcggtaaaggctggaatatatgagtatagagctcaaaaggaccttccgaaaatatcagtccaactgcaaatacagaacgccatgaccagaaaaaaaacaagagcaggtacctgccaaaaaaaagtaattttatacttactgaagagaagatgataaaaaggatacatcttcccataaaatagaaaaatatacccctattccttaatattggctcagtttaatttccatctctcaactacaaaaccgaatgaaaaacatccattaactctcatgttaagagtgaggctacaagttgaacatacaacaaacagtaggcctacatgacgaacggtgacaactataccaatagttaatcttagatgaccaaccatgactcactaggacacaagcagacacattgtctgcgggtccaaaccacctaaaacagggtaggttggaggaacaggttttaccaggttttgagaatagaggggcagattttacttgattttgtaaatgccagacaaaaactaagccgagtcaagaatcgaacgccaggaatagatattttcattaagaaaaaagaggcccaagaaaaagcagaacttacctgttaccgtttgacccattggaagctctttcttgcttttgcctttccaggctttttcctttcaacaacccgtgagtctcttgtcaaatatccagctgtttggtttaagtatgaagacataattagaagtgttggaagataatatagaaatgagaaagaatagcaaggcaacaagacaacaacattcgctgaaatagaagtcattttggatggttgctcatagggaaaataatgctcaaacaatctcaatgttcaaatgtgaactgccaatcatcatctagaggagtaagagtcatctcctttacctgctttgagatttgggcgtagtcctggttcccaattctgcaaggccctgctgatccctagccggatagctccaacttgtcctgcacttgcaaaaaagaaattcaatcagggagaatgtttttgtagcctatctaaaaatcaactagtagaaacgtgcagcgtctaatagcaaatgtgtatgagttagaaaattacactgaataaaacatattaactaaagactcaatgaatccaggcactggcattgaggtatgatactaaagctggaatccgtggagcattgaaagataaagcgtgcaaaattatgcgtgaatgaatgcctcatgtgaacgtgaaatatgacatatattccatatctcataatttacaatacagaacccaagaatttatatgtgcatagttaatgcaaaacactttcgtatagaaccagaagcaatttatcatgtctatctccagaaaattatttatcatgtcaaaagaaataaatactaacctgagacaccaccacctttcacagtacaagtaacatcccaacgccccaaagttttggtcacggtaaatgggcgaagaagatcagcccgatgatccagaattgggaagtaagaatcaaattgtttgtcattgacaatgaacttcccatcaccaggctgaatccaaacacgggcaatgctgcatttccttttccctgttccataagcccttcctttctcatcgacttgtcttacacgtgctttagcaatttcctcttgcttttggcgttctacatcagctctgcttgatgttgcattcattttttcgatagtttcatcttctatttctcttaggggaggtaatccaggaacacccctaacatcctttaagaggatcaaactagcaatcatatcctctgtaatcccagaggcctcaatgagatcaccaaatgcacgatttggacctgcaaccacaaaaaaactactttacgacatgctacaaacatatgtatgcactatggattattcctgcataagatcctacttaatagcagaaagaaaaactttgtatattattagaatcaactagggcataataaataattaaatcagtcatgaggttgcagaagcacgcagaacaaaaatcacaatgatcatgagtgaaattatctacccgattcaatgataccttattgcaattgatggtaaatgacatgaatgagtggcatcacatgaaacaaatgctggtggtgagtggagaccaacaggcacattccaacttctgcattgaagcaaattgctcctaaaacacctaccggatatttgtgatacctcaaaataattagctactgatcaagtatacaaacctggcaagctcgtcctgatacagcattgtaagtaaacaacatctaacacttacttggaataccatttcagagatttattatgtctgcgggtatgatcctatagctccaaactacgccaattcaatcagttgcataatactaattatacacacataacagcaaccgtactatgacaaattatgttactgcataaagatagatttacctttgagtgtctccattagttcttgctccctcgcccttctctctagccgttttcgctcttcctcctcctcgtcttcccccgcatcggcctcatcaatcgcagcgccatcacctccgatcccctcaagcccacccccgagcacggcctccgcgaaaggatccttctcatcctccccactcagcgtccacagctcgtcggcgcctgcccccggagccttctctccagaagcgacggcggcggtggcagcctcttccttgaagatctcctcgaacacgtcccccttctcgctgccctccgcgcggaaatccttcgcccacgggtcctcgccggcggcgctcaatcctagtggatcctcgccggcgggagcttcgacgccctcaccggcggcgaagggatccggatcgccggattccggcgtgaacgcccatggcttgttggggtcgtcgtcgcggccggacgtggagaggagccgcggccagaggaggctggaggcggggaggggacgacgaaatggaaggggagcggagacgggagaggacgaggcagcggcggcggtggctgcgctcgccggagttagggtttggaggcggtggccgaggcggcgggaggagtggaggaggcggcggagcagcatggtggcggccggaggagggaggcgaccactccgtggaatgctagggttttagcggcttaactcgtctcggtttcctctttccgcttcctccgctaattttacgtgttgcgaacgggaaagcgtattaaccagttgcttggtttcagctggagaggcgtatttcttaaaattccgtatcctagcttcgaacacgtattttgtacaatcagcttggattttgtactaatctcgacttctcgagtacgaagatctgtgtactggtatatggccgtgcgatccaaatccacgcgatacactggcttagttaattactgatctcaccgtagaaaatgcagtgagtaagacagtaagtatatattgcaaatctaaggtcaagtccgtcctgttctacccgattaatggcttgcattgatgactttaactaaccatttcgccgtcactaaagcccttacccgtactacgagtgtactacaaatatcataaattgaagattcagcaaaccaaactcggcagctttgatgtcagtatacttgtgtgtattattgtctttaaaacatggtcttaacgtgcattttgcaatggaagaggtgtaaataagatgtgagcagggttcatgttaggacagaaacgggtaaaaaagaaacgctatgcacacgtgtattgtgggcgcatgaatttgtactgtacacaaagtaagatgttctaacgtgtttgtgaaatttgaaaacatatttttagtcaaagctcaaatggttttcaagaaattgaaatttaaaacggtaaattcgagcaaaatctcgtgaaaagatgcgactatgtgagttactacaaagttgtcacacgaattttacacctgcatgaaagtagcacgaatactagctttactgatgaagagaggtaagtacaagtagtaagcatataaggaagtttacagttaacccaggtttgattggcttttacctcatgctgcggcaagatcttggtgtcactctctcacactgacatcgagaaaaatgtctgaaagctttggttccttacggatttttctgcaaaggctcgcgtcgctgctacctgaataggctgaaaagcgacaagattgaggcatccagaccatcggcatgtgaatgtactgcctcccctgctcaattgcaaaaggctaaaagcctagaaagcgatcctttttacacccaaaaaaaaattccatacacgagaagaggtggtgttgtagtaagtacagtatactagtagaacattttagcgtagttcaacgcgatgatgtgaagaatgattgcagcatatgaactgccactcatttgcgatcatattgtagatgaccaaactacagtgagaacaacttatttgcaatcatatataaattgacaagtttacaagttacctttcatcaaacaaagattctctactttgtatgtatctctttggctctttggcctttacaagcatattttaacttcaaatttcaggagaaattgaattgttttctacgatacacgcctaaagtttcagatacagattttatcctgatatgcttaaaaattcagaacaggaaagaatattcatagcagattcttcaccagcctgtcagatagtagaaatccccaaacaaaattaaccccccaattagttgtacaccagccaaaaactaaagctctcctccaaacagtggtccagcacaagcaaaatttgggccaaacctgaaaggacccctcctccaacccgacactgtagcaggtacatgatgagaaaaacaaacaaaaacaatgagagagagagagaaaagcaaattaaaattgcaaacaagaacaggtagccagcttgccaacaccactaagaaaacagtaacagcaatccttttcatctaattggtcccaaagcttttaagattttttttactgtaatcacgcacctaatcttcctcatggagtcataccttctctctctgcctgaacctctcgcctagcaacacgcaaacaagtcttgggaaacgtatttgccacactttacacttcatgctgctgtgtttagctaccaaatttaatgacccatattgatctgtctcatgtgcggctgcagtgcgatttcgcctaacttattcccaagttggctaaccccactgtcacaccatgaacagacttggttagttatttttttttctctccacagcaaagttgacaaatactagcgtaaaaccaccaaggctgtgtttagttccacgctaaaaatcgaaatttgactaaaattaaaagtttgaagaaaaaaaggttaaaagtttatgtgtgtactaaagtttttgatgtgatgaaaaagttagaagtttgaagaaaaagttgtgaactataccagacccaaatccccttttaaattcacacataatttacaccgattcacacatactaatgcgtgtagttttgcaactgagttgttttaaccctaggtaaaccctccgttacaaaatataacaaagttatgtatttgataggttaatatatataactaaaagttaatagtatattttaggatggatatattgtattttccctatttctacttatgtactccctccatcccaaaatgtttgacgctgttgactttttaaaaaatgtttgaccgttcgtcttattcaaaaaattaagtaatttttaattcttttttctattatttaatttattgttaaatatatttttacatatacatatagttttacacatttcataaaattttttgaataagacgatatttgaaaagtcaacggcgtcaaatatatttagagaatgagaaagtaagtaagtaaaaaaaaatcgtcctcttctccttccctccctcgtctatcccacctacaccatcctaaagagtactctttaaagaagggtttatctacaaaacggatcgaaaagttgatcgtattttccatatcaaattaaaccacgttcgttcgatcccgtcgtaacgcgtgagcatgtaactagtttttttttttttgaaacatggaaatgtcgttttcgttttccatcgcccgatgacaaaatctggacaggttaacatttccaaaacaaacaaggggacgagattttaaggcaaatccagagacaaaaaattggttaattaagcccagagccgggagggacagctcagcgctgtagcgtcgttgcgcctgagaagaatccgagaagctttcgttgcaagctccatcccaaggagtccttgatctcatatggctccaaactctccaactctgtagcgcgtaattgccagagctannctactattacagcaagagagagaggaggaggaggaagaagatgcagtgggtgtgagctgcggcttgcgggcgagggagtaatctcgctgtcgctttcgctgggcgacgangttgnngaggagagacacgaccattcgtccggcccccaacgcgcccacngcccaccaccaccaccacctccatgactgcatcctcctccaaaaacccaaggcacaaatcctaaccaccggacgcgagccgacgcgacgcgacgcgagtccccatccacatcgctcgcggcccttccaccgcacgccagatcggtggcggcggcggctgctcggggttggatccaatgcgagcggtgattgatagctgttgatgcgaaggacgacgatctgaggtggtggtggagttggggggatggctgcggcgacggcgccggtggcgggtgcggcggagcggcagcagcaacagcagcagcagcagcgcggcggggcggcgtcggcgagcggcaacgcggtgagttttggggtggtcccttcgccttctgctctccgattcctcgcttgcgcttggtgcctctcttcggtggtgtgctgtggctgtgtctgtctgctggattttcgttccggtttggtatctgatgctgcgttgccgccgagtttctcgccggagtggtgctttgctttggcgtgtggatggatgggtgttccactgttttggtggtggtggaatttttggttgagctgcaaggccagatggcgcggataagccaatgcagtttggttcggtggagttggtggtgtgatgaatgggtttcgtttgagaaaatcaccgtactaagcgaggagtgaggttgcagtagttgctaatgttcctgttttatttgggtttggattggatttggtggtcttagtattggaggtgttatccagatgttttagtctgagagtgaccagcggattgcatggtggatgatacttggcttggattagagttgtttaccacaggaatgcgaatcgaaatgtttgagagagtatcaatttgtcatggcgtaaggatggagggattctacagtgtcatctgcacgctgaaactggacattggatgtgtgagatgctttgcaggctgactggtgttggatcgttgtggtgccctgtgaatgatgggcttcagatatgaggtgcagggagagtgggaatccagatgagggaagtgaggaatttactggagtttttccccgttgaattcatctgtccttttacgttcatagatgaacagtctgtatattcagtggttatttggagaggcgtggtttgatttgttcactcttgctggatctctgatacataggtcccgaattgcatgtctgctagcccgagtacaagacttctgaatgttctcgttaaaacagaactttcgattgggacctgatgttgcatttttttgctattacatatttaccattataatcacagtatttctgacattgtaattctctctaactaggtatttaagagtggccctctcttcatatcatccaaaggtaaactatttgggttatgcatcagttatttccacctgtgcatatcagagcatcaccattaattttcagctatgatttttaaggaattggatggaaatcatggaaaaagcgttggttcatcctcactcgaacatcacttgttttcttcaagagcgaccctgtaagtattttattctggtccacaacctaagtaattgctatattgaaaatctcaagttatgtagacccatcagtccagaaatagtactttggtttggcttgttgatatgacggttcacacctatctagtatctacatagcactttcatcgtctctcttgatcatggccaatatgtagtagtgtgatatacatttgttttatgttgatttcatgacaatgcatgtgtagatcacaattaaacatgagtacagtatttttagagtttggcactgaatggcagaatgactaatttgctcttttcagtccaccaaatatatgagtagcatcattatattttgtagcttccttgttctggtggttacatgtgttcctttgcttcaaatatccaactggcagtgcttgatccttggtaactgcttattcatgttcttgtccatgttacacgagagtccaggtaggtgtttagtgtatccactattttagtcattgcatggtcatcagaattggcattccgggccacaggttgctgattattatttagtctagaactgaagggaagagggaggaggggaggggagaaggaaatctaaccttcataccaaatgctgctgtatgccaaagcagcagcagttgctcatggccatattagagggaggaaggaaaattctgttggggatgttggactgatagagatgcgaaatgtgatcgttggggcgctgggacgccttgtgtagcccactcagcccaccttttttattctcctttatcttttttctccaactagggccaatgggatcactcagtgcatttgaaaaacaccacctccccatcaactcacatttctagtaatctgcaaccccatcccttggcccagattcctggtgactacagtcattgccatatatttcgtttcatttattgtccagcttatgagctacaccaatagaatttgtttcttacttcttgacaagtacctttcatgccattgtagaataccttgccccagagaggtggtgaagtgaatgttactttggggggaattgacttgaacaattctgggaggtttgtatctttcattattatttatttatttgcagttttattcaaagtttactttattagatttttatcaaatttgctgcatacttcttagacaaatgatttagggcactgcttcctttttggtttaactgcataataatgttaaactaacaatttatctcattcacagtgtagtggtcagggaagacaagaaattgttaactgtcctttttccagatggtcgtgacggccgtgcttttaccttgaaggtatacaatttccctttaactttaacagcttgaccccttagaaaatacaagatgttgaattataagtgttgtgttttttaagtcttttaaatgcccttcaaagttcactagaagtgcctgctattcccaatacaggcagagacatcggaagatttgtttgagtggaaaacagcattggaagaagctcttgcacaggccccaaatgcagctcttgtgatgggacataatgggatatttcgtaatgacacaacagatccatatgaaggagctgttccaaactgttggttcct

SEQ ID NO: 71982 - DNA, 675 bp, Oryza sativa
tgaacaaatgcaattgcttaacatgacattgtgtagaaaaaaatgtcatgttcctgaaaatataaatatacacaccagtatgcatgctccatgcatcagtatgatttgttaatgcagccaatgtgatccgcaaaagaaagctagtagccactgtaatgcagaaattgtcaggggctggccattccagttggctgctcatctccttgtttggggccgtgctttgcaaaaaaacctggtgttttgtttttgttaaattgtttgtctccttgtggttctgtgcaaaaaataaaaatctaaacctggtcgggtggttatgtttttggtaagtacatggaattttatgatatttattcaatattttacttaatcagaagtagtagatcccacatgtgttcagcttttgattgacacgtaattttacttatccaggaatttgccaatcttcgtggtaagagctcgaaagccaagggaggtcctcgtcaagcaattgataatgaaagcaatggtggagctcgttcattaagaggccggcaaaaagacacaaaaataaaagaagataataattcaattaaagatgactttaagaaacgcaaggtggtggaacctgaagcaagggaagaaggtgaaatttcagaatctgaagcagagactaatatcgtcaggacaagggagaaa

SEQ ID NO: 71983 - DNA, 3951 bp, Oryza sativa
gccgcccacctcaccgtctccacgcccgacttcgacaccgcggcgggagccctcttcgcgcgccacggctgccgcatgcgtcacgcggttgaggagggtggggccgccacgctcgttttcgacgaggcgacgaggccgatgccgtgtcgcccgccgccgtattgtcgctgccgttcctctgcctcgtgggcggtggccggtgggggagcccgcgcgccgcttctccccccaccgtctgcgcgctgctcctcgccgccctgcgcgccacccctccccgccgaccatccgcgcgctgctcctcagcgcccacgcgccgcctctccccgccgcccgctcgcccgtagctcctccccccaccgctgtcgcgtcgcccatggccgccatcaccgccgtcgcgtcgtccgtcgccggccgccgacgcccttcttctcccgccggttgaggaagggagagaagaggggaaaagggagagggatgaggctgatgtggtagcctgacatgtggggcccacgtgggtgccacgctgactcagccaccacgtagaacaaaaccgggtcattaccaccaaaggactatttgtgaccggttttggttagttaagggacgttggataccaggttttgtggttgggggacgattttgtaactcgatgacaagttgagggaccttcggtatactttttcctatatgcaaactagtaaaaaagaacatggagccatttatcccacttggatcagatattagccctaaacactagacaaagcctaaagaggtgttgatgtgaaatttcatcgtgacacatgaagacctcggagatcttcttagctctaatgcaggtcctaaactttgatgagatacaaacgtgtcagttactttgattctataactgacaagaagtaaagctgatcggcaaaaaagccgatgtctatcaaacaatgccttggtcctactgaccgatccaaaagatacgtgtcagctgatagccgatagcttgatgtagaatcggctgaagatccaatgttaaatccaaatgattaaataatcaataaaacttttactactatcagctaaaaccaacttgtatataatccttataagccgatgcaacacttaaacaatatccagatgactcatcgactaaaaccccgataaaacaatgattgatgcctactgacttaaataaatctaacttacgaaagcaatcgcataggtcgaatccaacctatcgatgttgtatatcacgactatggtatttgcatggtatggggatcgttgatactaggatatatgcaagattgagataaaagagacagagacaagtatttttatacaggttcgggccccttatccgcaaggtaatagccctactcctattggccgaagccagtgttgctcttattcatcagaatcacacgagtacaatatttgggataacctatctagctgtcatcgacctgacggcatggatctccaacacgtagtcaacgacagggttgtcttcctactcgaatacgaacccaacgagatcagagattgcgctagatccctcttgttggcctccgcggcactagattgggtatgtctaggcttatctctaatgttggcatttggcggtgtgcattggtgtctattctgattgttttctctcctgggttgtactggcatcccctagggggtcttgtatttatacccatagatgtccccttatccaagtgttggcaactttttgtgaaaatttacgtgtaaacaccaagtagaactagggagacaagtatagatacgatcggagtggtccttatagtttccatatagaactctacttgtccttccttatccggaactcattctatatacgacgtatgattccgtataagacttggtataagatggaccccaccgagcttagtcgactattattgcgtatgtgttatccataaccttgacaatagcccccgacttcgatgcaaatgaacgagttgatgttctcggacgaccgagaaggtgcggagtatgcgactaaattccctgcccagccttgatcgagaatttgggttgaagtcaagaaatttcgtcttggcgggcaaaccgttgttttattccataatccttgtcgaactccaccaaccattcttggataatcgagaagctgtagagcctgcgacaaagccctaaaatctgagttgactgttctgatatctgacttttctgaaatcaatactcagaatagattgttagatagaaagagcccccgagcgaacgctcaagggtaacatgatataatgtgaatttgaaaattgaaaataaattgaatttgcacgtgacaataaaaaagtactctcgcggtcttgctagagctgccctcagtaatcggagtatggtactcttcctagtccatagctgtctttatggaaaagtcgtttttccacataggcggcttaaaatcttataataaaccaagctaaagctgcgattacctacccctagttgtgacgttgggaaaaccaattcccggttatgcggcttagttagtacggtgccatgcaccactctgacgtgaccaaatatgacatggtcatttggctctgcaatgcctgacatcaccttatccactctggcgtgtcaaactagcgtaaaaggacagtaggatcgacttcgagacaagatgatataagaaaaagagaatcaatggacaaatattgcacatttatatgcataaatacttacagaaaatgatgcaaatggggtgatgagatggctaccaccaggggccaaaaccaggtgtgtagttgtactcaatcacttcgcggaagcagtaggagaaccgctacaattgttggtcgcagaccaggtacgtaaacatactcgaccacttgaagacgtggagcgaggactgctacgccgctggttgaagaccagttgtagtcgtaactcgactattagaagttgaggtgcgaggacaactatgccgctgtcgaagaccagatgtccataacgctgccacaaccgatgcatcataaggttgataattgcctgatagattcaagcaagccaatatgaaccaaccaaagcggtcatgtattaaatttacccaagacagtaaaaccatgaaagagaaatttaacacatcagatgagattggcaagatattatgtttaaagaaacattaacttgatcagaatatcggaactaaccgagaaggtcctaactaacccaatgtgcctataaacagtaatggaactaatgatagagatgatattaccatataggcagcacttgggtcggcccgattagccggaggttgaactcaatcgatgcagcccatgcacgaaaataagaactcgtcgaaataaaacctcgcgagagggtggcgatgcgccgaaagtaaatatgttgatttgtcgagatagtttacaatgactccagatgtacatatttatattttatacccatagaccgataagagtcctaatcggacacgactcaatttgttctaaagataaacgaagagatataagttctgatcggatcctaaacgctctttcctaaagataaaaaggcagttactaaaccttgcctaattaatagataaaccaagttgccatatcatggtcttcatgatttctttttgaactcggtctattatggataagctttccatccgttaattgtgatttttccttaacagaatccaatcttaccaaattttaacattaacatgaggtgaaaacaaaatggtgggcttgttctagaccttcgaaagtggttcccaaaatagcactatggactcgacacccccttttgtttccttttggaataagttcacctaccgtccaacaactttacgtcgagtctgtatgacatgtcgacatccctaatatccaatacaagaaatcttcacccttcaaatgttcaaaaccatgcaatcaaggtcccaaagcagtatatatgggt

SEQ ID NO: 71984 - DNA, 1373 bp, Oryza sativa
tccattttcacttgtgaagcagatgtcattgtgagttttataaaataattgtccctttgaagggatgaaaattttagcacacaagaaactgaaaatgcatttgttataggttatagttgtagatacaaataaatgatatttactttctaaaatttcatgcaagggataatagtgagtcagaaaagggtcaaggtgtcatgggatatgaagtatggcagcatgaaaactcccaaataaaacataccgaaacaggtggcaacaagatatgcattgcgaacataaatgttatgatccatacgaacacaggaaatattgcactttgaaagcaagaaatgctcggtaatgtgggcagaaaattgaggtaagcataagaaacactctaccagctttggcttcttccatagaattctcgtcttgtggaagaaagaccattccgacacctgtatttgttctgtccaggggagcaagcccttgcttgttggcccagtcattgaacaagtcccatgggataccactcatcagtcctgaaccgtcaccggagtcattgtccgctccacacccaccacggtgctccatgcagccaagagccacaagggcatcccggacaatattgaatgaaggctcatttttcaagtttgcgacaaatccaacaccacaagcaccacgttctgataagatttcattcaaatctgcagcctgataaatagaaaggaaatactgatatcaacaagagcaaaacacactgcttgatttacagcatcataattgcgactcagaatacaatcttgcattcaagacattccagaagagccatggaaagtacattacagcctttttcaccaatgcattacacaatgtggtactcctggaattcgatcgcgatcagtacctaccaccacagctgtcatgtatccgttccttaccaaataattgtttatcgcacctgcatttgttgtagtttgttcacttactaccctactgttttaaaaaaatccacaaaaggaacagcgcaacagcgacaacttgcagtgaacaaggatcaactagagattaaaaaaagcttgcacatgcaagtagcttttgcatcaggacaaaagcctatccaataacagtgatcaggaggcgttaaataatctgaatcatcagttccatgaaccacctctaccgcagcttactctgatttccaatgtattcggggcgaccgcaaatccactagaagcatgtatagagagaaaaataaaccaaaatggcctcaaaactagggatgaatccatgaaaacacgtatgggctcatagcttcataaaccaatctaatcagtaatcaccacaaccaaacatgcaaaaccccaaaacaccgacccattcaagcgcca

SEQ ID NO: 71985 - DNA, 8425 bp, Oryza sativa
atttctcttttttgtttcaccccatataagttgtattttcactggaatttggtaggatggtgatagatatattacaacttatgtctcaacattttcatttttttctaaatgtttacctagactgaaagcacctaggattgatttgaatatcgagattataaagttcatgcaaacagttatgcaaatggtgtcatccatgactctacaaaattgtagttgaaaatatagcttatataaaaagaaacaaaaaaaaggagaaatgctattagggggtgtaaaatgagcttaaaaatagtttatgggattaaatgatccgacgaaatagtttgagggagtaaaatagacttctttcatatttaaacgcagaggtagtatgaatgaatttaatgcccctcgtccaaaatggctgttgttttagctccacacatacaaaagcaaaaaaaaaaaaaaaaaagcaaaaacacacatttacatagtttgctcctatgtagccatatatataatataatactcaaccaacaagcattcaatggggacacttacgaaacaaaaccagctcacactagacatttagatttaaattcacagtcatcagctcggactactaagcaatcaatcacatgatacaatatgattggcgtattaggacaagtcattggtgcattgtacaaagggaggcacaacagtgcccacaggttgatctgtccaggtgaacagtagcattttgttaattgctaataagctagtacactacctaatgacaaaattcttaatatgctggacatcaattgctatgttacaatcagaaaggagatcatttttggcagtggcacaaattatgtcaggaaaggaccataagaaggatgaagtgaacaaaacacacaaaaaattgtgaaatatcaatgagacataggatggaaaataatcaaatgccaatttgggaatggaagatcctcaatttctctcctatctagttcattattttttaaaaaaagcaaatagtttgatacagatgacaagaaacttataaagaacacaaaatggcacaactgtgtaaaccaaatatagacacagtacatccaaataacatcaggctcatcataatatcaagaaccagacttcagcatgtccaggaaaaatgcagtagtgatcaataacaaaatcaccatcaaatagctgtattttttcccaacacatcaaatcgcatttaggtgatagattatcgtacatttttccttgattatatatatcacatattcctactacattgcaaagttaaacatgtttggtccagctctcaagaaaaatcttcaaacttccagccattaagtttgcccaaattcatttttaagaaaatttaacattgtaaaaaaaagttgtatgtacctaccaaatcccttagtccaatttgtaaaaaagatctatcaagaacctaccaaaccacaactaccagcaaactgacacatgcatagctttctaatatctatatagcttacaaaaaggttacccttggcaccaaagtatgcacataagtaaatgaacatcaagtgccctaacgatcacacaagtatataaaaaacataaacatattcctgtaagtgcactgaacttcataatctccggcttctatcatcaagataccaattctccccataagtctgatcctatgcaaaaacacaaaagagaaatggaggtaccaagttccaacacaatatcgaagcacaatgaaaagtttcaaatcgacatataattacaccaagctcatcaccagtccgaaacagtgaagatacgacaaaagtgacaacttatgcttttcttgcaacatgggaaccctttggaacagcttcaccactaagtgctgccaaatagcaggattctatacctgcttatgagtaagcaaaagatgatattgcactgaagcaagctgccaaagggggctgcagcattcatattattcaattcaacaacgaaaggtgcaatgtttctccttaggacacataattcttgtagtgaagcacatagaacatatacttgcacaaagattgcagaatatggtgcggaatgcactaaatcccatcccaaaatctccttttccaaattacaaaccttaattacaaaatcgagcatatactggccatataacttccataaatcccaagagtacgcaactcaaatacagaaattcttatattttctaaagagtaaatcttatgaagttaccatatttgaaatatgtggtcgaatcattacgtacacacacactgatcatctccccgaacctaatccattcccaaaattccacctttccgaattgtaataccggtaatagaagaatccctaattacccctttccaagaattcacgaccattgtttcatccactaaatttctaacgccccaagaaacaagaaacgtcgctttataacaactcttattattatgaagaagaagcggggggagatctcgaggcagaaagccactcaccgaggtggaactcgtggccgcactgcagcctcgccgtggacctgtccccgccgccggcgaccaccgcgtcgaggcagatcgagcacgggaccaccgccgcggcgctctccccgctgtcgtcgtcgtcggcggtgtcgccccccgcccccgcccccgcggccctcgccccgcctcctcctcctcccccctccctcccgacggccgacgccggctcctcctcctcctgggcgcccatcccggctgcgctcgcggcgttccccaccactccccgccccgcggatccctcccggtagagcgcgaacggggtgcccccgacgaagaacacgcgcccacctgcgcctgcgcctcgcctccccggagctccgatctcgcgcgcgggcgcggcaaccgtctcgttcccaccaacggcgacggactcctgctggctatctgctccgtgtccgtccaccagaaatattaggcaaaaataatactagacgagaataaaaaaggaaaaggaaagaaaaagaaaaagaaaacggcaggaaataaaaagttggggtttttttcgtcggggtacctgggggaatgtttatttgcagcaccatgccctgcccgttttcccttacagtccctggcagtatagaatttggattgggcaagcccaacctatggttgtaaaaaagaaaaaaaaaaggaaggctgatttagataaaccataattttcattcgtcctaaaatatagcagtatttgagtggatgggacacatcctaatactgtgaatctggacaaacacatgtccagattcgtagtagcagaaagtgtcccatccactcaaaggttataatattttcgggcggatagagtacacatttgtggatctaacacttttgagcttaaaggttgcagaagactctagatctagggtgaatcgcaaaatgaatagatctggaatgaacttacacatagccggttatcggagattctgatttgagtataaccactatagatctgctgttgttggtatgccgctgaggaggaggcgccgtcgtgactcgagggctttcatccattcgatggaagttgcctgtgtgggtcgccgacgatgacctgagagttgagctatgttcaaaaggggcacctccggggattgagaataacggcaaggcatagagagatctgcttaccgttgtaaggtggtaggtggcgacggatagcactggcaacggcccggagagtggcggatgcagtaagccatcaaaacgtagcctgagagatcgaggaatcaccgagagaagggacagcgtaacgctagagaagaaatgtgaaggcttagtcggagtgggcaaggtactatgtggtgagagtcttatttatagcgacgacattcataaaaaaaaagtgtgactgctattgaaactaatgctaggaaaaagtgagaaaaatataaaagtaattacaatcatcggattcatagatatttatgatatattctttgttttacaatgttagaaaacaattatcaatatttaatagtgcgataatcaattgccgtacaacttatgcgaaaattgatacaacgcacaaagttaacacaataacattactactattcaatgtcaaagaatactaataatcatttactactatgactttagtaatcgtttttatttacttgaatttgtactccctccgtccaaaaaaaaaatcccaggggcggagccacgtgtggggcaacctgggcttgggccccacacatggcaaaaattttcaatggagaaacactaaaatttacatagaatctgcacaaaaaatttatagctatatggttcagctctactcttgctaaaatgctgcctccgcccctgaagaatccaatactgggtttgaggtttgaatctagatagtgtatgtgcagaacctaactaagattgttttttttatagaggaagtattattttagaattgttaaaaattagaataagagttagggtagtgaaaaaaagagagacgatatgcttaatgtcgaattaccaaaatttgcatcccgtatgttttaattatgtttgtgatgtgaatttcaatatatcaatatgaagataatatgtcccagttagaaaatcaacagaacaagtaggttaacattggaaaaatcgaattcctttatatttttccccttttggttttttagcatcacgagaggaacgacccctgccaaccaccaaaggtaaatctgaaccgttcagggtccaaacccgacgacgctttttgataccttcatctctttgtgtagcgtaagctgttcgcagtgtgagctcacactctccgtccagggatgccgtggcgtggcagggtccctctccagctcagcacccacgcgccccgcgccgcacgccgcgtgtatgacatgcggggcccccctgccgcagccagctcgctcggcgagggtgccacaccaggtgtatgacatgcggggcccacgcgtcgactcgtggggttgcctcggtgctgtgcggtgcggtgcggtgcggttgggttttgcttttgtgagtttctgacgcgaggaggaggagatgccgtgacgacctcgcgatttcctcttttttggtttaaaaaggcccttttcagtttcgaaaactgggtgcagcaaatcttttactacttttcttttcttttcacggtgatgacgccaagaaacgaggtttgcattttgcctggatggctgtggcccacggcacgggactccttttcttcttttttttttcttcttgttttaccttgtttggaggaggctgaacccaatttctgttgatgaccacagggcccatctgctacggtggaaagtgattacgcgaggaggcgtcctccaaagggcgcctaaccgagcggcgcggtgtgcttacgttgggcggcgaaacacctggcaggtgccaccgccccgcgcggcgcacctgcacacaccgcccgcgaggcgaggctgctgctgtggctgcaggggtatgacgtacggggtttcatccggtctctagtggggtggagcggagcgctgatgtgcgacaaagggagggaggtgtgcgagacggatggcgatgtgggtggctgccgcttttgcccaggttgactctgggcgagagagaaccgaggtcgggtcgggtggggtaacgcgcgccgcgccgcgacgcggggggctggcggttgggggttgagacttgagagagagagagtcggtggattgtgggcctccgctcattgggctcaccaactcctttcatattcccgacgtgggccgtgtgatgggctgcgaaggagcgatatagtgaatttttttcatttttaaatttttatttttttaatatttacataaatattataccatccaaaatatttacagaaatggcccctgtcgtccaagtggaggacagcaaggtgtatgcatttttcactgaggtcccttgccactctctgcaagggctaaagggggcaaatgcaattttcgccctgccaaaattgtatttttcaagtttttattttcctcttgtcatccctcacgtcaccctacttctgtaaattttttttgtcgatacaatatttctgtaaatattaaaaaataaaattttaaaatggaaaaaattcgtgatatagtcagctccgtctcagttggcaggacagaccggccatttttcaaaaaaaaaattaaaataaagtctacatcatcaagtataggtcgagtttcatttatatccctcaatcgagaaaccaggtatagatcatcccctcaactattaaaaccagtataaatcgaatccctttgtggtttggatggtggttttatcctcgtgctccttggagtagtgttgcttcagcgagcacaaaagggtcaccactgaacgcgctgatgaagcctagaggggggggtgaataggttgtccctaaaaacttaaaaacaaatcgcagcggtaaaattcaagcagacccggaacttcctggtaaggaacttaaaaacttccagcttgcctggcccggaacttccggtgttctaagacaggaactttcggtaacagaacagagatgaaattcaaattttgaaataggagaataagccaatcttcacaagatggtgcacaggtattctaagcagaggatatatcacagaatcatccacagaaacatcacagaaagagacaagagcgattttttcccaaagttcggatcttgcgatcctactctccgttgaggagctccaaagagctgggtctcgattaaccccttgcctcacttgtgcaaaaaccccagagaaaatccacagccttcaaccccaaacacccctaggaaaatttctagaattgagtgaccactaagatccaacttaacctacttctagaaatccaccacaagtgtggttgctctacttggaaagtctctagaagctcagcacaagaacttcactaacttacttcgttccctttcggaggagaggaaatccttcacaaacttacccggtacatccacaatatgcaacggattctcgcgggcgacacctaaccatctaggagatcatttccaagagtaataagcaccaagatgacagcccacgagatattccaagtgctcacccaagatcctaggcttcacacctctccaaatcttcttctctccctctcaatctctctatctcacaagaattaggctctagattgagtggagaaggcaagaaacacttgggagaggctagcaacagttttaggtttgaaaagtgaaagtgaatagccaagaacgagcttgaaacgagctgaatatgtataccggattggggacgtcatctagccattagtcacaattttgaactgggaactagacagaaagttccggacctggaagacaggaacttccggactacacttaggaaaaactttttcacaagaccggaacttccagacctggaagacaggaagttccggagttgcacttttggacaaatggagtatatgcaaaaatgactcctagggaaacttgacacttggttcacactaagagcacttgacatatctcagagcatcacctggaacccctcttaatagtacggttttttctaaaaacccgattccaaaagataaactatcctatgcacttctcgagttccggtccgctttgattttgtacttttggggggtctccaagcatccatctttcacaccttggactaatgcacctgaaagtcattcaatgaactcattagtcccttaaccacatttgtcattaatcaccagaacccactagggagattaatgcactttcaatctccccctttttggtgattgatgacaacatggttaaagcttacaaaagattgataagaattttgttttggatggttagaggtgaatgaaactcctccttagtgtatgcatatataatatatgagagaagctcatatgcatatattaatgggagcaaccgaagagagtttccttcatctctactcattcgtgggatgcaaataagcagtaagaatagatatgatatgcaaaagatacgacatgatgagcactcaaaaggataaaatcaacatcacatcacaaacaacaaataagacactcatagcataaatgaagtgctgtataaataaagagcagctaagagcatctaacagttattacatccacacaaatagagaattattacatgtccataagatcttaagagtagaggccaaaggactgccaggtccggaacttttggataaaatacccggaacttccggataagctgacatgaatataaagcgagggagctgccaggtccggaatttccggataagaggatccggaacttccggattaaacagacagagcaggcagcaagcatcaaaaacaaaattttgacccccttcgattgcaattttctccccctttggcatcaaggcaccaaaaagagacaaaatcacaaggaaagaagaggatca

SEQ ID NO: 71986 - DNA, 7954 bp, Oryza sativa
gacctgtggggcccacgtgggtcccacgctgagccagccgccacgtgggacaaaactggagtcaaaaccgcctagggaccttttgtaaccggttttgtaagttgggggacgccggatgtccggttttgcggttcgaggacgattttgtatctcgctgacaagttgagggaccttgcgtgtacttttcccaatagaggaccatccaaatgaggcctttgtcgtgttggcagagaagcccatgcctacgccttgctgcggcctcacgggtaagcggtagaactcgacctgtctagtgttctgctttggatgccattgccatgtgagcatgtaatgtgattatgtgagtgactccgtttgaagatgaagattacggatagaaaaacattaacgtattattaattattaattgaactttatttctttaacttggaaaaaaaagacttatctaatatttttaagtaatttttatatgaagatactaaatacgctgtttaacagattgaaaaacgtattaattaacgaaaatcgtggtaaatttgtatcttaacaagaagagccacatgtgagacggtacggtgcagccacccctctccaaaatacaatggaccatagcaagcaaagcaagcacaggcacgcaggagaaccgactagacgctagaaacatgagacaggacgggcactggcctcaatagtccaatagcatacctggcgatgccgcgatgctcggaacaaccacaagaagacatcgcctgagccccaagcccaatagggtacacggtgaagctgacgaactggtttaataattctaaccttctgactcacatagcctttcacagtttcactcgtgactggccttgcgtgcagtccttcacaccttcaccgacatgcatgcattgatgcatcatacatactctaacttcagaagagatgcggagccgagattcaatcaaactacttcagcttcaccaaaaagtgaaacagagtggaataaagtgatacaaaataaacgaactacagataacctacttggaggagcttcaaatcctaagaaacacttgattggttggcagtttttgagaatctgaaaaaaaaaaacagagtatacaactataagaatctaaataaacaccgggctatttgaggagtttctaattcgaagagaagcaaacaggtccaaaagtatgatttgggtcactctaaacttcgttttaaaagttagatttaatagttagaatcctgccaaatatgaccagttaaccgggctcaaatcttttggcaggatatgcggcaatgccatggcctacctgcagtcggcgtttgtgtcaactgcatatgcggtgcggcgacgactgcatatgctcttgcttggacttgaaagtcatattcatattgcggttgcgggtctacttctgtctctaaacgcggctgttactgcgcgtcgccgttctcaatcacggcatctctctcccacgtacggcagagaatatcacgcgtacttacccaaaaccccaaactgcaacccactattttagctgatttttaaccgaccattatacggttcatgaaccagatccacaacctcacgtgtactcactcagtaaaaaaaaaacaatctagacaaggataatataaggttgtgtttagttcacacaaaaattaaaagtttggttgaaattgaaacgatgtgacggaaaagtcgaaaatttgtgtgtgcaggaaagtttttgatgtggtagaaaagttggaagttttgaagaattgttttgtaactaaacacggcgctagtacaataaatatgaagacgagcattctcagattcgttacagtaggctatatctcattcttacctagcttgtatttttatggagggcctacatctcatctgacagatagccttttagagcaggtacgttagtagactataagccaattataaacatattttgagaagatagatagggagagagacgagcagcgggctacagatttgtagccagctatagcataaattctaagatgcaatctatatatgataggtggcatcagataactattgtatgaattggccattaaaatgactacatataatttagagttagcagttggctatagcccatgagctgcatgccaggatttagttcacacatgccatatgggcacctccatgcaaagacatttttctcctctccttcagctgtccatgcaaaaattctcatcggatttcgagggattcgagtgacgacacgcgcgcaggggtacgtggtgctcgcccattggccggaccgccgcctccgatcacgagctcggtccccggccagcgtcgccatgcatggcgcagaggcagccgaggcccccgccgtcctctgcccgatacgtccaatggcgaggcctcacgggcgggccagggcgcggccgctcgccgtgtcgtttcccgccatggctcacgtgctcccccgctatatagctcgctcggccacctcgccgcaccaccgtgtcacccgccattgctggtctttgccttgctgtggtgagagagatcgatggcgctgagaatgagcatcgcggcgatgtcggtgttggcggtggcggcggtgctcgttgtggccggcacggcggcggcggcggcggcgtcgtgcccggcgacgccgccggacgcgggggcgacgctgcaggtgtcgcacgcgttcgggccgtgctcgccgctgggggcggagtcggcggcgccgtcgtgggcggggttcctggcggaccaggcggcgcgcgacgcgtcgaggctgctgtacctcgactcgctggcggtgaaggggcgcgcgtacgcgccgacgcgtcggggaggcagctgctgcagacgccgacgtacgtggtgcgcgcccgcctcggcacgcccgcgcagcagctgctcctcgccgtcgacaccagcaacgacgccgcctggatcccctgctccggctgcgcgggctgccccacctcgtcgccgttcaacccggccgcctccgcctcctaccgcccggtgccgtgcggctcgccgcagtgcgtgctggcgcccaacccgtcgtgctcccccaacgccaagtcctgcggcttcagcctctcctacgccgactcctcgctccaggccgcgctgtcgcaggacaccctcgccgtcgccggcgacgtcgtgaaggcctacaccttcggctgcttgcagagggccaccggcacggcggcgccgccgcagggcctcctcgggctcggccgtggcccgctctccttcctgtctcagaccaaggacatgtacggggccacgttctcctactgcctcccgagcttcaagtcgctcaacttctccggcacgctccggctcggccggaacgggcagccgcggcggatcaagacgacgccgctgctcgccaacccgcaccgctcgtcgctctactacgtcaacatgaccggcatccgcgtggggaaaaaggtggtgtcgatcccggcgtccgcgctggcgttcgacccggcgacgggcgccggcacggtgctcgactcggggacgatgttcacgcgcctggtggcgccggtgtacctggcgctccgcgacgaggtccgccgccgcgtcggcgccggcgccgccgccgtgtcctccctcggcgggttcgacacgtgctacaacaccacggtggcgtggccgccggtgacgctgctgttcgacggcatgcaggtgacgctgccggaggagaacgtggtgatccacaccacgtacggcaccaccagctgcctggccatggcggcggcgcccgacggcgtcaacacggtgctcaacgtcatcgccagcatgcagcagcagaaccaccgcgtcctcttcgacgtgcccaacggccgcgtcggcttcgcccgcgagagctgcaccgccgcctagtcgccgtcgccgtcgccgtcgccgccgccgccgtctcactttcgctgctgcttcaattctttgtagcttagtgagctagcttctcaggtgaagaatgtttcagtggtttatttagtctgggtttggttcgttgattagatcctgatgataagtgaagtgaaatgtgcacgtttgtgatgtttaattaggtgctggattaattcagctaatcccttgctttaatgtagtaacatgatgttttaagagaagttgggccgttgtttgaaaatacagaagttattgggccgtcattgcatgcccactatctgcaaatgggctttgaactcactggaggtatgtgtgtcatatcgagcccactatctgcagaaattcagatgaaaccctcagctggaccggcccatttccttcttattaggccgaaaaatagttcgtgccattccattctcttccacgtgttcttcacgtgaatgcgacgagtgaaatgaaagcacccgtgacgttgcattagccatcaggcaaagcatccagtaaacatccgtaccatgtgctcacgtccatcatctgtacgtgtgccacaattattgtccccctctactaatgaggaaggcgtattggccagcaatttctcctacatatggtggcgtttgtttccgatgaaaataaagaaagacagagcacacaaaataagaaagccactaataagttgttataaacttaaaaaataatttatttgatattttaaagcaatatttatataaaaagttttcatacgaaacataccgtttagcgtatcaaaaacgtgctctaatgaaaagttgagaaaaaaaacacacatattttgacaatttgaccctttaaaaaaaaactaattttacaaatgaactgcggccaaaacttagggctgttttggtttgatgacaaaatttgccctacaaaatagttggcactttagatagtaccttgttgatgtttggattgatgccaaaatttaccaaatataatacaactcctacaaaccaattctaccaaaatattgatttggcactaccaatgatttggtagggcaccaaaccaaatgagcccttatttcagaaatgatcattttgttcagcgccaaatcgtatggcgctgaatttagacacctcagcgtcacgtcaactggcgctgaatgccatgccactgcgaatggaaggctgagttggcatgccaacatgcattcagcgccgtgctatttggcgctgaggtgtttggcgctgaacaaaagggttatttttaaaataagttttagccatggttcatttgtaaaaattagtttttgtaaagaggcatattgttaaaatttgtgaaaaaaaacatatcttaattagaaaagaatatggccatatataatccaatgttccgttcgtatgcatgcttattgcactgcgatgaggaaggctatgtcagaagcaaactagagggactcttgtttagaaatattttgagaagcagtcactgagcatccaaccattgaaaatgtagagaagttcgaattttaacaaaaaaatctaaactatctgagacgctgaaaattaggaaaatacccacaactgctagaaaccaagggcggatccagcatagagacggaggggtcttaaccctcactactgacgtgaatactataagagcccctacgaaaatcgcactaaaatattttaccatgtgtagatgggagaggggctataacactatctaatttgctcagattcactgttatttttttctgatccgtcactactagaaactcccctcaactttcaagcacctctcgagccatgacatgaacaaacgtttgtactactactagtgaaaactcaaaagcaccaggggattcaactttcgctcaattgcgagccttgtgcctcctcggattttcgccccccccttgtcaaacctgcaatcatctttgcatctttgtagatgcaaaagcttccatcggcattgcccgaggcggcgttgcctgactttgctacagtgttgtactacctgcgttttcagtgttgctctcttctgaagccacgagcacattcagtttcactttgccatgcgaccccaaccaatgcagttcgtgatggtactgtaacttttttttttttttttttttttggctttgaggaccagcacagttttggcctcggggacgacgaaaaaagcagcagaagcagctgcagatgcatgcagtgccatgcactgctccggcttgacggcagagtcgagatgatgggtaccgagtcaaaaaagcaacaaccaaaaaaagtttcttgctattgctacttccgccattatattttaagagcaggtataatagcaggctataagctagctgtaaacatattttaaaaagataaatgaggagagagaagagcagcgggctacagatttatagtcagctatagcacggactccaagacaccgtgtgtctatgacagctgggaccatgtattaataatatagtatgtaactaatgtataaatgagctattaaattggctatagatgaattggagctagtagttggctatactattaaacttgctttaagtgtagccatgagtgtttggtattcaacgtttgatcatccgttttgtttaaaaattatttatgattaatatttttattgttacaggatgataaaatataaatagtattttatgcgtgatttatttcttaaattttttaaataaacgaacgatcaaacattgaacacaaaaatttataactgcatttaaatgggatggagggagttgtatatagtatacggtataattaactgtgaagctgcagcggccatacggaaggtataaaatgtcgctttttagcgatttcgtcgtacgtaggctagtctcccaaatctgggccagcattgttgtgacattgtgtgatctgaattccatttcacgcattgttcagtacgtcattagagacagagacatggatctaaccagatcattaataattatgcaatctgtttctccctttcagtttccaacagacaaaaaaaaaacccttataatcagagttgcaaaacattgcagctttgtgtggctatctgaaaaacggcagtcgcatcgcatgcatgtcacagctctcacgaagtcggcagagatgcgtacttgaggtctaattgcatgcaattggagagaaacgccagaagagatttttttctttttttgtttgtgcaagacaggatcatcatcaggatggcgtctcaatttcttcagaagttcacgacagcttccgttatctagggagtgttctggaccaccactaataaatggcgtttttgtttctctcttgcttggcctaatgacctgccttttggtagcaatcgttaggcacaaaaccttgagctgttctactgatgacaaatggagaggaacagcaaagacacagctaaatgatagctattgaaaatgttcactccttgttgattgttcttcttgaaaagaaaaaaaaaaaaggaacagccttgcactacgcagaggagaacttaaaataactatagatgagactagtctaagttaattccagttaactaaggcacaatgatattgtgatacacacagagtataaaattggctgtggagagaacatgcatgcaacacaatgatcatcgccgattcttgaagatatatctatacaaaatacgtgtacaatcatgtagcatgttcatggctcataaagaaattgggtgaagtctttagccttcagattagtttttttgccattgcagtctctactccttggatgccattttgtgtgatatcagactatcagtagctttctgatgctttctccttttggttttcgtataatagaatccttggtgtccaatcagcgttgccccagcgtataagagaaggttctgcactgatagttgccggccacaactgctcatcaacgcataaacaattcgggacacataactgtctgatcttttgagctctttgctcaatttttctatggaacttgtgttgccatgttggatagtagtagaataatataaaatggtatagtcatgttgggc

SEQ ID NO: 71987 - DNA, 16173 bp, Oryza sativa
  unsure (1)..(16173): unsure at all n locations
tgcacagagatatcatcgttgcaggtatttaaaaacatttttttccaaccagcgtacaaccactatcactgctaatttctactcaaaccaggggtgataatgggattccaaattttggtatattttttctgcaatataacttaagaaatattttgtattttcctggatgtataaattgtctcacatgattgtatatctctctctccacatttagctttctacttccttggtcctaaactgagcacctctaattttggagaagtcaacatatataaatttgactaataaagaaactagcagcatataattttagtgattagatttgtatttatgatgatctttaccttcttataattttattaagaaagcagagaaaaaggggaaacggtgaagggagcagtgcccacccttaccagaaccaccaacagaacttaacctttacataaaaaacacgcacaactaaaaaaaatgggcctagcaatctactcttttcattccaaaatgataatcatataacttttttgaggctacttctaaataatcatcatatttatgttcattcatttagtgtattcgttatttatgcgttagagtaaatagagattgatgcatatacacatgcacacaagtattttataatcagtatgcaatatcttgatttgctataggctagaaaatagtgggtatggtgcatgcatcgggtttattgtcggagtaaatataatatgagagagttaattattagatttttttactagtgtatgattattttggaatagaaggagtattaaaaaactcaatggccatgatctaaatggtacattcactggccattgtttgctagggttcaaattttttttgggtctatcgaaccaccaccccaccccctatacaaaatttccggggccaaatttttttggtttttttccctctttttgttaatttggcaaaaaataatgttcaaatttcacaaaattatgttcaaaaattcaaattacccaaatagaaatagcgaaaacgaaaatttgaaccctaccatttggatgaagtttagttgtaaagaaataactatggagcaaatcaaacaatttgaggtatgccaatagctgagatttagttaagcccacgtcattaagaaatattcaggcactggattatatcctaattatattaattattagcaatttgatcatcccattcccacggcctttcctaacatacgatcgagtaacgcatgaggtaactcagcccggatccttcgttggcccaacttgcccagcccatcggaaagaaggaaataaacaagtctggaacaagttcaccggagtttgcctggggtcccttaaacccaaaaccagaaatgtatatcctaaactttatgaaaccgtgcaaaaaaaatgtcccaggcagtatggatctctggtttcactggcgtgacatcctagtcagcaataaataaataaataaaattatggggcccacatgtaagtgaggtgaaaaaatgtggacccacacttctttttccttttcttttctcttttctttcttctcttgatgagggatgtgggtcccgatcttccgataggtactaataaacaatcgatttgggcggagtcgtgacacaacttgatccggcttctgaacgaataccctactgacccccgcaatcgtaccaccacgtctcatctggttatcaaccgtgccgaaacccggttgacctcgttgaaaaggctaatccctgcatgcgaattgaataacagaagcaagattaagatagattgcaatacaatggcatatgaatgattaggcactccaatttggggttccacaaacaatctagcggcgaaactgttctcgacaaaataatctaagcaaaacccgactctaaacgatgaaggctactaaattaatatgattaggagcgttctagggttgccctagggcgcacacccccttgggctaagcccacgacacaattacaaggcccaaaacacaaatcagattcggactggatgagatacgtggcttgttttgcagtttcccgatagctcggtaggaattttgacgtgggatcaaaaccatctgaaagtagactccataagctttccaacaagtactcatgggccccgaaattccttctggatcagcggctaggtccgtttgaagttgatgctgtcaggaggcccaaatctaaatccaaaacgtgtacaacttaatttcttgtcttctatgggccaaaagtgacgtggtgaggtagaagtagacttggagaaggtcttggtttggtccacaatcaacttctttaatcatccatgtatttgttatgctcggtctcttttccttcgcccaagcaagtatctctgcaaatgaaaacacaaaactcattgtgtagcaacgtttgttcaaatatataacaagtaaatctaatgtagaacatatgcacctttatttaattaatacataaggtagtcatggttatatccgagctagttatgtcctcatcacctcttctcttctcttctccggaggccggcggcagcagagggagcctcggagagagggggcggcggcgggcagggctgcggcgtgcggagcggccgctggcgagcgtggcagtgggcggctggagagggggaggggagagcggccggtgagcctgggagggaggagagggggcagcgacgggtggaggagccgcgagagaggagagagagggggccgagtaggtcgagcttcactcgtgagtcgtcggcggcaatggcgtccctccgcgcggtccccctcctcgtcctaggcatggcgctgtgcgtactcgcgttgttccactcagccgcctccgcatcctgttacctccgccgccattgcgcgagcttcgtcttctgcgggatagggtagagagggggctgagccacctgagcttcactcgtcggcgacaatggcgtccctccggccaactgctgctattgttgctgatgcggcgtcctacatctcaaccctgctcgcgccaccatctcaggcagctccacggcacagtccggcacccacagcaacgacgtcagcagcgccctcgccgtgcgctgccccagctcctctccctccccctccccgtttttccccccgtcgaagcagcacgagaggcaccaaatgcggcgacctcgcctccctccgagcggcagtggcgaccttgtgttcctccgcgctcgcccatccccgcctgcctgcttntgccagcaccgnncgcacccccccccccccccccccgcgccggcctctcaggctcggggggggggaagaagagaagaggagaagagagaacaaagaaaagagaagaagaaaaaaaaagaggagaagagaggatgctgacatgtgggtcccaccatatgccacatcagcgaaaccggagaaaaattagggcaatacttcctagggaccttttttgcacggttgtgtatatatactaggggtggagatgtctggttttggggttatgggaccacagacaaactcgacgttaagttgagggacctccagtgaacttattccaacacgtctcaatcttcatcagtatccatgagcgcagccgttctctctcgtacttatatatagttgtaatccaccaagtttaaagctcaacatgcaaacataattacttatgaaaagatcatgtaagaatggcatatcatatataatttattgaattctacaaatcaacatgcaagcatatccaatcatcacatctcacatcatttccacaatatttcaacatatattcattcatatattctgcattaaagcgtagggtatcatttagtttgttttatgattagtactataaaccctggcttttcatcacttttttccgttcttccatcttgtgatgcaaatcttggccaacaatcttatattttaactacaatctcctatagagtctattaaatttatatatgttctacaatctcctacatagtctattacatttatatatgttcaaatatagcttgacaaaccagtttttttttgttaatagctaatatcctttttattctatcctcaaccattgaaaaaaaaacaatattgatgattttcagtatttccatagcaaagtgcgggacatcaactagtacttgatatatattcaaatccaataattaagtcgtaaaaaaataccatgatgcaaatcaaacaatttaacgccaaattgtatgcatgtaagccaagtgtggcaccaagatatacttgaaagttgaaactgggaaaatgttccctgaatctgcttgttctacttaacaatagctgaaacaggtattctaaacaactttctgttggcccgtcatctctagtttgctatctggcaggttacttgtccatctttcagcgtttggagtttgttctgcaaaaatccaaaggttcagacagatctgctaatgagctgatgcagacactgagatgccctgtcatgttccggggcttgtaatggtccaacagatgcaacttcccaactaattatatccagataattttatttggcaagaagggaacagataaataaaattacatgtcacagatattagttaccattaattttctgctcccttgcgtttcccatccacagagaaaagttgctagatgtattcttagctttgtttttcctgcagtggcaaaaaattggaggtagggtgtataaacttatgcattctaattaacattataattggagcattgtgtagcattgcactgatctgttttcaaataacagacaactttgactagctcactactactaaaaggatttttttcgtgcggtcaaaaagttttttttccatgcggaggtcttgcccgtctacaccctacaccctggtgtctgtgaaaataaatatttccgcatacgggcagcctaaccgcacggaaaaaataatcttcacatgcggtcagtttaagtagaccacacgggataatcggatttcgtgtgcggtcgggttatgtcgcccgcatggaaaaataaaattccaaaaaaataaaaattcgaaaaaaaggaaccctagaatccgacggcagcggtgtggatccggccggcgcgcgtgtgcgcggagcgggcggcgccgctcccggccgccgttgcctcctcgttgtcggcagcgggacggcgtagatccatgcgcggggggctggcggcgccgtccgcctcctcctcgtcatcgtcgttggccaggacggtgcggatccggccggcgtgcgcgcggggccggtggcgcccctcccggccgcctcctcatcatcgtcgtcgcttcaggccgccatcgaagcttcatggggaggttgagggagccgccgccttcaccgtcaaccgggccgcccaccgcccattgcgaggctggccgaggtggatccgcccgccaccgaacagctcagtgccgcgggctacacccaccgccgtccgcgtccgctgccgagccgctcagtgctgccatccgcgcccaccactgttcatggccaccgccggccgcactcgccacacacactcgagcgcgagaggataatgagagaggagacagagtgagagagtgagggagaggtgagagagcgagagaggagagagtgaggataaggatgaggatgggtggatgaggataaaattttgaagtgttgagaagggaaaaaaggaggaatgatagactcataggcggacctttaaaaggcctcttaagggtccgcacacgaaaatgggttcccgatttttgcagatacacgcgaaacggtgtgtctacaatctaaagagcttgtaaaaaaatcgttttcgtagtagtggctttattatttaaactttgatcactaattgctttaacatggttagactaaagtgtacgaaagttttaagcttatatttggttggactgtggcttttgaaaaagtagctgtgggctgtgacttttgaaaagtagttttagaatagtagctgtgaggaagctaaaagctcgtttggttacacacaagtggtttttgaaaaagtttcttccctaacgagtagaccccacgtatcatgcacaggtatctttctcctttctcttgagtcttgacacaggaaggcaggggcgccaacaccttcgccatccacggcgagcctcgccttcgggtgcgccatggacagcaacatcaagcaactgtggtgagcttccggggtcgtcaggctagggaggacgccacaatgccgcgccgggaagaagagcacgttgctcctcggcgactccgagaaacacgctggcgtcgggtgcgccatggacagcatgagttggttctcctccacgagattcagatcggggaactcgataatctcgtactccttgccgttcgccgcgcctccggcactaatgccagaaaaaaattaaaatttgattcaatttttcttccgaatgtttcctgtctgtgtgatctgtagaacttatgctgctggggttcatctcgctgctgctcgtcgtgttccaagaccgaggatacgcatcgccgagagcctcatgggccactggctgccttgccggagcgacgggaaggcgtcgtcgaactcgcatcacggcgtcaccgccccgtcggctgccgtcgtctccggcactggcgcgaggaggctgctcggagaagggacagccggatctgggcaccgttcgacgtccccggtgcgcacgccgaggcggagcgactgggcggcggcgacggctcgtcgaggcggcgcggcatcaggcggggtctgcggggaggagaaggggcggtgccggggagaggagctgggccggcgtcgggcagggagggcgcgcgtgtgagaagccggaggagacgggaatagattagcgaaccgttttctttaataatatcagaggtgggtaatttttttccctaaaagcaagtgaaaggacggagcagaggtgtgatgaatcacaagcgaaaaatggaagtaattgtgaagcaaactggaatcggagaacagtaccgttctattgtaagaacactacaatttctcctcaattctctctgtacttctatgtgtactagctagccagccaattgttgatccgtcattcatcaatttagggcatgtttagggggagcttatagctgctgtagcttctctcagaatcagaaactctatacaaatgcatttacaatactatagatgtattttaaaaaatatctaataagtgtcttatagtgaattgtctctattaacgaagagacattttataaaatatctataagatagtagaggcattttctagagacattaaactgtagtgaaaccagtaaaaaaaagtataaaatatctataagatagtagtggcattttctagagacattaaactgtagtgaaaccagtcaaaaaaaaaaggaaagtaaaatagttttcttgcttttgttgagccttgaacttgagatctcttggacaatcattttttatctttaatgcactaaccaactcaactccatctttaatagtttaatgcactaaccaactcaactccatctttactagtgtgtttgtatctttagttacttatatttagtcatttagtacacattatcattttaaaaagtatctcagcatagtttaaaatgtctcaggaaaatgcctttacatatcagacgcattttacagtgcccaaagaatacctctacaagataaagtctaataaactgagctaaaaatgtctctagagttaaagttttctaggcaaactttaaagagcctctgtaaagtgtctctacactataataattctgatcttggaagcaatttgcaaaacgcctctagaaaagtgcctctataggaggtttttgttgtacccacacagtccagcttttagtctagattctaagaagttgtagttgtagaatccagaaaataaactagaagtcagaagctgggaaatctagcttttccagattcttagaaactggctaccatacagctgcttctaagaatcttaagcccctaccaaacaggttgttagtgtctgaaaaatcatgattttaatcacaccgccaaaacaaaatagtaaccgttccagggacagggcatagtacaactttatacctgccttcatttgttaaacatataaaaagttcagaaatttccatactcatactcaaactcaggggcaatcttatctttttttaatttctctcctcttttttccatgaaattattaaataatgccatggttgtcctataaccaattacacaattttttggtgtccttagtaatgacacgattttacaatgtcttctagccaattagaaaatttcacatgtcctgtagcaaatttttcctattaaatacgtactaatttagaaggaaaatgagactgactagaatcagctggaacttactggtcttacaaagagaatgagagacctgcatgaatataatcaatggaccttcaaaaggttgttgaaaatttgagaagcagtaatttggagacaaagttagccttgaaatgcaggttgtgattattgtactgactttatattgtttggatcatcgtacaacttggtagtcagagctgatgctgagttagttaaaaatgaaaaatgtgaaggtaggcactgcttaaacaatgaaataaaaaaaattattgcaagacaaaaaggaaattaaaaattaatatgctcaaccaaacatggcaccaattaggtaggagactattacatgtttgaccgtgcattttgtctaattgtaggctggaagacgtaccatccttttcgagctgcatggtttggatgcatccgcacgaattatatttaatccaacctgttgtctaacctaagtagtttaattccccaaaaagcgatccatggctatatatctgaggcaacaaagaattacttcaatcagccattctgtgtattcgaacacattgtcgtctgcgtaatcaaaaaataattcttttaatgatatgaaaggtccgaatactttgcttaaatatcatatggtcataaaaatatgtaattagcgtgaaacaaagtaggtccacaaagaatgagcctatgaatcatgagaagctagtacataaggatgaaaaaggagcacataggaacggataatgcttacaccatatttgtttttgcaatttttagccggacaaaaatggaatataaatagcttgaatatgaaaaccaaatatgaattatctcaaataaaaataagtatcaaatatgatctgacacgaatacataatcagatttgtctcgaaacacgaaaattaactgaatttctaatagaaacgaatacatcacacataattacctcattttatagaaaagttttgtcatagactaaataataccatttaagttcaacatgaatagcattagtggtataaatgcatgcctaactaatattataacatataatatacatcataatttatgaaaatatttaaaagttcaaataatattaatagtgtgaactaatattctgtgatgggctactattaaaatctaaagagatagaccgaatttaaggactaaagttagcaacaaaagagttatgtttcatgcctttggtatatatctgaatcacttcaccagatattcgtattattattcatattttacattaccatattcctaatcttatccagcaaaaaatatgtgtatatgtatttgtatccaaattatctgatgaggaactaagtgtcgatcttctggtaggtattgataaatctcgatttggtggaaacttgacatacacgatctggcttccgattaacacgacacgaaccttacaatcacaacaccacgtttattttggttatcagctctgtcaaaacctaattgacctcatcgagaaggctaattgttgcatccgaatcgaagaatacaagtaagaacaaggtagattttttttagataatggaacaataataaggtagattgcaactcaatttgcggatgaataattaagcactataatttggggttacacaaattgaactagcggcgaaaatgcaatgagaaaaataatctaaccaaaacccgactataaactatgatgactactgaataaatatgattagtaacgtcttaggattagccctaaggcgtccaccccttgggcttagcccacgacacaattacaagacctagagcctaaatcagactcagactggataatttacgtggcttgttttgcatattaccgatagcttagaaggaattttgatgcaagaccgaagtcatatgaaagtagactcgataagttttccaacaagtactcatgggccttaagatttctcttagatcagcggctaggtgcgtttgaagttgatgttatcaagaggcatgaattcgaattcaaaatgtgcagaacttcgtctcttgtcttctatggaccaaaagtggtgtggtgatatagaagtataattggggaagatctcgatttggtcctcaatcaacttaatttttgttatcaactttacaaaatttattatgtcatccatgtcacatgttttttaataaattttaaggcatagtgaagcaatcgatagtattaggttatgtagctattcatattttcacggatacttgttattgttgatacagtagaattactatcgaatactcattggtgattattttataaggataattttgaagaaatttttttattctcatatttttgttaccacacattttatgggatgtgcttgaagtgtctagaacatcccaggacactatttgctttttttctacttatttttctctcttttaatcgaacggttctcttcattcaaatcgtgcatctaacggttcatatttatttgatgacgtggctcttcctggtgggatcatgggatacccttttcactaatgtaaattggtgcgtaattaaataagagatttcaagaggcctagtacgaggttgccttttttttttttacggagggagtatattagctgtgtacttttgaggagttgggaacccctttccttcgcacacaaaacataccaacagataaacgcatagttaattatgtgttagcttaaaaaattgaaaactgaattaaaatgatttttatatcattttttctattttttcaaaagaatacactgtttagtcacacatagagtactattcatgttttatcatctaatagcaataaaaatactaatcataaaaaattttcaaataagacggacggtcaaacgttgaacgtgaatagtgtaaaactacacttattttgggacggagggagtagtttaggaaatatgcgcgtactaaactagggagtgaggttgggaacctcaaatcaagaacacaggtcttaaaaaatgcaaaggttccggatctgtagttctgtactttttttcctgtactgtgaataatgattagcaggttgtattgggaacgaagcgatttgccatcaaggtacttttctctgaaaggtttagttccaggtgtactgtgtaattaaccaagctgattttttgcctatttgaagttgaaggcttgatcgttgcattcgacctgtcaatcatactttaatgcctttagtcccagcaaattgaccatctgtttgtacacagttttgaaccaagcttggatggttaaggtggtggttgacaggttgttgtactctaccctggtttgacgtcttgtgtgtcacattgatacaacgaattctttcagaggttcagggtatatatgtggaaaaaaatgtttatagtgactgttaatcttaaaatctgattatgtaatctatttattcattggttttcatatggagtggtcgagtgtcccgtgtctaaactgactttatattcgttttaggaaaaaggaactgcttgtatgtttttattggtttaaatagttaatctcaatattctgtagaatacatcatagtaacacgaatctaaacaatcaatatttaattatacttcctctagattttttatatgacgttggctaattcaaatttataccagctaacgtcatacatatacgtatggagatagtatttttagaacggatatattatagctcaaatggcacggcagaattctcctaaatcggaacttgattatgcatttttgagtttatgacagacactttgacaaattcaaccaatgtgaaacaaagaaacagtcttccagtcccatcgtttggcctaaacagccaaagaataagccaaaatttgaatttttgaacttgattttgaagttgattttgaaatgcttttaacgtaatttttgttaatgttggcttttaagtcgctacgaacaaatctacaaaagttttacttataaattaattttaattttctaataagccaaataagccattttgggtaaaatggcaaccgatgggagccttccatcgggcagctgctgcgttgggtcagctataccgtttgtgaaagtagtatagggtagtaaaaattcaacgaaacgatattttttttcctcccttacccgacaaaacggccaaacccaaccgcttaccataaaagaaagccccccgatcccccgcaacatccatccgtccatccccgatccaacggccgatccagcttcacgcgctttcgatcgccataattacgcaggccgccatcgtcgtcgtcgtcttcgtcgtcgccattatccccatttctcccgtatcctctctctcctctcctctcttttcgagcgcggcggcggtggtggggaggaggagggccagcggcagcaagcggcggcggcgacgcgatgatgatgacgcgggcgtcgatgggggcgatggaaggcgcggcggtggacgaggtggtgcggcgcctcttggagggcgggcgcggggggaggcaggtgcagctgtcggaggcggagatccggcagctctgcgtcgaggcgaagcgggtgctcctgtcgcagccgaacctcctgggcatccacgcccccgtcaagatctgcggtgagcgacgccccctccccttcccaactctagccctgattcgtgttcgatttggcgcgtgagggtttgcgcatttccggggcggaattccgcgattccgattgctgaggttgggtttgtttttggggttgttgcgtctgcgccgccgccgcgttcgtggggtgggcgattaggggcaaatgctgcgtacatgcctctccggttcgttagcaaattagctgtttcctaggaagacctggtaaaagtaattattcagaagaaaaattgaaagaaagaaccggtactgtaattttgcccaattcaaatggttgaattgttcctggttggtgcttgttcgtggtggtcaatggtcggaattggtacggtctttatacacttttggtgcacttgttgttctcttcttttacatttctggaagagaggaaaccacgtattttttttgttagcctgccggccctttcactggatttgtgctgactggttactgaaggtttgaaatgttagcatttcagcaaactgtcggaccatctgttactttgggcattgagagagaatcctgttggcgaagtctgttgattggtgttggaggtggtagtgttccttcattgtaaggaacaccacattccttttttttcccctttggctttttatagattattattaacttcagaaagtccagagacgtggctgaattgatgggtagagatttgtttgaaccatagaataaggtaatggtgaccaaagtaaaggttggagacttggcatgtacgcagtatatgagtgtaaattgtgagatgcaaagaagatctgggaattgcattttatgcacaatatgttgtttgagtccaatcttttgagttatgttctgtgtcacgtcaatcttcagagtgttatatcattgttcttcagattaaggaagaagtagtctgacatgaggttccttgcataaattaaatttgctcactgctatatccaaggtgaggaaaaaaagtgcaaaattacccaataaaaacaatttgtgcttgcttgcatagtgtggatatgacccaagctctttgggttgctggtctggaacatgaattagttcccaatccaaagggattgggttaaagccctccttacatgaaaaagcctaatggtttagggcccctttgatttgtaggaaaaacctaggaattttagaggatttcagtcctatagaaaaatttcctatgaaggcctttgaaacaaaagattgaatcctatcctatcctttgaaattcctatggaatggacgatcttataaatattttggaggaaacttagcaagaggtccaacctcttggaaaatttcctttgagtctatctctctcatccaatttctgtgtttttcttgcggtccaatcaaacgatatttcctgtgtttttcatgcgttttgcagtcctttgttttgcatttgcatgcctatcagcatattgtgtttttcctgttcctccattttttcattcctactcaaagggccctactgtgtgtggctttgttaagttcgacatcgttatttagatgttctatacctggggggggctcagattaattttttcctctactaaagtgcaacttctaatatagttccatgctgcatcctttcttttcaattttcatgcaacccagtttaacagcttatttaagattcataatgttaatttggtttcaaaatggtcaagcttttttggtgatgctacaacagtaacagtaatgtagtcttattcacaggcaaaagctataaatgctatgtttcattcagacaaatgaaattgcaaaaacactcatcgattcatggactgttatagtttacatctttgagatttggcaatagcttgtgtagctgaattagtaatgttgtaccatagggatggtgaatacaaatgtcaaattggaaaaactgaccctttgacaacctacagcatgtaattagctccatttcattctaagtttattatgttctgaggtgtttttattgatattctatatcgtttgctttgaagtcctcactaaagtgatctggaattctacatgcatacgtacggttgaattctttgtatcttttgcacactagcaccatgtcgatgtgttgcaaaggataccacctaaagatacaaataagtctaagatgtaaaatgccataaataattccactatactcaaaatcggatacttacattactatatggtactcatctatatacaatttttttatataaacatactatgatacgaacgacacatccatacgtacatagttacagtcagaaaacatctaatattctaatgagtagaacctacatcatcctccaattccctcttgtaatgagtaaaataagatctattgacattttattatcattggtcgtatgtgcatatttagacttaccgcagtacataatttaccatatttttaactcgtgttgtggttcagattgtgctattaaaggaacattcatttgcatgcaggtgatatccatgggcaatttgttgatcttctgaggctgtttgatttgggcggttatcctccaacttccacttatcttttccttggagattatgtggacagaggcaagcaaagcttggaaaccatatgcttgcttctggcatacaaagtgaagtatcctgataagattttcctgttaaggggaaaccatgaagatgcgaaaattaacagagtgtatggtttctatgatgaatgtaagaggccgattcaatgttcgactgtggaagattttctgtgattgcttcaactgcttgcctatggcagcactcattgacgataagatactctgcatgcatggtggcctctcacctgaactgaatagcttggatcaaataaaggatatcgagaggcccactgagattcctgactatggtcttttgtgtgatttagtttggtctgatcctagtcctgactcagaagggtggggagagagtgacagaggtgtttcctgcacttttggtgcagataagcttgtagaatttttggagaagaatgatcttgatcttatatgccgcgctcatcaggtaagcactaattattttgatctttattttgtctgttgagatctatataacaatttcagcatgaatgtctttaggttgttgaggatggctacgagttctttgcgcaaaggagattagtgacaatcttttcagctccaaactattgtggggaatttgataatgcgggtgctctgttgagcatagatgaaa

SEQ ID NO: 71988 - DNA, 13399 bp, Oryza sativa
gcaacgtctagataacttatcggctagcaccccgataaaacattagcatgaacctatcggcttaacaagacttatattatcaacaacaatctagtaggtcgaacctaaccgatgcagcacgagattgtatatgataatctaatactcgatgagccgatagatctgtctaatgtgatggatataacaaatctatttataacagcattgtgattgtagagatatatcggctaaggcagaagatcagacctaaccgagacattcccaactaaaccgatgcgttctctaaatacaatgcaactagatatagaattgagatatcaggtaggcaaatatatcaaccaaaccagagcgatccaagagatggaagcgatgtagccttgaacaacaccaatgcagccgatagattcaccagggccagcgaaacgtaggacttaccccttcgtcgaagatcgaaatccgatgcagccccgtgtcaggtgccaaattccgccggttgataagtaaaacctcggtaaagagggtggcgatgcgccgagagtagttgtattgatctatgtgataatttacaatgacctcgggtgtacatatttatacccattgggagatactagtccttgtcggacaagaaagaaactctcctaaagataaaaggaaaacagaaagtccttatcggacactaaacacactttcctaaagataaaagaaaacaaactattcctaattaatagataacttgccatgccgcattctctttaaactcggtctcttctggataaacatcctttagtagatcaatttccttaaccgaatatagcaagaatctaacaactgacgacttgataactctcatcggctaatctcaggacttcgaagccgatgctgactctaagccgatgattactccggacttaccaaattatactgttaacaggcggcaacggttacgagtggtggctgtggcgggtgggtggcgcacggggttctcaggcggcatgctgggtcagcgtcggcaaaggcggcaacgcggggggggggggggggagcggcgttggtgtcagcatctacaggggatcgagagccgcgtgtggtggtacgggttgagcagcaacggcggcgtgcgggctatatgcatggttattaccatcattttctatatgcatggtctcttcatgctctcatatagtttctgtttttatatttgtttctgacttgtgaactatttaatcccacacgatttattttatcctttccacaaaatataggaagttaatggtaaggctagttgacatgtgaaccctttgtctcatatgttatttaatttttacttttaaaacggtagagttagtggggaagttttaaagtagtataacaaagtagctggttggactccgcaatagcgtggctagcacccaaacaaaatcatatattcttttagtatgattttacttaaaatttattacatagctacctcattgtgttaaggctttgaaagaccaaacctcatcatcatcgtgtttgtaatcatatagtttttaaaagtcacaaaagttgctaccccttatgtcatatccttctttatttgcttactcgatctatcactatttttattcattcttcttggaacctttaaaaattggattttatagtttttagagtttatttcacattgggttttgtttttataatttatagatgtcccatcgaacatttacattatactcctatacggcctgttcactgcctcttctctttattgtcattaatattttaaaaatcaaagataattatcatttgagttcatttttactttctaaaagtcccgccaaaccgtcagcagctttgccattgtactcctctacggttcgcccactgcctcccttctttattatcattgagattttaaatcaaacatgattatcgttgttttttttttactttttaaaagttctgaacctttaaaaattggacttatagttttattttttataatttttagaagtcccatcaaacgatgccactgtgctcctctacagcccgtctcctgcccactctttattgccactgtgattctaaaaatcaaacataactatcgctggaatttattttttattttctagaagtcccatcaaccgtcggcggctctacaactatactcttatgcaccctgcccgctgcttctctttttattgtcactgagattttctaaatcgaatatgattatcaatgggtttttttttactttctaaaagtctcggcaaccgctttacttgtttgctttatggcatgcctgacgtccctcctattaatcgtcattagaattctatttggtgttttattaacaaattttatatgtcatatcaaccgccaccactttactcctttataggcccgttacttaattttatctcatcatgtgttttagatggtattttttttcaatactttatttttatcacaatttttatttatttattaattgtattcctaattgaaatcttatttttcttttttctaattttagaatttattttttttgaaaaaaattagttaataccgtattgtgttcttttaatgtttttattttttattttcaactagaaaaatgcccgtgcgttgcaacaggtgaaggctattttaattttattatggtttagctaaggttaaattcactgttggaatttgtttggatattctttttacaaaatcatgagccgcaattaagggtccgatcatctcaagttagcatgcaagttttttaaagagatttcttatacgactccttctgtatttctaaaaacgaacaaaattaaaaaccgactcaaacacggatatgtatttccaaaagcgattgaatttaaaaaccgattcaatttaaacacggatgacgtaccaaaagtaccggcaaaaacatcttcaatttttataataattgagatttcagttgtttcaaagttgtattcctacttgaactctcttttaatttttctaattttggatattattttattttttattcgaaattttaattaatctcgtattgggttcttatatggattcttctttcaatattgcttatttttaattccgtatttcagctaattttaaattgtattcctacttgaactcttcttttattttctttttctaatttcggatttatttttaattttattctgaattttaattaatttcgtattgggttcttatatggactcttcttttaatattccttatttttaattccgcatttcagctatttttaaattgtattcctacttagactctcctttcgttttctaattttggattttattttttttatttcgaattttaattaattattgggttcttatatagaaacttcttccaatattgcttatttttaattccgaattttagctatttttaaaatcgtatttctacttggactctcttttccttttctacttttggattttattttattttttttcgaattttgattaatctcatattgggtttttatatggaaacttttttaatattgcttatttttaattctaaatttcagctatttttaaatcgtatttctatttggactctccttttctttttttctttttctccgattaatgtgggaatttctagccccacagcgaacgtggtgcttcctttcaaagctgttttaataatataactagcatggtggcccgcgcagattgcgcggctagcatcattatattttctctcatataatagcatatttgttttctcattatattattcaaatatattaaaatgacaacctaattttaaattttgtaataactttataaaactactaatgtgtaatattcatattgtattttatatacgtgttagttattaattatttttaatatcaaattttagttatttgtaaattataaatattcttatatggactctagactcgtcttttaatatttcttttttttaattccgatttttttgtaaattatatttctatataaactctatgctcttttttcaatattatttatttttatttctgaatttttattatttctaattgtatttctatgtggactctaaactcatctttcaatattctttaatttttaatttcgaatttcagttacttctaaattgtattcctatattgactttaaactcttcttcccatgtttttcttaatttcgaattttatttatttgtaaattgtatttttatacggactctaaactctacttttaattttattttgtttatttcaaattttagttagttttaaattcctatatggactttatactctacttctaatattccttattttttaatttcgaatttctattttttttcttaattcttaattgtatttctatatggattctatactctacttctaatattccttatttttaattctaaatttctattatttcctaattgtatttctaacctagactctatactctacttctaatatttcttatttttaattccgaatttcaggtatttcctaattatatttctatatagactctatactctacttctaatattccttatttttaattcctaatttcagttatttcctaattatatttctatatggactctatactctacttctaatattccttatttttaattctaaattttagttattttctaattgtatttctatatggactctagactcctcttctaatattccttgtttttaattccgaatttcagttatttcctaattgtatttctatatggactctagtctcctcttctaatattccttatttttttaattccgaatttcaactatttctaaattgtatttctgtatggactctagtctcctcttctaatatttcttattttttaattccaaatttcagctatttctaaattgtatttctatatgaattctgttttttctttttctccgattaatgtgagaatttctaggccatgagagcgaacgtggaggctcatttttctattcctttaataatataataatagatagatagatagatagattgttatcaaaacactatgaagtctgaaaatgtatcactacaattatacaacttatacacacaggggctaacatatactccctccgttttttaataaaatgcgttgagtttcaagaaaactgttttaccattcatattattatatgttaaagtataagttgtccaaataaataaaaataacatttataatttttaaataaaacaaatgattaaacgtggtactaaaaaatttaacggcgtaatgtatttaaaaaacaaaggaagtatatatataaatatatatacatgtgaaaagactgaagagtagtcaggtcagaagagggaggctgcggaaatggaagtgatcttgttgcctctggttgtcatcatcacatccaccatgcttctcctattgatcatctccacggcgaagaagagacaccatggcacggcaaaccttccgctgcccccagcgccgccctctgtccccgtcgtcggcccgcttctctggctcgtgcgcgcgcgctccaacctcgagccagccatccgtgagctgcacaggcggcacggccccatcctcagcctcaccttcctctccccgcgcgccgccatcttcgtctccagccgcgaggtgacccaccgcgccctcgtccagcgcggccacacgttcgccagccgcccgccggccatcgcgccgttcgccgtcctcaccagcggccagtgcaccgtcagctctgcgccgtatggtccgctctggcgctccttgcgccgcaacctcacctccggtgtcctcggccacggctctcgcgccccactctacgcgcctgcacggcggtgggcgctccatcttttgacgtctgacctcgcggcggcctcgggaaacacgggtggcggcgtggccgtggccgtggtggactgcctccagttcgccatgttctcgctgctcacgtacatgtgctttggtaagaggctcgatcgtcgtggtgtccgggagatcgaggccgtgcaaagggagctcttctcctcgtacatcagcttccaggtgttcgccttctgcccgacggtcaccaagcgactgttcttccggcggtggcagaaggtgctctccattcggaggaggcaagaagacatattccttcctctgatcgaagaaaggagaaaacgcatcaagatcagcagcatggacaacgacggcagcatggtttgctgctacgtggacacaatcatctcccacaagctccccaaggaggccggcgatcgccggctcaccgacggcgagttggtgagcctctgcacggagttcctcaccgcgagcgtcgacacgattgtcaccgcgctgcagtggatcatggctcgtgtcgtcgagcagccggagattcaggcgaagctgctggacgagatcaaccgcgtggtgtcgagcgacaaggagcacgtcgacgaggaagacatcaagtccatggcgtacctcaaggcactagtcctagaggggctacgtcgacacccgccggcacacttcctgctgtcgcacgccgcggtggaggagacgtcgctggacgggcaccgcatcccggcgggcaggtcggtgaatttctcggtggccgacgtggcgcacgacgagaacgtgtggagccggccggaggagttcctgccggagaggttcctggacggaggggaaggtgccgggactgacctgactggaagccgggagatcaagatgatgccgttcggagttgggaggaggatctgccctggacttggcctcgcgctgctgcagctggagtacttcgtggcgaacatggtccgggagttcgaatgggggatggtggatggtgattgtggtggtggcatcaaccttgccgagaggccggagttcaccgtgataatggagcagccgcttcgtgcgctggttgtgccgaggaggagagagtgaccgccacgcacgggtgtgcatgccttgatcgtcgtcgctgcatggtgtgcagctgcacccaattggagagttgcgtatcttctcattacttgggagatacctctcctatccacatatacatatatatatattacaagtagaagtaaaataaataaattcaactttgtatctgttcatgagttttcttcagtctatacgtatatattcaattagcattttagcaagagacttatatatctctgactgacaggcaccataagtattaaatcgttgacatattagacacatagaacagatgccaccgaaggatattaggtacgtggaatggagctttgtaccttagtcatcatcgtcgaaacgcatgagctcttccccatatgttcatatcaaagttggcatggttaggatgtgtgtcagctgcatgtttcactgccccctctgcttcctctgcctcaggttcggtggcctccttacagttgatgtaaacggtggcttcctcgaggcaaccaaggtttgccaatccaaagtcgaagccattgccgagatccttggtctgccttaccccgaagcagaactcgatgatccgaagcctcggcatggctccccgctggatcaccggcccgtggtccgagttccggaaccggcattccttcagacacgggaacgcgtctcgaccaatcacaatcatctccttcatctcgtatggctccacgcgaagtgtccgaagaacaggcagcttcccaagggcgtcgatgtccacctgcctgagctccctcacctggatgagcagcacggcgaggcgcggcacgacggaggcggcgatccacgctggcagcagccgcagtgggctacaggagatgtacgtcgccaacgcgctgaatgatcggaggcgcggaggcggcgtccagctgccatcctggagaagatcgagcagcctcttgtgcccattcccgctagcggcgtagatgtgaagatcctgcaatttacgcaggtttcgcagggactccaccagggcttcctcggtgctctgcgtcggctgcctcagcgtgatcttgaggaccctcagctttgtcaggttcctcagctcgttcacaagatccggtgaatcgcgagtcgaaatgtccgagagctcctccagtgacaccagattccctatcccactcggaatccttgtctggaattcaacacgaaggcacatgagctttccaaggcgaaagactgttgccggcagttctttcacccttgtgtccgcgaggtccagcgtctgcagaaactgcagctttcctacatcttctgtaagttcagtgatccgtgtatttctcagtccaaggtaccgtaggtggatcaaactaccaagatgatcgttgaggacgtggtggctttgtgaaatatcacaaccttctagatccaatacacgaagaactttgaactctgaaagattgatgctaccaatagcagggctgaagacagaaagcgaccgcgcttgaagcatgctcatcatggtagcctgatttgtagtgtctactgatgccttgcttcctcggatggataaccggcaacccttgtttgatgaacatgtctgctgctcatcgttcaatatagtcacaaagttttcttcgcttgacaaggagctgataagatccatcaccgagaaatgtacacggcagcagtattcttccctgataccatcttcgctataatctatgtctaataatttgaccatgcttctatttacaagctcattgaaataactctctccaagctcaaataagctctcttcgtgatttccatcttggataaaaccttcagctatccacctccatataagtcggtctcacctgacctcataatcttccgggaatatgcttagatacaataagcaagcccttagatttgcaggtaaacggtaatatccaacggaaattgtcattctcatattcttcacgtcagcaccattctctagtgttgaaccgatagagttgtggaccttataccattccttcttgtctcctattttaccagccaataaactggctagtgcaagaatagcaataggaacaccgtcacatttctttaaaattttatcagctacttcagcaaactcatcgtcgagacagattttgttgtcatggccaaatattctttgaaggaacaatatcttcgagttttctgcagaaagtggctttagttcatatggcattccagcttgatcagcaacactgaaatttcgggttgttgtgattattctacttccacaataattctcaaccagagcatgcttgatcatttcccaagatggcttatcccataaatcatcaataacaatgagatacctatacatgtacaataacactggatgagaaatgtagttacacaaagtaaaatgtattatacatcatagactatttcagaagcaccctttccacgaatgtaaaaataggattgtcaactgcaaaaaagggaagcaccatgtgcttgacaagttaaagttcatctttaagctaaatggcactatggctggcagccttttgagcttttatgataacctgaaggtgtactaataatgaattacatttttcaaccgtaggaggttgtggcattgtcatgtttaatttggattattgagcactgagaaataaacttaataaatagcttaaaatgtattttaaacatagtgatatccttagggagtaataatgatgtctaagcaatgtagttgaagaaagtattctttgagaaaacgttttttttttcaaaaactggagcatgtaatccattttaataatctgatgaataagctgaaaagaacggggcctattcaagccaaataaagattttgtgagttgtattactgtatgagcatgtatcaccatctagttctgcgaaccaccttggccgcggctactagattcatcatgcaggtcaaacattttgtattaaacaaaccatctgaactcaactataaatatcaattagtataccattatgggccttagtgaaattttatttgattttgggagaaatgagaagtgagtttagttctcccaatgtcaaacatgcttgaggcacgctttctttgcactcaagatcatgtggagaggattccatcataccatctgtgtacacaacagctgggtaatcgcatttccttttccttgggttcccctgttttcctctgttttcccctgttcttccccttgttctctctgctttcccctgttctacccatttttttcctattcccctgttcactgttatttttacagctaaagttgccacagaaacgtactcaaataaactctaattcgatcgtgcacatggcgagctccactgctctaggtatcatgtcctttcgagttcgagatagaaccatttggaaatccaagaccaatcaatcattagttgatgctaatttctacgtgaagcagtaacttactgtacatacctcctgtctcgtaggaacttgctcagttgatcgacgagctgcgcctcgccgctgacgctcggttcctcgccgccgacgctctcgtgcttgtcgtcgtcgtcaagctggcggagcatcctcatgaaaaccatggccatgtcgggattgatggcggacaccgacacgaaggctccgcagtcgaaccgcggccggagcgtgtcgtacaccatcttggcgagcgtcgtcttgcccagacctgcggctccgacgatggacacggtcttcagccgctgctccgattgctcgtcgccgtcgacgtcgtcgcagagcttcttgatcaggtcgtccttggcggcgtccaagccgacgatctccgtcgccggcgggccagcgtcgacggcagcggccggccggcgagggtcgacggccgcggttgggcgaggcctcctcctggacaggtcggcggccctctcgagaagcgccttgaccgtcgccgccgacgccgcgtcaggggagccgtccgcgcgacgagccaagagcgccgcgtcgcacgcgagctccctggcgtggccggaccaggccttggcctgctcgtcgaaccgcgctgggggcacgtcggcgaggtagtcgtcccggagcgcggcgtgcacggccgtcagctccgccgcgaggagctcgacggcgccgccctcgcgtgtttcttcttcctcctccctgaccaccagcatgatgtcgcccaggctggagagggcgctgcacgtcgcggccatcgccgtctccattgctctgccgtctgcaccgcaggctgttgccgccggccagctttgtccttcctcgtgactggtgtggtggtggagccggaggcagtggcaatcagaccaagcaagtgtcagcaagtgtcattgcgatggcgattgtgcagcgccgacggatttgtttagatttgagcgcgggacacctggtgtgtttggttggagggatatccctagatggaagatgacgattcagtttttaaatgtgtttggttggtgggcgaggatggatagggtggtccagagagggaatatttcacgaagatgctggatgagtgtatccgaccaaattggccggacgaggatatcaacctttactaatctttgatcattagttcttaattagcaataattaaagtatattattgttaattagtaattaacttgttaaaattagtgttgattagatatagttactctattttattgttaattagtataaattatggctatattaatgataattaacatattttattattaattattacgttgttgttttcattcaatccattctcatccacccaaccaaacaaaaaaactggatgattatatccacctaaccaaacaaaaaactataccattatatttaagatagccatattctgtcttgaccacgaaacaaaatatagaaggacgcagcgtcccctcacggttccacagaagcgtctagttttagcaacacgtgtaagtgccactgccaccgatttgacgtcgatcagtcaatcaacatttcagctgtatcggcagcaataagaattaaaagtatagccaacgccaattcatataataattatatataaatatatactactctttcttcacagggtaagactttctagtattgtccatattcataaagattaaaatgaatctaaatattcatatgtgcctacattcattaacatccatatgaatataggcaatgctagaaagtcttatattgtgatattaatatttggtcacatttatcataaatacattacgtcttagagtctatgcggcagctggctataaatatatatagcccaccgctcatctctgtcttcttttatcttctcgatatgtgtttataactggcttatactactatgtccaaaaaatcaaacctggatttgaatctagacacatttgatttttttagacggaaggggtagaatgctactgtacctgctctgagcgaagccgtcttcacagcatctccaacagactctccaagttaaaatttacccattttagcaaaaaaatctcacttcaacagcctctctactagaatggctaagccaaatgactagccaaactcctcccctcaatggctaaatttggccagcccaaattgccttgccattcgtgggcccgatgttggagatgcttttctctcaccccgtactacctgctcgagtctgctcccacgccatctgcgcaactaccgccagcgatggctgcgacggatggggacggagcccaagcggcagaggatggcggtgatgagcccggatggcagcggatagcggcggagcccgagcagcggtggacgcggcgaccaacccaagtccctccgcctatcaccgccgtgtcctttctccctccgctcgtgcctgccactgccatgggaaggaggcgcgtcgtcgctcgctcgcatcctccacccgagctcgccgtcaacggctcgcccgcgctcaagatcggcggcaatgggatgtcggcatcgcacctccctgaggagaggattccggcatcgctcctccccaccttccacctcctcccaacgccggtgctgcccctctcaacctcctcgtgccgccgcatgtgccccagccacatccacctccacccccggccatccggcgcagcttgccatctattgctgccatgccacgggaaggtggggaaagaaaagaaatgaaagggagaagagtgccaagacactggcatgtggggcccaataaaaatggagagtgtggaatggacagtctgttggagcgtgtaggagatacaaagagaaatgtttttagcaagttggccaaatggatgaatggagaggcaaaaatagccatgctattggagatactctagggacacgaaaaatgacatgctctgtcctctatgaataccacctccgtcccaaaaaaattggacattctcctgtccaactaatgtcccagaaaattgaactcactagaagtaagttatacagaggtactcccttcggcacacaaaaaaaatccat

SEQ ID NO: 71989 - DNA, 3400 bp, Oryza sativa
aatggtactatgcatataccttgcatctatattcgttcgagctttcccatctaaggctaatcaactaccattgcttctgtattcaagataccatgacataaataatattacttcctccgtttcatattataagattttctagcattgcccgtattcatatagatgttaatgaatctaaacatatatatgtgtctagattcattaatatctatacgaatgtagacaatgctagaaagtcttataacctgaaacggaggtagtaaatgagtggcaatgatatttacatggaaaatgtgagcacacatcagaaacggaatgttgtgatgcagcattcttgttctttgttgcaaccttgtagtggagtggcttttgcataagctagcaatatgggaagctagtgagccaatttgatttattttcactcctttcattttaatcctgtcttgagatttctgaattttcacatgcaatatttcaacatttatgaatgattgaattgttgtgatcccattttcagatccttgacctttctttttgttgtgtttcagatgttagacagtgggagtatatatcctattgcctttctcagctgactttcacagagaagggtttgaaaaaactagttgataatttcaagatatttgagcatgcattatctgaagattctgtaatgaaccacttcagaactgtgatagcaaaggttggtgctcagtagcctaggctgaatggatgcatatgttattatgttaaatacagcagggctgaatttgtgaactcttcaatgtttttttaatctatggtaattcctcctatcagtgcaagaagtttgccaagccagatctcaaagtttgcattgaggaatttgatgagaaactcagcaaggttcatcaggaaaagaaagagcaagaggccacgaccaggaatgccgaggcacacaaacaaagaattggttcacttgacaaactcatggtaactaagagaactgggaaggataagggaaaatctgctgaaggtacaattttttttctctgaatctccttatcatctatatcatttaagttaatctccacatgatcatccatcatgtattgactatgaactcaaacattagattagaataaggttacgctgtaaatctgtgtctataatctatacaccagaaaaattgatgcttaccttaaactgaggttcatttctttctgtctgtcagtggcagaggaaactagtgaggtagttgatccatcaacggagagcaattctgaagataaggagaacatgccagaatgcagtgacaatatttgttcggaaaagagtcatacatcatccacgtttacagaatcagacggtgacagcacagaggttcaatcagcgagaacttcttgcaaaggtaacagatggttgcactgctgatattcgcatgacacatccagtttctcaaggaatctgttccatgcattatgcaggcgtgtcgcgttcaaggataaataaaatgagagaaccggaagactcagaagacagtgctccaatgagacgtgtgtctcgcagaaggtgtttacactcactaccttacaacaatcttacttcatagtagtagtatttgtttcacgtccactaattttaaatctttctggatcattgctttgttcatactactaagcagtgctattagactcgtccttaattcctactcatgaattactaagaaatgcatttgcttacaaactttgcagaccagttaggtgatgccgaactgtaatatggaccaggtggcaacaactcctctctgggaagatctcgccttgagatcttggagttctgaagcaactggtctccctggcgcttgtcccaccagaaactctatctaacgccgatatatttgttgaatcataatgtttataagcctgcgttgacctgctaaatcttggtcagctccacacggaacggtttgctggatgctgatatttcatctagtaggttgcctctgattgataatccgtaattggagttcggtatctagtctccttgccccgtatgttgaattttttgttcgttacgatttgcgctgcttgaacaaatctatactcgcttggtcgaatccagaacttggtactactagagagatgtacctgtatgttgtctgtagactgtactgcctccattctcagtattggagtacatgttttaggtgtatgcaggtaaactttggatatatatgtattcctaaatgtattactagcatttgtcgtgtgaaaaaaaatactagtggattcctcatgaaaaagtactttatactattagtagttatgaacatatagctaaaaaaatataaattcattgatagtcgaagttttaaaattttgattgaattttatctgaaatatcatatactttttaaccagatggagtaataggaattacatatgcttattggagagctggggccctggaaagcccaggctaaatcatccatggcctcacttaacaaagcaacaggcagcagctcatttgcgttgtccagggacaaggcaaaggcatgttgcgccacttgtgcaatccagttctttttttcgctgtctgcctcgaatctgggttgctcacatccacatgtcatccatttctcctcaaagaatttgatcacgaaattcagccgcgacgttgacggattccaccagccgcggtcctcctcatgctccatggctgatttggaccactgatttgagtggcagatgatttatctgagatttaattcagtgctgaaacaataacagttcactagtatgaaaaagtattagtcggtcatatgcttcgtcgcttgcatactttttccatgcagtaactgcaaccggtgcatatttctccacggtgaaaaagacattgtcacactagacatgtttatgtagaaatatgagcaggtgttttactttgaatcattaagattaagatgtagattttacttcggtttctataagcacactttccaaagtgtatttcttataaaaactttatatacagaagttaccctaaaatattaaataaatctattttttaagtttataataattacaactcaattattcatgcgctaatggattttttgttttgtgttgcgtaatttcattttcatcttaatctatctcaaacaccacctgatcagtcatactatttgtcctctaaagatttcgatgcttatttgtggttatacaatgtaagcaatgtcaactgccaagctcataagctagatatattcgcatactccttctgttccaaaacagtataagcatttccgaaacttaaaatatgtattccattataaacatttttctatcaactttcccatcttcaccaatcacaactatgtctccctggacgtcagtttctattaaaactcttaaaagtgctt

SEQ ID NO: 71990 - DNA, 1454 bp, Oryza sativa
acactttcttttgacttaccatactacctttgataagctggccgggctgtgcggtttgtgcgtccccgggaagttggagccgtgcgtgcgtgcgcttcccgggccctgtcgcgtgatccgtgtggccgcgcggcgcgtggagatcgaacgagccggccggcacgcgaggcgagcgtacgtcccgtgcgcgagcgcgcggctaaaccgctaaagaacccgggaattcgatcggaatggcgttaacgtacgtgctaacgtgtcgggtacgtacgtgacatcgcggcggctggcgtggcgtaacttgatcgatcgggatgccatgccgttcaacccaagcgtcgagaaatattctgcatgggcactaacgtggccaaaacccccaaaacccaatccaatctcctctcgcggaaactggtgcgtgattgttcgatcgattgatgatcacgtatattattgttcctgatgaattaataattaatcaggaaaataactccaaagttttagtgctgctgtgtgataaccagatttattgccccgtgcattagaagcttggaatggaagacctgatcatgtaaaataataataagaacaagatgaatcgctgagtaagcagctgatgttctacgagccattttcttctccctaatgcgtcatgcgtgtaaactccaacagaatggaccaaagattcggtgggtacgttcgtacgaatcaatgggcacaggccaataaaacaccgaattaaccactaaaaccaccgtggcagcgtccctaattaaactaatcgtgatagctttgctttggcgatccatcaccaacgctacgggacatccacgtatgtacaaaacgaccaaacggacatgagaaaccattggctctgtggcgactgattgaggctttacctgaataaaaacggtcagggtcgtcttagcttagtcaagtgtgattgtttatgattggaacatacctaaggaaaaaggtgattaggtgaaatgatttcttaaactaacatgggtgcacattcggttccaaccagtatcatcattaccaaaagcaagttgcagttgagtagacatgcaaaccaactttaatcctactctctgttaacctcccctgagcagctgagccgaaagttcaggtttcagactgcttacctagcagtcattgtaaattttaagttgagctatattactaccataaaacgctattgcatcaagatgcttaaatcaactaacatgatattttttccttgattggtgtatgctttgaaggcctgccaaataccaatgcaaatgtacaaggtagtagtaataccacaactgttgtaaataaaaaagagtaaattttactttaagtcaccttttattatcaatgtttctctttggatcacccttcaaccaatgttttcattttagattagataattttatctttgtgacattttaaaccatcctcaa

SEQ ID NO: 71991 - DNA, 3757 bp, Oryza sativa
atgcacagattaaacggacatacattaaaatgaacgaatagtccagccaattagtctacctaattagcattctcaaattaactcttaaccgttagatctaactgaactacagtaaagaaaatgtaaatttactcaatgttttgttagcaagaaaaactttatatgtaaacttttttttcccatttggagccccctgtttgtactgaatttgccatttgtagccagtcctctcatcctctcctcctcgaaacggctaagcacaaaaacagaaaaccgaaaccgagggagaaggagcaaccaaccaaaccaacggacgccatcgccaccaccatcctcgccgtcgcctctccaactcaccactcctcctcctcctataaaccaacgaagaacacaaactcaaactcctccttcacacacacgcacgcgacaccggtcaagaagcgcgcgcgcgcgcaccactgcaccgcgcgagcggcaacggcggaggaggagaggctgtgagtggtgggcaatggccgtggcggcgcggctgaggtcggcgggggcaaggctcgtggtcgggccggcggcgatggcggtgggacgtggtggtggtggggaggggaggtggatggggacggccacggcggatgcggccgcggggatcgcgaggtgggagccgatgggggcgcgggagtactacgactaccggagggccatctacggcgacatcacccacaaggccatcctagttgacgccgccgggacgctcctcgcccccaccgagcccatggcgcaggtccgctcgcctcctcccccatctgcatgtcgcatctctctctctctctctctctctctctctctctctctgtgtgtgtgtgtgtgtgtgtgtgtgtgtgtgtgtgatgcggccgcctccattccgcgggatgccaatagttcagtgtttctaggcggattttgatcttacacaccactcattatttatattcattaagtgtgacgaatcgacaatctctgtggtcatgtgcgcgattaaacagtgcatcgatctgatctgttgcagtgttgatgttctatccgatccaagtctatggatcgatttggattgtgtcagacttagtgagatctatttgtgtgttcttcaagtttgtcatttgggtggatttgttccgtacataatgggctggcaacaaaaaaagctctctttttgcgatgctgggatatgtgtgcgcaattatgcatatggaatatgtcttcttcatgtggcttactcctgatgtcctggtgtttgttcaggtatacagaacaattggcgaaaagtatggagtcaactactcagaggatgagatcttgatgagatacaggagggcttatgcgcagccatggggtagatcgcggctgaggtacatcatataatttgcttttactgttctgcatcactactgtaactgtgaggtttggatttagtttttgcagtgtcttggatggccttgtgattttattgttcctgtgattttgatgatttgatttttagaatagcgtctggttgtgggacattatgctatcactgtcgagtgcattatagtgtgtcaaatccttactcaaatggttgttgacgtgtcgtatattaatgctttttgtgcgatttaaacaaggtttgtgtcatgcagaagcagcgcggctgccaacttaatatttgtcactcagtcagcacaagttggtcttttcaaactatcaacatgatattccctgactccctctatctactccgtaacagagaatttgctcttgtgggcacatgcaaatttgatcttcaagtggtacgaactcatgaaagatgaaaaatatgagcatccaacaggcatacaagcatgaaagattttaaatagagtgaatcgttcaacaatatgataaattgcgggatagaaaacttccatcttgtttctgacgaaaaaattctatcaaaactgaacctcaactgaagaaaattgttaccgtgatgccaaacagaacctttcaagaactgttgttttataattctatgaacaatcaatgtttcagattgatattcaggaactaaccaattttcgggaatgagttatatcttggtgacagaagaggggaaatgaattttcatcttacgtttataggcagtattcagatcaaatacagataatttttctctgtgtgtgtggtttagagtttagacactatacggttgactagtgaaactcttgacctggttttatgttgcaaagcacacataagtatggacaatcatctgcatctaattcttcttgacatatttggttgatggtgataggcagtacaagtgcatttattctttcttatggaccttttatctaaccagtgcattcacgtgcctccttgaactctgattgttgcgttaccaaaatagaatagagatataaccatggtagagttgcagccttccagatatgtgattgtgttgttcacattctagattcatatttcaaccatatttacctttcttatccttcaaatttatctgagctgcatggactaaaatgcttcaatatatccaggtatgtggatgatggtaggcccttctggcagcatatagttagctcttcaactggatgctcagatttacagtactttgaggaactttatcagtactatacaactgcaaaggtgagataaactatgcaatcataatcgtttcaatttttgcttttacatgctatatataccttatgaagttcttcatgtttgctaggcttggcagctctgcgaccctgacgctaaatatgtttttgaagcattgagaaaggctggtgtaaaaacagctgttgtatccaactttgacacacgtcttcggccacttttacaggccctgaattgtgatcactggtttgatgcagttgctgtatctgctgaggtgggtttccattttcagatgaaccggttagcttggcccaatgtccaagccctggctggtccttgacttactgttcttgtctctggatcctatatcaacaggttgctgcggaaaagccaaacccaacaatattcttgaaggcttgcgagtttttaggtgtgaagcctgaagaagctgtgcatattggtgatgaccgcaggaatgatctctggggagccagggatgcaggctgtgatgcctggctctggggcagtgatgtttactctttcaaggaggtacaaactacataccttaaattttcagatgctccaacactgcaagatacaaacaaaccaatcatagttctcttcttgttttagtccatttaatgccaaagttgctgttctattacttgtctctctttgttcagaaccaagctcacatcatcaaatctggattgctatgcaggtcgcagaaaggatcggagttaaggtgtaaggagtcgttcgtccgctgggtcacctgaaataagaaggccgggaggtgttgcatttttgtacatagcggcaacccttgttgctccactgatgtacatatttttccagagaataaccgatggcagtgtagtatatatctgtatgactgcatttgcatttgagactttgagcgctcaatttacgttacccctgctggtgtctgaaactctgaatgtctccttgtgttagctgaacctgaaaacgttaacctgaaggcgattagcatcaacatccacattgggtcgccggcccaggtgaccaggcctgcattatgcttaccagttctgggcagcgcacacttcttttccattttaacagcacttccatacaaaacttt

SEQ ID NO: 71992 - DNA, 7871 bp, Oryza sativa
gtcgggggcgcaccagtaaggtcctaaggtcagtggtgaaatcgtgggtccatgactccaccatccaaggtttaaattctattacctacgaatattacgtttatacaagtgtacttttaataagattttagtaagatcaagaatgtactgttgtttttcatctcttgataaggatatcgttgtttttcatctttttgagcttgtgttaaggggcagattcatggagatgtgagcaaggtgttggtaagatcatgaatgtaccgctaattttaggggcggatccaccgtatagcaaggttgtcaggatcgggatactaggtagtatcgttttgctcaaagtaatatcgtatcgtagtattgggatgctatgagattttcttttttaaaatttaattaatacttatattaattatatatagccattctatataaaaaatatagtaatgatatatgtcatgtaaatagagacatttatcaagagaaaccacgttggttttgatatatttaactgatttttatataaatttgagcatatttagttacactattttcaaaccatgttattttaaataatattttgtagtatcgtagggatcgtagaattgggataccacctaagatttcatatgatcatgtagtaatgaatagtaggatcgatatactatgaaaattaggatactaggtgggatcggtatcgtttcggtttggtaagatcgtagtatcgtaagatactagaatacgtatcgggatactgataacattgccgtatagttaatatttttgctaattacactactaaatatgcttggaactaataaatcattcttagaattaagcatttgcaccatggtaggtgaagagtgaccccaatgatttttttttctagctttgctcctggctggtttcatctctttgagcttatgttaggagaagtattcacggaggtgtaagcaaggtgttgcatgtgtagtggtgtgtgtgcgtgtgtctgccgtgtaatcgaaaaaaaaatcaccaagcatgtcgctgtgagcagtaaacctttttttttaaaaaaatgaaaggaagtgagcagtacaaacttgcttggcaactttgacatgaaaatccaacaaaagaagctaatcggaaaacttgtcaaaatggaacaaccccatgcaaaagtcccaataagttttgagttgcacgccaaaataagataaattcaaattttgtaacaacttcagctcatgtcaattagcatatattgtcagaagatgtacacaagacgtgctagttcatgcaatctgtttgccatttgacggtaaatcatttaccttacttacaaacagagatcggtctggatgtacaaaattcttgtagaaacaaacaagagatacccatccaaaacatatgtacatctaatccaaatttccaaccaaaaatcgcttcaatcttcaaagcaaaactagcagcagccaattagaagagaggattagacgaaaattttcatgcatgtctacttgattcccttgtccaacccgagcaacctcaccggagacagcctgccggtggggctgacgacgacgtcgaccaccctccgccgcccattccgctccttgatcgtctccagccgcggcgaccacggccgccccctcgccgcgcccaccagctgctcgtagtgcttcctcagctccggcgtgctgcacagcgccgccgccccatgcgcgtcctccccctcgccgccgccgccagccggtggccgcctccccgtgacggccttgacgatgaactcctccgtgaccttgatcaccgtccgtccgccgtcgtccttgacgtactcgaacgggctcttcgcgccaccggccagcagcggggcgccggcggccctgtcgtaggtgagcgcggcgagcgaggcggcggtgacgacgtcgcggccctgggggaggcggtcgacggggaggacgaggtaggtggcgcaagcgtcgaggcggtcctcgatggcgagcacgggggccgcgcggccgaggcagaacccgtcggcgcggcacaccacgaggcgccccgcgtgctccatcatcacctccccggccatcctcccggccgccgccgcccgcctctcccctccccacagcaccagccgcgcccctcgccgccgccgccgccgccccggcacgacgacgcacagccaccccagcaacccattcttccccatcgccatgtctagctagtcccagcaaccaacacgagcttagcgttactatatattgcggagcacgaaggggttgacatgcatgtacatgtacgagccgcgagccgatccgtgcgaggcgcgcgcgaggttgacatcgcgtcggtggtcaaaagtccgcgggcgtttgttcgactagcgcgcgcgcgattcgccggtggaacggttcacgcggggacacgacgggatacagtgaaatctcgcgcaacttgggcgtttttttgggcagttttggtggtggtcgctgcaggcgcgtcgcgtatcgcgcgcgggggcggcacgggcgggcgggcgggcggcgcggctgcatctgtgctggtgcagtttgccgtggcggtgagggcgcagcatgtgtgcgtgggtgagtgagaggacgagattgtggtggagatcgtgctagcagggggcgacgtaacctagtcggcaaggcaacgggggtatactggcctgattctagctagcgatcgattgatctcacatgttacaccttacacgtacatgctggaaaacttctctttttttttgatatatttcttccaaaaaaacctagacaacggtatcccgttccagggatacccttctatggatacctgatacctgtcgtggtaccagctgcatggtatccgatacctgtgatacctgttacccggtacatgtgatacctaggatctgacacatatgatactcgtgaaagagaatagttaatatacctatcccattgcaacgggatcccgttttgtagcagccctctatttcttttgagtagttttaaaaaatgatgggataaatcagtgtacgatatgtcaccccttcaaactttcaacttttccgtcatatcaaatgtttgacatatgcatggagcattaaatgtggacgaaaaaaaattaattgcacagtttgtatgtaaattgcgagacgaatcttttaagcctaattacgccatgatttgacaatgtggtgctacagtaaacatttgctaatgacggattaattagccttaatagattcgtctcgcagtttacaggcggaatatgtaatttgttttgttattagtctacgtttaatacttcaaatgtgtgtccgtatatgttactttttttttatcaaaacaactaaacacggccaaaattcaaattagatcgacacttattacgacaaaaagtgcacggaagctggtggctggtagttagagtcgttattagtagttcaaacggtgagattgtgaaaattcctctggatcgggtgggtttctacttttcagagatgaactggttctgtcaactgcctattgttttcgcaggatcaagctaagggtgaaacttggaaggaaggtttcagcaggatcaagctgggtcagccgcgtactctgcaggctccactccaatacggatctactgatcagtcgtcgcagcactgcagcagtcgagagatgtgtatcatttctgagaccaaattgtattattttactattataacgtgcgcaataatttatactagtagtataactatgcacctaagcattatgaaatgccttgctataaattcagtgaaagatacgtcagtggcgacgacgttttgggcaagtactcttgctgctgttgtgtttgacatcttcctccaatcctcctctcgattgtcccatgaccggatcctaatctaaccaattgaatcatttctctattattaaatggaattcgccacgacagacttactcttcatttcgcactgcttacaacatttacatattaattaaagtagaacaacacatagcatcttcaagctagacacatactcctaatcctaaaatatagtacatttacatagcatctgcaaaggtgcatgcaagcaaggttcaccaaacggttttcaaaccaaaaaaaaaaaacgaaggtcagcggtttcctcggttttcgtgaaaaccatttgaaagttaacgataaaatcctatcaaattttatcgaatatagaaaatctagcttgctttattttttttttcaaaacttacctttcgttttatggaccaggaccaatttcatctcagaccaaactttaaaaaccaagaggtttgtgttttcgagctagtcctgcggctttcgactgtttggtaagccctgcaggcaagtcccatggtcatgcaggcattacattgcgcagaaaatgcgctgcgtagtgacgacgtgagactttgtcgacgacattatcgatctctctccaactgcagaagaataatttcatagaaaaattgcggcgcctgtggtgcgcagcttgctaattaaccagtaaattataaacaaaagcgtattttgaacaagtcctctatgtgacatgcatgcatgttagtatattgttatgtctagagagagatcctaatccaggtatgcactagcttgttttggcaggtcagctgagacttgtaaactgtcacaacacttgtagtaatttaatttgaaattctgttcttgcctctgacgaagctgtccatatagtaataaagttcaaaagaaatattcaggagttaatgcagggttagatcatgggttgacaaatgagttcgagaaaatcccatgtatattgaaaggtgttttattgcaccctttttttgaaagtcaagagccacaatttacgttttaggtaatggaagtgttataactttgggtctatgcaccaactgttttgaaagattgctatgaagggaaaataacatcttttggcatgaaaatattgacatctctactctttagacatgcttgtatagttatataggcaacattcttacattcaagagttgtttttaagttcttgcagaggttttagttgagccagtctatccatgattctcagaaaaattgcgcttaactttggtctaattttcatttcttaatcttcattcatccaagattccaagcagggctaaatgaaaagcaaaaaggaaaatgttctcaagaaagcctggaatctttcgggtccagcctaattaaagcccacatactgaactgggccggcccactagcccaaatacccgcttggtactgacatgtagggacagccaaaccgcagttctacacatctcctcagctccaggcggcggcggcggcggcgatgggcgcggaatcggagcaaccaacggcggcggcggcgaccgccgagcaggcgcaggatctcatcgacgtaagccctgaaccctcccacgcggcctcctcgccggccggcttctgctcccctttcagctccttacgcgttgctgtagtgtgtagtactgagatggatgcttcttcgcttgggttaatcgcgcgccgccgtgtcgcttctcgtgcaggccgctaggtacgatgacctggaggacgtcgtcgcgctgttcaccgccggtgtttccctagactccgcggattcgcaaggacgaacgggttggtttggttccccgaactctcatgctgcctggattgatcttagccttttgttataattattggtctcgacatgctagtatgatgttggaatatgctatagagatgttgcatggtacttggatataactgaatatttaccatgacttttaattgaagcagagtagaggtagctccatgattggggggcggatgaataatgagtctatgtgtctttttatttgtcttgtagatgactaactatggagagtgatatagctatcattttccctttgctgtttcaattgtcttactacatgtttagctgcatatatcataaattcaactgtatgcgctaatatatctgaaaactgattagttttctagtttattggaaggacctaagcaccctgagtgatctgctgtttaatcatgcaaacttccttgtagaatgttgactaattattcgatcagcagctacctaaccatttttcctatttctgtcagcacttcatatggcctctgccaatggacatctcgctgtggtgcagtacttgatccaaaatggagcggtaagaaaattactagtatttcatagtgtttttcctgtattgggcatcagttcatgttatagcgagaagggcagtttatgaatgtgtgtttgatatacagaatgttaatgctacaaactcagagaagaacacacccctccattgggcatgcctcaatggacatatcgaggtatttgtgttgccctctgctatagccatcttttgatttttcttgcactgaaataaatagctgatggcacctctgcttgtgaaaataactttctcaggtaattaaagcgttgatatgcgctggggctagtgtcagtgcactgaacaggtatgtgaaatgtaaatgaccgcatctgaacaagcaatgatgtatcagcaaaatagaattgcatggacctagtattagactttcatctgtaatgagtttgtttaagcaatgatttggtatttctgcagccatttagttagtaatgagttagaattgtctgtaccctgtctttagacattcgttaaaaatgagtttgtttatgaatgaaagttttgatgtttctgcagccatgagaaaacccctatggatgaagcagtgacgaagggcaagatggaggtgatcgatgcaatcggtgcagcagtagctcaagcagaactcgatggtgtcactgtctcctaaaaggacttggtactccttctgaacggtcctctccttgacaatggatgacatataaccttgttcttatcttttctggtactgtgtattactgtctgtgtcacttgtgatgctgatatgctagtatcttgggcaatgggagaacttgaaccattacttaatattatcaattctgtcggcaatcagctattacaatcaatgacctaaaacgatggacatggatatatactgttataggctatttgtgcaccagtcgaagtcgcctggactgatcttctggtttcagacttgtagtggactggaactttgcatttgccgtgttagtaacatagtcatgcccactcatggaagtaagtgtagtttgcttgttataacagatgttattggcctgagctttgcagcttgtaagctgggttaatctgtgagctgttacccatctgggtatttcgcgttgtacagctgatttttcatgtgggctatgtttctgaattctgaactgtatgtacttgggcctgcatgggagtatcaaggcacagtgcaacgtccacttctaaccaagttagtatggcccatgaactgaccttaattttcttttgtggaatactataccgaaatgaactgttgctgatgatttgattgattgattaatttgcctatcctgctgcccaatccagaggcgccagatgctatctgactagtatgcaagttcagcaaatcacagttttggctgtgttcggttcccttcaaacttacaactttttcatcacatcaaatatttggacacatgcatgtagcattaaatgtggacgaaaaaaaaccaattgcacagtttgcatgtaaattgctagacgaatcttttgagcctaaatacgccataatttgataatgttgtgctacagtaaacatttcctaatgacagattaattagacttaatagattcgactcgcattgtactggcggaatctgtaatttgttttgttattagtttacgtttaatacttcaaatgtgtgtccgtatacgtcaatttttttt

SEQ ID NO: 71993 - DNA, 653 bp, Oryza sativa
ttgaaatcatttagtatttaaaaatgttgtttgaacttggggaggaattatggactatttggatgggcctttttaacttcggaaattccgacaaactttccggaatttttccgaccgattccaagttccgacggaaactgatattatcatattcgattccgtttccgaaaaaatatttccgttttcgattccgtttccgcgaaattccgaaaaaattccgaccggctgattccgttttcgaaaacaggtccggaatccggaaaaattccgaaccgttttcacccctagttgctctgcataattgcctaaaactttgcactccttcaaatgttgacccttcatcgggagccccaattgcgacaatgaattcattatgttctgatgccttgatgtttgaagccgtagatctttcatattcattttgaaaattttcaaatatacaaggtgtgtaaatgttattttttatgaagaatgaatcaatttaccatctaccatctatcatctatttctggattgttatttttctagatttctttggagatccatacagttcttatttggattatatcctccacatagtatatctcacatgtttgggaattgggttatgggtgttaataaaaaaaataaggaacttattcttgtagaagctt

SEQ ID NO: 71994 - DNA, 2529 bp, Oryza sativa
aatgaattccgcggatggctcgtgaatcgcgatgccttgtcacgcatactgttgtatgttcttgatttgcatactcaaatgtgcccatagttctgttatgtgcatactcaatgacaaaaaaaattaattttattttaggacgaacaaagtaacgtagatatgccctttctgggtaataatttctgggtgtagctagcgccaacacaaatttagacaatttgacacttcgcaaaaactatttttacaaataatcactgccaaaacttattttgaccttttgttcagcgtcaaatagcatgacgctgaatgtatgataacatgctaacttaacctcccatctgtggtgacacggtattcagcgtcagttgacgtggcgctgaggcgtctaaattcagtgccacatgatttggcgttgaaaaaaaaaggtcattttcaaataagttttggcgacgattcatttgtaaaattagttttttcaaagaatcaaattgtcaaaatttgtgtagcgccggcgcctcttcttttcaatgcttatctggagcgtcacctgggacacgtaaatgctgcgatgtagaagctgtgtaactgtactctgtattgctgctacttatgttcctttagtagtagtatttacgtcgtgtttagttccaaagtttttcttcgaactttcaatttttccatcacatcaaaactttcctacacacataaattttcaactttttcgttacattgttccaaatttacaccaaacttctaattttggtatgaactaaacacgggctttagttctagaaatttttcttcaaacttcaaacttttttatcacatcaaaacttttctacacacataaacttctaactttttcatcacatcatttcaatttcaaccaaactttcaattttggtatgaactaaacacacccttagtatacacccttagtatagtggatgcagcgaggagctcctgatcgatctggtgcattgacatttcgatccatctcatctgcatccacatgtcggcgtccggctgcattgaagcgtttcacataaataggcacaggaaatttacccaaccagtgaccacacggaggtatcgttagaaagaagcgtgcatattcagatcgtacatatagcagcatttgttgctaggatctgtacgagcatgagcattcatttcactctctatttactggtagtactattacattaattttacctcactagtcaatactacccgagttatataacttgtggccagcacaacttgttgatgttgtggttaacaattttattggctacaaagtgtgtggcatgctacattttgctaaatattttgtggcgaagtgatcgatcgatggtgtcatccaaacaggctcatgttagctctgctctcgagtagatcagaccactgtactgtgttgggcgagtgtgtttagtcgacggagcctcggagaagaaagcttcttcgcccaggcggccgatctgaatccctagtgcgcccgagaatgattagttcttgatagaatcatgtataggtacaacagtagtactacctccgtccaaaggtaaatgcagccgtgagtttctgtgtccaacgtttgaccgtccgttttatttagaaaaattataaaaatatttaaaaaatagtcacacataaatttctattcatgttttatcatctaatcacaataaaatattaatcataaaatttttttaaataagacgaacgatccgccgttagatataaaccgtgcaaaactatacttttttgaaacgtactccaggagaatacatgcaggtattccgtcgtgatcgtcgaagcagcaggccggcattggtcgatctcgtcgagaacaatggatcacaattcacatgcacacacagaagagacacccgcaatccctcatctgacgtcgaattatatcatactgcagccaagtcaagggagttgcagttgccagctgcctggcatatactagaacagtcggcacaggcaagcagcagcagcatacaactagtacatgtcaggtcgggttgacgccggcggcgcgcgatggctgcctcgtgagagcgaggcatatatcacagtagcagcatcacgagccacacgtacgtgctagcaaagctagctcggccacgctgcatgcatgcagctagtgcgtgctcccccgttacaaaataatttagcttacaatcgttatgatttatcccagaacaatcaatttaaataaaatcaagcttgtttcgatttgtgtttctttctttttcgtgaacgcgtaaaaaaatacgcgtcagtatattagaaaaagatataatttttagttccacaacgtaacataacagaccaaacataagtcattgttgagttacatgaaaaaagaccgcaagaggtaaaaaaaagaaagaaagaaaagcgaaagctgctgttcctatatagagggagagagatggtggggaacccctatgcttccaacaagtgctcaaacaaaggggcactagctaaagaccagaaacgaccccttctaaagga

SEQ ID NO: 71995 - DNA, 3948 bp, Oryza sativa
aattagttttttcattcgtgtcaaaaaccccttccgacatccgctcaaacatccgatatgacatctaaaaaatttcatttcaccagctaaacacgcccaaagattaggacctctttggtgctcctttgttaattgggagtttgggaccaatgattcctacgacaattcaatggatttatattttgatgttctagggtagccttataactgcacggatctagatcagggcaagataattaatatttctcttgtttctcttaattttggcaatatcctgatgtccccaatagtgcctaaacaggatttatctgatcttaggcgtgaggtcggtcgtcgtcgtatctaggattactgtttgtacatgtggtttgtgctcatgcgagtgaagatatatctgtctctggtgtgaactgtgatgaaaggaagggtccctcagtacttacagtgatacaagcctatgctagcaaacagtgtagaccttaagtacactagcttaagctttgccctttcatcatttaacacatgtccgtgcattctctgcatgcctctcctaattatcacatccatatgatccactccaacctcccaacctttctacacagcattattgctacttttgcctgtagtgttacctttacagcatcatccatttaacacatcacatcccccacaacagtagcgaagaagacacggctattaaaaaagaaactcctaactcaaatttatagtaatacatatatatgtcccaaaaatatatatataataacctcgatatagattagacttttcatattactatgaatttgaataaggctctgtctaaatttattgtactagaatgtctacgtataagagattttagttggatgaaacgtatactaatacaattaatctggatagggagcatattcatattcatattattagaatacgtcacatccacacaaatataatcttttatattttggggcggagggggtatatttgaagatggagggagtagcgaagaagacacggagtgtatatttctgtgtagattttgtctttaagtcaaatatatctacttttaactactagtttttaaaactcacgtagtaacaacatataaattataactacacatttttttagaaacaatttgtaaaaatacaaacgttcaatttaggacatagttagaacgatatataagtaattgaaacggatggagtaaaaatgacatctaggattacattaacctactagtacatatatatggtatacatacgtacatatccttgtgacttgtgagtgaaacactgagggaacagccaaaaaaaaaacagtttccaattgttgcaacaagtccatttcagaacttctagaaacaaattaagtgaagcttagcttgagcaagaagattggtgagacaatgttcgtgtcgagtggtcatttgtttacggcagtaatcacaatgtgtcttagtcttgccggccgctattgactgcttatgtgtgggatccataaccgaggctatagctatcaatataatgtaatttactactagtagtaacttagaaaacaatatgaattatttagtgtttagtggatacacacagaaaagcttgccacctttgtgtatgtctttcttgtttatccctacattctttgattatgacattagactatttgacatttatgcttctagcattcaaataacagtaaataataataaagcctatgcaaaatctgcacaataatataacccaaacgagtagtctgataaaaaagaacggacaatttacttgtttatttaatgtgttttccttggatagaggttccctatgtcaaggtggattgtttgctcttcggtttcgcaaccaaaagttaaattttaaattttaatcttagagtttactttgacttttttatctaggtttattttttagcattggtttttaagtccctcagaacatatgtataaaagattaatttactttcaaattaatttctatcgctaataaacattacgacttataattaattacagacgaaacgataaatcgatgacaatactttaatttttttcttcattagttgtgtcaatcataattcgaacccagacttctggttctgatgccatactttacaagttggtggctttgctaggcaaatgtagggagaatgtcagctggcctcagcacaaatcctactcccacaaattagccccagcttaattagccccacaagagctagcaatcaaccaacaaacatagggtagcatcatcttaattagcctcccatcattttcatcactaatttaattgcgattgttggggcaatgacatccacaacaagactgatgacccaatgaagtgatcgatcagctccaaactaaagagtcattaaattactaaacctcaatccttttccgctaagttggttaccatgatgaccctagtgtggttttgttggccattagcgcagtcactgggcccaccagccaccataatcccaaaactgttaaattcctatacacttagcctttcctctttccccatgatatcattttactacgacccaaagttaaatcccttaaaaggggaggggaaaaaaaccaaaactttagtcacaagtggagaaaatgtttgatcacttatctggatatatattagagggacaaaagtgtgaacaatatgatttgacagcattattaattaaggaccacaagatctcatcaagaattgctttccactccattatctaaagagttggccgtggctagctggagttggagttaggctaaggcaatataccaattccatcacatgcggctaatataattccctatggattgagaaccctactaccaagtactccctccatccctaaatatttgacgtcattgacttttttaaacatgtttaacagtttgtcttattaaaaaattaagtaattattatttttattattatttaatttattgttaaatataattttatgtatacatatagttttacatatgttataaaagtttttgaataagacgaacgataaaaacatatttaaaaacatatttaaatatttagggacggagggagcagtgctactatcaattctctgtggcaattctcggtgcacaccaactcgaccgatcgaccgattgatcgatcaccaagtggagtcccggaaaagcaggcaatgcaaaaaaaaaaaatttcatggatgttaacatggtactcgtcacctgactgacgtaacagttgtgtaatgaccgtacgtaggtagccgacaaggccaaggcactgccatttggcaaattgaattgccaggtttgatacgtacgcagcaccggctcatcgatcatcgatgatttcacgggtaggtagtcaaagttagtactagtacactgtgtaacccgtacagttgcaactgtacatgagactacgaggtttaaattctggtgttcacgattacatatggatacacgcttacatgaatttagtatgttagaggattaccgcgcctccagtggcggagccaggatttcaaagttgggtattcccgtctaagcgctgagccgctggccgcccctgcccctcgcagccgccggcaaccaacaggcctgaccgcctgagcttggcggagtgtcgggcgccggccaccgcccgccgcagcaatggcctccccctccgcggtagcacggttcagctcctgccgccggttgccgcctcaccatgccgctacctagggtttgcaaataggaagcggcgcgagggagccgagccagggagggatggatcacggagggagagcgagagggggctgtctagaagagttgtggctaagagcaggtacaataacaacttaataagctagctatacacatattttaatgggataaaagaggagagatagagtagcgggctacagatttgtagccagctgcagcacagacttcaagatgcatgt

SEQ ID NO: 71996 - DNA, 1271 bp, Oryza sativa
tatatatatatatatatatatatatatatatatatatatatatatatatatatacatatatatatatacacacacacacacactagaagtatacttgttttttgataaaaaaaaagttgggtattcctaggaataccagggaatcatgtagctccgcccctgcgcgcttccagctttttatcacgtggtaaaggaacacactcattgatcattttctttgtaatcgtaaaaaattagacatgttttatattggtttttgttgtgctgatagtagaatcaatctaagcttttttttctcctaatttaatactctctctgcttcattatgttataagttattttgaattttttctagtaaaaccttttaagtttaattaaatttattaaaaatattttcaacacaaaacaagcatattattaaaaaatatattcaatctacatttaatgatactatttgatgttgtagtattgctaattttttttaaacttggtcaaatctaaagaagtttaacccgaaaaaaaaatcaaaacaacttatagtttgaaacggaggaagtagatcgtacctctacggttcttaagaaagtatcttgagatatctaaattttaaactaaactttttggtaccttgaggtacttagttactagagataccaaatctattatattattaaaggaatagaaaaaggagcctccacgttcgctctcatagcctagaaattctcacattaatcggagaaaaagaaaaacagagtccatatagaaatacaatttagaaatagctaaattcggaattaaaaaataaggaatattaaaagaggagactagagtccatatagaaatacaatttagaaatagttgaaattcggaattaaaaaataaggaatattagaagaggagactagagtccatatagaaatacaattagaaaataactgaaattcagaattaaaaataaggaatattagaagtagagtataaaaataaggaatattagaagtagagtatagagttcatatagaaatacaattaggaaataatagaaatttagaattaaaaataaggaatattagaagaggagactagagtccatatagaaatacaatttagaaatagttgaaattcggaattaaaaataaggaatattagaagaggagattagagtccatatagaaatacaattaggaaataactgaaattcggaattaaaaataaggaatataagaagtagagtatagaatccatatagaaatacaattaggaaataatag

SEQ ID NO: 71997 - DNA, 28283 bp, Oryza sativa
  unsure (1)..(28283): unsure at all n locations
tttgggcaaggacttgtgcgctttggttgtgtttaggacataggttatcattcaagcgtttagtaattgtcttttactctttggcatacgtgttcatatgcactattgtctttaattgactgtgtctaatttattcacatgttgtttttcttttctttaccaaaaatgtacaatgaggaataactccaccataagctttattttttttatgattaaccgattctctgatattaatttattggtatattacagtcgcgtcgcatgcaaaaattatatcgatcttcacagacgagcctataaacacgactgcatgtgaagatcgatgtccgcatgtgcagcttaagaggccagatatccgcatgattgggctggccggtgaaatcctgatcatagatgaatggccctttcttcaagatgcctcctattcccaaactgtagttttgcgtacgctaaagtttatgttggcctctgctgtttctccgtcagttcacattcttttcagccaactttgctgctgagttcaaaagcagataaaggagaatatctaaaaccaagtgagtcatagatatatcaaaatggcttgtggatcgatcgaggaccttctttgtcagcctttttaagataacagaagaagatagtggaagcagcttcaaaaagaaaatgaaatagaatacgtaaaaatacaccactacttatgacatttaactgtgggtggtagaattataaccgtgcttaggctgaacggtgtggttcttttctatacgaaagttgttttaaaaaatcatactaatttattttttaaagaaaattatctaatacttaattaattatatatggtaatcataagtccctccattttgcatgttaaatagattagttctcaacccgaggaaatgaacacagcctaggataccaacatctaccagtgatatcttcttcccgagtctttaatttcttctgaataaatctaattagaatatggccttctatttatcctatatatctataaagtttatccctactaaatatagttaatgttaattctctcttctctcatgaagccacatcatcttaattgtttgtagcatttggatgattcatcaatactgtaaattgcatctcttcacatcatctcaattgtttttagtttttggatgattcatcaaggatacaaattgcatctctttcctccaaaagacacattatacaacccaatcatttataacctttgaataattgataaaggtaaaaaaatatataaatacctgaaaaaaatcgtagaataggtaagaaagaaagttttaaaagtcatatatatattatattatcacacaattctttcatattatattatcacgcgcgaggtacccagcttgttttttttaaagctaacactcaaaaggtctggttatttccacctacaaggcagtggaaggtttaattacacgtgcaatctatctacatacagtagacagaaaaataaaaaaaactcaaaaaactgattatttttactttgtatagatcgattaagcaattacaaagctactgccgatgcttgtacattgcaagaaattagttcatatgtcatatttgcgatcactggtagatctccttcagtgcaaagtaactgtgctatgcccgtgcatgacaggccacccttttcttaataatttcctattgcttctcattcccacacaagatatatgctatcatcttccatgcatgtttcaaatgatgcaattaagcatgaatttatgtcaccagaatttcatcacaaattgttaaagaactgaatcttaaatcttccaacgtaattgcgaagtgaggcaatgggtttggtaagagagtgagactagctcaggtgagggcaatgaggtatatatagactaatgagagggacaagcttaaattttcttttaccctcttgctattaattgatagaatataacccaatggtccctgcacgaatggagaagcgacattagccattgatgactgatcaggagctagcgctatacatctattatattattaaaacagccttaaaagaaagcaccatgttcattgtgggggctagaaatttccacattaatagagaaaaagaaaaaagagtccaagtagaaatacaatctaaaattagctaaaattcggaattaaaagaaagcaatattgaaagaagagtccatataggaacttaatatgagattaacaaaattcagaataaaaataaaataaaatccaaaattaggcaaattataaataactaaaattggtgataaaaattaaagactattgaaagaaaagaccatctaaaacacatgacaagattaattaagtaactggcctatacaggagcatagtgctggcggttaatgcgacatctaaaaacttgacgattaaaaagaaggacgacgggcaggttgtgaagcaatcagtcaagacggttagcgggacttctagaaagtaaaaaaataaaccttaatgataaccatgtttaatttttaaaatctcaattacaataaaaatgagaagcagcggacgggtcatatcatgtccgacgcgtgccctagacaccacagtccaaagtgactcagcactggcgtcttatccatatcctttcaactccagactagccggggatcccccataaacttgtttcatttatgtcagggcatgctgcctcacagctagctgtcgagcatgcccaatttcccatcaagttctgaggtcgtgtcctcctacgtttaaagaaggttacgtttaaagaaggttgattattctcggatgagctttttgaaggtgtcattgatggaataatatcccaagattatgcatcttgtacatttggatgcccctctagacaaaaggatgcgagtcatactagtaccaaggtgagcccggggcccggggcccggagcaaggccgggctcgaggcaaaccttagtttatggggtgtttggttcatggccacactttgacacaccacacttgtgacttccacaatttgttagacatgtgtttagttcactgccatagttgtcccacatgtcgtagactcaatttttttgtcaactttaccacactttgtggctagcaatttatccaccatacttttgtagctgccacaacttgcctagcgttagttgtggcaaagtgtggccggtaaccaaacacaccctacgccttcatgcttggttagtatcgtcactcctttttcccgagtaacatgtgacttgtacgggctatggtgagccttgggcccaagacttggccgtgcccgaggcaaaccttaactcattctcttaagatatggttcttgcatgttcctacgtccctcttgctgaggaccgtagaacctactagggctagggtgagtctagggcccggaacagggccgagcccaagtcaaaccttggactatattcttaacgcatattgaggtatgcttgggacccaaactaggtcccatgatgcttttcagatttttgagttacatacgcaatattctccctaagccaggggaaatcccgtgtatgaaatcttagatgggcctggggccctccagagtgggcccctaaccttgtcaccctaaagttaccgttttatttttaaagacattctgagcatgctatttatttgataatgatccttttgctagataaatggatacactggttccgatttcaccgacacatattagagtacaatagtgtcatgaaagatttcaaatttgttcgattcaaaattactgcggtcatttatcacttaaatagtatgtgtttatcacaaatatgttaatttttttttttgcaaaccgttcctaatgttaagtacattgtccaaaaagtatgtgtcttttcagaacatataactggttaaattctaaaggggacttagtgtttaatgtagcacattcacaatgtatgcctaatacagaagaaaaaaagttggcctctatctaactagtacaccgttcatcttttgtatcgtgtttggtgcattctgcttcagccatgctctattcatgtttttcattccttcactcaccgtaaagaaacattctcttgtcacaaaacaaatccagtttaacttagcagaaatgctcaacgacgcaccgaatgctctaattattctgaatatattgacatatgatggcgtgaacgacccaaagaggttttattagaactatgatcaaatctggctaattctatacataggggtaccattgagctagtgaaggaagagagagcgactagccctgatctacactagtattctgcattgaataaaaatgttgtaagatcaacgtgtgttttgattcttattctgtgatgaataattggtatatgtgattattggttttgatatttggagattactgttgaagtggttttggatataactgttttgtcggttttgttgggaccggtcagaccgggcggaggttgccggttagaccggcttgtgttgagcggtcagaccggctagccgacgatctgaccggccgacgctgtgtcggtttcggtttcgggttgtttctttggatatccgtgattgtttcatggttatggcttctagatggattctatacatatgtaatactgttatttgctactaatgagtcaagttggggatagcttggtctcggaatatggtttctttgtttgtttcctgtgtaggtgactcgatgcctcggagagtatttgcggtgatggaccgggagtcggcttggtggtaagacgatgtccgtggtggttagatatcatgcgggatactaaggctaaagttgatgcacgtggttgatggagattccatatggcatacgatggaggtattgtgtgcgtatgggatgcggagttgaatttggaaggagtccaaatttggtatgattggttatgtaaagtttgtgtcttgtactagagggtttcctaaggtgtttagggctcttagtatgagtttggttcgtggctttaggctgcctacctcatgtataaatagagggggagcgtgaggcttcctggtatcgcttttgtatcgcttttcagagcgtagagttgctagtttagttagggtttcgagtttagttgagatttttgtaagaagtgctgttggtgtactttgtaaacacagtgagaagtaataaagttgtcatctattttgagagttcttcgatttgggtttcaccgggtttcgacggtctaaccggtgactcaccggcggtcagaccggtggcaaggcggcggtcagaccggcggcgcaagcaggcagcggcagacgttctcggcggttcgaccgatcgatctacatcggtcagaccggcgcatccacttcggtcagaccgcgatccatcggatttgagggtaacttttatttccactaaaagttttggtttttggatatatcaaccattcacccccctctggttggcttagttcttatgattcgatcctacaaatgtaagttgtgttagatccagaaaatgtcggcattgagaatcaaatatcttgtaaattattccccactaattgtatagttactaccaagtctctcttctcttatgggatagcgctgtaatttggtcgaggttgacatagttctacaagcttccctgaatctgcctcccacagcacacgtcacaacacgaggtcttttggagccatagcgcgcgcgcccacatgcacaacgtagaatatgccatgaacaactgaaaaacctgatgattgccccaaatggtccaataaagctaccattttatcctaaattgccttccattcctattgcttttctctgacaatgaacgatggagtaagaatgtaccgtttcctttacaaataaactactagtatttgtattgagatgagaaccaatatagatgaagcagagggggtgaggggctgggtgtatttaaatgagatatagtgtgcaatataattaattatatctttaggctgacttctaagctagatcattaacacatgattgattgagtattaattatttcatacttaaaaatggattaatataattttttacaaattttttacaagtaaaaatttggcacgaaacatatatactattgcnaacgagggagtagctccctccaaccttagaaacaaaacccagctttagtcttaccacatcccgttttaccaaatacataataacgtacaatattattaagaaatattttgaatttgttagagtcaaaactactctggttatttattccatccttgatcagtctgttctaacatgaatatgttatatatttttttgcaaaatctttcagctattgttacattatttcctaaaaaatatgtccctttgcgtagcattatttatgatgggttaaaggctaacgggtagttggtgtttcagtttagcacgtccacaatgaacacccaatacagaagaaataacatatgtagtgagcgtttttctatcaagtacaaccttcatctttttcttccttcattcttatttggtacaccttgctcggctccaggatgctatctttatctccttttttttcgcttagaataaagaaacattctcttttaacaaaacagatccagtttaaacctgctaaaatatttaacagacatatacggaatgctctattcattctgagtataatgtcatggagtcttggacaacccagagaggttataatagcacgatgatcaaatacgactagttacatacatatggctgccagtgagtatatatggccaaatgggcagcccggcacggccgggcctgagccgaggtcggtcgggctggcacggcccgacctacacgccgagccgtgccgtgccagcccacgggctgcacacacggcacaggcatggcccaataatactcgggacgtgccgggccggcccgaaggcacgacagccacatcgtgcttctccacgggagattagtctattattccttcctaaactctatgggttgtgtctatatggctgaaaataagtctactttgtattcttcttgtctttgggccttgccttttatggttaagtaagcctattttacgtccttctactatttttttacgatcgtgctgtgccgggctggcccatcatgccgagggagcggcccaagcatcagtcggatcgtgccgtgcttggaacgggccacgaccctcgggccatatggccatctataccagtgacctagtgaagctagagagatcaacttggtcacaaatagctatactctctctctttaaatgcatgcaaaggtagtcatatttgatccagacaaacgcgggcaaaaggaaatcttatattcttttcaaattattcgccaataactataattaatggtaattcactcttcgctaatgaagtcaaccgtttatattctatagatgatttcttttttttttttttgtaaattgtttttctacaccccattaagccatatgcacatcatctcaattattctacctttttctataacaccatcttattatttttagcatttggataattaatctgtcatgtctcatctagtatgaaagtaatgtcatctataatatggttttagtattggaagatctatagaagttgtaattttgtaaacaaatttctcacaactgtcgacacatgctctttttcaattgagctagtatggtcagacgtaaatatacacttgccttgttcaacaaaggtacatatagcttcttatgtagagctctgctaggtcatggacaccgagaagatttgctctcagcatcgaatggataagagtacaaccacaatccttccccttattcgcaccgaaggaaacaacaatgacccaatcaaattaagaatgagcaaacaaaacggaactaatttagatatgtgcatgtttccacaagtgcataccatgtaccatcatacatggatggaaacatcaaaaaagatgcaaatctattctcacagagggaataaacagaaaagaaaaacttacacgagttatacatcaaaccacaccctaactttggtgcaccacttaactagcttctaccatgagaaccttcctctactggcgcttacaaagctctggacaaccccatcaagttattgctagttgatatttagcacagatggataacctagtagtttcccatggcctccaactcctatagaacactatgatcgatttaacataaaaaatgacaataaatctcttacttgattaaattcttgtagctgtcttacaaatatcgtttggcgttattcattggaactagacttcaatagggcaaagggaagaccatgggttcgagatatatagtgagtgtgtgaacaatcttggagtgttaactcatgagtgggtataagatataaagacatacatgacgataaggaactagggtcctcatcttcctatagatattgataagtctattatggagactcgacgttcatgaccaaaagactccgataaagacgatcgaacccctcgtaatcactatactacagcttccttggttttaacccgagccgaaacacaattaacctcgccggtaaggctatctcctacaagtgaatcgagaacacaagcaagagagtagaaaacgaaatctcataaattggggttccacaatcaaaaattacgctgaaactgctatggcagataatctaagcaaaaccctaccctaattcatagacacctattgaataaatagatttggtcaaccaaggacccttagatgcatccctaatggacttcaacatgatgcgcagcccaacgggcctaaagacggtgacacggcactgaacagattctggacgctctatagttccaatggctctcattgactcacatggaattttgacgtgagactgggcatataggaaaggtaatcttgcactctcgttagctttccataaatatgtagaacatcaaaaacatagtccgaatgagttatggccaacgattttagtgtgggcttatgtattttgaggtgggctcgaacttgatataaattgctcatccatctccaagcatctcttcgggagcttcccgattcttcctcgtgcttatccaaaggagtgatgtattatcacatacacaaaacatatattcctaacagtaacaattgctgctcaggtttacatatactactgtggcaattaattaagttttacatattctgctctatgttacaatttaatgtttaacttacaacaacattaaattaatgctgcttgtttcttcatccccactaaaacaaaaattaatcaggattcattacagcacgaaggctgcgttttgacaaatcagattattacatttgaagggtcaatacaaaaaatcaatcccctgaaaacacgcaaaaaaagaacaggggcaatattcaccttgtctaggagtaataccgttcactctgtttaatcctagagaaaatccatgaaatgccattgacaagcaccctaatcccagaaatgccatcacagccatactgctgttaactcctccccgttaagttgtatgaaaagacaatcttacccctgggcaacctttctgctcaaacatcaacattttgttttgtttgctctcacaacattattttgcattggtgcatatttttaaattcagacatcattattttgccatcaatcaaattatttcaaaattaaattcacaaattttggcatcaaaattatttcagaaattttgctatcaattatcagggttgtgatatgagcaaaaataggggcatcaattatcagggcaatacacacagaaagtaccaattatgatcaacatgaattttcacaatataaagggttcacagtacttagcatcacaacccaatataaaggttcacagtacttagcatcacaacccaatacaagagtactttgcatgcttaatacatcttagttcagacaatacatgtgacagtaagaaactcaatcaattattctcaccttgcttctagtccccattgatggactactctgcttgcttctagttctcattgctggattgtcatgtggtatttcattattcttcctccttttggcaggtggagtagtagcttgtactattggggatggttttctcttgatcttcttgtctttgtcctccttctcatccttcttccccttccccttccccttccccttccacttccccttcttctccttccccttccccttccccttggcaacaggtgcaacaacttgttgtagtggcacaatggccatagagctgaaaaaaatcgttatttagcaatcaatccatcccctcattttcattctccccttcactatggtccaatctatctacaattccaccaccaatatctcattcacataatgcagtacaaattcttcaaatgaaaccaaacaaaaggaggaaaatggatccacctgagagggatgtgccacctactgggactattacggcgctgcctgcgacctcctcgccagcccctgcgaccaccgtaccggtgcatgcagcccccgcgtcaacccctgtgctgccgcttgccacctccttgccgcccgtcgcctgagagctcgctgccgacgcgccgccgcgtgcgagccacgcgccaccggctgggcccgcacgccaccgcctggtgtcgccacatcggcattgagggccgccacgccgctgcctgggtgccgcgcaccgctgccgggggcccccgcgccgccgcctgggagcgctgcatcgctgtcgcttgggagcgccacctcgccgccgccagggagcgccgcatcgtctctgcccaggagcgccgccccgccaccgcccaggagcgccgtctcgcctccgccggggtcccctgctccgccgcctgggggcgccgcatcgccaccgtcgtcgcccatcggttaggtttagtgttctctttttttctccaatttttttcttttaccgcctctggatagtaaaatttggagcaagagtaatctggtcattttggtaaaaaaaaaattctaacggtgtggactaaacggtaagttgactgtgatggcatttcagggagaaaaacacttgtaagatggcattttccggaagttgcgcttgtcgatggcatttctgagattaaagtgcttgtcaatggtattttatggattttctcatcctatatctttttctacttccactattaaaatgagcatcactctctataaaaagtaaaaattaggagtagaaaaaataaagaggaatgactatgtgtcaggtgctcaagagtaaccaaactcggtccacttgcttttttggaccgttagatccaaaatcagagacgcagataaataaaaaaaatctcaaatctaatccaagagtccacgacaatgaccaagacttaagagaaactcaatttcctgacaaatagacacaccataaataagaacctagtaattttatttgccatggatgattcgatgaaatagtgagcaagaagcgccgtgaggagagaacggcaggactggaaagtggaagcggttgaacgaaatctacgtcgattcaccgtcaaacagcagtcacttttgtgcctctgctatatactggtttccatgaaaatgcagttgtttcttcagcacatcatcaccgttgttgcccaagaagaaacctaacgtaaccttctttcttcatcattggtcgtaaatttcatggcaacaatacaatgcatacgattcgattataatttagttacactttgatcaaatgaacttgtcgatgaagaagacgggaaggccagccagcgtggttaatcgacatccatgtcgccgggccggaatttgactacattctgcgggggcatggctgccgacaactccaaagttgaggcatcttcattctcttttttaggggacaatggcacaggagctctgcctattcattaaagaaggagagtttaagacacaagagatcacatccaagaggtgtcacaattagggaaaaaaaacgaaacctgcagcactttgaggaagtgcgcaggcactaacatcaaaaaccggcgtaaaatcatgtaagcattctgagcatcatcatacgctttgcacatgctaataatggaatcaaccacctacgacaccgaggcatcttcattcaccatgatcgttttggtgctaaccttggcaacgaggccgtcagaaccaagcggcacaatatagagccacaataatcccaatacataatctgtcagccattttagccttctctaatacgagcgcatggtcgaggacaccagcacactttacgaagatcaactaacagatttagctcacacttctgttctgcaactaatattaaagcataccatgaaagggtgtgagagtaactatgtacaggttccgtattgccttccattcctatttccttgttctgtaaggagagaaacaatcgggacactctcttttgtgtgttgattgggtttatcgtggaatgagatgttgtggtggactcactggactggtggtatatatggacatgaaccaaaggtaccccatatttaaaagcaacatacactggtggagaaacgatttttactcccggttgagaacccccatatagttccggttttccaaccagaagtaaggatctaggactaaagatcactacctttagtcctgggtgagtcccggtttgtgttaccaaccggcactaaagctgtggtcccggttggagggtttttttctttttttttcttctctctttctttttcactgttcttttgctatttgcccaaatcatctcatatcaaacattcataccaaatcattcacggcatcatatcagatcaaacattcagaacacacagcaatatagttcatccaaatcattcacagcaatagttcatcccgaatcattcacacaatagttcatccccaaatcattcacaacaacaacatagatcaaatcacacattcaacacagattgtatcaatcaacacagatctaatcgcacattaaggaaaaaagaaaaaaagaaaaaaaatccatggcagcgccggcctccaccgcctgccgccgcaccggcctccgcatcggccgctgcctagtgcagccctccacgcgaggccgcagcccggccgcctcccctttcagatctggcggtggctagcctcctcccctccggatccgccgccgcccggccgccgcggcgcgaggttgccttcaccccaccgtggcgcgattccgcctccgcctcggcccggccgcagccgcgcgagggccctgccgctgccgctcggctggccgccacggcacgaggcccccaccgacgctgcccggccgctgacaatggggaagagaggggaggaatagaatggggagaggaggaggaagaggaagagatgggaggaggaagagataaggttagggaagagataaggaatataatttattaacttcttgatctcgcgcacgcctcgtcctctccaccgcgcatgccgatcttttgttccggtttaggctaccaactaagactagaaatagatctatcaagccgggactaaagatgatagggatctttttttccggttggtaatgggactaaaaatagatctttagtcccggttgggaacaccaacccggactaaagataatctttagtcccgattttattataaccgagactattgttgattttggctgaccgatcaaagatggtttctccagccgtgatagtttggacaatgtgtacgtgtgtgcagtataactttctattaacttcatttttaggacacaaagaattgcaaactcgtacagtgttatgaaatacatattatcaagaaaggtttataattttctctctgcaaaaaaaagagaaaggtttagaattcaacaaattcagtttattttaacgcaagtatagtatataaagcaaatatgttcaaccgtagttacagtgcctcaataaatatagatagaacctgtccatgcagcttggagcatccgacttagcacggtattcgcatttactgctaattacatttttcagtgtgttagataacttcgtctatctcaataaacactaatccaatctctcggttgtgctataccgatagttaaacaaaatctgagtcactttattggaccattagatccaaagattccaaaatcaagggtacacaaaatttgtaggatcgaacagcaagaactaagccaaccatagaagaggtgaatggttggagtacccaatcaccaaaacttttagcggaattaaaagttaattcgatgatctgcggtctgaccagagtagatgcgtggtctaaccgcctggaagccatcggtctgaccgccgtagttgcttcagtttgaccgccgagatcagctgctatcgcttgaagttgccgccagtttgaccgccgttaccctgctggtctgaccggtcagatgccgtcggtctgaccggtggtgtctcaccggttggaccgttgaacccgagcaaacacaaattgaagatctctcaaagtagatgacaaatttattacttctctctatgtttacaaagtgcaacaacaatactcctcacgaaaatctcgactaaacacgaaacgctaactattctctcaactcaatgctctctaaagtgataccgggaggccacaccctccgtctctatttatacataaggtagacagcctaaagccacgaaccaaactcatacaagaagtcctaattcaccttggaaaccttcccatacaagaaaccaactttacaaactccaatcataccaaatttggactccttccaaattcgacttcacatcccatacgcacacagtatttccatcgtatgccatatgaaatcctcaccgatcatgtgcattgatctttagcctaagtatcccgcatgatatctaaccattcggacgtcgccttatctccaagtcgactcctaatccatcaccagcaacactctcccgaggcatcaagacacctacacatgaatcatacaaagaaaccatattctgagaccaagctatctccaacttgactcattgttagcaaacgacagtattacatatgtatagtatccatctagaagccataaacacgaaatatccacggatgtccaatcaaataacctgaaaccgaaaccgacacagagtcggccggtcagactgcgggctagccggtctgactgcactcatagtaccggtctgactggcaacacctgcctggtcccaccagacccgataaaacaatagcacctgttcatcacctgtaaacccaatcattttcaaaaccacttcgtcaataatctccaaatatcaaaccgataatcttagatgccaattgttcatcacagagtaagaatcaaaaacactattgattttacaatctcccccttgatgaacacattggcaaacccatcaaaaatgttttattgtttggaaaaaataaaaacaaaaatggtaaaaagcacggagtgctcaaaaattcaaaagaaaacttctctcacttttgaaaagaaaaaaaaatccccccttgacctgaaaaacatgcacttgtatcttcttttctcccccttttgacaatgatttcataagtataggaattatatttattaatattcaagacctttgcatacatatagtacatcaagtcatgtgttgcaataaaaggaagatgaacccatctataatatagcaagcatgcactaaagtataatcatataccaaagattttacaattaggttcaaatcaataatcaaaattcatgatttcatatgttttataatgcaacatctttacaagcacataggttgaaaaataaacactatacatatatacctattgcattcatcactctttttcaaatcatccttagcacaaagcaaccaagataatttttaaaattttatttgagactttttgctcatattttctctcaattatttcgggtacgtcctcgtcgtcgagactgtttccaaggattcggcaaccattaactttgctcacatcaaatacgttcttatcgtcaagactgtttccaatgattcggtatttattttttctctcatagatatttttttcttctagtgcacaatgagcaatttaaaatctatttgaggaatgacaatttaataaagcgtatacataagcatttataaatcaaaccatatgctagcattaatattgcatatttgcttaattcaagtatagaatttaagtgtcatgcattatctcccttcaaaacaatatttaagcctcataaaaagactagaatacatacaaactgtgctagagacaaataaaccttcaaaatattgctagcatgcacaagaatataccacatgtatataaaaaaaactcttttttctcaatttttcttattgtcaaattttgcttgacaataccataaggtacaaaactgccctcacaatctcatggattcgtggcgaatcgttcaggagagaggcgagcagagccagccctgggcctaggcgggttgtgcgaccgcctagggcccaggccgacaagggggccatcatcaccaccccaccccctactcccatgcaggcccgggcaggccctgggcctaggcgggttgtgcgaccgcctagggcccaggccgacacgggggccatcatcaccaccccaccccctacccccatgcaggcccggccggccggcatgcccaatactgctgctggtctcaatgtcactaggacacgaggaggcagggagctccgcggctatcgtcaatctcgagaattgatcgaggcgtcgagggtgtgcagtgcaacgcgacgtttcgtgttctcgctcctaatctcgctctctgttttatctcacatcttaattaacgcggatcgactcgccgatgaaccaccaggaacgacgacggcgcgagcaaaccggcgacaccgacgaccacgcgcctgcagccacgccttgcccttgcggccttgctttcacgacaatcatgattaacagagcagactagatcaaggtgagagtcttctaatcttatttgcatctatttatttcgaaaattaggttatagctttattttctttttgttgtttaattaacttcataatttcaggtattagaaaatagagtgttgcctaattagaagcatctgttaggttctcctaaagggaacaaaagaaaatgacaagaacagttcgttgaatcacataaattattttcagcttcaattttcaaataatgttgtttccggcgatactcttgagtctgaagatgtcaaagtggatggctcatggtttagctatatgcaaccatgagaagaatatcttggataacattaatccccaaattgttcttcaatattttgcttctaaaaagttcccaagaagttctttttaagaaaaacttggatatttgtggtcttctatttaaggtattcacactattctatttttcatgctcttttacttgctattatactatcaatatcgtttatagtgaacaaaatgccatattgtaatttgcaactactaaatttattatttatcatgcttaatacaagtaaaagaatttctaatcttaagggcctgtagcatcgagtttgcctagggccctcgaaatgttaggaccggcgctggaggcaagattggatttaggaattttggggaagaaagtttgaagaacagaggaaggagacaaagatagttgttcgattgctttttacttcgttagctttcccctctcagacaggaggttatataaatacatcgagttcttgggccaatgggccgttacactcagcatagcccaattaggcagcacaaatgagacacaagtctaacacaccgttatacggccaccagtattgccttccattcctattgcctgcttgttctgtaacatgagagatacaatctaaactctctcagtgtgtgttgggtgggggtacgaagagctgagatgatgtggtggactagtggtatgtaatgatacgctcaaaggtacaccatagttaaaactctctcacaatgtaagtcattctaacatttcctatattcatattgattttagtgaatctagatagatatatatgtctagattcattaacatcaatatgaatgtggaaaatgctagaatgacttgcattgtgaaacggagggagtattaacttttgtctgtcataacacatgtgtaattgattaaaaaatttagcagcatttttttatgcaaacaccatcttaccccacgtccagtgttgtgaagtacatattatcatgaaatgtttagaattcaaccaattcagcgtgttttaacacaaatataatatgttcagcgcatttttttcaaccgtagctacagtgactcaatatatatagagggtacctgtccattcggattggtgcttgtgtcctcatcccccctaaaacaaaaattagtcaggattcactacagcacgaaggctgcgctttcacaaatcggattattacatttgaagggtcaatacaaaaaatcaatcccctgaaaacatacacacgaaaaaaaaaacaggggcaatttttacctagtcttgtagtaatacccttcactctgtttaatccaagagtcccactccggtgctttctactcggagtagaaattaatatgggccattggtcatatttaattgtagggctgagatctaattctactcccactagtattagtggaagtagaaatatggaagggtgttttcgtcaagagaaaaaaaatctcgtaggggtattatcgtattttttcggtctcttactcaccctatccttatccgattcctctcatcaccacttcccgtcgccagtccaccccatccccaccttcgccggcgtccatctccctcgccgcctccgtcgcctgtccagcgccgtcgccttctacactccctcgccgcactcgcccttcctcgccgccttctccaccgccagcgcccctccgtcgacgtccgcctccccgcctcccctgatatcggcggcttccctccgtcgaagcccttcctcatcgccctcccctccttctctcgtcaccacttcccgtcgccagtccaccccatccccacctccgccgccgtccatctccctcgccgcctccgtcgcctgtccagcgccgtcgccttctacactccctcgccgcactcgcccttcctcgccgccttctccaccgccagcgcccctccgtcgacgtccgcctccccgcctcccctgatatcggcggcttccctccgtcgaagcccttcctcatcgccctcccctccttctcctccacccgtgtctcagcgccggcttgtagcccccaccgtcgccgtcctcctcccccgcccccttgtccagcgagtcgcgtgacgtagtcgcccctccacccacctccgccggcgggcgacgagtcctcttcgccgggtcacctccccgcgccaccaccgccacgttatcctccccatggaccgacgcacccttctccactccaccgctgtcgccatcgacctagccgcccccttctctgaagtctgaacatgcccttggcaactgatttaacccagtgtaagcgatactctattagttagtaggagtactactaactgggtcatattaatcacagttgaccaattctattgtcttgaattgcagttttttttggttaattttcaattttttccctcttcagtgttcagatactatgcaaggaatcgagaggagacagccgagcttcaggtacattctgaatcctccaatcttaatataccaaccactactgttatgattttgcagataaagattgtttgttcttgaatccattgtattgtatattgattatttgattgaatggttgattgatccaccagatgaatggactgtttgaggactgcatgttggctgcagccgttgcttcctgtttgatatggcttcggtattgcttccatgcattctgacctatctcacattctgcatatgtgcttgaaagctaatgcttggttctgttttatttagtgcctcagtttgatttagtacaataaattaagcgctcaattgttaatagtctttcaaaatgattatgcagtcccttttcttttccagacgtgcatgaatctatggttggcttaaaaattatagttgaatgggcacaacattaatgttcactgtgtacaaaaaactgtggttgtattttgaattttgtacatgatccacgacaggtaatctgcattggttatttggtatatttgtggagcatattatagatcaagatatatgtgaactaatagcattttaaaattaaaatttgtccagatcaccatatttgcatgaatatttttccttcaaagttggtccattttgttcagacaggacaacattgcacttaatttttttttcatattatggttcaagtgcagatattgtggattgccataacactatcaccttccaagtgcaaattagcactgagatttctgggttgatcagtcgttgtgagtatggaattttgattctatgttcttctatgattaccaggctttggaaggatgtaatctatgatatatacaggtggtgatcatagcatgatagcaatcaaattccacagtgttggtaggaataaatttcacaggttgtttgttgttgaatccattgtattgtatattgattatttgattgaatggttgggagcagggtcagtttgcaagacggtggcatgcgcgaagggtggcatgcgcgaagggatccgcatgccggcgaaggggttatcggtgttcaggtgcgacattgtagcagacgcacgtcggtgacgtcgacagctgactgcactgagtcaccccgaagcgtaaggtttcatataccgctccttctcaaatggattgaaatatgaactatgaatattatctcaaaaaggcatcaatgtttgggatccataaaatacccaagtagtatataaattatttaataagggtaagagagcatagtaaggtaattgtggtaaatgtatgacagatgatccatatatgtcgtggttggtagcagtggacgatctttaatgttgttcagttcggagttgatcaaaattccggctaagtcctgtcgaaatgtttttacttccttctgcataatgtaaagggagtgcattttaaatggtttttcgtattaggaagcagtggtgcaaaatatgaatagaggttgttgtagttacctgtagttgaatttttaggagataagatccagtccaatgctccatgaacttaagggtgtacaggccgcatgagacgctacaagaatttagtcgttaggataacacgtttccgtatttgaataatgtgaatatcatgtggaagagtttgagtcacccacccgtctccttgctttggcaatttttggactttgttgtactcccattcggtaatattgaaatcaggccaatcgtgttttaactgtgggtgctgattctctgtcccgtataatcccctctcgatagctagcagctgggaagttttgtgcaacgttggtacggttaaaatatagcaaaaccgatttgaattatacaagtggaagtgtatcgcttaccacacgccttagatcgggtcgatctttactgattggctttgcgagcgaatctagtatttgcacctcacgtcgcttggcgttaagaacggctaggtaccagtgtgtatctttaatattaattgggaggaaaatctgcagatgttcaacagtaagattgagtcataaattgaattacccattacatagatagcttaaataagtattaccatgtcaaatggtagatagtcgcatgccatatctctaatccatcgtttatctcgaggttcgcttgcttcgacatgcgctccctctacatttagtagacctgttttaatgcccatctctaggaaggccttgccatctcccctgattcctttctctttatagcggaggcattggatgtatgcatccatgacctgaatttgagtttagttgagttacataacaaatatagttataaaagaatagtaggcttgttaataggcgaacttacatcatcattcaagaaagctggttgtgttagtactttcatttttttccgtttaacctccacttcttcaatatgcaccatcactttgttatcgtcggtgttattaatgtaggtaatgaaagggtcttcttttttagtcaactctacataggtacgacaaattagtaatagatctatataaatgttaaatggttaggcattaccttctgaattttttaacggtgtctggccattcgtttttgtcttattttgacctcttaaggcgttcttcggtgggcctttgtctatgatttgttgggtaagatcttccttctcgatgtacactagaaaagggtaagtcaaatcagtaacacagaaacatagaatataagttaaaatttatggatgatgtagagagttcatacattcagatatttcatacggtgtttggttgttttgtttcctctttttttcacaccgtagttcgtctgtgtctggcatgtaagcttctttattcgtttgcgcttgaaaaggaggaaagttagtaccattgacatgagcatatgtaaatatgaaatagcatagtacctatcgttttctttgtctgtgcttgggttcttattatgtccttctttttaccccttgtttcgtagatgaagtcagtccaattagttggtttgtatgttcttcctgtaggacctgtaagcctcttcctgctttgattgctctggttactgttgtcctgttaggtaagaaagtacacgtcagtattatgataagatgtagtaacgttagcgagagaaataaaatttagtttaccttcgtttcacaagtcatgtttacattttggtttatataggactcttcgttatgatttgatacatgctccctgggatcattttgttcttgttcaacatcctgcaatagcgtcaatctttttttagcggtgtatatatgtaagtaataatgattaacagtctagcatatgatgtttacctcaaacacatgcgtactatcttttcgctttgggcattttgaatcattttccatgcaatctagtatcaatgatcgcatacgtggccaaaaatcctttgtgaaatctttgaaattatcttgtaaagtttggatgctttcttgtaacctttcttgtaaagtgatgtcggctgatggttcagtggatgttatagagtgtatctgaatagcacaagttagaaaaggatgtcaaacatattttgttaaatagagttcgtattaaaaccccataatatatacctcttcagaagtgccttgaaaatcttcattgctatgtgtttctgagtcattgtcgtgcgctttttcattggggatttcattgcaatgtatagttcccctaatatcgtcgacaacctatttttagtgaaaaaggggtattagagattttacagacagttgatataattagtacatagtattaaaaatgagatagttaccttcccttgtccaaaaaggtaagaaattcgctttttttctttttttttatcccagtactgaattagtggcctttgacggctagaatgatatattgtcgcagccaatttatctattcgcactttttcccaataccaaatctgcaagcatttgaacattagataatgagtattgctatgaaaatatgttcatgacaattttgtaaacatactaaattttgaaacgaacctgtaagaggcatacgttcccctcaatgtttgttgtcttctctctaaattttattatgcctttcagtaactgattcagtgttagactagaccagtttagttccctcattttgtcaacgtcgtcgacgagattgagatattctgagcgcacatatctttgagttgtaggacatatgaatgatccaattgagaaaagaataaatcttcgaatgaagtggtcatcgtagctcgaggagttgattattgcttcccgtaatgcttgtaaagtaattgttgtttggccttcctttttgtacaggttgaacaattctggtttattgatttttggtgcctcaaatatgtcatctccttttgatggcagtccaagcaaacaatcaacatcatcgagtgtcatcgttacgaaggtaccattaatattgaatgctttcttctccttgtcatagcttcttgcaatctcattgcacaagtttcggtcaatatgtatgttgtcaatctttagcaagttgccaagacctgaaccctcgatagcttccttttgacgtggacttagatggagtattacctcgtacatggcatgtggagagcaaactagagttccctgattaacagaaaagataataaaagtttagtccttgtgaaaatttatgcaagtgctcatatatacagcagccataaatcctaatggtgcactgtattgcacatcataaggtactaatccatattaattttcttaacatgagaaccaatgtgattgaagtgaacaccttattaccatttggggtcatataaatcataatgtactatattcttgctgatgtgataattatgcaagcatatttttttttgtactatatctttcttagtgggggtggggtgggggtttggctcgacagggatttctgaacatataggatgaaggtgttagtcaatataagagtgcgtaattggagacaaagcattaattggttcacgggaaaatcagggttaaggttgtaaatgtatttcatatttatctctgcaagattaataacagattttatatactaaagtacagttgcaaaatgggtataatcatagtatacttctgtcctgtttttgcagttccctctagtatgtatgtgtggaacaatacgaagaatggtagctgaatccaaggatccagatctctcaaagttggagcttgtacatgtaccagggggagctttagcatttcaacttgctgccaagttctgttatgggagctttagcattactaaaaaattgattctatatacgctctgttaggtgggaaaatcagctatatgttgggtaacaaaagtgtatggtgctgcagtatgagttaaacctgacccctttaaactgttgcctgtattatcccatgtagcaggcccatatttcttgggacatctcgccatggtgttttgtctgtgaggctgctacgtcctctatatccattttttaatcataaactagtcaattatataacattgcaaatccatgtctagcacctctgtgttgtatccaccatattagccggaagctataatgacgtactgacaatatgaagcaaatgattgtgattgtttttttagtacgtgattttgtatacgggaataaatgaatgtttgttttctggttttgtgcatgaataataaattaatgtttttatttgttcaggtctctggattgcaaacacagattttgctttcactgggggacctttcgagccaaatttgtgaaacgcaaaagatgttgataaagatggcccatgataacactgaatttcaggaaaatatgaatgatagaatgacaaacgttgaacacattcaacagctacaattacagcaagtcacggtacattttctgaacatttatgtttgttttttccacatggcaaaatgctttgacacatatctttcttttgtgcaggatataacgcatggagaacaacattttccaaggaaaagatacatcgaggtcgagtatcctagcactataggaaagagggttcgaggagtcaatggtagggccgttgtaagtaacaagaaatttgattgttacaaaagatgcttggtagacggtaatgatgacttcgattttgtttgcactacggacgaaacacgcattgcgttgcgtatattgtgtgcaaagcctactgagacgataatccatattgatgacgtcgttttgacgaaggccgatttggtatgtcttgtacagacttatccgtatgacaattatgaaaaaaacattagcacaaaggtacgcctatgcactatttttgcaaaaagtaaagcaaaatcatctctaagtaatgcttcataaattgtattgttgatgcagatcattaaggcgtttgtcaagcattttggacaaagtagatcaattaaacgacataaacatatgtaccatgcctacttagagaccccgtcagttgtgtcaatgcttatcaagtatggctattatgatggtgttgagctaggaaacactgatgaaaatatgtacaaatccgctggagtcagctatgtgaataatgatatggtaaaatcataccttacaaatttgaattcattatattatttaactattttgtaaattgtattgatttgacatacagatttttctaccaataagaacttcaatagaccattggtacgtagcggttctggactgtaccagaaaggaggtgtgtgtccttgactcaatggacacgactgaagatgacttgaaagaacttaagtttctggtactttttccccataaagtgttagcattatcagtgcaaccaagtttgtagaatattaattatcacatatttatttcatgtagatgaaaggcatccgcaaatgtgtccgacttgtcctcgatgataaaatagtagagaaccctctgtgggacgattacaatgttcaagcttggaaaatcaggattagatataacttgcctaacaaaaaagacaggttagatatttacaaccctgagagatgactttgtaaaaaaatttatttcggaataattttacatctactcgtactcgtacaggacatccagtgggctttactcaatcaagttcatggagttatggacaggagattcactaagcaaacaattttatcaggtatatatgttgtacaattagcacggaagcattcctatttatttcatttaaaactaataatattgttgtcaattacacaggaagacatagacagctacaggagaaaacttgcagcaatcttgtacatgtctccgtcaaacaagcttcgaaacaatatctgttctacctcaaacggaaatggtactgatggaggaactagggcggcagacgtatgattgaataagagttctttacggttttgataatttcagctcaatgaagacatattgaacatgtcagaaattcatggtgactaataataactgaggcattgtgttcgattaattattgtcatatacagctacaattttttccctgaaattaattgcactgttttggcttggtgctgttcaagacgaactgtatttactgcaccgatgccttttgattattttcagcagtacagttttctatttcctacaacacatagttggtatatctatagacaaaattaacatgaacaccatataacagcttaaaccatcacgtaggctaaatataaatcacatagtgcatatcataattcatcaattaatttagcttgttttcttcacatccttttcaagagggtataagtcatttaatgacatgtaagtacgtaatatacttaggaagtgcaatatttatacatgtcattgtcagacaatcatatctcaacaatccattttgagatgctgaaaccaacgcaaccaaactgaagtactgaacatcgcatgagctgaacacgcaaacttgtgatgaagtcatgagcatgaactctaaaacacagttcagttgaacaggccggccaatgacaatcgcatcagctactgactttggagatgctgtgcagcgatgggcgccattgacgatgccgggagtgtgtcgccgagctgctccgttggccgtctatatcatgctgcgcaaaccgcgataggatgggcagcagaagagtaatcagaattcagaacatggcactttgtcaaaatttaataaagtttaggagactttgcaatcaaatcaaattaaagataaacctaaattatgaaggctaaggtgttcaatactggaatgtcaagctaatgagattagatcttgccaaattacatgctattcctgacagggaaatgtagatggctagaagatgaataatggtcttttgcaggaactgaaaatccctttcttgtcgcaacaagacatttgatgtttattattatcacccataaactgtttcaagaattgtcggtgatttttttaaaatttaattcgtctgaagttttggaactgacaactaggttcgaggccttagtggagcacttcacttttctgaggcattcatagttcatacaacatgtggacactctgttcatgtaatcttggatatttaggaacatgacagtactattacttcaatctgaaaagttgatgtgacagaaaaaataaataaaaccaagatgttgacacaccataaagtaagcctataaatccaaacttatcactgctcacaagtttgtatgattg

SEQ ID NO: 71998 - DNA, 41801 bp, Oryza sativa
  unsure (1)..(41801): unsure at all n locations
cactaatgcacccagtactttcatgagattaatgaatgaagttttatgtgctttcattggcagatttgtggtggtatattttgatgacattctcacatatagcagatcaatagaggatcatcatggtcatttgcgtgctgtttttgatgctctacgagatgcacgtttatttggtaaccttgagaagtgcacattttgcatagatcgagtctcttttcttggctatgttgtgactccgcagggaattgaagtagatcaagccaaggttgaagccatacatagctggccggttccaacaacgatcacacaagtgagaagctttctaggagttgctgggttctaccgccgctttgtgaaggattttagcaccattgcagccccactacatgagcttaccaagagaaatgtgacattcacttgggctgtagcacaaaggaatacattcgacactttgaaagataagttaacacacgctcctttattccaacttcctgatttcaacaaaacttttgagcttgaatgtgatgctagtgggattggattaggtggtgtattgttacaagaaggcaaacctgtagcatatttcagcgagaaattgagtgggcctagtttgaattattctacttatgataagaaattgtttgctctagtgcaaacattggaaacatggcagcattatttatggcccaaagaatttgttatacgctctgatcatgaatctttaaaacacattcgaagtcaagcaaaacttaaccataggcatgctaaatgggttgaatttattgaatcttttccatatgtcatcaaacataagaagggaaaagaaaatgtcattgctgatgctttgtctagacgttacacaatgctatcccaacttgacttcaaaatttttggcttggaaacaataaaagagcaatatgcgcacgatgatgattttaaagatgtgttgttgaattgcaaggagggaaggacttggaacaaattcgttctcaccaatgggtttgtgtttagagctaataagttatgcattccagctagctctgtgcgtatgctattattgcaagaagcgcatggtggagggctgatgggacactttggtgtgaagaagacggaggatatccttgctgataatttcttttggcccaagatgaggagagacgtggagaggttcgttgctcgctgcacaacatgccaaaaagctaagtcacgccttaaccctcatggtttgtatatgcctttgcctgttcctagtgtgccttgggaggatatttctatggactttgttttagggctgcctagaacaaagaaggggagggacaatatctttgttgttgtagatagattttctaagatggcgcatttcataccttgtcataagagtcatgatgctacacatgttgctgatttgttctttcgtgagattgttcgcttgcatggagtgccaaacaccatagtttttgatcgcgatacaaaataccttagtcatttttggagaaccttgtgggctaagttggggactaaacttttattttctactacatgtcacccccaaactgatggacaaactaaggtggtgaatagaacattatctacaattcttagggctgttttgaaaaagaatactaaaaatgtgggaagaatgtttgcctcatgttgagtttgcttataatcgttcgcaacattctactactaagaagtgcccttttgagattgtttatggccttctgccccgtgctccaattgatcttttgccccacccaacttcagagagagtgaactttgatgcaaaacagcgcgctgatttgatgttaaaacggcatgagaccactaaggagaacatagagcgcatgaatattaagtataaacttgctgggagcaaaggaaagaaacatgttacttttgaacctggtgatttggtttggttgcatttgagaaagaataggttccctaatttgagaaaatctaagttgctacctagagctgatggtcctttcaaagtaatacaaaagattaatgataacgcatacaagcttgagctacctgccgattttggggttagccccacgtttaacattgcagatttaaagccatatttaggagaagaagatgagttagagttgaggacaactcaaatgcaagaaggggaggatgatgaggacatacgttccaacgatacaaccatgcctattgcacagcaaggaccaatgactagagctcgagctcgtgaacttaattatcaggtaaagtgattcctagctaatcatacaagttcttcttagaattgggtgctactaaatggttgttgtgatctacttgttgttaggaatatgggagaggaaccagatcgcaagtagcactagcagcgctgatttgatgaagtcaatgctcttcactccggagggcaaacgaggcaaatgagtacttgttggaaagatctcgtcgtctactttcagctatgtgtggcctcaaatttgacccaggctgctcagaatgacgaaaatagttcttcacatcagaaagggcttgggccttgtatctttatagcccattaggggtccacaaaacctagggtttgctcccacctcctctcctggtcattcctccacctatataaactcctagcagccaccattttgcactttgggttttgtttagatgtaagtttagctgcagctacttccttgtactcgcgtgtgtcggctagaccacccggatacttgtattcagaaccccattttggtttgtttcagtttcatcacttgacaagtgccgtgagctgtttccttgtcaacttgttcttgcttgttcttcgattgcttgcaggttcaaggttgttcatggcacggcaagaacagcaacaacgtggagtcggtgtaccggttgctaaggcacagcacccctgtggtagttgtagtcggaccgccaacgtcgtgtcctcccctaaatcgaagtttatcctcctctcatcgaaagatcgggatcccccgttgctgcatcaagcacgaccacaatggcagtggtgacgaggacgacgagttcgtgcgctggtaatagggtgcgcaaggatagaaattgacaggaatgatagaaaagtgtggatggaaaacacgacaaagtgacacggttttaatttccccattctagtggcacgttaccgatatcgtgaatagtagttgtatttttttaatttgtcatatctgtagtagcataaatccaaataaccctaaaataaattgcacaacctgatttcccaattaacttatccctctggttttccgcacgcgcgcttttcaaactattaacggtgtttcttttgtaagaattttctatacgaaagttgttttcaaaattatattaatccatttttttaaaaaaattaactaatacttaattaatcatgcgttaatacacacaccgttttgcgtatcggagaggaggggttcccaactcctcctcccgaacacagcctttagtgattaggatctccgtaggggagacggagggatctggcagcctataggctctttggcaggaaacaatctggaaataggtggtaatcctatcccagattcaatcgggtctccagtctttgcactctagggtgtcgagacggacggcagtagcgacctccgggtgtctgtgcagcaccagcaagagttgaggcagacagcagcgcgcagcaacctcccagggaagtggctgacaagcttgcgttggtgcgaaagcaacatgctccctccactatcagcgtccacatctggacgcgactcctaggagcatccatgtttggacgctatttgtagtagcgtccttattactttggttcatctttcctcttaattactaataatttaatttaagggattttaattattataaataaaaaagctggtgctccaccactgcttcctcctgctcctgggatggagccccatatccgatgcgaaaacccgctcccctgcttcctcctcctcgtccttcctgtcacgggctcgtggcgtgggatgcaacgtggtgctagtgtgctactaattgagacgactgagtaagtgtgttcctagcaagggagcgtggtaagtcttccatcccgtgccaccctgttagatgaggtaattggtgctatcgtcgttgcgcattagactccggtcaaaatttggatctatagcagaggagaaaagggaaatagttaggcaagctcgtcatccctgcacgcggaacgtatttcacactggagatggggctccactgcggcactgccccagctgatgagaagtagacaagggagggggagacgagagggggggaattaagcacttgaactagaggtagaagataggtgctgtaagattcatgcgcacacgtggtggtagataaacggagtctttccaaacgtgagaagtaccgaggtcctgtacagttttcttccattgagtaagatggcttttctgacacaattgattgtggggtccagttcgtccaagatggacgagaagaagcacaacacggatccaaacactcgaggattaaatcgaaagaaattcatcctaaatttttacgaatgactgttagcaattttgtatattgtaaatcatgcttgcacatatagccatcaatttgggcagaaccatactttcctcttactgttatatagcatctcgcatgaaacatgttgcattgcgttcaaggtatatattaggttaaacaacaacaatggtattatttccataccattatatgaatattgtaaaatcacatgatcgtcatgaccagatgaacgaaattaatattgtttgtacatgaccaactagagagctgttcagctaaatttgcaaaataataacacacagtacaaaattggccggtagctagctaggtttcgtctaactgccatgcaggcgaaccctagcgcgaggttgccagccaggggatccatcgcgtggtcgtgagcaaggctgcaataaccgaagctcgaggcaaaagcgtccgcaagagagggctgcaactctggtgccggccactactagaaaactcattttcggcgtcgtagggtatcaattttcgcaggcgggcatgtaattcggagccaaaaccccactggcaaaaaatgtacccggggtggagggcgcggtccgcctgcgaagatcgatctttgtaggcggaccatataagcgtcgcctgcgaagatcgatgttcgcaggcggcaaacgtcgtgcgcctgcgaagatcgatcttcacaggtgccacttatatggcctgcctgcaaagatgcccctatatagtcttcttcctacccaagccctattcattctccccgaagtttctctctcctaaagtgacttaaatataggggggaggttttgaacttcaaatcttcgggggatttttctacggtgcttagatctactcattttcacactaggtatgtaattttttaagcttttagacctcaatttctgatggatttatgcatgcaaaattgtgaaggaagagctctatgttttttaatttaatttcttttgatatgttgatgttagatgtatgtgtaatacttgatgcctcttgttgtagtgatttaatgtggtaacataaattctcaattttttttatttttgctatcacatccacctcctaattctagatctagatctagatcttgtcatatatagagagagaataaaatttttaatatctatttattcggtgcaatcaaaaaatagttatagtagtttgtaatatgccgatgatatgattttgttagattttcctaatgtactaatttggcaagtctgtgtaaaaaaaattgaaataaactttgtttttttattaatttacaattaacctttagttaattagttttgaatagcgataagttttttcagtaaaccctacaaatttggtattaattgtgcaaaattttatgtgcatttttttagagatatggaaagtcgggaatggatgtatcattggccgaggtttttgtctccatatagaaacgaagtgtctaaatttattgttattgccaaggcacacgctgaaaagaacaatatgaggaagataatttgtgaatgtgctgactgtaagaatgaaatagcctgggacttcaacgatgcttttaaagtaaaggagcacttagtaactcgtggatttatggacgagtacaaaatatggacacgtcatggcgaagaacaagtggacgggcctgaaaatgtagttccgacacaagttgaagacatggtgcgtgacgatggttctgttgaggacaaaatcgacctacaggaaatgttacgtcatgcagaacccgaggtgctgatggggtcggctagagggttaaataactttgaagctttacggaaggtagcaaagaaatttttgtacaatgagtcgaagggctgtgacagtgagttcacaacactacggtaagttctcgaacttatgaggttgaaggcgatacatggatggtctgatactagtttcgacagtctgttataacttctgtagaaaatgctcccgaggcctaactcactaccatccagcacatatcaagcaaagaaactcatatgtcccctttcacttggtgtggaaaagattcatgtgtgcgtaaatcactgcatactgtacaggaaagagtacgcttctttagatgaatgtccaacatgtggtgctagccggtacaaatcgaatagcaataatggcctagaaccgtctgatacaactgagggacgacagagaaaaatcccgcagcttgtgatgtggtaccttcctgtcaaagaccacattaaacggatatactcaaacccgcgagatgcggaactaatgcgctggcatgaagaagggcgcaagaaggatgggatgattcgacacccgacagatgctcgtcagtggataaactttgatgctcagtatagagagtttgctaaagacccacggaacattagatttgccctgagtactgatggagttaatccttttggagacatgagcagctcacatagtacttgccagtgttctcaccatgtataatcttcctacctggctttgtcaaaagcaaaatacgtactactctgtatcctcatacagggaccccgtcagcctggtattgatattaacgtatttcttgaaccattgttggaagatatggctgatttatggaaagagggattgaaagtgtgagatgagtacttaagggaatacttcacagtgaaggccatcatcttcgtgaccattaacgattatccagtaatgttttcagtttcaggtcaaattaaaggtaaaacaggatgtgtaatctacttgaatggaacgtactataggtatctcccgggttccaacaagcttgtgtacatgcggcaccggcggttcctacgcacaaatcacaagtaccacaagatgaaggcggagttcgatggcactgaagagactaatcctgcaccaaaacctacatcgggagaaaaggtgtgtgcaatgacagaaaattgtttgcgagtttggaaaaatgactaagaaaccatcaaagggaacaaagcgcaagaaacccgaaaagaatatgaaacaaggggatagtaagaagcaagatgatagttcgaagccagatgataaactccctcccccattcaagaagcattccatattttttaagtacctcccatactggaaagatctggaagttcggcatgccatagacgtcatgcatctagagaagaatgtgtttgacaacataattagaacattgttggacatgccaaagaagactaaagatggtctgcaatcaaggatggacctagtcgagatgggaatcagggaagagttacaccctcaaggagagaagaatgacaaagtatatcttccaccagcctgtttcacactgacacctgaggagaagaagtcattttgcaactcactccgtgatgtcagagtcagtcgactagtttccatgaaagatttgtcggtatctggttataattcacacgactgtcatgtcttgctcactgtgtttcttgaaattgcaataagggccataaaaccggagcatttaaaggttactatcacaaggttgtgctactttttcaacgcagtgttgcagaaggtcattagtctcgaagagttaggaaatctccgtacattcgcacatgagacacagtgccaacttgagatgtgtttccctccgtcattttttgatatgatggagcacctcattgttcacatagtgccgcagatggttgcgcttggcccattgtacctccatcaaatgtggtcatacgagcgttacatggcggttttgaagggttacgtccgaaatcgtgcacatccagagggatcaatggttgagggttatagtactgaagaggttgtcgagtgctgtattgattaccttaaagatggatatgcaattggagtacctgtgccccgacatgagggcagattgagtggcaggggaacgataggaaagaagagattcgtcacccatggtcacaaatcattccaagaagctcacttcagcgtgcttcatcagtttgctatcgttgagccgtacatcgatcaacatatcgaacaaatacgagctaacaataagggtcgcaccaccgagtggataatgaaagaacacaagcgtctcttcatagattggttgcgagacctagatttacctgagggacaaactaccgatgaaataactatgaagcggttggcttgtggtccatcaactacagtaaattcttggtagggatatgacattaatggatactcgtttagtacaagagcccgagataataagacctgtacacaaaacagcggtgtccgtgtggaggcaattgatgaagccggggaaaaacaatcatacttcgggtttattgaagaaatatggtaaatcgactatgggcatacaatgcaattccccatatttaagtgccagtgggtaaaatacccgaacggggtcaatgttaataagttcggtcttactgttgttgacctggcgagtgtgggtcacaaggatgacccttgggtactcgccaatcgcgtggcacaagtgttttatgtgaaagacccatcaaatttgaagaaagatatagtgctacccgggaaacaaaagatattgggagtggatggggttgaagatgtcgtagattacaatcaataagatagtatgccactttatagtcagtttgtacagaagattaagaatgtcgagacatctactcagaagaccgtgaagccttacatgcgcatggacggtgtggggaaaaatgttaaagggtaatgattgttgagtcgcatgtaagcatctaagaagttagtagttatgtaatggtggtatgttaggtgatgtgtgatcatatcgcaaattgacgaacaattgtactcaacattttgcatattagtttgtactaatttttatacaattgcactcaacattttgcatattagtttgtactaatttttatgtgcaattaccatttgtagggtaacatttacagttttttattttttaaaagtttttttaaaagaggtttaaaattttagtagcattttgttatgttcacttaccattatttgaaaacttattttaaaaagatttcaatcaatggtaagtgcacatataaaattgctactatatgttttttaaagtagtaatattaatgtttgaaacatttaagtaatatttacatttgaaaagtagtaatactaaggtttatctacttgtatgtacaattaccttttttattacaactactgtagacatgttcaaatcacaaaaataattttaaaataattctgaaataaatagagtcatccttgtaaaaatcttcgcaggcggaccgtccgcctgcgaagatcctttccctatataagggcaagcccgcggcgccaaaatttctaagtccaggcgggaaccctagaaattttggcgccgtcaggctgccaaattttttcacctccgccgtccttcgccgccacccgcctgcgaccttcaccatccgaccgtcgtcctccgacgccgccgaccgtcgtcctctgcgcgccgcctgccttcgagctcgcgccggctgcacgctacaccgcgccaccggccgtcgatccagctccaccgccgcccgctcccgtagccggccgcatcgccaccgcctaccgctccaccgccgagctccaccgaccgccgctccaccgctccaccaccgccactgccgtccaccgcgcgcgcgcgagctagcgctccaccgccggcaccgtccatcgccgccggccacttccccccccccccccccccggcccctccaccgtgctgccgaccactccaccaccgccggccgctccacagccgccgccgccatctctctctttctctctctcgcagtcgtccacgagcggcttcatcggcctttcgtcgtccacgagcgaagacgtcctcggccgaacggcttcatcggccggtcatcgtccacggccgaacctcgtcgtcgacccttccttcgtcgtccacgaccgaagctcgtcgtcggccgttcgtcgtccacggacgtgtgtgaatgtgggtgtttctttttatatgtgtgtgcatgtgggtgtgagggggtatatatgtgtgtgcatgtgggtgtgaatgggaatgaggggtgggtgatatgtgaatgattgtgaatgtgaatttgggaatgtgggtgatatgtgaatgaaattgggagggtatgttaaattttgcaagatatgtgtatttgtcaaatttttttaataacatgtgggagggtatattaacatttttttaaaaaaaatatggaggatatgtttgcctttttatttttttttaaacaacatgtcaaggaaatgtaattgttaattagtgcactacttgataataacatatcaaattttgtacaaatttgtttgtactaattaatttagcataatagtaagtactaattaataatatttcgcaatttaaatttgtttgtactaattaatttagcataatattaagtactgattaatagcataagtactaattaataacatatctattctagcataatagtaagtagtaattaatttcgcaatttaaatttgtttgtcctaattaatttagcataatagtaagtactaattaataacattttgcaatttaaatttgtttgtactaattaatttagcataacagtaagtactaattaataacatatctattttcgctacgtgttaatatgggaatctcagagaatttaaatttgttcatatgacattttgttaatatacagtttatttttgtacaaatttgtttgtactaatttgagtaatttaaaatgtggaggataacttttttttatgttagaggtttgaaacgatggccgatagtactaaagggactaaagagaaaggtttaggggagcaagagcagtcccttgctgctgtggttgctccggaaccaacggtcccaccggaagatagttccgatagcgacgtagctgacgaagacgatgagtactcgtcgccaagcgatccttgtccaagcccaagcccgaagagaaggaaaaagggcgacggtgaagaaggcgacaaggattacattccccctaaagaaggggtaagtaaacttaatatgtaaactgttcaccgtgactttcatgtataccttctcgtaggaaacggcgccacggcgatcaaaacggcagccgaagaaaaaagttccgtcgaaagacgacgaggtaccagctaacacaaccggctcaaagaaagcgaacggtcagcaaaggcgaagaaaaggaagggtgagagaagcgtgaatagaaaggatgaagggttccatattgttactcatgtttcgccaaaaggagagccgctcgcccctaagacggcatgtgcgaaattcagttcacagtgtggcataatagtaagggaaaagatccccatcacggtcaaggactgggatcatgtatcgaatggggataaggaagtcctatgaaaagagttgaagaaaatcttccagttcccggatggattagaggcagcagtgaagaattgtgcactgcaaacaatggccaagtcttggcgtggttggaaaaccaccttgaacaagaaatttgtgaagacgggacgcacactgtttttgacgtatgccaacataaccccgaatcaatgggacaactttctgatgttgaagaactccccagaagaaattcaaaggagccaaaagtatgcaaagttggccaagaagaacaaatttcctcatcgcttaggctccgcgggatacgcaccaaaggtggagcagtggacaaaagaggaggaaatgaggaagaaggggcaaccagtactaatggaggaatggacacagagatcaaagaactgggtaagagctagaactccgaagatcacggatgaaggcaaagtatcgtttgaagatccggagctgcagagcgttgccgataaaatagagaatttatccagttcacagaagaaaggatttttcaagcctaagagggagaaagatgtgctaagtacggcgctgggtactcctgagcatgggggaagggttcgaggtgtgtcaagctagatgagttggaaggaagggttcaaacatgacccccacaagaagcgtgaagcgtataaggataaacttagagagaaggggctgcggagtttgaaaggcaaatgatggatttctgcgtcaagcacatgcttttgcctcgccccgaaaccaaagaacctgagccagattaccccttcgatgacctcaaagagaatacaccctgcagattgcacgttcccattggacgctccgggaaaactcttgaggctgctacggccattgctatccctaggagaacatataatgaagagttcatacccaatgcgtatgccaaggtgcagccgcaagtggtccacgaagggtttgagtcctacgacattgacttcccgactgcagatggtgtatccatacttggggatgcggtcgatcttgtaattctctagcacaagaatgacatatccttttggattgggcaccgacgccacgcgaaaacctgtggtgccaaaaccggggttgggaaaacctccgagacctcctaagaggaaggtgactgataaggcggaggaacccgagatgtaaaaggaaaatccagtgccggaagtgccaccagagattgcagtgctggaggcagccatggagattccagtgccggatgtgcccatggagattacagtggcagaaccagaggtgcaatttgtggcatcagtcgggtcagaaatagaagaagtaccacgattcgaatgggacggtacagagccagaaatatttgaagacccttctcctacgaaagaccccgaggtgcaagagaccacggtccctgagaaggccactaccagttcagaggtgcctagagcggttaggagccacaactccaagtccaaagataagaacaaggagaagttcatggtaactgtcttcagaggggtaaggaacgtgccaagctcagagatgatgacccccagaaggccgctgaactagccgggccaacatacttcgcaaccaatgattgcccggaaaagtacgaacatgggaaagcactcttgccggaatgggcactgaacgaaggaccatgggagatgaaaaggttacataccttctacatggaggccagcaagaaaggcttgggcaatataacagctcgatcgctggcagattgtttcggtgaagaaggttacgtatggctagatttctcatatctccacaccatatatcgtcgggataagatggacgtcaactacgtcggtgtttggtgcatgtgagtatgagttttaattaattatatgaaaaatatgtacaatacaaatccatgtgattgttactaacaaacttcttctgcaggatgcaatacatggatgctaagaagaaaaaagaacctatcggcttcttgaatccaactcggatctgccaaacacaacataccgtgaggctagcaccagggtatgaccaactgaagggcatgaatccaaaagagatagctgaatataagaagggcttgcacaaggagaaattgattactgtcacacagtacattggacgagccttcttgcactttcaaaataagagagtcgtcatggccgcttataattttaagtaagtccggtacatttatcttctgcacatatgtcttattttagctggtactaactaactatgttgttgttaatatgtagcgatcattatatctgtttactcatccaccctaaagacggaaccgtggtagtcttggaccctctcaattacaaacaccaatcatacaaagaatttctaacaatcttacagtagtaagtgattatgactcttgcatttttatatgaatgtattataaataaatatcctccttaatatgaaacggtacaacatccatatagtgcgtaccagtactacaagttcaagggtggagaacaaacccgaacaagggagaagctgctagtacgtacctattgaccggtaatattccactcacttaatgtaactgccatggaagcaccactgaagactggcttctccgaccttccacccgctaccaattgtttcactaattgcaaattttaactattcttttatgatatgtcctgaagtgtcacaagcaaccgcgaggaacggtcctttgcgggtattacgcttgcgaattccttagagttaatggaaggtacaggattaacgcggaggatgtaagtctctatactatgtgctagacagcttcacatatttatgatactaatatattgtttatcttcaatgcatgcagttgccaagattagaatgtcgaacaagttttgacgatacaggcatcaaaaatgtctaacgtgatatgtgccacttcatccaccatgagtgctgtcatgtgaaaggagatttcttcgaccaagagagtgccctagccacaagtgatgaattcaaggatcttcgggagtggaacaatgctatgccataatgtattaaatagatggcgtatttgaagtgacaatgtaaaaaaatattgtaatatatatattttggcaacacttttgagtaatgtaatatatgtacatttatcagtaccaaatgcttgataatcttccaatatatgtacataataatctacctccaagaatttttattcaataatttaaaagtaatttacgggcaaattattattaaatttcaatattttctacctatcttcgcaggcggaagtttttttttgtaggcggccgattcttcttttcgcaagcggaccggactagccaacgtccgcctgcgaaaattatcttcgcaggcggacggccgccccgcctgcgaagatcggcgatcttcacagtcgttggcttacaggcggacggctgccccgcctgcaaagacccttttcggccggttgcgataatgcttttcctagtagtgggcagcgactgatctgattcctccacttcgctttccaccatatcgtccgccatgtcgagcttctgctccgtccttgcagcagcagcgaggaagccgctgcgccggagctccctccagcggtgattcatgactcgcgaggtccggccgtagacagcgtggccaatcttcttccagcagtcgcccaggcggtagtggaggcgtaggagctcgtcgtcgtcacgggcagtgaaggggcggtggtagacgtcgcgggcgaggtggtggcaccacctgtcacggcacaaccttgcagagcggcgtggcatgatcctggcgaccctactccagtggcggaagccgttctccttgacgaggcgaggcaaccaaggatgacgtaccaaagtaccggtaaaaacatcttcaatttttataatagtaaagaattggtattttcttttttttcaaacttattttttgaatttatttgaaattcatcaaagtgagcagtacgcattcgagaggggatgcgctttgggtgccattattgtcgaaaggttatacatgaaaatggaatataggaaatgttgacactatggtatacgcaagattggaatagggagatagtttaggtctttagtagtataggtaagattggaataaggagatttaggagtataggatatattggtactagggtatacatgagatgagaatagggacatgggatagagagattcttatataagttctgacccctgagatcaacggaatagtcctattcctgtttatatgtatagctccaggatgtatcagagatagaatacaaaatgggagtaagctagctaatctagcccatttgtcatttaattcagaaaaaattgctacacaactcaattttgcattaatcatactttcctcttgctgttatatcgcacctcgcacgagacatgcatattacattgcgtttaaggtaataggttacacaaaaatagtcatatactcatattaatgccttattgccataccattatatgaatattattgtaaaacaacataatcgtcatgaccagatgattggaattaatattgtttgtacatcagtacatgaccaactaaaaggttgtacagctaaaacaaggaaaatcattacagagtacaaaataggccagtagctagatttcatcaaactgccatgcacgcgaaccctagcgcgaggctgccggccaggggatccatcacgtggtcagtggcaaggctgcaagaaccgaagctcgaggcaagagtgtccgcaagggtactgcgctgcaactctagcgacggcagcgactgatcagctggctcctccacttcgctagtttccaccatgtcgtccgccatgtcgagcgccgccagctccttccttgcggcagcagcgaggaagccgccgcgccggagctccctccagcggtgcttcatgacgcgcgatgtgcggccgtaaacggcccggccaatctccttccagcggtcgccgaggcggtagtggaggcgcaggagctcgtcgtcgtcgcgggcggtgaaggggcggtggtagacgtcgcgcgggcgaggtggtggcgccacctgtcgcggcacgacctagcggagcggcgtggcatgctcctggcgacccggctccagcggcggaagccgttctccttggcgaggcgctgcagccgcgcgtcctcctccggcgtccatgccggcggcagcttgaggcggacgatgcacctcgcgcgaggcggcggcggcagcggtggcgtcgccatgatcacctcctgatccatcgcgacctctcaatctgctcgagctgagagctacggcgacgacaagtgaggattcagatgaagaatcgcgattcaccggtcgatgatgaaagacagggcaacgccgttgcactgtatacatacctatatagcgctaattccttcattcgtgtcggattacgaatcggagtcggagtgattaattaattagcttagcatgcacgcgtggattaatcgctagcttcggactccgtatatttactaatagtctaatagtgtttccaatcgaaggaaagtattcaagtgcaacgtaacggtgtttactatcccgtctgacatttgaaacaaaatcatgagaaaatctatgaaataccatcgacaagcactttaatcccataaatgccatcgacatacgcaacttcctgaaaatgccgtcatacaagcctatttcttttgaaaatgccatcacaccgttagtccacactgttagaacgaaaaaaatttacaaaaataaccaaattgccctaactccaaattatactaacccaatccagctcccgataggcgacaattgcgaggcagcgctcacaggcggcggcaacgtgggccccccaggcggcggcgcggggctcccaagcggcagcgcgtcggcagcaagcgttcgtgcggcggtcccaggtggtgagacggccgctcccaggcggcggcgagatggccgccaagcgaacgcgtggcggtcccaggcgacggcgtggggctcccaaacgacggcgacgaggcggcgctcccagatggcggcacggggctcccaggtggcgtcgcggggtccccaggcagcgacgcgtcggccgcaagcgcggcggtcctaagcggcggcacagcggtcccaggcgacggcagcgaggtggcgctcccaggcgacggcgcagggcccttgggcggcagcgcgtcgttcgcaggcgcggctgtcccaggcggcggcacgggcccctaggtggtggcgcggcggtcctaggcagtggcgtggcggcagcaagcgttcgtgcggcggtcccaggcggctgctcccaagcggaggtgcagggctcccaggccacgacgcgttagtagcaggcgtttgtacggcggtcccaggcgtcaatgtgacgggcggcaaggaggtggcaggtggcggcacaaggagtgactcaagggcctcatgcatcggcacggtggtcgcagggccgacgagttttgacttgattattagtctgcacgttcaatgcctaaaatatgtaagagaaaatccatgaaatgccattttagataaactatttcagtgagtggtgattatgaaacacatacatttttaaaagggcatgtagcctagtggttgcagtgacctgagtagcaccccaaggtcctaagtttaaatctccataggatcgaatttcagattggattatttgagggctaaattccctatttgataagctatgtttctaaaattaaaaaggctgcatatatccagttggatgtagaggccggttaaagaaatacccttctaaaaaaaagaaacacatacattttccttgatgaagttcaagcaaccgtcattcggcacaaaggcagcaatcttcttcccattcttcaccagctgaacacgagcacacttacagatggcagagtttggctgcttggcctcaataccactataatgaaacagatggaaactagttcaagttaagaaagcatgagtaataaaattgagcatgagtgttgtccaggcgtacatcttctccaaaacaatgcccttggcatgagatgatccagcaaagggtttcttccactcattgccaaagtggctcttcttgtatgccttgtcggcccatctttggttcctgcggtgggtcttgagcttgcgcccagctcccataccacatgttttcttgcaatgaaatttcaggaccaacttaagacaaatgctacgtcttacgattttgccaaacatctcccgcgtgatttttttcctggcatttgacgtttttttggccacatgatctttgcacaaggcatagaagcccacgaacagcccagcagcccatcatcatgcctaaccctgattgctaactctaaccccggtccactcactgccccacacgaccacgcccgcactcgttccccgttcacatcacatcgcacacacgccacgccgcttggatctgggtccgtggccagcacccgcaccgccgtagcgcgcgccaacgacggtgctgacgtggccgtcttccagcagttggtgcgcccgccctcatctgtcccccttctcgtcgatagatccagccgcctctttgccttccccacacgcatggatccatcagtgacggcgacgggaggggctgatccagcgcccgcttggtgatcaggagctctccgtcactctcccacttctctcttgtttcctctactctctctctctctcccactccgatctggcaccccctccttccccgcaggccgcacatatcccaccgcctatctacctcacacgcgcgtggcctgatccgctccctctcccactgacaatgcgggcctagtctggcagtcgcggaaacggacactacggttgctgtctttttaagatgctatagataacaagaatataaggtcattcacaatgcatctacatggcatttggcctcaactctccaactagactgattgtatacgtggagaagaaaaggaggtggggcccatgtcttcactagcttcgcgtgtccgagagcctcgtcagaagaaaacagctttttcaatcgcatctcagcatctgcacgtgagaaagcatgacacaaagagagaagggggagaagctcaccgaaaaaaaggtaattacaaagagagaagggggagaagctcgccgaaaaaagtaattttagtgatggggctcgcataggaaaatgtttggtggggtccacctgaatccatgccgcattgtggagaggaggagcttcgctgttttctgtacgtggctgtttaggctcctcggaaaaacaggacgcattgctaatgccccaacactcattctaaagctaagagcacataacgtggcaaatggaacattccctgcaaaatgcccacaaatcaagagaagtgaaatttaatggtacagtgtactacaagcaacacaatctaatcggtctcctggacctgatggccttaatgttggtttttatagagtttcttggccttggattaaatctgacatcactcaaacggttcaagacttttatgtttcaggccaatttccaaaaggtatgaatgatactaatattactcttattcctaaaaaaaattatcctacttctcctgctgattttaggccaatcagtctttgcaatgtttcttataaaatcatttctaaatctttggccgatcatatcaaaagtgttcttcctgatttaatttcagattctcaacaagcttttataaaaggtcgtcgcattgcaaataatcttattattgcccaagaaatagttcactctttcaatttaaaatcttttaagtaaaatgcttttctgctgaaacttgatcttgcaaaagcctttgatcgtctagaatggaactttattgagaaggctcttcgtcgtaaagggtttcatggtcattttataaatcttgtccttgcttgcattaattcggcaaacttctctgtcaatcttaacggccagtcatatggtcacttttcagctgaaagaggaatacgacaaggttgtcctttatctccttatttatttattcttgcattaaatgaactatttgaaatgatatctaatgcaattcaaacaggtcaagtcaaaggagcttctttaactccaaatggtaccattattccggccctgtatagatgggactaaaacttttaagtccctatcacatcggatgtttgaaaattaattataaatattaaacgtagactattaataaaacccatccataatcttgaactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctcactcttcaatgtatgctgacgatcttatgattgtaggtcaagccactcctgaagaagctagaagcatcttccaaattattcaatttttttgccatcaatcaggtcaaactccaggttggaataaatcttctattctgttcagctctcatactcctatcctatcagtgtcactcaagatattttatccattttccctgtctccttaatgaacaacaattccaaacatcttggtcatcctctcattctaaatactaaagccagaaactctgcctacaactttatcattgaaaaattcaaaaccaggctgtcaattattaaagcaaaaactttatcccatgctggtagactttctttaataaaatctgtgtttgcttccatccctattttctatatgtctaccattttacactccaaaaaacttctatataaattaactgccattatcaggaaattctggtggacaggtaccaatgatgaagacagtaaaaaaggtatttgttggaaatcttggtctgacatttgtaaaccttttgatcaaggaggtttgggaatcagatatttactaactgttaaaaaaagtcttcttattcaatgtgcttggagaattattgaaaatccaaataacttggtttctaagatcctaaaagaaaagtatttccctcagggctccttttggaaagctttaacaaaaattcctaaatctactttttggagttctattctgaaaattagacatcttttggataattctatcatatggcaactttctcaaggtgatatctcaatctggaatcaaccttggtgttctgtttggaaatcccttcctaatcatattactgattctgcaatgactctttatttacctacaaaagtttctcatctctggaatgataggaaagaataggatatttccaaagtgtctcaaatctttgatccccaagtttcaaatgaaattttaaaaactccaattgtgcattctaatactgatgacaaactttactggattcataactcaaaaggtatttgtacttctcaaagtgcttataaagtcttatcaaccaactctatgttacctgctgctaatatttcaaatttgcaattaaaccttttaaagaaaacttggaaatgcaaatttattcctccaaaagttaaaacctttatttggagacttctcagaaatgctcttgcaactgcaaaaaatttgaacttcagaattcctactatttcaaactcctgctctcgttgtagtttgtctgaatcttgtgctcatctgttttttcaatgtgcttttgcaaatctggtttggaaactgtctgaatttcatttagatacaatcatcattgcatccatgcaaaacatcagtgatatcttagcctatgttctagctacaaacaactctgaattaagcctttaaaaagcttctattcttctttggatgatttggaaagctagaaatgacttctactttaaaaagaaaaactgggaacccattcaggttaattttgcagctcaaatcatgtcttcaaactttatttcttgtcttgatactattgatgaagatcatgaatctcaaaatcatgatgttaacagctggacttctctcaattctgcttcagtaattcgctgttatactgatgcctcctggcaggatggtaatactggtattggaatcttcatccataactctgatactcataaagccctatttattcaagctgcttctaatttcttctcctctcctttacaagctgagcatgcagcaatcatgacagccattttgatttgtcaaaagttaaatattattgatgttactcttcttttagacaatcaggaattagttagccttttgcaggttcaagactattattctcacgaacattattggagcttaaaccctttactttaagatcttatttcccttgcaggaacacaggctcttaacatcaaatggatttcaagacaagttaataagatggctgactttctagcaaaaaaagcaaggaataaatctagacaaaatctgaatcaaatagtttgtcaaaatatttcccacttatgttcccattctgactgtccgactaagacagctttggaatcttctccttttatggagaatgtatctttggttgatgtattatgcttctaagttcaataaagctctaaattctcaaaaaaaaaaagctactgcaaaatgaaatatttgtagaaaatttttttttaccatcatctgtagccatctgcggcagaacaatcccacatgaccatcatcagtgttaaccacacgaccatcttcagtgttaattaagacacaatcccatttcaaataatttggagcaagaaaactggcagaaactaagatcaagttcttgacaggctcctaacaccaaaaatattgtatgctaccatgcataggttctcagattcaagcatttaaaccaagggacgggtgattacacagcagcaaagaattaatatcgcttatgaaaatgtttatcactgacggtgtcaaatctgaccagcactggaccatcaataagctcacattacctacatctaccgcaatctcactctctaccaatccaagaacacacaacaaacgaatcaaccaaacatggcccatagctacacttcttattacaaactaaggcaaagagatagagaaaatgcttctagtgaagacacatgttaacacgagcgaacgcaacggatcgttgcagaaaccactacaatggacgaaagagaagggatcttttgcacacaccccatggcggcggagggagaggccgagagatctccgaacggcgatgcgagaggagggcttcaatgacggcggcggctgaaagtggagtgaggaaggaagacgagggagattctatagtagcaaatctcagcgatttagggttagcgtggtgcgcgctgagattcgtgttggggtgatgggtataatcccacagtcctcgtgaggtttggtgagagactacgaggcggctaggccagttcccggcccaccatgtcattcattgtgtgaacaggtccaaggcctcctattttaaaaaaaaaaaatttcgggccaatttgccagtagatttttagtttgttttctcaccttggacgtatataatcattccgatgagcattaaattttttttaggggccctatgaaaggatttgatccgtagaaaatttcagaggaaatatgacatgaagttctaaactattgtaactttggaaaaaatccaactacccctctaaactttgattggaagttcattaagcaccgtgtactttgaaatcggatatctcttactatcgaatttcatgcccgttctcgagcgattagccccgccacgtggcttcactcgattccagggttcgagtcgtgcgcgcatccgttggattagaaatcaacgggagagatccacaaaaggatctatttataaattttaatcttccaagggagtttatctcaaaatgtggcatccatcatccagattccagagaaatcctttcctcccctcgtctcgccgctttctcctccgccgaatcgccgattcacaagccgtcaccggcgttggtcaccgccactccacatcagtgcgcctccctcgccaatccccatcccctaaaatccctagcccacagctccaccatcgtcacttcacctctccgcgcctccgcatctcgcgagctgagcgttgtcgcctcctcctcgtctcctcgctcccttgccgcccgtccgcttccctggcgcagctctcaagtgggagggctgcgcgccggctggaagtctcttgactcttcccgttctatcgatccctgcggtgggagagcaccggcaaacagtggtcgtacacctcgccgatcgacttggctcgctgcggcggacgaccactatgacgtcgtccagcagctactgcatatcgactaacctcactccgtcggatcccccgcctggaggctctctgggacgacaatgccggattcgccggcgtgacgcggtaccgggcggacggggaaggctcgaacggccggttgcggtgaacgctccttggtgtttaggctggagatgataatcagggcagtccacaccgccgcaagaggcggcagcacggagatgctgagggggctcacccgacaccactgcaggttgaagtttaccacctccgtagaaagttgtcaagtgcattcctagcttacgtcaagatagagctggtgtcccctgcagggagatgctgttcaagatttatgagcaatacaatttccgcgatgatcgtccaggagtattgtccagcaacggatagtagaaacatgaaagaccaaccttttcccaccgcttatggggaatccttaaatagctatagttgcagctcatttttttgagagccacacaatgggatgctccgtttgctgttggattgaaggaatgatctaacaaattgtattattgatggtttgaaaagtgaggatattatgtttagagatgatcattacagaaactgtacaatgctcgtatatctgttcgcttgttttatatttttagatgattaaagtctctttgcggactatttttctaataataagaacattcatatattcatacattgggtctaattggactggctcatctacactttacatggcgaaaataatggcccatcaccaaatatgcgcgtcgaagccgctcttgctttctagttcaactccctgaattttctaataccatttatataagctcataacatggttttgcataattatttttatctaatttgtactttctctgtttcataatgtaagtcattctagtattttctacattcatattgatgttaatgaatctagacacgttaatatgaatgtagaaaatgctaaaatgacttatattgtgaaacggaggaagtatataatttagttgagttttatatctgttatattagctattcgaggcagctcgttttagcttttaaatacgcaagaccaacaacattcaaatcaagcttaggggataaaatgaacggtattataaagtgtaggtggggcatgatttttatttttgttttctcacctcggacatatataatcaattaaccattccaaatttccaattaaaattgtttttttggcctatgaaaggatttgctccgtagaaaatttcagaagaaatatgacatgatgttcaaaatcatgcaattttttcttacgcgctctttctaaactattgtaccttttcgtgtcttactaccatgtgaaagcgatcaagttacacaaatgcgtttagcaaaaagcaccgaaattcatatcagttagcagagtccaagtagtgcattgtacatcgacataattgaatgagtaaacataagagcactggaattactaataattcatgttttctgttggtaccaaatgtccttccacaagggaaaactcttacatggtgtcgtacagcaattctacagacacaagaccatagcccataggcagctttattatgttgtagaacaaaagaataagaaacatttgaagtacacagcctgctcggttgaattgatatcacaatttagaaacagtgacattttggggctaggagctgatttatatacctccagcccacggccaaccactttggtgaaccatataaatttcttcttgcaatttcaccttgtgacatgtactgttgcgcatacatcgtaatgaaaatatcatgcccaggactaggcagcaggcaccaagtcatacctccaattctgtgaatgctagatctcactgaagtgtcagtataccgacaaaatttgacttttgattagagaagaaatcaaatagtccggagctattatttacacaaggtttgttatgggatggtattctcatactagtcatgtcattctgaaatgtaaggctacacctttggaagatgaagatcggctagtgacgaagtgagatcttctctcgattgggatctccgactttggagtgttgtttgacctggcttccacattccactagaaaactgcatctgacctaagcttccaacagaatagctgtgatagacgcccaatgactgcctggaggactccataagctgaacactgctgcctcctaatccatggctcatgctgaatggatggggctctgacccagcaacagtaggactcagaggtgtctttgttcttgcatcacctgtgaagagaatggcaatacgaagcaaatttaaaagttttgtctataggacggaacctcaagctacagaaaacaaaaggcgagtgcaacagccacacagaaattgcaggatagtttgacttcacataatgaaagaaatctctttccatactattgtgccttcattgttaatagagttaagtaacaaaaactacttttctataatagtatattaaataattaaaaagttcagtccaacataataattaatataaaaagaaaaaagaagcagcttttttagaatggaaagatgtttgattgtttaaaattaaagagatgatgcatagtatatagtagacatatagtataacactttatttggttttccaaaaaagcagagcaaccaatggctatacgtctactaaagaaaaagaaatggtacatatagtatcaacagaattgtcagggtaaaaattttgtgcttctagaatttaagtcccaaccccacagacaatagatgctttttacatgaggaaacaccttaaagtaacagcaatgtcaaggaaaaaaaaaactcaatacatacctgaagtaatatgactccatagatgaaatctgaaaggtgatcccatgctaagcacaggactgcctgcactgttctgcctaaaaagtggcagataagacttgcggaatgatcttgggattgaattgctgacacacaatatggcacatatgactaacacaattgaaatcagaaacaacacaataagaatatttggatttatctctcggtggagtattctgtatccttgaatatcgattcgtgtagacaacacctgtccagcctctaacaaagcaaccccaagagtccaagttatactaccagagtcaattatcacctggttatctttgatctgcagcccctctctcagaagtgatgtaatataaggagccctgaaacaatactgttctataaaaggttgtggtggaacactactctttgcaaccttccatgttttttcacaaaattcctggcctctatttagaacatcaatgagagtggcatcggcagtcaaattgaaaaatttaaaaaccacatagaaaccagacatagcataaaactgcccatgtggttgcggaaaggtactaggaagagcacaaggtttagtgttgcagtcaactgagcttgcattggaccactcagaaagattcactgttaattttgcaagggcactacattcgttccactgaggcatcccgatcagttcaactgccattccctgcttctctttgcctgttgtcttccctccaacactgggacttccatctagtttgagcgggtggcagtaagaacaaatataatcttctttgtatcccgtttgtagacaaggatgcttaacctgaacttttccattaccagctgcccctcccaacttcttcacaagatgtgcaacagatttgtcaaatgcatcatttagcccataaccagacagagaataagcactaagttgatgactgatagaaccaatccttagactcatacttgtttcatcctgaatggaattatcagtctcaaatgtcacctgtaatgatgatccacctaaatcaagtgaaccatatgtcattttagaagatgaggtgccaagcatattcaaatgatggttaagagctatccatccataataagcttcatccatgccactgataatcttgactctgtctctagaacacagaaacgatgaattcttcagaatatcccaagccttgtccagaagccactcagaatctgcactcggtagcttgcgcacaccagctgtggcatatagaaaagcaggcgtgtgtttgtgtgcacgtctaggaatcaacttctcagccattcgaaggaggggctctattgtcatctttaatccagtttcattgtgaacaagtttgttcaacccaggttcagtctccattcgctgataggctcgcccagttaatttaccagattttttcttaggagcatttcctaagggtttcaaagcaataggaaatgtgtttccatcgtcatggttaacagaccattcgtaaacatacactcttgtcccagtgcttccacaatcaagaataacatagtattcagggcttccttccgagagaaagacatggaaatatctcaaagaagcatatataaagaacaccaaaaggaacagagcaatagcacaaccagcagctctcatgcatttctttcgatttgttggtgatgaggggggtgttttctcttttgaaaagcttgcaacagcgccatctctttgaagtgtgcggataggttttgcacgccctgagaccaaatcactaccagtgctagagcccctttctaatgcatcaattcttgagaacgtaggcaaatcttgaagtgaagaagacagccgcatagttgcttctttgtagtcagggtggcaattattataagatctcactggtaagggcaaataagcagttggaatcttggcaaacagaagtcataaggatgcagcataaataaccagagtaaattaattcaatagcgcctttgcaccgcctctgcctgcaagaaaattccatagttagaatatactaacgtggtaaaccacatatgaataaagctaaaatttgaaagatgctccgcactaactaacaacactctcgttatcaggcataagaaaaactttcctacaacaccaatgcaacactagcattgaagaaaatagatgcatcctaaattcctaatcttaggaaatatattaacactatataaatatcagtaatatctgcaaatcaactcacatgctaaaccaggttttccctaaatcctgatactaactcagtgcccccacgttaaactgctagtattcatatgcatcatcccaccgacactacaacagaaacaggtcaccaccgacgacgaactcccggctacacactaccacccataggcaaaaactcaaggatcgcagcaacgcgcccgcccccaaacacgccagcttcccctcgattccagcacccaggatcgcgtcctccaccacaccaaaccgcccgatcccagccaccgacccccgaacaacctaagatctaatcgcagattgccgacacgcgaccacagaaacccggcatcgaagctgccggattggatctggccgggaaggggggggggggacaccgacgacttacccgtcgcggcgggccggtctatgcctccatcgccgcccaccccccggcggcgcggggccagcggcggcgaggattgggagcacccgcgcggcgcggtggggcggaacaattggggcgaggcggcgatgtgggcgggggcggtgcccgcaacggcggcgcgtcgacgaaggaccgggcggtgtggggcagcgtggggtcggcgcggacggaggttgtgggggcgtcgtggcggatggaggtggtggtgacgacgtcttggaggcggcggcagctgagtggaggcgggcgacggatcggggatccgcagtaccggcggcggcggcgcggatgagattagggttaggggagggagggagcaagggtgagagggctgggtgatgaaggggcgatcgacggagggaggaatctgcggcggaggggaggagaccggcggcgaatcggggcaaggagggcggatttggggggcgacggtgcgggcgcgggttgggggatgaggacgcgcgggtgttgggggagaggtggagatgatctcgatcgttccatttttcacggccgtcgactgctgaatgtaagagcttaggagtgaaggattagctgggtccaagttcacagttccgacgaaaatcggttgaatttcagaaaccgtatgagatttcaatgagtttcattaaaatttaaatttgaattgataaaaaaaatcaaattaaatcttataaatagtatgatattcgtagaacctattgggatataaattttcaaaaaaattgatgtattccatgtatttactgaaatttacactagaaaagaaaagaaaaaataacgaattagaaaaagggaaaaaatcagtttacctctttttctagttatcgattgaaatctcgatgatttcgctcggaatttcgccaaagccgactggttttcgcgagcttatcggtaaactcaaggaatttgtattcaaattttggtttatgaaatttgtttggtatctaccagatttcgtgaaaatcgttattccgccagagctcgaaacgaaaggccatcttggaatcgtaaaccctggccagtgaattatagggtagatagataaatggaagtagtattttgctatacttgtggcatgcacgacgaggatagttggtaggcctaccctcgatggatttgcatgcgaccgcgcttgttgttcggtcgagagatacggcaactggcatgagggaaatatattggttgatgaggaaactgttttacgcgagagttgtctacgccaactcgctttgctggcggaaaagctatcacgtgaacgttcgtggaaattggttcacgcgaacgccccttttccggatcgtttctgtatactaactgattagatcgctgtaatttcagatcaccaactaattagatttggagatatacaacatggaccttgtgggctatagtagtttaaattgacatctttatcttatttttacttttttttgtttcttttgtgaaattattttttattctagtttgttatttattttgtgatcacaaaatatgtattcatttttaaaacataacacaacagcaaaatttatctttgaatatttttttcactattatttagagaaggaattttaaatcatatataaactttacatgtgtaaagtttacatataaaatgttactgaaaattactatgtataaagttagtatatgtaaactttatacgaataaagttacatgtataaaatagaattgtttatgttagattttagtcaaaatgagaaaagaaaaggcccggatatgatttagctaactagtgggcccgtgaagattttgcatatgcataggctaagttgtgggctggagcaacttgtgagcaagagcagacacaagttcgctcgacgcgaacagtcgcgtactagactcacccctttgctggcgcacatgccacacggctggcatgtccgtgccctcacgagttttcttttctttcatcaatttttttgccaatttttttgttatttttttattttagaaattgaatctttcatctctaattctagttgaaagtttttgaatttgagttgaacgtttcgaattttgagatcaaagtttttaaatttgagttgaacgttttgaattttgtgacgaaagtttccaaatcttagtttattgttttcaaatattgacttgatttttttttccaaatctgagtttaaagctttaaaatcttggttaacagttttgaaatttgagttgaaaatttcaaatatatagtagaaaaggtttgaattatttacttaaaagtttttaaatctaagttgaaagtatcaaatattaattgaaaagtattcaaatcttgacttggcagtttttaaatttgagttgaaagttttcaatgaaagaaaagaaatgagtttggattaagtgtgcgctacttaatttgttagcgcatatgcgtaaagtaggaaaccactcaaaggaatgttgttctcgttcatctaaaaccatccaaatagttatattttttataaaaaaatgacaacatttataccatgaaattttgtgtccaaacttaactcactctaaataaattcagcaaatgaatagtatagtggtactatatttatacccaaatttatttcctgatttgtaggttgaatttaaacttgatttttgttggagtgctagatgtcactaaactttacattgttaatttttttaaaatcttttataactatttatattgaattttcaagaaaaatgtacgcgagggaacatcgtatcgagggattagaacccactttcctggctgatgaattcggccatgcattaatacagagcagcaatcatgtctattactcatttttataatatcaattctaccgaatgcatatttctatcagtaaaataatatggaacacctcaaattaatacatacgtacatagatgagactccccaaaccagggaaatctcttggaacaacttcggtaagattgtgaggacctactcagacctaccattattttcagaagaatactctctttgagttgtaagaaactattagatattaggattaattgaattgatgtcattgtaaattcatgttattgaaaaaaaaaactattactattcaggatacctgttacgtgctactagaattttataaaattaaaaccatgccatcttcgtcattatatatatatatatatatatatatatatatatatatatatatatatatatatatatatatataccaaaatacccatgcatgtgggacccacacgtcagttccattttaatttcttcctccaccctcccctcttcttgctttccatctctgtccacctctccctcggtaataagagaggcagtggcgggcaagccatgggtgtgcggcggcacaagcaacgagagagcgaggcagcggtgaccttgtcggtgagggaggtggaggctgcaaaagcagcatctttaaggcaggagccctcgagtgaatgattgatgtgagaatttgtagctgctaattaatatggaaatttttaacctttataccttttaaattaatgtggggacttctatagtggactctaatttaatatattttacgcaaggactacaattaataatatatatatatatatatataaagatataaacatttacacgtagctccttgtttctcaaatattttatcttgatcacaatgggatgtctgatcttctgccaggtaaagattaggcggagaaggctaatctccttgtttctcaaacacctcatcgagatggctaatccctacatgcgaatcacaaaacacaaacaagaacaaaggtagattacaattcaatttgcatatgaatggttaagatctcaaagttggggtttcacaaaccgaactagcagcgaaaatgcaatgacagaaataatctaagtaaaaccctactctaaactataactgctactaaattaatatgattaggaacattctatagttagtcttagggcgtccacaccttgggcttagcccatgacacaattataaggcccaaagcacaaattagactcgggctgcatatggtatgtggcttttttctgcagattcccgacaacttaagagaatttttgatgtgtgaccaaaaccatctgaaagtagactccatacgctttccaacaagtactgatgggagctgagattccttctggatcagcagctatgtccatttgatgttgatgctgttaggagggtcgattccgaataaaaagcgtgtagaatttcatcacttactttctatggaccaaaagtgacatggtgacataggagtagatttggagaaggatattggtgtgataattccagaagcattgaactctttatctctggctgtacctttgttatatattggtagaaacagcctctaccgcatgccccgttatacatcgaataagaaaaggaaacaaactagagaaatatccaagcttatcatctattatcacatgtgaatagtgctactttaatttctacaatataattggttagtccacagcactactacataatacccttttggtgctggttgggaaaccccccttaggtgtcggttttccgaaccggcactagggaggcagcactattgattccaagtgattggtaacggtttcaaaaccggcacctttgaggcgcttgtgagccaaaaaaaaaaaaagctcgatgcatcgagcgcatccaccccccacgttgcccccataatctcaaatccacaacatcaatgaatcaaccaacatcatcacaacgaataaaccaacatcatcatagaaattacagactataaactcccgaatcaaccaatatcaatcacagacatcacacaacaaacattgaaagaacaatcaactccaccactgctcaccgtcgctgtctaccagatccgccaccgctgccaccgtcaccccgaggatccgccgccgccgggccgccatcaggccacaattgcctcccctcccacagttgggccgccgggaagtaggggccgtcgcatccgggaagtaggcgctgtcgcctgaacaccattcgccaccacctcgcgcgcctcccctcccgcaggatctggtggaggggagggcgcgcaggcccctcctagcccctgcgaggccggtgctgccttcgccgcccttccttctgccggatctgtcggagggagggcgcctccaggcagccgccgctcctcccgccgcgcgccgctgacaccgtcgatgccgccgcacgccgctcctctagtcgccgcctccgatgaaagagaagagagggtgctcaagagagaggggaaagagcgcagagagaacgagagagatcgagaggagacgagagagtttgagcgagcgagcggacgctgcggaccttatctcctcgacgcgttgtggtggggcctgtcggctcatcgccggtttttaatattaaaggttctgattctaaataaaaaccgatacctataattacttaaggtgcctggtttttgcgatttcaacccgcggaggtgggaaaaggcctataagtgctggttttagcacttccatcacctatagcgctcacatctgtttgatgttttgtagtagtacatgtaacttcattgatcatgcaagcacttcgtatgcacgctcccctttctttcacccatacaaatatttctgcaaacaataagataaaaaaactcatgaaatacttacataataagcatgcacctttgattgatgaatataaaagataggcatggttatatccgagttagcgatgttctcatcacatcttgtgatgttaaaaactgaaaataatagcgtagccatgacagagttagccgcaacatttttttttgccactaaactgtgaaatcgtatgtgatttgaaataaacagaaaaagaaaatatttgtagacttatccgtgaaatcataagtgactggaaaaacaaaacaacaaaaattaggagatattttcagaaaaagtgtaaacaggagatatttccagggaaaaaaactaaactataaaattgattttcagaaagaatgtaaacaggagatatttccagggaaaaagaaaaaaatgtaaacaggagatatttccagggaaaaaaaactaaactataaaaattaaattttaaatgtatcagagccaggtttcgatcctgggacctgtgggttatgggcccaccacgcttccgctgcgccactctgatattgttgtccagagttaatctctcattcttattatcgcgttttcttgcactatccttgatctaccctgcatgaaaacggttcggaatgtttctccataccggacgtttttggaaacggaaagtatcagttggaaatatttccgaaacttttgaaaacggaaatgaattcaatttttttctcaaaaaatggaaacaaggtaaggctactatctgtgagaaacgaaatcggaatttttttggaaaacaaattctcagatttttttttctgggaatcggaaacaaagtacgtatttctcatgtacaactgattagcttcaatcttctttgctctactagtcgagtgcccgtgcgttgcaacggatcttaaatagaaaatataatatggtttaacttgaaaatatataaatgtgtgtctgcgttgttgtaaaatagaaagctatattatatttaaataaaaaatagttattcgatccgatgtctcccagatggtgtcattcaataatcgaaagatacaaagtccaaaggaacaaatatgccatggttgtacagactcataggtcatctttgggaccaattatagtatagacaacttatgattactctaatgtgattatcattatataaaaattggatgataataaacggataaaagatgttaacagttgatgaaaatttgcaagccaagattaaacttgaatatatagagctccatccattttaaaatatatgtgtttattttgtttccctttttaatgtaagcattcttgccaaaattgcaggctgtactcaaaatagtgagatctggtgatcagataaaactttctaaatcaccactcaaagtctgaacctatattggtaacagttcatatgcaggatggaaatacataaacacatgaggagctttctcttttgttttcccgtttgtcactccatttcttttacataacaaagatggaggaaatttcaagcataagtactaatcactctttatttctgataatgaatcactgcatcagtaaaacttgataactcatgtacattgaaaaaatgtgtcgataaggatattctcgctgttttagcattgcagataaagcagaggaagattcaacagagtttcagcctacttgtgcgggtaatatgcatgttttgcaatatttttttctttcaaaggaatatttcttttagaacaacaatagtagtgcagcatgtgcatatttttctcaagtttctagtttgcataataatatcagttatcaatgttgataattcaaaaccacaaacaaaactatatattaatgccgtacggccacgctcgacacctcaacctctaggtcctgaaaagtacaaaatgttcaggttttttttttcaaagaacacaaaaatgttcgggttctagatcaatccctcaccggcgagctcgaggtgctgcggtactggatcgaccgcctcgccgtcgtcagcatgcattgtaccattggaataactaccacccatgcggcagagcattatattagatacttcagagaaaagtattttctatagaagggaaatctataggtaagaatgaaggttttatttacaatccaattcagccacttgaatgttaccaacacacaagatgcctaaaaagcaagggcaatattatgatcagcaaacacgtcaaagatttaggggtgttggacgagttatttcttattttagcaaaatatgtctctaaatggaattatcgttatgttgaccattccaaaaaaaattacctacatttaacaatgactaaagcaaacttaacatttccattctaacattctgcgtcaattaaaaaattattgctatcaacctcaagccatggacacaacacttgtttgttataggatttgttgctattaacctcaattcagtctgcataatgattagtgttttggctatctaagagacagcggacacttgtacgttagaaatatcatgttaacccagagatgatttggtccaagataccattaaaccaattatagcagcaaggacgactgctgtggccgtgcccaaagatgcacaatactccatctctgcatacctttagcctgcaaagctgaattcgttgatgtcatggtttctatacaattaagcgcaattgggcaatttgtgttgttattgttccagtatcacgaaatacaaattagatgtaatctgaacttaccttttcttacatagccttgtgaagaaatcaatagcactgagcagagaggcagagcacgcagaaagcacaaagaggaggaaagagggattagatatggggaagacttgagaatagagaagaaatcgccatcagtaatggcgactcgtggaggtggcgacggaggagccagcgggatcgcgtgacgacgacctgtcggcgggatggactcgcgtggcaccaccgaggcggtcgcggcggcgcagggaaggagccggtagggttgcgacagaggagcagccaggatcgcgcgacgacgatgacctggcagcgggatcggcagccaccgcgggatgagcgtccgaccctgaccatgcggcgcctcctctctgttccactgcggcgcggcagcctatgcacggcggctatgccctaccccgccctcgcctcatccaccgccgcaactccgacacactgtcgggctcatgcctcaccggcacactgtcgggctcaggcctcgacccctcctcgtggcggaaccagacggggatgcggcagcgcgtcggagcgtcgctggagagagaagtgatgcgatggcgttggaggtggttgcgagggagcggagatgcggagatagtgaccgagagaagggggaggatgcgtgcgccgcgtggatcgggcctgcggcggcatgcggagaaagagaaactcgatctgaatcgttggatatcacaatcgtacgggtaatattccgcatgtctgttaagggtggagtcaccaccatcactacgaaatttttaagtagttgagaaatgttcagatttaaactatgtattgaggttcttaattaaatggagatattttttttctagtctagtgattcagatttttattttgcctaatgactatttttatttttattaggccatgccatacatactaattacaattacagatgcatatagttgttctttttctccaagtgaagtgtacaattagttgtaaaaattagaaaggtgatttattgttttagaaaaagtattgaggtacaactcttcgtggattcgagaatttcagtttgaaaaggttttatattctaataaatatttaccctatacgctttgttttttaattcaataatatttgatacctttttatatccagaatttccaattccgattcaaaaaaattaaatttatgtggtttgcctagaaaaaaaaaactacttgagacccaaaccaccaaacgcgtgagtgaaatcctgaacaacttcaccgagaaaaaaaagagtgatttgcttcgaagtggaccattttataaattaggaatgattccatctacctcttcctcccaaaataaattaaattttcgtatattaatttaaacatagatatatctaaaatcttataaaaagataatttattttaaaatgaagagagtagctacgagtaattgcttccaaatcttctctaccaagctcgagcctccttccccaaaccttaccaaaagggaaacaactccatcgatcaatccacctcgaaaatgcacatccatcccttccattctatattaacgtttcaatgtacttccttcgtttaaatatatattaacttttagtgtttanaatttattgtaaagtatacttgatcaatcgtatatttccatcatttaatttctttatcacctacttcctattccttaaccaatcataatatttctttacctattttttttaaataatcatgttcaactccaaatctattttatgacggaggcagtataatttaatgaacggcttcatgcccctcgctgctacttctccctacatggtggcttatgccttctcctaaccaatcgtagcctccattgccatattattcctcctacctaaagactctgtttgagagagtttctggctactgcagtttttcccagaatcagaagctccctcaaacaacagtacagtttggtagttatgctaagccagggaaaaagaactttttgggggacatcatgttaatctcttgctgttttggccctccatggagtctaaccattgggattgtttaggcccattttttgaccatctatttgctgatgaaggaatcaggcatcgagccattggtagatatagttgtttgttactacttgtcatgttatctgccgctatgagtaggcacaaatatagcatgttttgtagaatcgtggtgcatcaacgaatttgttttgcacaatcatctgtgatttctaaattgtgtttacgcatcattttgactctcgaaatcagcattatttgtttttacctttttctttataatcaatacatgattcgttctccttttttgtgctaattatctggtagtttgttactgctccctgaaagtttccacgtttgtgctaccttagtgaacaaggatggaattcgcaattggtttggcttcaaagcgagcttaacacatttgtaggtgtttatggtacgctgcagcagtttgaagggactcgaaacgtttaatgcagtgcagccatattttttcctttcatgattagccattttctcatcagaggtagatcagtaaatgtatgcatactggtgaccattcagaaaacgaccacaggcagagaaccccattccaatagcaattgccattggtgtgtgacatgtaaatgtggggaaactgttttaaacactcgggtggacgtccacccgtttcttgca

SEQ ID NO: 71999 - DNA, 4696 bp, Oryza sativa
tcttgttgtagtgatttaatgtggtaacataaattctcaattttttttatttttgctatcacatccacctcgtaattctagatctagatctagatcttgtcatatatagagagagaataaaatttttaatatctatttattcggtgcaatcaaaaaatagttatagtagtttgtaatatgccgatgatatgattttgttagattttcctaatgtactaatttggcaagtctgtgtaaaaaaaattgaaataaactttgtttttttattaatttacaattaacctttagttaattagttttgaatagcgataagttttttcagtaaaccctacaaatttggtattaattgtgcaaaattttatgtgcatttttttagagatatggaaagtcgggaatggatgtatcattggccgaggtttttgtctccatatagaaacgaagtgtctaaatttattgttattgccaaggcacacgctgaaaagaacaatatgaggaagataatttgtgaatgtgctgactgtaagaatgaaatagcctgggacttcaacgatgcttttaaagtaaaggagcacttagtaactcgtggatttatggacgagtacaaaatatggacacgtcatggcgaagaacaagtggacgggcctgaaaatgtagttccgacacaagttgaagacatggtgcgtgacgatggttctgttgaggacaaaatcgacctacaggaaatgttacgtcatgcagaacccgaggtgctgatggggtcggctagagggttaaataactttgaagctttacggaaggtagcaaagaaatttttgtacaatgagtcgaagggctgtgacagtgagttcacaacactacggtaagttctcgaacttatgaggttgaaggcgatacatggatggtctgatactagtttcgacagtctgttataacttctgtagaaaatgctcccgaggcctaactcactaccatccagcacatatcaagcaaagaaactcatatgtcccctttcacttggtgtggaaaagattcatgtgtgcgtaaatcactgcatactgtacaggaaagagtacgcttctttagatgaatgtccaacatgtggtgctagccggtacaaatcgaatagcaataatggcctagaaccgtctgatacaactgagggacgacagagaaaaatcccgcagcttgtgatgtggtaccttcctgtcaaagaccacattaaacggatatactcaaacccgcgagatgcggaactaatgcgctggcatgaagaagggcgcaagaaggatgggatgattcgacacccgacagatgctcgtcagtggataaactttgatgctcagtatagagagtttgctaaagacccacggaacattagatttgccctgagtactgatggagttaatccttttggagacatgagcagctcacatagtacttggccagtgcttctcaccatgtataatcttcctacctggctttgtcaaaagcgaaaatacgtactactctgtatcctcatacagggaccccgtcagcctggtattgatattaacgtatttcttgaaccattgttggaagatatggctgatttatggaaagagggattgaaagtgtgagatgagtacttaagggaatacttcacagtgaaggccatcatcttcgtgaccattaacgattatccagtaatgttttcagtttcaggtcaaattaaaggtaaaacaggatgtgtaatctacttgaatggaacgtactataggtatctcccgggttccaacaagcttgtgtacatgcggcaccggcggttcctacgcacaaatcacaagtaccacaagatgaaggcggagttcgatggcactgaagagactaatcctgcaccaaaacctacatcgggagaaaaggtgtgtgcaatgacagaaaattgtttgcgagtttggaaaaatgactaagaaaccatcaaagggaacaaagcgcaagaaacccgaaaagaatatgaaacaaggggatagtaagaagcaagatgatagttcgaagccagatgataaactccctcccccattcaagaagcattccatattttttaagtacctcccatactggaaagatctggaagttcggcatgccatagacgtcatgcatctagagaagaatgtgtttgacaacataattagaacattgttggacatgccaaagaagactaaagatggtctgcaatcaaggatggacctagtcgagatgggaatcagggaagagttacaccctcaaggagagaagaatgacaaagtatatcttccaccagcctgtttcacactgacacctgaggagaagaagtcattttgcaactcactccgtgatgtcagagtcagtcgactagtttccatgaaagatttgtcggtatctggttataattcacacgactgtcatgtcttgctcactgtgtttcttgaaattgcaataagggccataaaaccggagcatttaaaggttactatcacaaggttgtgctactttttcaacgcagtgttgcagaaggtcattagtctcgaagagttaggaaatctccgtacattcgcacatgagacacagtgccaacttgagatgtgtttccctccgtcattttttgatatgatggagcacctcattgttcacatagtgccgcagatggttgcgcttggcccattgtacctccatcaaatgtggtcatacgagcgttacatggcggttttgaagggttacgtccgaaatcgtgcacatccagagggatcaatggttgagggttatagtactgaagaggttgtcgagtgctgtattgattaccttaaagatggatatgcaattggagtacctgtgccccgacatgagggcagattgagtggcaggggaacgataggaaagaagagattcgtcacccatggtcacaaatcattccaagaagctcacttcagcgtgcttcatcagtttgctatcgttgagccgtacatcgatcaacatatcgaacaaatacgagctaacaataagggtcgcaccaccgagtggataatgaaagaacacaagcgtctcttcatagattggttgcgagacctagatttacctgagggacaaactaccgatgaaataactatgaagcggttggcttgtggtccatcaactacagtaaattcttggtagggatatgacattaatggatactcgtttagtacaagagcccgagataataagacctgtacacaaaacagcggtgtccgtgtggaggcaattgatgaagccggggaaaaacaatcatacttcgggtttattgaagaaatatggtaaatcgactatgggcatacaatgcaattccccatatttaagtgccagtgggtaaaatacccgaacggggtcaatgttaataagttcggtcttactgttgttgacctggcgagtgtgggtcacaaggatgacccttgggtactcgccaatcgcgtggcacaagtgttttatgtgaaagacccatcaaatttgaagaaagatatagtgctacccgggaaacaaaagatattgggagtggatggggttgaagatgtcgtagattacaatcaataagatagtatgccactttatagtcagtttgtacagaagattaagaatgtcgagacatctactcagaagaccgtgaagccttacatgcgcatggacggtgtggggaaaaatgttaaagggtaatgattgttgagtcgcatgtaagcatctaagaagttagtagttatgtaatggtggtatgttaggtgatgtgtgatcatatcgcaaattgacgaacaattgtactcaacattttgcatattagtttgtactaatttttatacaattgcactcaacattttgcatattagtttgtactaatttttatgtgcaattaccatttgtagggtaacatttacagttttttattttttaaaagtttttttaaaagaggtttaaaattttagtagcattttgttatgttcacttaccattatttgaaaacttattttaaaaagatttcaatcaatggtaagtgcacatataaaattgctactatatgttttttaaagtagtaatattaatgtttgaaacatttaagtaatatttacatttgaaaagtagtaatactaaggtttatctacttgtatgtacaattaccttttttattacaactactgtagacatgttcaaatcacaaaaataattttaaaataattctgaaataaatagagtcatccttgtaaaaatcttcgcaggcggaccgtccgcctgcgaagatcctttccctatataagggcaagcccgcggcgccaaaatttctaagtccaggcgggaaccctagaaattttggcgccgtcaggctgccaaattttttcacctccgccgtccttcgccgccacccgcctgcgaccttcaccatccgaccgtcgtcctccgacgccgccgaccgtcgtcctctgcgcgccgcctgccttcgagctcgcgccggctgcacgctacaccgcgccaccggccgtcgatccagctccaccgccgcccgctcccgtagccggccgcatcgccaccgcctaccgctccaccgccgagctccaccgaccgccgctccaccgctccaccaccgccactgccgtccaccgcgcgcgcgcgagctagcgctccaccgccggcaccgtccatcgccgccggccacttccccccc

SEQ ID NO: 72000 - DNA, 1791 bp, Oryza sativa
atgttttctattcggttctcagttacattaacttcactagtgactgatttgtgaatagtcagccaaagtaatccttgactctgctacttggtcagcttgaaaccaggacgaacgatgtccttaattgtagtttaaagctaactgtttagttgtatcttgcttaatggtgcagcattacttatatatattctattttgcagatatccgatgcgattgagaatgagaaggaggtttccaagacatttcaaatttacaatgttgacagggctgtctgtggtcgagtagcaggtgtcattgccaagaagtatggtgacacaggatttgcaggccagctcaacattacgtatgttaaccgttttctttttttttttaattcgatttctcttatgaaaaggtaggaacataatgattttttgcccttcaggtttactggaagcgcagggcagtcctttggatgtttcctaactcctggaatgaatattcggctagttggagaggccaacgattatgtgggaaaggtatctaatgcaaacaggcatgcagcgctattgaaaattgtgcctgaccagatttataataccttttctttttttaaaaaaaatgcagggtatggctggtggagagctggttgtagttcctgtagaaaaaacaggatttgttcctgaggatgctgctatagttggtaacacttgtctgtatggagctactggtggtcaggtatttgtgagaggcaaaacaggtgaaagatttgcagttagaaactcccttggtcaagcagtggttgagggcactggagatcattgctgcgagtacatgactggtggctgtgtagttgtacttggcaagtaagtaccacatgcaggattctcatattgagaatcgccttcttttgtcctgatatatggatatttctcaatcgacagagttgggaggaatgttgcagctggaatgacgggtggccttgcctatattctagatgaggatgatacactcgtcccaaaggtttcataaccttgaaacttctggttttactagcttgataacatgcacgtatatacgccagttaggacttgttctttttaatatcattttccatatttctgtctagttgcatgctcggcttaggacaacctcagactaacatgttttacatgattctacgtcgtcaggccttttatctaaaaaaacatgattctacgcaagtacagggaatgatgattagaaaggcctacatgttctgatataatattacaatcttatcatctctaataactttcgttgcctatttcatcactttgcatgagtaaattgttcatgtatgaaggtcattgtcaaggtaaagaattgacaattagttgtgtttccttaggttaacaaggagattgtgaagatgcagagagtgaatgctccagccgggcagatgcagctgaagggcttgattgaggcttacgttgtaagtgaagttcacttcggaaagtttagcaccgactactcgttcatttcccatttcgctaacactgaacgttgcttttacaggaaaaaacaggcagcgagaaaggtgccacgattttgagagaatgggaggcatatctgccactcttctggcaactggtaccaccaagtgaagaagactctcctgaagcttgtgccgagtttgaacgagtacttgccaagcaagcaacaacagtacaatcggcgaagtgatctactgcaattcccaagtgatcagattagacaacaggaaggtgttctttggtactttccaggtgattttttcctgggaccgcatca

SEQ ID NO: 72001 - DNA, 1577 bp, Oryza sativa
cacccaaaagaggctgccgcatgcaacaacaaaacaaaaacaaatggaagacgaacaggaaagggatatacattcattctcactagcagcttctacgaaagaaaacgagaggattctttaccaagaatatacaaacagaatgtcgcaaaaaaaaagaagtctcctcctaccttggactgttccaaggtgacgaagacttgtatgggaaaccatgattagctgatccatttcctaaatccaggctgtggagttgctccattaattgtgaccgccgttctttgaagaaatctagcctggtcgtcagttcgaccagagtggacgatgccacgggagcttgcctcccgtactcgacgccctgtgatagtgatacaagagaattgaatactcgtattgaatgagaagcggtgtggtctttatttcgacactaccgcacccttcagttcggaagcagtggtttttcctttacctcggttgccttcgggatgttcacggacatggaattgccatccgctggcatgctcgttgatgcctccctcgaatcactcgacgaggcgtccatggagtgcttccgggagaagggccttgaagaaccatgaggtagcacgtgctgcttgatgcttctccaatgcgatgcacctgcggggccctgctgtcacacagaacgttgttgtgccatcagtggacgaaatgggatttttttacattgcaagtagacaattactcatcggtgcctttgcttttctataaacctgcaggcccataagacgctgagaactagaggtgcaacgagagaaggctagtgggcgaacgtcccccttaagtggttgtttgacccacctgacctggatggctttgggggtataaattggtggttgggcccatagtcacaaagttcctgggtcaatgggatcgaggaacgggatcgaggaacgtgatacgctacttgcgagaggtttttacaaggtggggacgaaaatgaccccgtgttttcgggacagggacggcgttcccgggtcgaggatcgctgccaccgccgtttcctgtgactatggttgggccaaacaattgtgatgcatggatattaaattttggcataatctactaggagtttgtatcattcgagctatacctagcaattgaaacattggatgagcacagtcaaccatatggaaaggttggaaatatagcacaaaaaataattggggcattttacaccttaagcacaccataatgatagcgcaatgagaaaatgagctaacatcagctaattggttggttctgtattttccaacttctgttgtcgtaaatttaagcatagaagattaagggaaaatctttagctaacctcattcctttgcttcttctcctgattacagaaagcaaggttcatatcaaaacctgattgaacaaagttcctgttggcaacaaaatattcgcatagttaatgtattgcaatttcaaaggacaactagagtatatataacacattgaactgttaaacatatatggtttgagcagatatagtaagccagcagttgacagcagaaacatcatgtttttgttactaaaatgtgtag

SEQ ID NO: 72002 - DNA, 999 bp, Oryza sativa
tcttcaactctatccttttacatgaaacaatcatttaaacacgaaaatggaatggggacttactcttcttcacccgatgaatcagccaattctgactgttgactttttcttccctgcataaaccgaatgtgtaaatcacttgaaacaactttatacactgatagtgtcctaaggagtgcatatctcctaatgttttcccagaggaaaccataatgttctttaaagaatatcacagaaccataagtcagtggtcacaattctacttcccttcaagtaacatgaactttctgaggagatacagtaaaggacaaaagttctcacttacattgttccgtccccaaaagttggagcgcttcacatgcatctgagttccattggatttgatggactgcctgtctacagaatattcaggtccaggaccaggtaaggaaattccagcatccaaagaagaaagaatatctcccatcgacaacggggaatcctgactggacaccatatttggtggatctttttcattcggtgatctctggacattcactgaaacattttcagctaaatgactatgctgggcatcatttacatccacctttgtttccaaagccttatcttctgtagaaggttcaccgtctgaatcatcatcagctacctgtcgttcatgttgcaatgagaacaaaagcataagccacatcatgatttttgacagatgaacttgctaatcaaataaaaattaaaagccaagttggtttctgattaagctactcagaatgcttcatatcatgaaccaccaaaaatatgtaaggataggcgcgataagattatgctactatatagtgaaaagaactactgcatgtgcaaagggaagaaaaaaaacttctcatcagtggaattggaatcttaaacctttttccgtgtatatatgattgacttgaaaatattcgaactgtatatatgattgtattagatcaaacttactaccgattaaaaattttaagactgcaa

SEQ ID NO: 72003 - DNA, 7818 bp, Oryza sativa
agttcaagcagctctaccaccaagatcacttccactgaagctgccatccattttcatacatacaattgacagcacacaagtagagtgcccaactgcattttgcatggtgtgacagcctgatctttctttggacagtttaaagttcatctacacctggaggcagaggtttcttgagcttcaacacattttcagctatctagcctgtcttcttgaaatgctttgtatataaaatctttaaaacgtctagagtactgccttgggtccaccgctgatattgaggttgggtcatactggaaagatttgtatgcatgctcgagctttttgctgatatcataatcttgaagtatgtctattatcccaaaatataatatagcatcataatactccccagttggctctccaataagctgtggttccaaatcattcttccgagcagtcagttcagctcttgcaggcatgtttgctccgagcttgattttaggccacctgttcattcataatattcagatgtaagtcacaggaaatagtgaaaagcaaactggaagtgtattttcatgggaaataattattaattctatgagtatctgtagccctatcttggttatgtggttatttaccaccttctgtccaactagttgatagtacatataaccacatcgcaaacagctagcaggcaaattatggaaaggaaggaactgctaaggtcctatgcaaaacaatgccctagagtagccatgaaccaagtggacacattccagattttgaatttttttttattagatagtgattccagattttgaataggtcatatgagaatgattacatggttttatatttaatagataatgtctttattaggtcaattgcttcttcagaaagaagcatgaatatcacgcaatatgtgatgatttgctggtgtgattgtgaagctagcccgtcacgacataaggtcaagacaagcaaacatcacataagtatgaattttccatatataatattaggtcacatttcattaccacatttgtaaacgatacaacagatattaaatgtttggcttacctgtttggatcagtgagacactgatccacatttcctcttgaaagacgaggagtagatattttgttgatatcgtaatcggtggaaccttcaaccaaacaaaaggccttgtaagggataaaatgagcatgcccaagaactcaagttttattcatgacaaactttgcctgtttttaagtttttttttttttaaccaaccttcgctcagaagcttctctctattgcctctaaaatgtacacccaccagaagactgtaatccatgatcttctcctgctcaaggaaatcgcaatccctgtccacttgcctgcttcaacacatttaattctatattaatgttttgaaggaaaaaaaatgattacatgcccaaaactagagtatgagacaatatgtttttgcacctttggaactcatggaaccattgcttcttcagtctaaatatgaaattcagatcaagatccttcagagttgtatactgatcaatctcagtttgtggcttgtcagttgttcggccaagagacgagccttttagatcaaaacgcctatggatggaatgatcagagcagaacagatttcccatgatgacaaagcgaacctgggcggtaatataatggtaaagagtcagggaacacatccgacaatgtatacgacaaagaaagcgctaaggatggatatgaaatactgaaatatacagtgagattcgtctctaacctttttctggtttgccccagctaatttaacacaatgtagaccaaaaaatttggtaactagagtgttctcgaatgaacggacatgattatagtaagcaggaagcatcttaagcagcatctgtaatgtaaacaaattttttttccttaattcagaataagcttaggaagattggaaaatggaaagcctagatagtcagcggatcacaaggacaaacctttacttccgatttcttcattgtctttatcatgtatcgatcatcatttgtaaggtaaaagaagcttccacttttaccaggagaagagagctcacgcagagcctcacttccacaaagggataacatataatcagcagcatccaccttgaacaacttgcgcagcgtcctttgattcagttcagaacaaatgttgatcagcattatgacaccagaacaagggtaaagcatacaattttaacatgggagtgatgaccaaccggaacacctgagggcagtaatccttccatttgaaatcacaagaattgtgcggaggggtgtattttgagccttctggagggaactttgtccatactttttcctttgggtcaaaagccgaggatttcagatcaagcgtaactggaccttgcttcccgactgcatgcctgtgccaacaagccatcgatacacacatggatttaatcatgggaaaaagttgataaaaatatgatctataggctagcgtggagttcaatcgatttcgagccataaaggaaaatgccatcttaatgctggaaaatataacatacactgcaaatcataatctgattaacaacccaagaatatcacaaagcaaaaattttatcgaattacttataaatattccccaattaaaagcaatcgcaaaacaaaatttcacatcattcataacatacaggggcaaaaaggaggagctcacgcacctgatcccgagctgcaagttgagcatgagctcgtaattcttgtgacccttggcgatggtctcgccctgccgcttcgcctcccgcggtggcacccacttggcgatgcgcggcgccggcgacggcggcgcgaggaccagcccatcaccggcggcggccgccttgatgctcctcctggggcccaccgcctcgtcggccaacgcggcgccgtcgacaatgtcgcaggtgatgtccccgtcggactcccaaatgcaaatcttgtcgacttcctgtcgccgccggagctgttgctcagccccgacgcggagctcgaccgcgcattgcccgccgccgccgcggcgccgcctctgttgccggagtgattcagcgacctgtgcggcagagacgcggccggctcggcggctccgcccatgaagcccgggaggtccctcgcgaacacgtcgcgggggtcgcgcgccgtcggggaggacgccgccggggacgggtagtagacgcccttctgctggacaatgccggtggcggcgtcgcgcgtccagtagccgacgtagacgctgccgtcggcccatcggaaggtgccctgcccgcgggggcacccgtcctcccacccgccatcgtagcggttgccgttcgaccagacgagcgcgccgcggccatggatgaggcggccgcgccactgccccgtgtactcggtgccattgcgccagatgtagcggccggcgccgtcctggagcccggagcgccactcgccgtcgtagtggtcgccgttggcgtagctcttcttgccgtggccgtgcttgaggttcatggaccacgagccccggtacgtgtccccggcggcgccggtgtacgtcccggcgccgtccatgaacccgtccctgaactccccctcgtacgtggcgcccgacggccacgagaacctgcccctccccgtcgccttcccgtgccgccactcgccctcgtacatgcacccgtccgtccacagatacttcccggcgccgtgcggcgcgccgccgcgccactggcccgtgtagaagtcaccgttggggaggccgcgctcgacgtacccgccgtcgtcgccgccgccggccgtggacgccgacgacgaggacgccgtctcggggtcgtcggcggccagcatcggggacacgcggcgcctgctgcccccaggctgcggctgcggctgctgctgctgcaccaccttgcgcaccgtcgcctcccacgccctggcgcggatgtgctcgtgcatttgccgcgcccgcctgtcccggccacacccgtttcttgatatatccccacacctccggcgccgccgccgccggcgcccgagctccctgtggcgtggatctagcaccgccggaggccgcggtggctccacggcggcattgctggggggagagcgagctcgcgagatggggagtaatggcgagaggaagggatgcacgcaacgcaagcgaggaggaatggaagggggagaaggaaaaagggaaggaaagcaaagtgttttggggtggagaggttggggaagagagggagggaggatggaatgaaagcaagagggagggaggtggaaggggtgttttacctttaatttgtttttttttcttctttatcttttgatattttaacatgaattcatgaatgagttgatttttttaaggttatttatggatataaaatataaattatatatattaaagagtttaaaaaatattttagaaaaatattcgaacaatttttaatataaatttaggaagcgtgcaaacgaaaattaatccaaaatcgagaataaaagatagagaacatttgtgtcatactccagcattcctaggagaatatgatatttttggtttttttccttttattctttaggccggtcttttgtaaaacttttaaaggactccaatatttgtgaactattgaataaaccgataaaaaccaatagtacaatacagattactcctttccgaaaaaaaaaggggctggagatcggtagttgtgttggtggtttttagttgttggtggcagtgtttgtctaccaattaaagtgtcaaaaggctacagatttcggttctgctgttgtctccatgcttaattagcagtggtaagtacttaccaactaaacaatcgatcctcggcttaatttagggctctgtctgtttgtgagatggtgggctcctattctttctccgagcttgcacaacaccagatgtgagatatttaactatttacagcaccgctcttataaatgataattaaaaatttaccgttttatttatatgtcacagacacataaaaatcaagatgtctcatattacgagtggtaaatttttaattgtcacatcttaaaagtgataaatagttaaacgactcatttgtcatgtacatgcttatttaattattaaatgtatgattttcttaaaaaaatacttcaaaattgtattataataatttattttctagtttttaagctaaaatttaattaatcataccacctcgttttcgggaaaaaagtttccaacacttactatcaaacacacccaaaacagaagagtgaagagaagctatcagttcaaaactacaccatctcttctccaatttagcctctcgtggtctgagtgttgtcttaggcctggtttagttaccaactttttcttcaaacttttaactttttcatcgcatcaaaactctttctgagtgttgtcttagacctggtttagttcccaactttttcttcaaacttctaactttttcatcgcatcaaaactttcctacacacaaaattccaacttttccatcacatcgttccaatttcaatcaactttcaattgtaacgtgaactaaacacacccttactatcaatttagcctctcgtggtccgaatgttgtcttactatccataattaaaatttaaaattataattaagatttttagttgattttgctttgtttttatcatgatttatttttgagcattagctttttaacccgctaagatcacagtatttaaattttttacttactgcaatattgttattacttaggacacctgtgatgtagaaaaaaatatgggacacattgaaggttccaatcctatataggaacactaagaagcgcctttaaacaaatgatgaaatactatccttgaaaatcctatgaaatgcataatagagattttaaagacaagttagcaagagctctaactttttggaaattttctttggagtccatctcatcttaatcttacgtttttttgcggtctactcaaatgaccgttcatgtattttcatgtgttttgcaattctctattttgcatttatattttagttaaaattatgtgtttttcatatttctttttttttcaattcggtgtttctctattttgtttctttttcccacggtttatcggctgtagaccaaacatcaaagcattaattactaaccaatcggcctagccttcttaagctcttcctacctgtgtagcctccatttggtttgtgtttggtgtcttgtccctgttcctctgatacctgcaggaccatggattcagctgcaaatattcagtaacccttgtcatgatatatagcctggtcctaatcttttgacttgtaggtctacccagctgtttggttaaaaggctgctactaatgaccggcttctgatgttgctttatttagctaatccagcactaatgaagctgatcaatctcatagggagaagaaaagaaaggcgatacactaataaagcaggggtatttattagtcaggattcagagacaggaatcccaatcttccatgaaagcgaatcaatcgccttgttagttgttcttctgtcatgtaaggcatgtacctcctgtcctccagctttatcatttattttaaaaaatggagattagtatttttctttgagcttcttctgacttttggccagcacacctcatccaagatttgattttggagtataattttacaccaaacgtacagtgtgtactggtttttgttagaagagaagaagaagaaaaaagaggacccaacaaaacccagaaaatatggcacgttgtcacatttgacatcctcgttcgctttcccaagaaagttgcaataagattaccaaacaagtttgatttctttggtacaagtatcagtggtagcgtctctcttgactttatatctgtgttcatcagcagacaccatttctcatgcgtttttgctgattgctgacttgctgaaacggtgataccgaactctcaaaactgcaaattaattgttgcagctgatgaaagatgcttctctgatgatgcaatttcaactcaatttaccagcaactagctgctgcttggccctgggtctctatctctccaagacatcaacacaatgcatgccaaacttgtgcattggaggatcctcaggtctcctagtaattatcagtaccacagagccagcagtactgttgaaattaatttccatcagagatcacataaactaatggtgagatcgcattagtcgtgcgtccaaataagtggtcagatcttgatccatttcttaattaaagtctcgtccttgcctgcaggtaggtagcctaagcctggtctcagttctgagcaaaaaataaggtaggttgccagtggaaaaatatgcttgactggttctcttctccctgataattgataaactgaaccaccagttcttcccattcatccaacgaacaaaccgacagatagatatggctagcaattaacagaaaccaaggtccaagtgtgaggtcaacaatattgtccttgcattggctcacacacaaactgtaaagttgttattgttctgcttgtctttagaagggcagaagtgcagacactgtagctgtaatgcaatgttactcagaccaaacagggatcagttaagtgtacagccaaacacaaggtgaaaagcatatactatctccatcgtagtccgactatatgtatggacaaagccaaaacgaagtctatgtgggatggagagagcgagagagactaaaaaatgttcggtaacataaattatttaagcaattgactagagcatttttatactacatttcatcggttttgctgttcatttcagatatatattgatccaacaggttggagtaga

SEQ ID NO: 72004 - DNA, 1123 bp, Oryza sativa
ttgataattaatttttgaaatgtgtgtagtttaataacatatgaattatatattatgaaaatatttttatgatgaataaaaatataagtcttatcatgttaaactatatgagtttatagagattgatggtcaaatattaaaatatttgacctaaaggcctgtttggtaaagctctgacttctaaatttatttttaggagatgggtttaaagtggtgctgtggatcagtctaaacctaactccatcttctatttcattttgtgagaacgcttcactcaactctagtcctatttaagatgaagctggaactttttgattagacgctttagaataggtgaagttgaaactggacttacgctaaacatacctttatattctaacgtcccaatcgtccaatcgatcgtatctcaaaaaagcacgaaaaaaaacataaaaaagagcagaggcaaccgataaaaaaaaaggatgcgagataggtttgcgctgtactccctccatttcaaaatatttgacaccgttgactttttagtgcatgtttgaccattcgtcttattaaaaaatttaagcaattatttattcttttcatatcatttgattcattgttaaatatactttcatgtacacatatagtttacatatttcacaaaaaaaaatttaataagacgaatggtcaaatatgtgctaaaaagtctaacgatgtcaaacattttgaaacggagggagtatcttccaaatctggctcttttccaaggacgcaacacgtacgtacgagcccacgctcaccgcgccgcgcgcgccgcgacggcgaccgcggcgaggccaccactcgcacacgcgcgcgccgcggcgagcgctgacccccgccgtcgacgacccgaccgcgagtggagaacaccggcgagaaatcgccgtcaagctagctactttggctgggaaaggtgcaggtgcacgtgatttgctggtaatccgagacaaaaacccgcaccaattggacagctagcgaacgcagcgtgggtgtgtacttgtgaccgtgataatttcgcgttggatcgcgttcgtttagtagtcatcagtctcgtctcagtaccagccaatgcaaagtcaaatccccagctggaatgccc

SEQ ID NO: 72005 - DNA, 4659 bp, Oryza sativa
aagtagttagcagatcgttctataatcatcacaggaaaaaggtttcctgaccaaactactagtgattaaaaagcttcccaagtccagcagccatatgcagttgtattgtaccttataacttacaagatctgattaaaaactgctgcaatgtttctgcacatatggaaacgcacgcctaactttcagaagagattttacctgatgcacacagcaaaatgatctgttcccatgcatgcagtcttgatggctatagaaaaggagtctgttcttcacctattgctaagattggagccactgaactggtagaaataggaaacagtcagcaaacgaaattgaaatggattcagaggagggtgtaactagaagaatacccccccctccccaaacaaaaaaagttttcagtattaatggcacaagtaatcttgtgttcttgccatgatctgtctcctgattacaagtctcttgtctgaacctgaattgttaccccagactatgttcaactaagactacgtacaagtatatccttcccaataaagaaattctccatatatcattttaaaactatttcgaatttccattccatggaattcaaccaggaacagtaacatttgattgaacaataactgtctaataaagtttagttcacagcatttctaatccaaaagcattcaccagcggaaacacttaatatgcacatcttgagaaaagattaaactaatccaaaacaaaaacaatgccaataatacaaaatatacaaagtttgtgagacacaattaccttattggttatttgtgtgcaatgtctcatggaatggccttcgtctcttcgatggagctccttttgccctaatctcttcaggatcaagtactctcttctctaatggctggttactagacaaaaagtgagttggcatatgaccaaaatctccggccacgatgttctcatcggatgacgatcctttatccaaaatcccctttaagaaatccatcgccttttctgtctgctcagggttcctagcggcctcgaagaaagcatcactacctagatttcggaggctacggtaccgaaccatgtgttcagaccacacattaggatcggcattcctgtctgacctaaatgccgcctttgctcccattgtccacctatccacgacacaacaacgagggatggtgtcaaaaccaaggaacttgactacaacaaaaatgtgtgagcaagggatgtcttcgcactccatcttccgacagtgacattccacaccttccaaagcctggcctttaaaagaaaccctcacttcatcccacacctcattatcgtccttcaaaccaacaacatacaatgacgaaccatcttgattagtcccactgatgacttcaagtcctgcaattagccgtatctgtgcacggactttcttgaacacgactgcggtgtatatacgggcagcgtctttctccaatgggtcggcgtctattctacaaaaagggaccgaattggtagacttagcgtccaactgagcctccttcttacgcaggccttgtatgcacaacttaacatgtttgactaagcacattagtgacatgtttctctttagaagggtgtgaagctttgagttcagtgactcactacgttggttgctgcgcatacccaacaagtatttcccatctgtataggcagctgcccatttctcccttagtcggtacatcagagcgatccattgttcatttcccgtgcctccattctccttaaaatcagcccaacgtctctcgaactcctcttcatccatactctcataaattaattttcttagctcgtcgagttttggcttacgaaggtgacgactcatattctcctctatatgccaagtacacaatctatggtaagcacccggcattaccttactgatagccttcgccattgctaggtcgccatcggtaattaatgattttggatgcacttgacgcattgcctccaaaaaagtctcaaggagccaacagtaagagttgacagactcatttgatagaattccgcacccaaaaattgttgtacttctgtggtggttaactcctatgaaaggaatgaaaggaagattgtacttgttcacacggtaagtgctatcgaaaataacaacaccaccaaaagcagcatagtctaaacgtgattcagcatctgcccaaaacacattcctaagacgcccttcctcatccgtggtgtatttgaagaaaaattctgcatcttcttcttgcttccttgttagatatttcaacacatcttcagcatcatgacccttgatattcttcatctcgtaccgcgtaaagaaattataaaggtccttcatcacaaaaccaacctcgtctaactcatcgtggttattctccataacctccatgacttgaaagggcctaaggccactcatgcgaagctcgaccgcttgggctttcttagaatcactcatcacacgatgaactcctaaaaaagcaacatggtctggatttgcaagttcgtgcgtatgttggttatcaaactccttaacaaaccacacccccttctcctcgttccgctcaatctcaagcttagctaagcaaccgcagtgggtcagtgcccgtggctcccttttccgctctgtcctctcaaagtgcttcaactccctgtacccttcacatgagcatacgaattgcctccatataatttcaccgtccttccgtttaaggttgtttttcctcacactgaaacccttcccctttgcatagtctaaatagaatttgtaaccttcctcctcgcttgaaaaaaccacagtacccatcattttatactcttcctgatcctctagctcacatagctcgaagtcattatgtcagacctcacctacggaaaagtacaaaaaaaacaaacagatcaagcacccaaatataagcttacgtcctttatacctcataagtatatataaaaaaagaacaaccatcaactgcataaatacattgccactctaaactattgagcaattactacagttcctccacaatggctgcaaattttgtatgtacgataaattgttatactaaaatacattttctgaaaatggttgttcagagataatttttcttttttcatttcagctgtacagtcaaattttgtgttgcacatcatccagtagtttcagaactctgtttcttttttcagcaccactggagaatatatgcatttgtgtatttcacaatgacttcggttacatgctcctctctgataattctaccattgtcgaaacccttaaaaaaggaagatccgaaacggagccaggtcattgcagcttattaagacctatttgtagtcagatcgttgccacaattcctgaatctcttttgcaggtcatgtggattcctatggacataatcaagttagctgacaaactagcaaaataagccaagtccaatgttaatgcagcccctgtctatttttgtcaaaatatatcgcatttgtcttatcctaccagaagatgtcatgctaaatcatatctaaatatcaatggtcagttcgctagggcagcaagccatacatgcacagcaaaatcaatttaatattgttcatatttctttcaaaaaactattgttcttcagtttcatcgttcatacttgggggacggtatccacacctgcgatgcgaaccgaagatgcgaaccaatgcgatacggacggcgacggaggcgggcaaggcggcgaggttgggggaggaattgggggacggtatccacacctgcgatgcgaaccgaagatgcgaaccaatgcgaacagaataaaacatcccataccaaaattacccctaaaggatattagaagattacttacctgccctttaaaataaagggtccagattaattctactcgaagtagaatacttcaagtatattgcaccggagcgtcgccctaaattcaaaccagatgatagcagtgacaccgacgagggcagcggactgatctgagaagactctcaaacaggagatttagagtggtcctgcaaatgtcccactctccctctgttcattccacttctcaacctgagacaggaaaagctaatgatgaccaagaaaaaaactaaagtgtggttcttttaacagctaaatttcctagtcatgcacaacagtaataacttgtaaaacacacacacacacacacagagggcgagccaatgcggtacagttaagaactaacacacataacagtcgttgacaaactgagtaaatctccaccgtattctatagttcgtttatcagataaataattttgcacaagccacatcgttcacaagaatcaggtcatctttattgaatcctaatgattcaacattggcagatatgtttttcactcaaagatgcattttgcacttgctactctgtaggacatgttaacatcaccactgaagcatcaaactgacagaaacgaatcaaatatcaatgtgtataaccaaatataccgaagggaatgtgctgttttctacttctgaccagtgatgtgatatgaaaacatcgatgggaaacaactaattttatggactggtatttacaaaaacaatagcttttaaaatccagaagaaaattttcagatttagattcagcaattcaggtaacacattagtcccatttcggcaagttcaactgctattgaactgaaa

SEQ ID NO: 72006 - DNA, 763 bp, Oryza sativa
atttgctagccatgtaacacaaaacaatctgatattgtaattatacggtatcgttagaatcaaagtatgtatattttggaatgaccgaatatgtaataattgtaaagaacttgtatgtttgttgctcatctttcttcagatggaccctttaattttttttattcttgcatgacgcttctaaaaaaaattgcaagttgtcttgttcgtagccgattgcagttaggctaatctaggatgtatgatgacacatagagggcggttttaaaatgactaatgagtgaattgcacttttggtgaccttttcttaccaaagttatggtttggctcgaccacccttcactcaacccactaggaaattttaccaccacaattctcttatatatccacatctaagttatcctctgtcaacgaaccacatctaggcataactgatttcagaagagggcagcgacaatgaggtcacctttgaagctcgagggcgagcctcggcggagggcttggtgaaggcgactgcggcgaaggagaagggtaggggtgtcagtgatggtgaaggggaggagtagcctcatactgcctgagctagtggtgacacgacgaagaggaggaacgtaactagcggccgcggggaagcccttggttggcggtgacaatgctggccttgcgccactccaggcccgatgcgagggctgtgctaactggtggcaatggtagctgcgacgatgaccagctgctgtgaggaggtgagcaaggagggctgctgctg

SEQ ID NO: 72007 - DNA, 20256 bp, Oryza sativa
tagttacagtgcctcaataaatatagatagaacctgtccatgcagcttggagcatccgacttaatattcgcatttactgctaattacatattgcagtctgttaaatagtgaactgcatacaataatttcatcaatatcatttttttatccaatctctcggttatgctataccgatattcaacaaaatctgagtcactttattggacctttagattcaaagattccgaaatcacaggtgatgataaaaaatctcaatgctaatcaagggtccacaaaattaaccgagagtttaaaaaaatcaggcgcctgattcattggaaaagggagcaagttgtgctgtgaagagatggtggcggctacgttggacggactcagcgtcaatctctccgtctggatagcagtcacttttgtgccgctgccgtatacagatttccatatggaaatgcaatcgtttgttcagcacatgcattgtcgcctcttttgtccaatgtataaccttattcatcattggtggaaacagttcaatgcgtacagttcactgttaaattttaatttataattttagatacacatggatcaaatgaacttgtcggtgatgaagcaggggaaggccagccagtgtgcattattggtatccatgtcgccaggcatgactttgactgcattcgtgccggctcacggatgctagtgcagggttgacacatcttcaccatcagcttttcatcactaacaacgggaaagaggcaaaaagaagctagcggcagcacgcacaatccacgatgaaggtactagctaggtattccacgatatctaacttataccattataccattataccattatatgaccactaaaattaaagaataccatgaaacggccagagaacggctatgcactggatccgtattgccttccattcctattgccagcttgttctgtaatatgggagatacaatctattaaactctctcagtgtgtgttgggtgggggtatgaagggctgagatgttgtggtggactagtggtatataatgacacgctcaaaggcacaccatagttaaagcaaacatattttagacacaatctgtatatttgcgcagcatatctttctattaacttttgcctgcatagcacatgcctaatttattaaaaaatttagcagcattttttgttttgcaaactccatcttaccccatgcatgcatgtccagtgttgcgaagtacatattatcaagaaatgttcagaattcaaccaattcagtgtgttttaacacagatataatatgttaagcagtacattattttcaaccgtagttacagtgactcaataaatatagaggatacctgtctattcggattggagtatctgacttagcatggtgtataattacttttctcagtgtgtcagatgatgtgtccacagataataaggagtctatcactactatagaaaacgtaatcagtgccggttgggaaagtgccggttttgaatgagatcggcatctatttcttttgcccacaaagatgccggttctagggtgggccccgtagttgggatgcgtactaaaaagatgtcggttttagattaaaatcggcatctatatctgtcagggataataggtgcttgttttgtttaaaaaccggcatcttttaggtgataaaggtgccggttcttgtggtttgggcgggctgagggggggggggcgtgggcgggaaagacactagaggtgctggttttaccacttccagcacctatagtgccgacttatattagctattctgtagtagtgtgtggtgtcttcgtctatttgaagatataccggtccaatctctcgaatatgctcatagtgatattgactatgtctttataagttcagagtgtgtacatgagtatttacatttttattcggcttcgagaaaaatgtaaatatactatttttgtaaaaaaagggttaagggtgattaacatagcacgtgcataagttacacatccacgacacaagcagtaacatgtatttgtcggattttatatgactagagcatccgtgatcttttcattcctcctcgtatataatggtttgtgtactctccttcttcaatgtttgctcattcatttttgcacttaaagaaatgacatattattctctcgcaaagcagctcgagtttaacccagttgattcaacagacatacggaaagcttgatttggtataaatataatggcatataatggccaggacacccaaacgatatcagtacccataccatcaaatgaggctaaattaagtacacatggctagtagacagatctgttgtgtttttgtgtactgattatctagctagctagtacaggctattcaaagaagagttaagttgagcttgagcataggaaaaacatcatctgtcgaggctgcatcggtagctattccacattgtcatattgatgtcgccacggattaggctttagtcttgattgttggatgagctgagttcattacagatcaatattggcccaaattagatttaatgtctggcctgaactggatctgatctgagcatagtttgagtcaagtgacattgactacttttgctgccgtagtaactttccttgtaatcatgcaatacatttccttgtaagaaacagtacatagatgacataatagaagccggtccaaattttcctgaccatattttctataacaaaaaaaggaaaaataatttatggctcttatatacattgttgcttatcatatttctttacaggagtgcgctggagatgcagcatttgatgatagatggtgcagcagcagcagatgcaattgatgatagatggatgcatatcacttcataggacgtgactatacagctagtggtagctggtttgtctaaactagctaccactctatctatgagaggcactatccacctatacttcaaatacaattttctcttaaactactcatccgatctacgatccaattacaccgttgtgttcgtaacaattaaatctttataacaagatctcacatgattatattttgatgaaaaataataaattacttttataatatatctaaattacttttagatttcactaaattacttcttagacatataaaagtaatccaataaaccctaaaagtaatttatatatattatagaagtaacttataacaaaaggaaagtaactttaactaatacattttttattggacgtgactacacagctagtggtagctagtttgtactccatatagtatctccttttaacttgaactatgcaaaagttacttccaattaacattgaagttatttttaaaaattgttaaacttatgtgtgttgatctttgctgattaaatttaatttctagataaagtcatatttttatccctacaatgaatttacttctaatgtcgtgacaaagttacttccgttttgttttaagttatttttataatatatgtaaattactttcagactttattgaatttacttttatatgtctaagaaataatttagtcaaatctaaaagtacttatatatatgataaaagtaacttaaatatataataaaagtaatttacaaatataaatattttttcatcgtaacataatcatgtaagatcttgttgtgaagatttaattgtaacgaatataatggtgtaatcggattatagataggataagtaatttgagagaaaaactttgtttgaagagaaaattaacatgggggagaaactgtagcctttctctttgtgactctctctctctcaaacaggaattacgtgtgcgtgtggttggagtggtttcatctcgattcttattcagaaatgcccacgcagatggactccatgatgacgcgagcgatcggatggctctgccagcgtcgcacgatagcgctaaaacgagagggctctcgaattagattttacgcacttcatagggttgtgccttttgtagtgaatttcttgatccttgtgaccaagtcacatcatgtggcattgtgatcttttggtcgatttatattgtttagattagatgtgaggttttggaatatgcctttatgaattctctttgtatgtgtttgatgaatgtattgaaattcggagtaatttactacttgctgaaatctgcagtgaattgctaccgacagatgaaattattaatggaaattgatcctgttttggaagggtgtcagcagaagtactatttctccacatatcatctgtcatgaaagattcatctgtgggttaaggtctgcctgtcggacaaggattatctattggtaaagctctagatatcatagtcagacaatatgtcggtaaacggtatgtctgtcgtgaaagcccttcgctggctgagtgttttcagctacaaacacaatctgccgggaaaggtctctacccactgatggtgtgacgctgtagggacctttgacgacagatggactgccgctacatttaggacatggtgtggtgacatggaagctagagaatgtgatcggccggattgtgcgatccatgcatggcagctgtgataaggaaggaatgaaactgagttccttttggccaacagaggtttttgcagtataataaatcaatgcggctatagtttatttccttatgccctccatccctattacaatttcgatcaccgaaaaccgcatgttgatttatgttgtatggctgataggaagggaacaaagaaccttgtgagcacttggggtatatatatagatcacctccggatatgggtgcaatggtggtagttggccatatgaactttaaaatagtatcagagagttgaccatgtagaacagataaatagcatgttggcctcatcagaggtccacacatgttttgaagtactaatagtaagtttgaaaacagtacaatattttactagagtaagtagtaatatcataaacagactataaatatcatatgaagcacggaaaaataacatagtttcaatttgttagagaaaaaaagtcatactgtcagcagcctactgccgtcatcaagatctgccaatctaatgcccatgtctaaccctctactgggctcaaataaaatgtttagaaaaggataacagaatttttagttccctttgatggttttagttgtatttaatagtaaaccgaagaaagaactctaacaacccaacatggacgaaacaacaacagtactatggtatttgatgagtaaagtagttgcaaatttagtgctagaagattggaaagttgacacgtagatgttactggcactcacctttggaaagaagagataggtagttagacagatagtcttggtgtacaaaatacaaggtgccctagatatgtatatctatctcagcaagaatacaacaaaccatgcatatacggaaatagattctcaaatatgtgaagaatcttgagcaggtaacggatgactcaccaaaaaggattcaactacatattccgagttgaggacaatcatgacttctcggattgtctcctaacatttccttcaagttctacaaagacaaggggccacccaagacgggaggggtaaaccttttcgagaaattcacaattccaacaagtcaatgtttcggttatcgtgaagaccagctgccttgaccacatcggcaatatcctcggtttagaatcttgccaacatatcacataggttagatcagtattcctttgatactttataccttgtatttcttgacatattaaacatataaagcagatgtagtgttaatatccattagggaccctaaaccagaaaacaaatcctagtctcctacaatactgttatgttctcatgagcactcttggccaataccctatatacatgtttatcgtagtcaacaattggtgtgtcaggtaggggctcacggagtattcaaagggttcttaaagacatgatatccagatgcaacttctctgatgaggttttctattgacaacattgaatcaggagaaacaaacagaccaaagatcgtatccctccaaattggagatatcatagtcccaatataatattaaaggactccatccatacatgtccaatccgtgtcagaccacctagattcatatatcaggatagatctcatgagccctctgcccttcaaggtctttttggaacaaggtctaagaatgaggtcggaggcattgaaaccagccaggacagggtaagaatattgtcataggtcaacatgttgataagtaacctgatgagaatcccaaagatcaagatgtggtggtaagtggtaacaaccaatcatctttggatgttccatcaccagttacccctcaaccaaacatgacccatcttcttgatatctgaatgtccagataaacaaaaatcaatatatccctgtctctgagaaatgaaaggcaatacatataacagttatgggagcaaatgtatctataaaaggtacccgaagaaataaatgaagaatacacgaagtttttaaaaatgatgtcattaatttgaatccaaacacgcactagaagggataccatcatctcaatcgggcggtaaaccccatctcaatcgggcatggcgtccgtcacaggctagaagtcacagatgtgaagagttatctcaatcgggcaaacggccatcacagatgaatctatctcaatcgggccctaattaaagcccgtcaccgatagctttgacccagacgaccaatcaaactatagcccatcacagatgaatctatctcaatcgggccctaattaaagcccgtcaccgatagctttgacccagatgaccaatcaaactatagcccgtcacagttgaatctatctcaatcgggccctaattaaagcccgtcaccgatagctttgacccagacgaccaatcaaactatagcccgtcacctactccgtcacctactaggccagtctttttttgtcctcactcgtgtgcacccacccccgggaaattcaaacttcccggtcggtcacccatcccgaaattgttccatgccaaacacgcttaacatcaaagttctttggagattggcttctggaaaagtagttgtaacttgttgatatgagtattctattaatcttattaagccctaggccaggatgtcaaaatggggttattaaatgatttcaaatggaaaagtcaccaaaatcaaagttgcagaactcattgaggtacaaaatttttattttggtcatttctccatatgactatttaaacaatttgaaatttgaaattcagtgtttgaaaagttcaaatagaattttagatcagtgaacgacttcaattgaaaaagtcatcaacaataaagttttattttggttatttttctatataacattttttgaaccgtttgaatttgaatttgaaaatatgacaacttcaaacaacattttcaaatactaaataatatcaactgaaaaagtcatcaacaacaaagttgaataactcatcatgatctaaaacttttattttggtcatttctttatacgagaaagtgatagtagcattatttacaaaattgacaaatctcttatctggtttataaattataacacatatatgtaaaagttgtgaatactattactaacattttgtcaaatgaagaaataacaaaaataaaagttttagatcttgatgagttattcaactttgttgttgatgactttttcaattgaaatcatttagtacttgaaaatattgtttgaagttgtcatattttcaaattcaaattaaaactgttcaaaaaaatgttatatagaaaaatgaccaaactaaaagttgtaaatcttgataagttatacaactttgttgttgacattttttccatttgaaatcatttattactcgtaaaattattttgactcataaaataaattattatactgcacttaattattttgctatagttcaacttacaaatataaacatttcatatgaaaaatgaaaaaatagtcatcggtgacgggcattagttaatgcccaatagagattaagtgtatagcccgtcactgatgagtcatctgtgacgggcctagttgttatctcaaacgggcctcaagttgatgcacgtcacggatgatggtcatccgtgatgggccacaacttgaggcccgtttgagatatggaatgttatctcaatcgggcctaaagttggtgcctgtcacagatgatggtcatctgtgacgggccgcaactttaggcccgtttgagatatggaatgttatctcaatcgggcctaaactacggcccgtcacttataggtgtcatccgtgacgggcttaggttttatgcccatctaatatgtctgtgcgaccatatctcaatcgggaacttttcggcccgattgagatgacttccttgtgacggtccgctatttcttggtgtattagagcctgtcacagatagaaggatctgtactagtgacgatagcttacaacatgtattgagagatatgatatctctaggacaacaataaatgcaggaatacatattgaaagattaggtcctgttactatataaatggtgctattgcgatgccaaaataacacatcgaaagagttgatagaaagaattggtcctcattaagatgcaacctgttaatactggtatgaggggttcataccccatggctatcgtaattatggcgcttgtggcaatgtttgccatcttctcaacctgtcatgcaggtaagcactagtatttgcacacaattatttatccttatttgactcatgaaatggaacagaagagttgaatctcagcattctttttcgataattgtgggcatattttttaacactacatattttgataaaacgtgtttgaactatgaattctgggaatgctgacaaattttgatagttttgtttcatatttcaaacaaaaaattgcacatatacggacaaccaaatatttctgtatgaaacagtatatattttgagtttcagaagttcttgcttattagttaagaatttcccctgattctcagcaaatgtagaaggaaaaaacaacctaatatcagatatgtttgaaggtcattttcttgtgatatatatatgcctaggtgatccttcatattgcagcactaatttcctccactacatatgaatcatccttgttgcagtgagtactactaactgcattgctctttactgtataacagagagcaggctacactgtttcaaagagtcaactgcttcacccaaaagtgcagcgacaaatgccgtgattttacacagattccggaacgttcctattgcacctttacacacgaaacacaatgctgctgcccacttgcagatagccaaggtcttgccagtgctaaagtcagtggctctgataaagatgatattaacattattggtagaggtggaggccacgaccgcgggggtcatggtggtggcggtggcagactcgctggccatggtcacggtggtggcggtatccctggtggtggtcaaagtggtggtattggtgcccctggtggtgggtgcggaggggctggccatggtggagcagtgctgggggcggtcgtggtggtggagcaggaggcagccatcgtggaggtggtggcgcccgtggtggaggcctctctggacgcggccatggcagcggtggtgctgggggtagtagtggaggtggccgtagatctctacctggccatgggcatggtggtcaagggatgaaccaagacggagatgtctcttgattgagaagttagttttctgtaataatattgagaattatatataaaaacattacatacatcagtcatttttttccattgtcaaaaggtgcacctcggccaatttttctttctataacccagagtctgtttggtgtgtcactgcggaagaaatagtgtactgtagcattatctagtgtagatagatcgagcaaggtagacatgagaagatggaaaaatatgtagcacaacaatatatgtaatacaaacttgaagagtaccataggatcaaaaatagacgtatgagatctatccatgtcagcctgcgtaaaaattttactcccagtaaaaatgccaagttgtttgtgaaaatgcatggttcccaatcaccaaccatatgtgaaaatagatttttacatgtgattttcttaatagaaccacttgcaaaaatattgctatttttttacaagcgaccctctagaagcactgcctaatgaaaatcatgattaaagtgttgtttctccatggtggtgtcaacagtggattttgtggcacagtcgttgggagtaacaacttaggcagtggagacgactgaggagatcaacaactgcgatccaagggctcgcgtgacattgaccaccgcagcgagggatggaactagaagtggcaagtgctgcggcgcgcacaacattggcaacaacagctcaggggcgtcaagcatgctggctccagtggatgcgagttgcagaggaggttggtggcgatgcttgttgatcagcgacgacgtcgacaacgtcagcagatcctaggtcgcctcatccatgatggtgcgtgagctagggttgctggtgagtgccatatttaggtattgtttcaatgtgaatttggggactccggtgacaatggcatctattttgggaaaacatttgtgaatttcctattccccatttgaagaattataacaggtaaagtgaatttagggaccttttggatgtgaatttgggaaatttttaattatttgattggatatctacttcaaaaccacaattacttgaattgaattacaggaaagttgacttttgagatagttcaacctttgcaaagaaaatatataatttcccattgccaatacatgactcagccttgttgagtcatcaatgaacccaagtgctcagttggtcgctcgatccgatgcaaatgatgatgacgttgtcttggatggctagtttgcaatgatcaaacaccgaagatagtgagagtgccaaagtttaaatcttggatggttccgatcccgagtctgttttatcgggtctcggaagggagggtatattttgggtacccgttggtttctatgccaagttggacatagagtaggatctgtaggaggcaggaccaactctatataagggacaagaccggttcaataggagaaacaatctactcacaatccaatctagccaattaaatcgttttatcaatattgcacctagttctaacctagctagttcgtccatccttatcgatttgcacagtaaatcatacaccttcactgcgagagtgcaaaatacctttgtaggttttcccgtaaaccttccgttcgcttatgagatgagtgtttatcgcttgttctatctaaatcttctcctgtagccggtttaatcttctccataaatatataaatttccataaatttataataattagttttatttacataaaattcatgcaaaatttgtatattcgaataatttttttgatgaagttttatgttccaaattaacatagaagattgcattatcatgaaaactcttaaagtttctcttgttttccatcactaatattttgggtttcttcatatgtgaaaaattatattccactattaatttttaacctgtttttccctctacgtttcattcccttatgttgttggtagagagtttataacctgttttttaacctgttttgttctaaatcttctcctgtagagaaagttttattggtagcttggcacatatttggaagcaaatgaatgacaaaattatttagacaaaacacctttggtccaaatttggaggactctttacacgaattaactcattctctcagtttgcctgaatcgtatagagagtgaaacttttttgatttgggctaatgccttcttccaaaacatttcagacaactcttgaagccttactttccagtattcttccatactcctctcattcccatttaccatccctatctaaactttgatgttacaattcagataaagctgtagcaagggtgtattgaacatgtagctaggttacacagtctgtgtcaaggttgccctttacacatagtgggtggctcctactctctcacctctcttctttcatctacctcaccttgcatagcaggtgcttaggggcttatgtgacttgctcttatctagtcataactcttcacctcagctactttccatgacattaaatacgctacatctagttcatccattctcaattaaccatcactagccgtcaacccgtgcattgcagggttattgtgaatgacagaatattaaaatttcactggataatgataaattatgttgttaaactcataagtatattttgtttaaaagaagttgatacaaaacactttcatttaaattatagtggccaaaaacataattagtaatttcttatataacccattctaatatttcttctattactttatgttttttttgaaattacataatttcaaaatttagtattaggaatatagatttatactcgttttgctgtctcttgtgagcattctgctatataatagtttagcaattttgaattaatatgtacagaaacaaacttggtttggagttaacctttttcacgatttgatgattcctatattcgtagttattaaatatcaagttgtattccatgtggagtagtctcaaatatatatagcatcttcgtaatttagttttaaaattcctaattaaaaaatattacactcagtttgaagtcttaattattgttttatcgtgattaaagattgttccaaattttggaatcaacaatggttctttcatgatttgaaaataacaaaattcgaaagtaatatatatcgtcacacatctgaagtataagtcatttccatgttttaataattttgaattttggaataaatcactacctgtattgtccttgtgttggtctcctaatttggtactatgctcctgtttttagatacttgattttaattagcacttttacatcatacattaaattagtatgctaaattaaaatttcgatgaaatcatagattcactgaaacaaatgtatttggatgaagcatggagcagatttgttagcgatgtatgtttaacttatctggaaaaaggaaatgtccacttaaaacttgttattaatttatagtgaactttctcattagcaataaaaaagatcagcaacataattaattctttatttcaattaaaataaaaaaatcaagaatatcatatcacatgatgtgggagtttaattaacgggatacctttgtgcattgtagatgtaatgatgaatcatcttatatgcatcagtcgattgtagatgcgatggtcaccgatggataacctagattcaaacagaactttggatttatggatgaatatgtaaacacctgaatttaattatagggtcaaatactcaaatcgcggcatacccgagtcaagatttatgtttcagatggacacacaattacaaacgaaaattaagtatagcacatatgtagaagtccatgatcacgcgcatcatctacagatttccaggtagcttgagctgctaattaactgctgagatcatctgcagatttccaggtagcttgcgtttctaattaagtgctaatcttaaattaatttatagttagtttagatgagaaacatgtaagaaacaactgaatgaaaccctaaaaagattgaatcagatcttgctcacttgagtattttaaatagccatcgtacctgcagagatcaatatcttggatcgataaaacatttcctcgccaatgcgtccggtcgacggagttcctcggctgcagggtcaagtagatcgacgtagcctgccgtgttgtgatctcgtcgtgtgcagcgtcgagtccgactgctgagaccgatatgggcacaatttgtagaccttgaaggaagcccgtatagattgaatggtggcccggacacgttttgggctttaattaaaggtccatgcttataatatttaatctacggtcataattttatgatctagttaatcaatggtcagattaatctgtgatcgataaaacacttcctcgccaatgcgtctggtcgatggagttcctcggctgcaaggtcaagtagatcgacgtagcctgccgtgttgtgatctcgtcgtgtgcaaagtcgagtccgactgctgagaccgatatgggcacaatttgtagaccttgaaggaagcccgtatagattgaatggtggcccggacacgtgttgggctttaattaaaggtccatggttataatatttaatctacggtcatgattttatgatctagttaatcaatggttagattaatctgattaacgtaagagctccgaaaagtgtccaattagtataggtatagaggtatagatatatttttttagttattcccaaatgatcattgatgctacctaaatttactaccaggttgacaaatcaatcagggtttatttgcttatctcatatttatctaatacatattgggcctaattcttttgtattttcaggacatagggtatagtagagaagccatccatgtgatgaatagttctcaaattaggtgggcaacaagtttggttccgactgttaaccataaaagagcaatggagcaatatctcaaataatatatgaatcacatatgaatctataaggtatatactatttttcatcaaccttctaattaactttcgatgattaactacatgatatctggagtgttgatgtcatctcatatagtgctgtatgggttaactggacgcattgacgaatggtaagaaactgactgcagaagaaactcaattgttagctaataggacgaatgtacttatgatttttgctatctgtaaataattgaaatcatgatcaagttgttaacaattgtatatgcaaatataagctaaacctggggcaattacttttgttttatggtgaaatagcaacctggtgttcatatggctcatttactacatttgtattttttttctagcttggtacaaatttaatgcttattagcttaatccttggtatggttcgtgttggtggacattgagcgcatctccttcagacacatgcttggacgctttacagacgattaggagttggcagacgcgttagagcaaggcgcttgggatgcctaaagattctaacttcgtggtgttgagatttaatctgtttcatgaattcttctgttttgattggatgttaagttgtgtttttgctgtttcatggttttatcaacgagtttgaactggtacatggtacatagttgttgaatagtcccacattggttgtgtaagggtaagcgacctaataaataattgtgggagcccctcacctcattagctagctttttagggtggggaaggccctttacgatcctacaattgttattagagcctaactagttcaacatctctggcccgagagacatagtgtgtaaaggcctgatggaccgtgggtgcctgcaagccccgtataccttagggaccgtggggaaacggtgaagggctgagggacactaatgtgtgtgaaggggagattgttgaatggttccatattggttgtagaaggactagagacctaatatataattgggggagcctctcgcctcattggccagttatcatcctacaataatattgtttggtccacatgaaaaagtacaaggcggaatttttcatatagtcttaaaatacgtttttattacaaagatcaggggcggacacatggtgcgacatgggggtacagttgtacccccaaattttttggtaaaaaaaattatatataatatatatacaatacttgggccaaaataccagtaggagcaatcttaattggtggcccaatagcccacaaagaaaccctatcccagtatcccctccctctctgcctcggcaccacccacacggcgtatcgcttctaaaaaaaagaaaaagaaagcgcgagttcgagctgagggccatgaggagcggtggcggtggccgagcaactcgccgcgggcagggaacagggccccggcgtgccgcgccagcgctaccgcggagctcctgcgatgctccacctccgaggtgggacggcccctctgatccggctcctcctctcgccccttctctcacgcccaaccctaacccggctatggcgcccttgttgccggcgcctctcttgctgccgctggtgccacatccgagggagcaagagcagcaggagaatgctgaggaaggagaagaacagaggccgaggccgacgccgacaaccatggaaaagaaggtcagtaaattagtgtctttgtagtttgtattttaatcttgtcctccaattgattgggaaaaattaagaattgagcgattgattgatttgttacacacataattttgtgatttaggttgtagagccttcaaagaagaagaaatttgtggatttgaaatcaatgtggggtagagctgaaaagaaactgaagtctatagttgatagcaataatatttctgagcattcagctaggaggaaagaccctgaacctgctactatacatgcacctgcaactaaagagattgggtgtagtagagcatgtgaagttggatttgcacaaacagaaactcaagtgccctatgaaagtatagaagtatcaagacctcaagatgtagatggcagcatagaagtatctaaacctcatgttgcaaattcagaatctgaagaggaagatgattggctagaagatgttgatgaggatgttggttttcttccacatgatcctggaaagaggattgccatctcagattatagtgtgtatcagcaagatgaagtgaggatgaagtatattgcacttgggccttgtcgaccaccactagagcaatttcctcaaagaaattgtggaggtaaacgtcgtttcatacatagcttgtttgataagtatagttggcttgaatatagtgaggaaaaggatgctgcattctgttttgtttgctacttgttcaaagatagaactaattatgttggtggggatagttttgtgaatgagggctttagacaatggaaccatcatgaaactaatcttgccatatgcaatttaatttttgtttactggatatgttatttaaattttgctttgagatagatttgaatttttgcctgacgtacacaattatggaattaatttctgctggttcacaaaaaatatatgggctgcacatgcctaaaatttgctttgagattgatttcaaatctttccttgcatacatatatttatggaactaatcttttttgtcaattatggaactataatcttcgttggttcaagtttcacgataaatccatgtattgcacgcgcgggccataggaagtcctcaacttctctcgttgtgccacgtggcaacatgagagcgttttgagggagccacgtggctgttagtagtgcacttaatctagctcaatagaaatatgatatgttcattagacctaatacagcaattggtgagaatttaaggaagagaagcaaacatgataaggttgtttatatggcccgcttaacttactcacttaagtgcctgagatttcttttacggcaatggttggcttgtcgtgggcataatgaaagtaaagaatcactcaatagagaaaattttcttgagcttctaaattggttggctagaaatttcaaagaggtcaacgaggttgttctaaagaatgctccaaagaattgtaaaatgacatcccctaggatacaaaaacagcttattagatgttgtgctacagagactactaaacttctcatggaagatcttggggatgagttttttttcaattcttgctgatgagtctagcgatgtgtatcaaaatgagcagttggcactttgcttgcgttatgttgacaagaaagggagggtggttgagcgctttcttggtattgtgcatgttgagaatactacagctttgatacttagagatgctatcaagaatttactaatgcaacaatcattgagcttgtctaaagttcgtggtcaaggatatgatggggctagtaacatgaagggtgaggttaatggtctaaagaagctgattatgaatgaatctccttctgcttattatgttcattgttttgcacatcaactacaattaactcttgtggccgttgctagggagaatggtgattgtgtttggttttttgagtaacttgggtatttgttgaatactattgggatttcttgtaagaaacatcaaatgctttgagttgctcaagctcaagagattgtagaagctttggaattgggtgaaattgaaagtgggcagggtctgaatcaagagatgggtttgggtaggccaggagatacacgttggggatctcactacaaaacagtgcaacatattcttattatgtatcgctcaatccggaaggttctactacaagttggaaaagatcgttcacaaagcacggaagctataaaagctcaaactgcattacaatcatttgtgtcatttgagattgttttcatggcacacttgttgaacactattcttggatacacagatgacttaaacacagctttgcaaaggagggcgcaagatattgtgaatgcggttgagctcattgttttgacaaagatgcaattggagatgttgcggcaagatgatgggtgggagaattttttaaaaaaagtcacctcttttttatgaagaacgaagtcaaagttcctcagatggatgctaggtacaagccggttggaagatcaccaagcttctttggtaaagtgcagaatcttcaccgctttaaaattgaaatgtttttgagtgttattgatagacaacttagagaactaaatgacagatttgatgaggtgaacacagatttacttgtttgcgtggcttcattcaatcccactaattcatttggttcttttgacaaggaaatgttggttaaacttgcacaattctatcccaatgacttctcagccaatgacatcatgcacctacctattcagcttgatcgttttattattgatatgcgtagagatgaaaggtttagagaagtgaacaccattgctgaactttcggtcaagcttgttgatacaaataagcatatcaattacacacttgtctacaagctactgaaattggtgctagtccttcctgtagcaactgcaagtgttgaaaatgtattctccacaatgaattatgtcaagaacaagcaaagaaatagaataggagatgaatacttgaatgattgattggtaacatttcttgaatgagattgttttcaacaagttcctgatgaagacataatacgtcatttcctgtcaataaaggctcgtagagtcaagttgtaacaacttgtgttgatttttcagaacatggacaggatgtaagtatcttgaacttggaaatattggctctatacttgaattattttttgcaactgtgaataactacatttatattttctttatgtagcacactatcttatataatatatgttgctgatgggtatcattcaatggcattttcttcctctgtattggatccaatctttatggtggtgcagccatacgcaatggttagttgtgtcttctgacttctgtactatttttttattcattgttcactataaaacatttattgtaagttatgtatggtattgaaatatactttgtcttaatatatgcatgcttgtgcttggattgaatgaccattagtggtttgagtttatttttaatgttgaactagtttcttggtactatgtacatagtccgtagactataacttcgtacccccatcgttgaaatcctgtgtccgccactgacaaagatgtcattgatctgctagtgcatatctagatggcgtatgtacatacgcatcaacccgcaaaatatgatcaaatagatcaatcttcagttaagtctcctgtttcgacgcatggacagcaaactagtatatgtaaatatttgctgagatgctacgcagatgttctcatagtaataacataatacgttggactaggtgaactccttatatttgtcaaatcgctgcataaaaagaaaaaaaatcccaaaaatgagcacttgacgaaaatggcatataatctgaacctgaggaaaacgtatctaaataatggaaagttcatatttctagtgtgatgtaatttagtactaaggattcttaatgattttttaaaccgtcaaaaagcacgaaagtagaaaataatggaggggtcgagttgctgaacaagaaaatagtgttacagggtcatatttggagatagctagctataagttacggaaatgctttttggcgattgctcgccctggggagggg

SEQ ID NO: 72008 - DNA, 50230 bp, Oryza sativa
ttccccccccccccccccccggcccctccaccgtgctgccgaccactccaccaccgccggccgctccacagccgccgccgccatctctctctttctctctctcgcagtcgtccacgagcggcttcatcggcctttcgtcgtccacgagcgaagacgtcctcggccgaacggcttcatcggccggtcatcgtccacggccgaacctcgtcgtcgacccttccttcgtcgtccacgaccgaagctcgtcgtcggccgttcgtcgtccacggacgtgtgtgaatgtgggtgtttctttttatatgtgtgtgcatgtgggtgtgagggggtatatatgtgtgtgcatgtgggtgtgaatgggaatgaggggtgggtgatatgtgaatgattgtgaatgtgaatttgggaatgtgggtgatatgtgaatgaaattgggagggtatgttaaattttgcaagatatgtgtatttgtcaaatttttttaataacatgtgggagggtatattaacatttttttaaaaaaaatatggaggatatgtttgcctttttatttttttttaaacaacatgtcaaggaaatgtaattgttaattagtgcactacttgataataacatatcaaattttgtacaaatttgtttgtactaattaatttagcataatagtaagtactaattaataatatttcgcaatttaaatttgtttgtactaattaatttagcataatattaagtactgattaatagcataagtactaattaataacatatctattctagcataatagtaagtagtaattaatttcgcaatttaaatttgtttgtcctaattaatttagcataatagtaagtactaattaataacattttgcaatttaaatttgtttgtactaattaatttagcataacagtaagtactaattaataacatatctattttcgctacgtgttaatatgggaatctcagagaatttaaatttgttcatatgacattttgttaatatacagtttatttttgtacaaatttgtttgtactaatttgagtaatttaaaatgtggaggataacttttttttatgttagaggtttgaaacgatggccgatagtactaaagggactaaagagaaaggtttaggggagcaagagcagtcccttgctgctgtggttgctccggaaccaacggtcccaccggaagatagttccgatagcgacgtagctgacgaagacgatgagtactcgtcgccaagcgatccttgtccaagcccaagcccgaagagaaggaaaaagggcgacggtgaagaaggcgacaaggattacattccccctaaagaaggggtaagtaaacttaatatgtaaactgttcaccgtgactttcatgtataccttctcgtaggaaacggcgccacggcgatcaaaacggcagccgaagaaaaaagttccgtcgaaagacgacgaggtaccagctaacacaaccggctcaaagaaagcgaacggtcagcaaaggcgaagaaaaggaagggtgagagaagcgtgaatagaaaggatgaagggttccatattgttactcatgtttcgccaaaaggagagccgctcgcccctaagacggcatgtgcgaaattcagttcacagtgtggcataatagtaagggaaaagatccccatcacggtcaaggactgggatcatgtatcgaatggggataaggaagtcctatgaaaagagttgaagaaaatcttccagttcccggatggattagaggcagcagtgaagaattgtgcactgcaaacaatggccaagtcttggcgtggttggaaaaccaccttgaacaagaaatttgtgaagacgggacgcacactgtttttgacgtatgccaacataaccccgaatcaatgggacaactttctgatgttgaagaactccccagaagaaattcaaaggagccaaaagtatgcaaagttggccaagaagaacaaatttcctcatcgcttaggctccgcgggatacgcaccaaaggtggagcagtggacaaaagaggaggaaatgaggaagaaggggcaaccagtactaatggaggaatggacacagagatcaaagaactgggtaagagctagaactccgaagatcacggatgaaggcaaagtatcgtttgaagatccggagctgcagagcgttgccgataaaatagagaatttatccagttcacagaagaaaggatttttcaagcctaagagggagaaagatgtgctaagtacggcgctgggtactcctgagcatgggggaagggttcgaggtgtgtcaagctagatgagttggaaggaagggttcaaacatgacccccacaagaagcgtgaagcgtataaggataaacttagagagaaggggctgcggagtttgaaaggcaaatgatggatttctgcgtcaagcacatgcttttgcctcgccccgaaaccaaagaacctgagccagattaccccttcgatgacctcaaagagaatacaccctgcagattgcacgttcccattggacgctccgggaaaactcttgaggctgctacggccattgctatccctaggagaacatataatgaagagttcatacccaatgcgtatgccaaggtgcagccgcaagtggtccacgaagggtttgagtcctacgacattgacttcccgactgcagatggtgtatccatacttggggatgcggtcgatcttgtaattctctagcacaagaatgacatatccttttggattgggcaccgacgccacgcgaaaacctgtggtgccaaaaccggggttgggaaaacctccgagacctcctaagaggaaggtgactgataaggcggaggaacccgagatgtaaaaggaaaatccagtgccggaagtgccaccagagattgcagtgctggaggcagccatggagattccagtgccggatgtgcccatggagattacagtggcagaaccagaggtgcaatttgtggcatcagtcgggtcagaaatagaagaagtaccacgattcgaatgggacggtacagagccagaaatatttgaagacccttctcctacgaaagaccccgaggtgcaagagaccacggtccctgagaaggccactaccagttcagaggtgcctagagcggttaggagccacaactccaagtccaaagataagaacaaggagaagttcatggtaactgtcttcagaggggtaaggaacgtgccaagctcagagatgatgacccccagaaggccgctgaactagccgggccaacatacttcgcaaccaatgattgcccggaaaagtacgaacatgggaaagcactcttgccggaatgggcactgaacgaaggaccatgggagatgaaaaggttacataccttctacatggaggccagcaagaaaggcttgggcaatataacagctcgatcgctggcagattgtttcggtgaagaaggttacgtatggctagatttctcatatctccacaccatatatcgtcgggataagatggacgtcaactacgtcggtgtttggtgcatgtgagtatgagttttaattaattatatgaaaaatatgtacaatacaaatccatgtgattgttactaacaaacttcttctgcaggatgcaatacatggatgctaagaagaaaaaagaacctatcggcttcttgaatccaactcggatctgccaaacacaacataccgtgaggctagcaccagggtatgaccaactgaagggcatgaatccaaaagagatagctgaatataagaagggcttgcacaaggagaaattgattactgtcacacagtacattggacgagccttcttgcactttcaaaataagagagtcgtcatggccgcttataattttaagtaagtccggtacatttatcttctgcacatatgtcttattttagctggtactaactaactatgttgttgttaatatgtagcgatcattatatctgtttactcatccaccctaaagacggaaccgtggtagtcttggaccctctcaattacaaacaccaatcatacaaagaatttctaacaatcttacagtagtaagtgattatgactcttgcatttttatatgaatgtattataaataaatatcctccttaatatgaaacggtacaacatccatatagtgcgtaccagtactacaagttcaagggtggagaacaaacccgaacaagggagaagctgctagtacgtacctattgaccggtaatattccactcacttaatgtaactgccatggaagcaccactgaagactggcttctccgaccttccacccgctaccaattgtttcactaattgcaaattttaactattcttttatgatatgtcctgaagtgtcacaagcaaccgcgaggaacggtcctttgcgggtattacgcttgcgaattccttagagttaatggaaggtacaggattaacgcggaggatgtaagtctctatactatgtgctagacagcttcacatatttatgatactaatatattgtttatcttcaatgcatgcagttgccaagattagaatgtcgaacaagttttgacgatacaggcatcaaaaatgtctaacgtgatatgtgccacttcatccaccatgagtgctgtcatgtgaaaggagatttcttcgaccaagagagtgccctagccacaagtgatgaattcaaggatcttcgggagtggaacaatgctatgccataatgtattaaatagatggcgtatttgaagtgacaatgtaaaaaaatattgtaatatatatattttggcaacacttttgagtaatgtaatatatgtacatttatcagtaccaaatgcttgataatcttccaatatatgtacataataatctacctccaagaatttttattcaataatttaaaagtaatttacgggcaaattattattaaatttcaatattttctacctatcttcgcaggcggaagtttttttttgtaggcggccgattcttcttttcgcaagcggaccggactagccaacgtccgcctgcgaaaattatcttcgcaggcggacggccgccccgcctgcgaagatcggcgatcttcacagtcgttggcttacaggcggacggctgccccgcctgcaaagacccttttcggccggttgcgataatgcttttcctagtagtgggcagcgactgatctgattcctccacttcgctttccaccatatcgtccgccatgtcgagcttctgctccgtccttgcagcagcagcgaggaagccgctgcgccggagctccctccagcggtgattcatgactcgcgaggtccggccgtagacagcgtggccaatcttcttccagcagtcgcccaggcggtagtggaggcgtaggagctcgtcgtcgtcacgggcagtgaaggggcggtggtagacgtcgcgggcgaggtggtggcaccacctgtcacggcacaaccttgcagagcggcgtggcatgatcctggcgaccctactccagtggcggaagccgttctccttgacgaggcgaggcaaccaaggatgacgtaccaaagtaccggtaaaaacatcttcaatttttataatagtaaagaattggtattttcttttttttcaaacttattttttgaatttatttgaaattcatcaaagtgagcagtacgcattcgagaggggatgcgctttgggtgccattattgtcgaaaggttatacatgaaaatggaatataggaaatgttgacactatggtatacgcaagattggaatagggagatagtttaggtctttagtagtataggtaagattggaataaggagatttaggagtataggatatattggtactagggtatacatgagatgagaatagggacatgggatagagagattcttatataagttctgacccctgagatcaacggaatagtcctattcctgtttatatgtatagctccaggatgtatcagagatagaatacaaaatgggagtaagctagctaatctagcccatttgtcatttaattcagaaaaaattgctacacaactcaattttgcattaatcatactttcctcttgctgttatatcgcacctcgcacgagacatgcatattacattgcgtttaaggtaataggttacacaaaaatagtcatatactcatattaatgccttattgccataccattatatgaatattattgtaaaacaacataatcgtcatgaccagatgattggaattaatattgtttgtacatcagtacatgaccaactaaaaggttgtacagctaaaacaaggaaaatcattacagagtacaaaataggccagtagctagatttcatcaaactgccatgcacgcgaaccctagcgcgaggctgccggccaggggatccatcacgtggtcagtggcaaggctgcaagaaccgaagctcgaggcaagagtgtccgcaagggtactgcgctgcaactctagcgacggcagcgactgatcagctggctcctccacttcgctagtttccaccatgtcgtccgccatgtcgagcgccgccagctccttccttgcggcagcagcgaggaagccgccgcgccggagctccctccagcggtgcttcatgacgcgcgatgtgcggccgtaaacggcccggccaatctccttccagcggtcgccgaggcggtagtggaggcgcaggagctcgtcgtcgtcgcgggcggtgaaggggcggtggtagacgtcgcgcgggcgaggtggtggcgccacctgtcgcggcacgacctagcggagcggcgtggcatgctcctggcgacccggctccagcggcggaagccgttctccttggcgaggcgctgcagccgcgcgtcctcctccggcgtccatgccggcggcagcttgaggcggacgatgcacctcgcgcgaggcggcggcggcagcggtggcgtcgccatgatcacctcctgatccatcgcgacctctcaatctgctcgagctgagagctacggcgacgacaagtgaggattcagatgaagaatcgcgattcaccggtcgatgatgaaagacagggcaacgccgttgcactgtatacatacctatatagcgctaattccttcattcgtgtcggattacgaatcggagtcggagtgattaattaattagcttagcatgcacgcgtggattaatcgctagcttcggactccgtatatttactaatagtctaatagtgtttccaatcgaaggaaagtattcaagtgcaacgtaacggtgtttactatcccgtctgacatttgaaacaaaatcatgagaaaatctatgaaataccatcgacaagcactttaatcccataaatgccatcgacatacgcaacttcctgaaaatgccgtcatacaagcctatttcttttgaaaatgccatcacaccgttagtccacactgttagaacgaaaaaaatttacaaaaataaccaaattgccctaactccaaattatactaacccaatccagctcccgataggcgacaattgcgaggcagcgctcacaggcggcggcaacgtgggccccccaggcggcggcgcggggctcccaagcggcagcgcgtcggcagcaagcgttcgtgcggcggtcccaggtggtgagacggccgctcccaggcggcggcgagatggccgccaagcgaacgcgtggcggtcccaggcgacggcgtggggctcccaaacgacggcgacgaggcggcgctcccagatggcggcacggggctcccaggtggcgtcgcggggtccccaggcagcgacgcgtcggccgcaagcgcggcggtcctaagcggcggcacagcggtcccaggcgacggcagcgaggtggcgctcccaggcgacggcgcagggcccttgggcggcagcgcgtcgttcgcaggcgcggctgtcccaggcggcggcacgggcccctaggtggtggcgcggcggtcctaggcagtggcgtggcggcagcaagcgttcgtgcggcggtcccaggcggctgctcccaagcggaggtgcagggctcccaggccacgacgcgttagtagcaggcgtttgtacggcggtcccaggcgtcaatgtgacgggcggcaaggaggtggcaggtggcggcacaaggagtgactcaagggcctcatgcatcggcacggtggtcgcagggccgacgagttttgacttgattattagtctgcacgttcaatgcctaaaatatgtaagagaaaatccatgaaatgccattttagataaactatttcagtgagtggtgattatgaaacacatacatttttaaaagggcatgtagcctagtggttgcagtgacctgagtagcaccccaaggtcctaagtttaaatctccataggatcgaatttcagattggattatttgagggctaaattccctatttgataagctatgtttctaaaattaaaaaggctgcatatatccagttggatgtagaggccggttaaagaaatacccttctaaaaaaaagaaacacatacattttccttgatgaagttcaagcaaccgtcattcggcacaaaggcagcaatcttcttcccattcttcaccagctgaacacgagcacacttacagatggcagagtttggctgcttggcctcaataccactataatgaaacagatggaaactagttcaagttaagaaagcatgagtaataaaattgagcatgagtgttgtccaggcgtacatcttctccaaaacaatgcccttggcatgagatgatccagcaaagggtttcttccactcattgccaaagtggctcttcttgtatgccttgtcggcccatctttggttcctgcggtgggtcttgagcttgcgcccagctcccataccacatgttttcttgcaatgaaatttcaggaccaacttaagacaaatgctacgtcttacgattttgccaaacatctcccgcgtgatttttttcctggcatttgacgtttttttggccacatgatctttgcacaaggcatagaagcccacgaacagcccagcagcccatcatcatgcctaaccctgattgctaactctaaccccggtccactcactgccccacacgaccacgcccgcactcgttccccgttcacatcacatcgcacacacgccacgccgcttggatctgggtccgtggccagcacccgcaccgccgtagcgcgcgccaacgacggtgctgacgtggccgtcttccagcagttggtgcgcccgccctcatctgtcccccttctcgtcgatagatccagccgcctctttgccttccccacacgcatggatccatcagtgacggcgacgggaggggctgatccagcgcccgcttggtgatcaggagctctccgtcactctcccacttctctcttgtttcctctactctctctctctctcccactccgatctggcaccccctccttccccgcaggccgcacatatcccaccgcctatctacctcacacgcgcgtggcctgatccgctccctctcccactgacaatgcgggcctagtctggcagtcgcggaaacggacactacggttgctgtctttttaagatgctatagataacaagaatataaggtcattcacaatgcatctacatggcatttggcctcaactctccaactagactgattgtatacgtggagaagaaaaggaggtggggcccatgtcttcactagcttcgcgtgtccgagagcctcgtcagaagaaaacagctttttcaatcgcatctcagcatctgcacgtgagaaagcatgacacaaagagagaagggggagaagctcaccgaaaaaaaggtaattacaaagagagaagggggagaagctcgccgaaaaaagtaattttagtgatggggctcgcataggaaaatgtttggtggggtccacctgaatccatgccgcattgtggagaggaggagcttcgctgttttctgtacgtggctgtttaggctcctcggaaaaacaggacgcattgctaatgccccaacactcattctaaagctaagagcacataacgtggcaaatggaacattccctgcaaaatgcccacaaatcaagagaagtgaaatttaatggtacagtgtactacaagcaacacaatctaatcggtctcctggacctgatggccttaatgttggtttttatagagtttcttggccttggattaaatctgacatcactcaaacggttcaagacttttatgtttcaggccaatttccaaaaggtatgaatgatactaatattactcttattcctaaaaaaaattatcctacttctcctgctgattttaggccaatcagtctttgcaatgtttcttataaaatcatttctaaatctttggccgatcatatcaaaagtgttcttcctgatttaatttcagattctcaacaagcttttataaaaggtcgtcgcattgcaaataatcttattattgcccaagaaatagttcactctttcaatttaaaatcttttaagtaaaatgcttttctgctgaaacttgatcttgcaaaagcctttgatcgtctagaatggaactttattgagaaggctcttcgtcgtaaagggtttcatggtcattttataaatcttgtccttgcttgcattaattcggcaaacttctctgtcaatcttaacggccagtcatatggtcacttttcagctgaaagaggaatacgacaaggttgtcctttatctccttatttatttattcttgcattaaatgaactatttgaaatgatatctaatgcaattcaaacaggtcaagtcaaaggagcttctttaactccaaatggtaccattattccggccctgtatagatgggactaaaacttttaagtccctatcacatcggatgtttgaaaattaattataaatattaaacgtagactattaataaaacccatccataatcttgaactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctcactcttcaatgtatgctgacgatcttatgattgtaggtcaagccactcctgaagaagctagaagcatcttccaaattattcaatttttttgccatcaatcaggtcaaactccaggttggaataaatcttctattctgttcagctctcatactcctatcctatcagtgtcactcaagatattttatccattttccctgtctccttaatgaacaacaattccaaacatcttggtcatcctctcattctaaatactaaagccagaaactctgcctacaactttatcattgaaaaattcaaaaccaggctgtcaattattaaagcaaaaactttatcccatgctggtagactttctttaataaaatctgtgtttgcttccatccctattttctatatgtctaccattttacactccaaaaaacttctatataaattaactgccattatcaggaaattctggtggacaggtaccaatgatgaagacagtaaaaaaggtatttgttggaaatcttggtctgacatttgtaaaccttttgatcaaggaggtttgggaatcagatatttactaactgttaaaaaaagtcttcttattcaatgtgcttggagaattattgaaaatccaaataacttggtttctaagatcctaaaagaaaagtatttccctcagggctccttttggaaagctttaacaaaaattcctaaatctactttttggagttctattctgaaaattagacatcttttggataattctatcatatggcaactttctcaaggtgatatctcaatctggaatcaaccttggtgttctgtttggaaatcccttcctaatcatattactgattctgcaatgactctttatttacctacaaaagtttctcatctctggaatgataggaaagaataggatatttccaaagtgtctcaaatctttgatccccaagtttcaaatgaaattttaaaaactccaattgtgcattctaatactgatgacaaactttactggattcataactcaaaaggtatttgtacttctcaaagtgcttataaagtcttatcaaccaactctatgttacctgctgctaatatttcaaatttgcaattaaaccttttaaagaaaacttggaaatgcaaatttattcctccaaaagttaaaacctttatttggagacttctcagaaatgctcttgcaactgcaaaaaatttgaacttcagaattcctactatttcaaactcctgctctcgttgtagtttgtctgaatcttgtgctcatctgttttttcaatgtgcttttgcaaatctggtttggaaactgtctgaatttcatttagatacaatcatcattgcatccatgcaaaacatcagtgatatcttagcctatgttctagctacaaacaactctgaattaagcctttaaaaagcttctattcttctttggatgatttggaaagctagaaatgacttctactttaaaaagaaaaactgggaacccattcaggttaattttgcagctcaaatcatgtcttcaaactttatttcttgtcttgatactattgatgaagatcatgaatctcaaaatcatgatgttaacagctggacttctctcaattctgcttcagtaattcgctgttatactgatgcctcctggcaggatggtaatactggtattggaatcttcatccataactctgatactcataaagccctatttattcaagctgcttctaatttcttctcctctcctttacaagctgagcatgcagcaatcatgacagccattttgatttgtcaaaagttaaatattattgatgttactcttcttttagacaatcaggaattagttagccttttgcaggttcaagactattattctcacgaacattattggagcttaaaccctttactttaagatcttatttcccttgcaggaacacaggctcttaacatcaaatggatttcaagacaagttaataagatggctgactttctagcaaaaaaagcaaggaataaatctagacaaaatctgaatcaaatagtttgtcaaaatatttcccacttatgttcccattctgactgtccgactaagacagctttggaatcttctccttttatggagaatgtatctttggttgatgtattatgcttctaagttcaataaagctctaaattctcaaaaaaaaaaagctactgcaaaatgaaatatttgtagaaaatttttttttaccatcatctgtagccatctgcggcagaacaatcccacatgaccatcatcagtgttaaccacacgaccatcttcagtgttaattaagacacaatcccatttcaaataatttggagcaagaaaactggcagaaactaagatcaagttcttgacaggctcctaacaccaaaaatattgtatgctaccatgcataggttctcagattcaagcatttaaaccaagggacgggtgattacacagcagcaaagaattaatatcgcttatgaaaatgtttatcactgacggtgtcaaatctgaccagcactggaccatcaataagctcacattacctacatctaccgcaatctcactctctaccaatccaagaacacacaacaaacgaatcaaccaaacatggcccatagctacacttcttattacaaactaaggcaaagagatagagaaaatgcttctagtgaagacacatgttaacacgagcgaacgcaacggatcgttgcagaaaccactacaatggacgaaagagaagggatcttttgcacacaccccatggcggcggagggagaggccgagagatctccgaacggcgatgcgagaggagggcttcaatgacggcggcggctgaaagtggagtgaggaaggaagacgagggagattctatagtagcaaatctcagcgatttagggttagcgtggtgcgcgctgagattcgtgttggggtgatgggtataatcccacagtcctcgtgaggtttggtgagagactacgaggcggctaggccagttcccggcccaccatgtcattcattgtgtgaacaggtccaaggcctcctattttaaaaaaaaaaaatttcgggccaatttgccagtagatttttagtttgttttctcaccttggacgtatataatcattccgatgagcattaaattttttttaggggccctatgaaaggatttgatccgtagaaaatttcagaggaaatatgacatgaagttctaaactattgtaactttggaaaaaatccaactacccctctaaactttgattggaagttcattaagcaccgtgtactttgaaatcggatatctcttactatcgaatttcatgcccgttctcgagcgattagccccgccacgtggcttcactcgattccagggttcgagtcgtgcgcgcatccgttggattagaaatcaacgggagagatccacaaaaggatctatttataaattttaatcttccaagggagtttatctcaaaatgtggcatccatcatccagattccagagaaatcctttcctcccctcgtctcgccgctttctcctccgccgaatcgccgattcacaagccgtcaccggcgttggtcaccgccactccacatcagtgcgcctccctcgccaatccccatcccctaaaatccctagcccacagctccaccatcgtcacttcacctctccgcgcctccgctttccccccgggcccaaaatttttcttttctccgcatctcgcgagctgagcgttgtcgcctcctcctcatctcctcgctcccttgccgcccgtccgcttccctggcgcagctctcaagtgggagggctgcgcgccggctggaagtctcttgactcttcccgttctatcgatccctgcggtgggagagcaccggcaaacagtggtcgtacacctcgccgatcgacttggctcgctgcggcggacgaccactatgacgtcgtccagcagctactgcatatcgactaacctcactccgtcggatcccccgcctggaggctctctgggacgacaatgccggattcgccggcgtgacgcggtaccgggcggacggggaaggctcgaacggccggttgcggtgaacgctccttggtgtttaggctggagatgataatcagggcagtccacaccgccgcaagaggcggcagcacggagatgctgagggggctcacccgacaccactgcaggttgaagtttaccacctccgtagaaagttgtcaagtgcattcctagcttacgtcaagatagagctggtgtcccctgcagggagatgctgttcaagatttatgagcaatacaatttccgcgatgatcgtccaggagtattgtccagcaacggatagtagaaacatgaaagaccaaccttttcccaccgcttatggggaatccttaaatagctatagttgcagctcatttttttgagagccacacaatgggatgctccgtttgctgttggattgaaggaatgatctaacaaattgtattattgatggtttgaaaagtgaggatattatgtttagagatgatcattacagaaactgtacaatgctcgtatatctgttcgcttgttttatatttttagatgattaaagtctctttgcggactatttttctaataataagaacattcatatattcatacattgggtctaattggactggctcatctacactttacatggcgaaaataatggcccatcaccaaatatgcgcgtcgaagccgctcttgctttctagttcaactccctgaattttctaataccatttatataagctcataacatggttttgcataattatttttatctaatttgtactttctctgtttcataatgtaagtcattctagtattttctacattcatattgatgttaatgaatctagacacgttaatatgaatgtagaaaatgctaaaatgacttatattgtgaaacggaggaagtatataatttagttgagttttatatctgttatattagctattcgaggcagctcgttttagcttttaaatacgcaagaccaacaacattcaaatcaagcttaggggataaaatgaacggtattataaagtgtaggtggggcatgatttttatttttgttttctcacctcggacatatataatcaattaaccattccaaatttccaattaaaattgtttttttggcctatgaaaggatttgctccgtagaaaatttcagaagaaatatgacatgatgttcaaaatcatgcaattttttcttacgcgctctttctaaactattgtaccttttcgtgtcttactaccatgtgaaagcgatcaagttacacaaatgcgtttagcaaaaagcaccgaaattcatatcagttagcagagtccaagtagtgcattgtacatcgacataattgaatgagtaaacataagagcactggaattactaataattcatgttttctgttggtaccaaatgtccttccacaagggaaaactcttacatggtgtcgtacagcaattctacagacacaagaccatagcccataggcagctttattatgttgtagaacaaaagaataagaaacatttgaagtacacagcctgctcggttgaattgatatcacaatttagaaacagtgacattttggggctaggagctgatttatatacctccagcccacggccaaccactttggtgaaccatataaatttcttcttgcaatttcaccttgtgacatgtactgttgcgcatacatcgtaatgaaaatatcatgcccaggactaggcagcaggcaccaagtcatacctccaattctgtgaatgctagatctcactgaagtgtcagtataccgacaaaatttgacttttgattagagaagaaatcaaatagtccggagctattatttacacaaggtttgttatgggatggtattctcatactagtcatgtcattctgaaatgtaaggctacacctttggaagatgaagatcggctagtgacgaagtgagatcttctctcgattgggatctccgactttggagtgttgtttgacctggcttccacattccactagaaaactgcatctgacctaagcttccaacagaatagctgtgatagacgcccaatgactgcctggaggactccataagctgaacactgctgcctcctaatccatggctcatgctgaatggatggggctctgacccagcaacagtaggactcagaggtgtctttgttcttgcatcacctgtgaagagaatggcaatacgaagcaaatttaaaagttttgtctataggacggaacctcaagctacagaaaacaaaaggcgagtgcaacagccacacagaaattgcaggatagtttgacttcacataatgaaagaaatctctttccatactattgtgccttcattgttaatagagttaagtaacaaaaactacttttctataatagtatattaaataattaaaaagttcagtccaacataataattaatataaaaagaaaaaagaagcagcttttttagaatggaaagatgtttgattgtttaaaattaaagagatgatgcatagtatatagtagacatatagtataacactttatttggttttccaaaaaagcagagcaaccaatggctatacgtctactaaagaaaaagaaatggtacatatagtatcaacagaattgtcagggtaaaaattttgtgcttctagaatttaagtcccaaccccacagacaatagatgctttttacatgaggaaacaccttaaagtaacagcaatgtcaaggaaaaaaaaaactcaatacatacctgaagtaatatgactccatagatgaaatctgaaaggtgatcccatgctaagcacaggactgcctgcactgttctgcctaaaaagtggcagataagacttgcggaatgatcttgggattgaattgctgacacacaatatggcacatatgactaacacaattgaaatcagaaacaacacaataagaatatttggatttatctctcggtggagtattctgtatccttgaatatcgattcgtgtagacaacacctgtccagcctctaacaaagcaaccccaagagtccaagttatactaccagagtcaattatcacctggttatctttgatctgcagcccctctctcagaagtgatgtaatataaggagccctgaaacaatactgttctataaaaggttgtggtggaacactactctttgcaaccttccatgttttttcacaaaattcctggcctctatttagaacatcaatgagagtggcatcggcagtcaaattgaaaaatttaaaaaccacatagaaaccagacatagcataaaactgcccatgtggttgcggaaaggtactaggaagagcacaaggtttagtgttgcagtcaactgagcttgcattggaccactcagaaagattcactgttaattttgcaagggcactacattcgttccactgaggcatcccgatcagttcaactgccattccctgcttctctttgcctgttgtcttccctccaacactgggacttccatctagtttgagcgggtggcagtaagaacaaatataatcttctttgtatcccgtttgtagacaaggatgcttaacctgaacttttccattaccagctgcccctcccaacttcttcacaagatgtgcaacagatttgtcaaatgcatcatttagcccataaccagacagagaataagcactaagttgatgactgatagaaccaatccttagactcatacttgtttcatcctgaatggaattatcagtctcaaatgtcacctgtaatgatgatccacctaaatcaagtgaaccatatgtcattttagaagatgaggtgccaagcatattcaaatgatggttaagagctatccatccataataagcttcatccatgccactgataatcttgactctgtctctagaacacagaaacgatgaattcttcagaatatcccaagccttgtccagaagccactcagaatctgcactcggtagcttgcgcacaccagctgtggcatatagaaaagcaggcgtgtgtttgtgtgcacgtctaggaatcaacttctcagccattcgaaggaggggctctattgtcatctttaatccagtttcattgtgaacaagtttgttcaacccaggttcagtctccattcgctgataggctcgcccagttaatttaccagattttttcttaggagcatttcctaagggtttcaaagcaataggaaatgtgtttccatcgtcatggttaacagaccattcgtaaacatacactcttgtcccagtgcttccacaatcaagaataacatagtattcagggcttccttccgagagaaagacatggaaatatctcaaagaagcatatataaagaacaccaaaaggaacagagcaatagcacaaccagcagctctcatgcatttctttcgatttgttggtgatgaggggggtgttttctcttttgaaaagcttgcaacagcgccatctctttgaagtgtgcggataggttttgcacgccctgagaccaaatcactaccagtgctagagcccctttctaatgcatcaattcttgagaacgtaggcaaatcttgaagtgaagaagacagccgcatagttgcttctttgtagtcagggtggcaattattataagatctcactggtaagggcaaataagcagttggaatcttggcaaacagaagtcataaggatgcagcataaataaccagagtaaattaattcaatagcgcctttgcaccgcctctgcctgcaagaaaattccatagttagaatatactaacgtggtaaaccacatatgaataaagctaaaatttgaaagatgctccgcactaactaacaacactctcgttatcaggcataagaaaaactttcctacaacaccaatgcaacactagcattgaagaaaatagatgcatcctaaattcctaatcttaggaaatatattaacactatataaatatcagtaatatctgcaaatcaactcacatgctaaaccaggttttccctaaatcctgatactaactcagtgcccccacgttaaactgctagtattcatatgcatcatcccaccgacactacaacagaaacaggtcaccaccgacgacgaactcccggctacacactaccacccataggcaaaaactcaaggatcgcagcaacgcgcccgcccccaaacacgccagcttcccctcgattccagcacccaggatcgcgtcctccaccacaccaaaccgcccgatcccagccaccgacccccgaacaacctaagatctaatcgcagattgccgacacgcgaccacagaaacccggcatcgaagctgccggattggatctggccgggaaggggggggggggacaccgacgacttacccgtcgcggcgggccggtctatgcctccatcgccgcccaccccccggcggcgcggggccagcggcggcgaggattgggagcacccgcgcggcgcggtggggcggagcagttggggcgaggcggcgatgtgggcgggggcggtgcccgcaacggcggcgcgtcgacgaaggaccgggcggtgtggggcagcgtggggtcggcgcggacggaggttgtgggggcgtcgtggcggatggaggtggtggtgacgacgtcttggaggcggcggcagctgagtggaggcgggcgacggatcggggatccgcagtaccggcggcggcggcgcggatgagattagggttaggggagggagggagcaagggtgagagggctgggtgatgaaggggcgatcgacggagggaggaatctgcggcggaggggaggagaccggcggcgaatcggggcaaggagggcggatttggggggcgacggtgcgggcgcgggttgggggatgaggacgcgcgggtgttgggggagaggtggagatgatctcgatcgttccatttttcacggccgtcgactgctgaatgtaagagcttaggagtgaaggattagctgggtccaagttcacagttccgacgaaaatcggttgaatttcagaaaccgtatgagatttcaatgagtttcattaaaatttaaatttgaattgataaaaaaaatcaaattaaatcttataaatagtatgatattcgtagaacctattgggatataaattttcaaaaaaattgatgtattccatgtatttactgaaatttacactagaaaagaaaagaaaaaataacgaattagaaaaagggaaaaaatcagtttacctctttttctagttatcgattgaaatctcgatgatttcgctcggaatttcgccaaagccgactggttttcgcgagcttatcggtaaactcaaggaatttgtattcaaattttggtttatgaaatttgtttggtatctaccagatttcgtgaaaatcgttattccgccagagctcgaaacgaaaggccatcttggaatcgtaaaccctggccagtgaattatagggtagatagataaatggaagtagtattttgctatacttgtggcatgcacgacgaggatagttggtaggcctaccctcgatggatttgcatgcgaccgcgcttgttgttcggtcgagagatacggcaactggcatgagggaaatatattggttgatgaggaaactgttttacgcgagagttgtctacgccaactcgctttgctggcggaaaagctatcacgtgaacgttcgtggaaattggttcacgcgaacgccccttttccggatcgtttctgtatactaactgattagatcgctgtaatttcagatcaccaactaattagatttggagatatacaacatggaccttgtgggctatagtagtttaaattgacatctttatcttatttttacttttttttgtttcttttgtgaaattattttttattctagtttgttatttattttgtgatcacaaaatatgtattcatttttaaaacataacacaacagcaaaatttatctttgaatatttttttcactattatttagagaaggaattttaaatcatatataaactttacatgtgtaaagtttacatataaaatgttactgaaaattactatgtataaagttagtatatgtaaactttatacgaataaagttacatgtataaaatagaattgtttatgttagattttagtcaaaatgagaaaagaaaaggcccggatatgatttagctaactagtgggcccgtgaagattttgcatatgcataggctaagttgtgggctggagcaacttgtgagcaagagcagacacaagttcgctcgacgcgaacagtcgcgtactagactcacccctttgctggcgcacatgccacacggctggcatgtccgtgccctcacgagttttcttttctttcatcaatttttttgccaatttttttgttatttttttattttagaaattgaatctttcatctctaattctagttgaaagtttttgaatttgagttgaacgtttcgaattttgagatcaaagtttttaaatttgagttgaacgttttgaattttgtgacgaaagtttccaaatcttagtttattgttttcaaatattgacttgatttttttttccaaatctgagtttaaagctttaaaatcttggttaacagttttgaaatttgagttgaaaatttcaaatatatagtagaaaaggtttgaattatttacttaaaagtttttaaatctaagttgaaagtatcaaatattaattgaaaagtattcaaatcttgacttggcagtttttaaatttgagttgaaagttttcaatgaaagaaaagaaatgagtttggattaagtgtgcgctacttaatttgttagcgcatatgcgtaaagtaggaaaccactcaaaggaatgttgttctcgttcatctaaaaccatccaaatagttatattttttataaaaaaatgacaacatttataccatgaaattttgtgtccaaacttaactcactctaaataaattcagcaaatgaatagtatagtggtactatatttatacccaaatttatttcctgatttgtaggttgaatttaaacttgatttttgttggagtgctagatgtcactaaactttacattgttaatttttttaaaatcttttataactatttatattgaattttcaagaaaaatgtacgcgagggaacatcgtatcgagggattagaacccactttcctggctgatgaattcggccatgcattaatacagagcagcaatcatgtctattactcatttttataatatcaattctaccgaatgcatatttctatcagtaaaataatatggaacacctcaaattaatacatacgtacatagatgagactccccaaaccagggaaatctcttggaacaacttcggtaagattgtgaggacctactcagacctaccattattttcagaagaatactctctttgagttgtaagaaactattagatattaggattaattgaattgatgtcattgtaaattcatgttattgaaaaaaaaaactattactattcaggatacctgttacgtgctactagaattttataaaattaaaaccatgccatcttcgtcattatatatatatatatatatatatatatatatatatatatatatatatatatatattatatatatatatatatatatatatatataccaaaatacccatgcatgtgggacccacacgtcagttccattttaatttcttcctccaccctcccctcttcttgctttccatctctgtccacctctccctcggtaataagagaggcagtggcgggcaagccatgggtgtgcggcggcacaagcaacgagagagcgaggcagcggtgaccttgtcggtgagggaggtggaggctgcagaagcagcatctttaaggcaggagccctcgagtgaatgattgatgtgagaatttgtagctgctaattaatatggaaatttttaacctttataccttttaaattaatgtggggacttctatagtggactctaatttaatatattttacgcaaggactacaattaataatatatatatatatatatataaagatataaacatttacacgtagctccttgtttctcaaatattttatcttgatcacaatgggatgtctgatcttctgccaggtaaagattaggcggagaaggctaatctccttgtttctcaaacacctcatcgagatggctaatccctacatgcgaatcacaaaacacaaacaagaacaaaggtagattacaattcaatttgcatatgaatggttaagatctcaaagttggggtttcacaaaccgaactagcagcgaaaatgcaatgacagaaataatctaagtaaaaccctactctaaactataactgctactaaattaatatgattaggaacattctatagttagtcttagggcgtccacaccttgggcttagcccatgacacaattataaggcccaaagcacaaattagactcgggctgcatatggtatgtggcttttttctgcagattcccgacaacttaagagaatttttgatgtgtgaccaaaaccatctgaaagtagactccatacgctttccaacaagtactgatgggagctgagattccttctggatcagcagctatgtccatttgatgttgatgctgttaggagggtcgattccgaataaaaagcgtgtagaatttcatcacttactttctatggaccaaaagtgacatggtgacataggagtagatttggagaaggatattggtgtgataattccagaagcattgaactctttatctctggctgtacctttgttatatattggtagaaacagcctctaccgcatgccccgttatacatcgaataagaaaaggaaacaaactagagaaatatccaagcttatcatctattatcacatgtgaatagtgctactttaatttctacaatataattggttagtccacagcactactacataatacccttttggtgctggttgggaaaccccccttaggtgtcggttttccgaaccggcactagggaggcagcactattgattccaagtgattggtaacggtttcaaaaccggcacctttgaggcgcttgtgagccaaaaaaaaaaaaagctcgatgcatcgagcgcatccaccccccacgttgcccccataatctcaaatccacaacatcaatgaatcaaccaacatcatcacaacgaataaaccaacatcatcatagaaattacagactataaactcccgaatcaaccaatatcaatcacagacatcacacaacaaacattgaaagaacaatcaactccaccactgctcaccgtcgctgtctaccagatccgccaccgctgccaccgtcaccccgaggatccgccgccgccgggccgccatcaggccacaattgcctcccctcccacagttgggccgccgggaagtaggggccgtcgcatccgggaagtaggcgctgtcgcctgaacaccattcgccaccacctcgcgcgcctcccctcccgcaggatctggtggaggggagggcgcgcaggcccctcctagcccctgcgaggccggtgctgccttcgccgcccttccttctgccggatctgtcggagggagggcgcctccaggcagccgccgctcctcccgccgcgcgccgctgacaccgtcgatgccgccgcacgccgctcctctagtcgccgcctccgatgaaagagaagagagggtgctcaagagagaggggaaagagcgcagagagaacgagagagatcgagaggagacgagagagtttgagcgagcgagcggacgctgcggaccttatctcctcgacgcgttgtggtggggcctgtcggctcatcgccggtttttaatattaaaggttctgattctaaataaaaaccgatacctataattacttaaggtgcctggtttttgcgatttcaacccgcggaggtgggaaaaggcctataagtgctggttttagcacttccatcacctatagcgctcacatctgtttgatgttttgtagtagtacatgtaacttcattgatcatgcaagcacttcgtatgcacgctcccctttctttcacccatacaaatatttctgcaaacaataagataaaaaaactcatgaaatacttacataataagcatgcacctttgattgatgaatataaaagataggcatggttatatccgagttagcgatgttctcatcacatcttgtgatgttaaaaactgaaaataatagcgtagccatgacagagttagccgcaacatttttttttgccactaaactgtgaaatcgtatgtgatttgaaataaacagaaaaagaaaatatttgtagacttatccgtgaaatcataagtgactggaaaaacaaaacaacaaaaattaggagatattttcagaaaaagtgtaaacaggagatatttccagggaaaaaaactaaactataaaattgattttcagaaagaatgtaaacaggagatatttccagggaaaaagaaaaaaatgtaaacaggagatatttccagggaaaaaaaactaaactataaaaattaaattttaaatgtatcagagccaggtttcgatcctgggacctgtgggttatgggcccaccacgcttccgctgcgccactctgatattgttgtccagagttaatctctcattcttattatcgcgttttcttgcactatccttgatctaccctgcatgaaaacggttcggaatgtttctccataccggacgtttttggaaacggaaagtatcagttggaaatatttccgaaacttttgaaaacggaaatgaattcaatttttttctcaaaaaatggaaacaaggtaaggctactatctgtgagaaacgaaatcggaatttttttggaaaacaaattctcagatttttttttctgggaatcggaaacaaagtacgtatttctcatgtacaactgattagcttcaatcttctttgctctactagtcgagtgcccgtgcgttgcaacggatcttaaatagaaaatataatatggtttaacttgaaaatatataaatgtgtgtctgcgttgttgtaaaatagaaagctatattatatttaaataaaaaatagttattcgatccgatgtctcccagatggtgtcattcaataatcgaaagatacaaagtccaaaggaacaaatatgccatggttgtacagactcataggtcatctttgggaccaattatagtatagacaacttatgattactctaatgtgattatcattatataaaaattggatgataataaacggataaaagatgttaacagttgatgaaaatttgcaagccaagattaaacttgaatatatagagctccatccattttaaaatatatgtgtttattttgtttccctttttaatgtaagcattcttgccaaaattgcaggctgtactcaaaatagtgagatctggtgatcagataaaactttctaaatcaccactcaaagtctgaacctatattggtaacagttcatatgcaggatggaaatacataaacacatgaggagctttctcttttgttttcccgtttgtcactccatttcttttacataacaaagatggaggaaatttcaagcataagtactaatcactctttatttctgataatgaatcactgcatcagtaaaacttgataactcatgtacattgaaaaaatgtgtcgataaggatattctcgctgttttagcattgcagataaagcagaggaagattcaacagagtttcagcctacttgtgcgggtaatatgcatgttttgcaatatttttttctttcaaaggaatatttcttttagaacaacaatagtagtgcagcatgtgcatatttttctcaagtttctagtttgcataataatatcagttatcaatgttgataattcaaaaccacaaacaaaactatatattaatgccgtacggccacgctcgacacctcaacctctaggtcctgaaaagtacaaaatgttcaggttttttttttcaaagaacacaaaaatgttcgggttctagatcaatccctcaccggcgagctcgaggtgctgcggtactggatcgaccgcctcgccgtcgtcagcatgcattgtaccattggaataactaccacccatgcggcagagcattatattagatacttcagagaaaagtattttctatagaagggaaatctataggtaagaatgaaggttttatttacaatccaattcagccacttgaatgttaccaacacacaagatgcctaaaaagcaagggcaatattatgatcagcaaacacgtcaaagatttaggggtgttggacgagttatttcttattttagcaaaatatgtctctaaatggaattatcgttatgttgaccattccaaaaaaaattacctacatttaacaatgactaaagcaaacttaacatttccattctaacattctgcgtcaattaaaaaattattgctatcaacctcaagccatggacacaacacttgtttgttataggatttgttgctattaacctcaattcagtctgcataatgattagtgttttggctatctaagagacagcggacacttgtacgttagaaatatcatgttaacccagagatgatttggtccaagataccattaaaccaattatagcagcaaggacgactgctgtggccgtgcccaaagatgcacaatactccatctctgcatacctttagcctgcaaagctgaattcgttgatgtcatggtttctatacaattaagcgcaattgggcaatttgtgttgttattgttccagtatcacgaaatacaaattagatgtaatctgaacttaccttttcttacatagccttgtgaagaaatcaatagcactgagcagagaggcagagcacgcagaaagcacaaagaggaggaaagagggattagatatggggaagacttgagaatagagaagaaatcgccatcagtaatggcgactcgtggaggtggcgacggaggagccagcgggatcgcgtgacgacgacctgtcggcgggatggactcgcgtggcaccaccgaggcggtcgcggcggcgcagggaaggagccggtagggttgcgacagaggagcagccaggatcgcgcgacgacgatgacctggcagcgggatcggcagccaccgcgggatgagcgtccgaccctgaccatgcggcgcctcctctctgttccactgcggcgcggcagcctatgcacggcggctatgccctaccccgccctcgcctcatccaccgccgcaactccgacacactgtcgggctcatgcctcaccggcacactgtcgggctcaggcctcgacccctcctcgtggcggaaccagacggggatgcggcagcgcgtcggagcgtcgctggagagagaagtgatgcgatggcgttggaggtggttgcgagggagcggagatgcggagatagtgaccgagagaagggggaggatgcgtgcgccgcgtggatcgggcctgcggcggcatgcggagaaagagaaactcgatctgaatcgttggatatcacaatcgtacgggtaatattccgcatgtctgttaagggtggagtcaccaccatcactacgaaatttttaagtagttgagaaatgttcagatttaaactatgtattgaggttcttaattaaatggagatattttttttctagtctagtgattcagatttttattttgcctaatgactatttttatttttattaggccatgccatacatactaattacaattacagatgcatatagttgttctttttctccaagtgaagtgtacaattagttgtaaaaattagaaaggtgatttattgttttagaaaaagtattgaggtacaactcttcgtggattcgagaatttcagtttgaaaaggttttatattctaataaatatttaccctatacgctttgttttttaattcaataatatttgatacctttttatatccagaatttccaattccgattcaaaaaaattaaatttatgtggtttgcctagaaaaaaaaaactacttgagacccaaaccaccaaacgcgtgagtgaaatcctgaacaacttcaccgagaaaaaaaagagtgatttgcttcgaagtggaccattttataaattaggaatgattccatctacctcttcctcccaaaataaattaaattttcgtatattaatttaaacatagatatatctaaaatcttataaaaagataatttattttaaaatgaagagagtagctacgagtaattgcttccaaatcttctctaccaagctcgagcctccttccccaaaccttaccaaaagggaaacaactccatcgatcaatccacctcgaaaatgcacatccatcccttccattctatattaacgtttcaatgtacttccttcgtttaaatatatattaacttttagtgtttaaaatttattgtaaagtatacttgatcaatcgtatatttccatcatttaatttctttatcacctacttcctattccttaaccaatcataatatttctttacctattttttttaaataatcatgttcaactccaaatctattttatgacggaggcagtataatttaatgaacggcttcatgcccctcgctgctacttctccctacatggtggcttatgccttctcctaaccaatcgtagcctccattgccatattattcctcctacctaaagactctgtttgagagagtttctggctactgcagtttttcccagaatcagaagctccctcaaacaacagtacagttttggtagttatgctaagccagggaaaaagaactttttgggggacatcatgttaatctcttgctgttttggccctccatggagtctaaccattgggattgtttaggcccattttttgaccatctatttgctgatgaaggaatcaggcatcgagccattggtagatatagttgtttgttactacttgtcatgttatctgccgctatgagtaggcacaaatatagcatgttttgtagaatcgtggtgcatcaacgaatttgttttgcacaatcatctgtgatttctaaattgtgtttacgcatcattttgactctcgaaatcagcattatttgtttttacctttttctttataatcaatacatgattcgttctccttttttgtgctaattatctggtagtttgttactgctccctgaaagtttccacgtttgtgctaccttagtgaacaaggatggaattcgcaattggtttggcttcaaagcgagcttaacacatttgtaggtgtttatggtacgctgcagcagtttgaagggactcgaaacgtttaatgcagtgcagccatattttttcctttcatgattagccattttctcatcagaggtagatcagtaaatgtatgcatactggtgaccattcagaaaacgaccacaggcagagaaccccattccaatagcaattgccattggtgtgtgacatgtaaatgtggggaaactgttttaaacactcgggtggacgtccacccgtttcttgcatgtcatctaaatggttatgaaaaaatttcaaaaaaattgacatgataggttaatttgtaatatatcacttcacaaacatgcaaatccaaattcgacttctacaagttgtaacaaaaacaataaatttaactgtgaatatacgtataatagttagtgtttgatttgttattttcgttacaacttatagaagtcgaatttgaacttgcatgtttgtaaagtgatatattacatattaacctatcttgtgaatttcttttgaaaatttttcataatcatttaggtggaatacaagaaacgggtggacgtccacccgagagattagaatccatcctcaataaatgtactgaagtgcacatgcaaaagcaaaacagacaccaactttacacccaaagtatcgtctgcagtttatgcggtaaaaaaggatatcactctgccattgaacggcaaacttactaggttattatcaccacagtggatctttctgaaagtactaggacaggcaatttcaccagttaccatcgtcgatctgaatatttgatgaagctatttcaagagtgtaatttgatgttgcataaccaaactggttcaaaaagatgaaacggcatagcagcgctggaactttgtgattcgaaataatgatgctgctttctttaagcatacaaggaacctcaggtatgaatttcatttaatccacctttaccttgatttttacagaaaacgggttacttcactatgttctgtcttctgatactcttatatattaaagtgattatcagttcagaattttctggcaatcatcatgatataaacaagtatatactcctatcagtaatcatgccgttgagttgaacacatagtataatatcaaaggccgcaactcctatctggaaaaacaaaagatcacgtcagttccatgttccagttgtgatattacatgctgaagccagatcaatggaatccaaaaagaagaaaaaaaatatagtccggttaaaagaaacataagaactagcaggtctgcagaatcattaaaacataaaagaacaggatgacattacttttggttcacaaagcatgaatgattggactatatccatattcaacaatgcatgaacttattttaaacataactaatataaacaacatagatgcgacatgagggtaacggtagatttaggagatggatttccatacatctaaacgtcttatcaaaggggggaattgagtagttccttttgggcaaacgtacttcatgatttgctaagataaattcatgaacttatcatagcattgaagattctataaaccttcataaaatgcttttggtagtgcaaatgcatacgaaaacaaaacattttataaaccaaggtaaaataaagaccaaataattttacctcataaggtatcctatccagatcagcatgctacaagaagtgcatttctcgttccaaaaagaaactttctttctagtcttgagatctgaacctcttgctccatttgataagaagctgttcaatgtcagcatccattcttgtgcccctacctccccagactaacatgtgagcaagatcaatcattgaagatccgtctacctcatgcactgttttgaaacccattctcgaatagaacctaacgagctgattagaaaggaaacactggtaagaacaccatcacgcgctgcttaaacaaaatgcaggacaaaaaaagtccaccaataaaatgaaacgaaaatattgcaatatgtggagatccagcacttcaaaacaaggaactgtgattttgtgaatcaatacttgcaaatatccaaatctaaatgttgtctcagcgggaataacgccattatcgacaaggtgaaccctaggaaatgataaacaaatcaaaactatttcttctcatcaattgtgctacccattgtttccaaggtgctttcctttgtgaattatatcaaagcgaatcacagcttgagcaattcgtcgaacaccatgcgcgcagcaacatatcaccaccactacgcagcagcccaggctgcaatagtatgttgtatgtaccttggagtggtagagatccgtgtcgttgatggcaagtagctcggcgcgcttgcagccggcgtcgaagccgtggcgcacggcgacggcgccgaggaagacgccgagcccgaacagcggccggtcgggcacctgcagcgtggcgcgggacatcctcatggagtcgaggtgcagcacggcgccgcctggccacgggcggacgacgccctgggcacggcccagctccacctcctccgtctccccctccccgccgctgccgccgccgcggcgcgccgcggtgacgcggaagaaggggccgagcgtggtgaggcgcacgcgcaggccctgcgcgcgcgacgcagacatgatgtccgccatggtagggaagacgacggaagcgcgcgcggcggggctcgccgccggcgtgggcggcgcgggcgcggccatggagagagatgaggggttggggtggagcgtggacacgtggcgagcgatgagctgaagatatttgggtgagggctgcggctggctggctgctgcggtggtgggttcagcagcgccgcgcgaaagaaatcgagtatttctttttcgaagaaaaaaattgttctactaccttcttaagatataaaaaataaaaaagaaaatctttcttatgcatttccctggtataaaatgtttttggctatgaattggtcgtatcagccctaaaacaaacaaaggccttcactaaagccacgcaaaaaaggggaatttaattatttatcacttttacatttcacaattattcaaatattctttttagatttgcgcttactaatttgtcatcaaaaagagagaaattcttaagtttatgccaattttacctacgtggcgggataaatgagattgctagtatgtatgtagggtgtgaaatgtctattttatcctcctgtcctgtcatcctcttccctcctcatttctatttcctacatgcggcagcgacagcacccggctttagtatcctcgattgcgacggccggaagcaaagctgaggaatggagtggcggccagcggtgggaggtgtgggatgcgatagaagctgcggacgtcgatagccttggggagccacgatgcgatccttggttgcggcagcagcaacgtggtagaagtaggagcaagccacgacgacgcagtggtcctgcaatatggtactcccttcgtcccaaaatgtaataacttttaactctcaagatttatttcaaaatataacaacttctctaccaatattttcttctcaaccaatcacaactctccaccattcacttttcttacctacctctactactcaaccaatcacaactctctaccgtttgcttttatctatttttttaataaccgtgtctaattttaaaaatacttatattttagaacggaggaagagtaattcttttttgccggtcatcttctcaatgctaatcgcgtcgtggacaggattggagtatggaatgtgctgatgctggtcgatccatggtttgctggctctttggtgatgtggcagtcggatgggctgttggagcatcacacgaagcatcggatcgccgtggcgatcgggcagatcgacgacgtagatcatttctgatctaaccttgagcgattgctggcagctggactcctcatcaatttaagggctcaccacactacaggaaaaattaactattgccacatatatattgcaaggacatataaattgttacaattagttactcagctaccacaattttatttttttatttaatattaatatatcgccacaatataaatttgttgtgatattttggaatttgttgcaatgaaaaatgggctattacaacgataaaaattactgttgcaatacaaaagtactacagccacgattttaatctccgtggtagcaattacaatttcttgccacaatatattagtgtcgtaattatttaaattttttgttgtactataaaaatacacgtacattgcaacgggtaaaagagctgagcaataaattaaattattgggatcattatacattataattgaaaaggttaatgaaatcctaacactggtattgttatagattttaattagcgcaggtacaatagcaagctgtaagctagctgcaaacatattttaaggagataaataaggagagagaagagcagcgggctacagatttgtagccagctgtagtacggactctaagacacagtgtatgtatgacatgtcagaccagttattgacaatgtagtatgtaactattatataaatgagctattaaattggctataaatgaattgaagctaatagttggctgtactattaaacttgctcttaaaaaagttaatgaaaatctttcctaggttttgggccgaaagcctttctttcttttcagcccatggccaatccactacctccctccgtttagcctgctttcctttgacccagccacaagtggaccccataagaccagctcgaacagtccaataccatcttcaacctctcgaagatagtcccgtgcccgtacggttgctggagcaatcacccaaaattggttgagggtttttatccactcgatctactcttttcgtttttttccaaaatcatagcgtaaaactcaagataaaaacgaaaaatgattgaaagtttttgatcactcgatctactctttcctttttttttctagcgtaaaactcaggataaaaacgaccgtggaagatcgttgcatcatcagcaactgttaaacggagattaaagccgaatcgaaagggaggagtggggaatcgatttttgcgattaaattggaggagaaaacgcaattttgatatgacggcggcgggaggtgtgcagagaacaggtcggattaaaaaacaaaaggcgcacgggagaaaaaactggtgacaaaaaaaattacggaaaaaaaggtaacagatcggattaaaaaaaccggaaaaaaaaccaaaagcgtcagcgcgtgcgcagaaaaaaattccttcacgtgaaaaaaaatgggtaaaaataacggtgtcaagaaaaccaaacggatctttttttacggtagtcggacgttttttcttactggccacataagcttttttttaatcactttttgagtcggacattttttttatttttttctacttttttttttgagtcggactttttttttctacagacgacggtgatttcttggtcttttttatagtagagatgattaaaaccgaaacataaaattaaaaccgattcaaatatggataacgtatcaaaatacctgtaaaaatgttttcaactttcataatagtagagattatacataaggtatggcaacaaataaatagttgttgcagtaagcttacactattaccaaaaaaaatactcctcgggctcacctcacacgcagccacgaaggcccacagaccaagcccaccacgccatgaaccaaatatattagttcataatatccaaggaaccagtcaacagccaattccccattcctcacaaccctaacttaccacacccttccctttgcttcactattttgcatgcatagatccatcacaaaaggtggtttaaattataaaaaaaatgtgtagcaagagtggaaatgtatagatttaaccactctagaaagatccctcaaagatttgtagttcaaaatctcccccctatattttggttggtctcggagagagaaaaacctcgtatgtaaacaggggctcgaagagaaagaaggctatatagctggatttttgtaggcgacagaaattaggtgcctgtgaagatagatcttcgcagacggacgacataagtctcccgcctaaaataatcgcagcgcctgtgaagatctatattcccaggcgatccacataatataagtggtccgtctgggaatatagatcttcgtagtcagaccacaaccttagcctcgggatacattttcttaggtggtgttgtggttcggatgtgcatacctgcctggaaaagaaatggcaaacgtcactaaaattcgtttttctagtagtgaatcatcaccgtgcttcactataatggaatgtgagtcgatagtacacccgtccataaaatcctctcatgcttctgtttttgcttcctctcatgcttctgtttgccttgcatgttccatagccacgcgccgtgcgccatcgaaccctttcggttgcatttgcgaactaaccagatgccattttcttcctctgcaatagctagataactgcaaatctgcaattgccaataattaattgccggcggagaacatggcacgccactgcatgtccaccatggccgcgaacacggcgtgggccgcgtgcccgacctgcaccggcgcgccgccagacgccgccgacatctccgacccgcagcagcggcatgcaggccccgtcgagctgcctcgtcgagagcaggtgctcggcgccgatcctccgcagcgcgcgccacttgcggcgcggcgggaggacgaacacggagttggcggcgtgcccgaccccgacgccgtgccacgcggccggtgaggctgccgttgtgcgtctggaggatctggcgggccgtcgacggagacgaggcgacgatcgagacgacggtgccaagccggaccgccatgagcaacgtggctatggatttaatatggtgtctcgctgtgtatccgccgccaacttgggaccgaactcgattgtaatttgtaatcggagctgtcttgactcttgagtagtatatactcaggtaggggcggtgctcctctccacccgaccccataagtctacaacaatcaatctaggtttaaggtctcaatcgagacgagaagggggaataagccacaattccggcggctacggctccgtctccttcatcaggtgcgcgctttgatctggattaggtgtcgctcgatccttttcattgtcaaatctctcgatctggatttggataattttgtgcgaacttgggatagatcgatgatcttccgctgctgatagttgataaaagtggcctactttctcgtttctgatctgatgctgttctcggtttctccacagcaattcccgcgctgctgatggatccatctgagggaaggaaaatgagtagctttaaggaggaaagaagtgaagggaaagttccggccacggcgattgatcccaccaacgagaaaaaaaagaggactaagatggtgcgctacactcaagaccaaattcagtactgctttgcgaactcggtggagttatctgacgacgacgaggacgattttaagctgacggaggtgctgagcaaggagtgtcttggccggatgtcgcaggagtatctagccaagttgtatgccatggaaatcgctgaagagaaggagaaggctaatctgaagaagatacaggacgtcctccgcaatgaacgagagaacatcttcaacatccgtgaaaaacccgaggacgtccttaagcagtaccacaccaaaggctatgctgagtacgaggttgtcgttgacgatgacaagggcgatgaagacaataaagttcatgcgcgagttgctccccctggccgaagaagattccggaatggggttgccatgaagaagaatcagtcaggaggaggaagtattattaggaagataaattgaaataatcgtctttagtgtttgacagtatttgacatgtatacatcttagttgtaggggaaattatattttcccttctatttattagcatatagtaataatagtattatggtttgattatagtcgtgctaattgtattatgtttcaatcttgttcagcattgatccatcatctagttcagggaatctgaaactacgtaccctagactgaaaagtcagagaacatagtttgttttgactggagtagttttgttgactgcatttttaggaataattttgaaccccttgcaaaagctcgcctgaaaaatgttatgtataatttggaacctctacctcttgcaaaagctaagctggtctctgttgacatttttcagagttgcatgataaggattccgatggacaaaactttttgacagtcatatgagaatggcactctgctaccatatatgtttctccaaatgccaatgcaagttggattaacacctgaaatgaagaatgagtcagtcaggcagtgtgcttgagactgtcagacatattttttagtttagtttgcaaagttattgtagctatcaggtctgtctgatcacaggggcaagtgaaagtgtgaaaccgagcaatttcttcagttcccaacagcaaatttcttcagttgcttgacaagctattactttctcctgaatcttttctagctaacacatcgttagcaagggtgggcgtgatggagtatggatggacctggattttggtctatgctgcttccggatttacctaggcacgagcgaggattgcccatcgcctgtatagggatgggggtgaaagtggaggtgggtgtgttggttaggggtggttatatggagagttttgtcacgatttcccccattgcagtatcttggtggtacttcggggcatggtaacatgtgtggaatcttgtcttgcgggtaaagttgtacacctctgatcagagtaaaactattcgaatagccgtgcccgcggttattggacagtcaaccatctcaccgtgattagtctcaccttaataatttgacttaatgaactggtgtagtttaggtggtttaggtggggcctgtcgcaacgtggttttagcgttggacagtcatgaggttaatactactaaattatattctgctttactgtttttaacttatgatttataaatgctacttttactgcaaatatcctatgagccattccttcgatatccttgcatcataccttctcattggtatgacttgttgagtacagtggttgtactcaatcttgctttattttcccaatccccagaggcagtgaatttgtcggatggtgagttctatgaagattagacttgtgccagacgtcgaggttttgcctggggattatgggggaagcttctctttgccgagcatattaagtttagatgatctttagttttttccgctgcttttctgagtttattttatatttttgtaagacatgaaactgtatcaaattatcatctgtgtactttggttgatgtctggacagagattaaatatacagatagccggtgattcgggttctcgaatctcggggcgcgacacaattgctcacgaaacggttgtgcttataaatctaggcagcactgggaaagtgaaaaaagccttgactcctcatttgcacagataattttttttagataatggaagctttatttagactcagttaattacatcaagatgattttacattaatagtccaccaaggtttttattttctttttattagcaacggaacgggtataattttagactgccagctttttgggggtggtgtggctgaaactaaagtcagctttatagcaatgagtgatacagtgtgtaccaatcatatagaatgaatggattggcttttacttcagaaaatcatccagtttcttaagaaacatcacaattttgtgtcgcatttgtgctaaatattttagttagtgaaacttgactgtattaatttgcagatggaaatacatgtcagatgctgcccttcattcaatcttctacatatagtctacgaaaagtacgtatataatgggttacatagtatcatcgtacatatgtgcaggaccagtttgtaatgggttgtatcatcattaagcaggtaccgttcttgcgtttatactgtgttttttttttaaaaaaaaagtttgtaatgcaattatttaattggtagataaacatgcacccgcacgtggctcagacgcagacatcagatgctcttggctatagcttgcagcggggtggccatggtcatcgtcaacccaagattctccgacatgtccacaccattttcctccacctccaacgggagcgtccactcgaagcgatgcagcagcgaccccagcattgcgtgcagcatccttgtcgcgagtggcagcccgaggcagacgcgcctcccagcgctgaacgggatcagcccgaactccgtcgtcgccgtacccagggcacggccggcggcctcctggccatgctgccggagcatgaacctctccggcaggaacctattcggctccggccacgcctcggcgtcgcgatgcacggcccacaggttcaccaggatggtgctccccctgggcacgacgtggccatgtatctccaccatctcctcggccacgttgggcactatcggcaccaccgggtgcagccggagcgtctccttgatgactgcccggaggtagggaagacggtccatatcggcgtattcagcatgagttttggagccgagaaccttcttgagttcttcctgtagctttctcatggtctctcggtcctgtagtagctctgccattgcccactcgagtgtactcgcaatcgtgtcgactgtcgccagaaatatgtcctgaaattgatggatttaattggattaattgttaaaacaattactacgatgacattaacgaacttattggtagtaaagggacatagttggaagttggatatatatgtccctgtatttcttttatgttacataaataattgatgttacataaataattgtaaaaaaagttggcaaggaccccctttttcttcctcgcctctcttgattcggatctgtcggatgtcaccacaataggggtcctcgccaagcatatctactgtccatctaattcagacctgaagctcgtcgatatcgcatgacaaaggcctaaagagaggagcggagaggggaagagggtatgtttcagtgacggatccaaaccacgggccacctgggtcatggcccgtggcccggtggataaaacccatgttgacacgtgtaaatttaccatgtatttgatagataggccaaaagtataatgggctggctcggggcctacccaaattctgggttcacgcgaggatgttgatgctgagtggaataggaggaaaaggaaagggaccctgttggcggcgacattctgtgcactgttcaggcaatggcagagccatcagcatcagtcatttttgcaaacattgatcacactcgtagtggaggtgacagtgatgaagcctaggcaaccacttgatctaatggagagctggcttcccatgcaaaggaaggcgtcggggtaggactgcatgaccacaaatgccatcaagaagagaagataagatagaaattcaactaggccccagtatgaattttgtttccgcgtcggatgccatgtaaaaccgcctctaatttgattattggtctaggctaattcactatttgtcatcctcccaaaatacacatacccaaatgccactctcccaaatttttattctcaggtaatcagacccacatgtcagtcccccttcccatttgctgaccttatggacccatgtggatccggggaggaggcggacatgtgggcccaggtggcaaatatgaatgaaaatttgtgagagtggcatttgggtatgtgtatttcggaaagatggcattctcgtggttacagagggtgtaaaatattcggtacagtagttacggttgtaaaccagactttaatccacatactagtttttttttagaaaaattcatagatatttgcatggtgacttttctggtaataaaagtctatatataatttatacaaccaccttgattaattatttatattatgctagtatggtagaactcatgaattactaattttccagctataccttttgcaaaataaaaaaaatccaactaaactgcaatagcagcacacggatttattggtatctatagtacccatctatcttaaaaaataattatttccatctccacgtttagatcaccttactaaatataatacatgcacggtaacaacccatccttcagaactgtgcaacctagcctatccaaccgacgggccaacttatacatagcacctcacttacactatcgtcaccgctttatgtacaagagttaacccgaaaatgatatattatagttagggagacaatgtcttataagctggttctactattactcaactagcaatgtggtagcaaagagcacacgacactcatgggtcacacatgtcgcatccttattgggcaagatattacatgcacccaataggagatatcttgaggatgtaggactaacaaaacaaatttaaaagaaagggatgtatgcatgtatgcacgatttgtcttatgaaatataaaaaaacgtgtttattactctatattttaggatggagtgaatagttcttttttgaaaatatcacacgtaccgtactaccccttttgtataataagtaaagattaaaggcaaattttgtaatataacatcatgactttgcaataatagaactactcagtagctacaaacccacttttttttccttctctttcttttatctcacttatatatttaatgtgacaattgtgcactatatgtataaagtcagctcttacactagaacgaccaatctttatatattttttttcttcatttgtggttatagctgacttataactatatacctgcagatacctgcaaatctgcaattgccactaattaattgtcggcgtgtgtcatcatgtagcattgaaaaaaaaaacgtacgcgagagaaaaatatgcacgagagaaagaaatacagtttggtgctttacttacagtgagaaatgttctgatcaggtctctgtcgatggccaccttaccgtcgtccttcccatgctccgacatgtcgagcaacacgtctagcaggtcgtcctcgctcctggcctcgccgtcgtcgccagctgcttcacgccggcggcgcatccgccgctcgatctgctcgtcgacgaggtggtagaccgtccccacccgcccggcgaagcgccgccgcaggccctgcaggtcgacggcggcgagcgccggatagaagtccgagaggttgggcttcagcgacagcgccacggcctccctcgccgcgtcctgcagcacgcgcgcgtcgtcgtcctccaggccggcggagaacatggcgcgccactgcatgtccatcatggccgcgaacgcggcgtggccgacctgcaccggcgctccggcgccgccacccgacgccgccgacatctccgacacgcggcggagcaggtcgagcacagcgtcccgaagcagcggcaggagccgccggccgtcgagctgcctcgccgagagcaggtgctccgcgccgatcctccgcagcgcgcgccacttgcggcgcggcgggaggacgaacacggagttggcggcgtgcccgacgccgtgccacgcgtccggcgggacgcggccggtgaggctgccgttgtgcgtctggaggacctcgcgcgccgtcgacgaggacgaggcgacgaccgcgacgacggtgccaagccggaccgccatgagcgggccgtgccgcccggcgaggcgcgccagggagcggtgcgggaggtcgctggcgatgtcgaggaggttgccgatgagcggaagcggtgttggtccaggtggaagacggcggcgggcgtcgccaaacagttgtaacgcgtatgaaatcaagaacatgagaagaagcgagcacatgcagacgagcaagaaaaccatctttctttttttcttttcttttttgatgactaaaaactctgaatgtgtttttttgacagaagcaggttaccctgaagctcaatttatagacgaaaaagggacaattccatctacataaaccacaaatatttcaacggtaacaattaataccacgaaattcttccacctttcagaattaccgtaatgggggattgggatcatctgcagtaggaatagcgaccgcaagataaaccactgcatgcgatttcagccgtccattttggtgatgaatggaccagatcatcagctacagtactagcgcaaaaatactaaatatttcttgctacagtgatctacagtatccgggtgcatgtgaaccgttagattcggatctaacaggtggcaatggactgcataagttgcagtcatagtacaaactgcacctgatccaaatcccgtaatggggaagtgtttttttcgaaaatataccacaaactttaccaagattacagagatgccctgggagcaagattgggacgggttttcaatctcgatcattgccggcggcagcggtagtgtgtaggacagcaggaggcacacctggataaattttgtgcagctcgctgtccaggaactgacgaatcaattggctgcaatgcagcatagaagaacctacacgtgccctgatgcccaggacgcatgcgcctaacctgcccgaatggaggccgtagcactctcggcgcaacacggacgccagcggtttgcggagggtacgattgtggaggagaaaagtggcatcaggcgagatgtaacactggctcggtccccctgctcagatttcacactgtggcggccggcggcggagcagagaaatgagtgagggctgcatgagcgaatcagatgagagaagtagattgtgggggtgatcccatcgcaaaactaactccgtcattctcccgtcactccgtcaattttgtgctaattctggcaagtggaaggattttgtggtattatctggtaccattgaaacctttgttgtatggatggaattttcccgatggaaaactaactttgcagaactgccactggctacgctctagaagtcaggatttacaaacttccactttccaacctcatatgtccatctacatagatagcagttcgttcgccaccatttaagttcttcggtatttatgggtgactggatttgggtacattctatctatttgtttcctatagcagcattgttcatgcaaggtttgttgtttgtgttgagctcaagctccttagattcagtggcgaactccgtggagaattcctgctgagcctggtgaagcccacaagaaaatttgtagttcatcaacaaaccttcaattgtgctttttatggaggccaacaaaagggattacaggttattaagcggtgtgtatgttaaaggaggcctaaggatgcaatagttgtggcaacgttgcaattccctatcgatttgcacctctattgttgcttgatttcaataggaagtttgcaaccttagtgtagtttcctgttcgttggaatcagatggctggttactttcagctaatcaatttggcgatgtactaggatttgttcccctaaactctcttattatgttattaatgaatgttttatgtttgaaaaaaaatgaggtatatgtatgcacgtgttgcacaatccatggaaaccatccatcgatcactagtactcttcttgtcggtggctcccagtaattaaatttgggaaatcttgctagtgacgatcaataatagtagtaattgagtagtacggtgaaataaaatctgagtgggattgttgtgatcgtgatgtagtactgtgcttattgttgatgggatttttattagttcatcaatacaggggctgcaaggaagaaaaaacaaaggcaactgccaatgacataagcaatcccaatggtaaattggcaatcctattggtcgatttcagggttggaaacctcgatcttgtgaacgagggtcggctctatgccgtaagtcagtgtatactgtagtcagccctttgctgccctattcccatcttcttcaatttccctctttcctcttcaatgctaacctagtcctcctcatccacattctattccacattccctcgttcaatccctcttccttaccttcttcttccccttcctgttttgttctgctttggcgttcgtagggggtcatggatctggatggggatccacccctggaggatgagcatgaagtagtccactctcaacttccagagattgccacctctctggaagcgatgacaatcacaccaacaaaggagatcagagtgaggttgcaacagtctcctgaaacggcaacagttcaagccactcacaacctcctcatgaaggttggacattctggaggccagcagaggcagatccctttggaggctttgaagaaatcaatggcaaaagcttggcaaagagtttatcttgacatctctcaggtagaaagcaatctctttatggctcattttcgtaattatgaagatctgtcctgggtttggcaaaagcaaccgtggtcttttggcagtgatgtttttctgcttgaatgggtttctttggatgagaaaattaaacctatgtcagcttacactttcaagcatcttatggttaatgtgcgtatctatggcattcccccaagtcttagaaatgttaagaatgtcaagttggctgctgaaaacataggtcaaatctcaaaagctgaaccaatagatccagatagtttgctgaggaatcagaaatttgtttctattagaatcaggattgatgtggaaaaaccagttcctgatcatgttatcttggagcttcctgataaatctgaacttaaagcttttctgcattatgaaagaactcccataatatgtactttttgtggtctcctcttccataatgttcaggtctgtcctcaaagacaaagaattatcattcaatttccagatgcatccgaggaagatcttaaagataaactaggaaagtggatcactcagatcgattatatgccatcagaggcatttttggatatggaggaatccaacaaaaattcaattgtggaaaaattcaggcaacatttttcttctcctcaattcaagaacattcaagaacagcagaagcagcaagagagaggaagtgggaccagccagtcattaatgcccaagctagattggaaaaaagcgagtgagaaagctttgactttagctggttgcagcactgttcaagggcccccaagtcaagctgttcacactaccacagtaggcaaacaatgtgagaaaaaagacaaagaacctgatatacaaagtacaccagaagttggtaccgaagagatgttagtacatggaagtacagagaaaaagaagctggtttcaagtactatagaggatcatgtcagctgcaactcaaagaatgtcaatactgctggtaaggtgcatcagatggaaccagtccagtctgttccattggttcaccgagtttcacccagtgcaagtgcccatcagaacagtttagttaaccctgctattggcaccaacgaagtgcaacacagaagaagcacaagagctaccaagatttatgagacagcctcacaacatttaagtaagaagagagggtttcatgaagcagcccatgaatctaccaaacgccattgctccccaactacttcagctacctcttccttctcgattgtgggaggtgaagaacatggagggattgaatcaagaagagcttctccaactaaccatcattcagcaccaatcagggttccaagtagaagaggtgggcagagagctacaagatgggatcagagaggaggttatggtggtggaatggtgacctccacttcttggagacctcttgctgctgctcattctgatgtcattcaaagagatgctccaagatcccctcaaagcattaacaattttcatagcaggaagcatacttggagtgctttggaggtgcatcatgatatctttgttgatcaagctgctggagatactcaagggggtggtgcaagtgatgctggagctagctccaggctgatactggctacagatcctagggaatgcaatgtttcagagattcagcttgttgatcccagtgctggaaacggtggagatggaagtggaaagaatgatggatgggcaatggcgccagcccataaggcgtcaagggcgccatgagtcttttaagctggaactgccgaggtatggggggtcacctcggcagtaggaaaatgcaacacctccaacgcctaatatactctactaatgctaaggtaatctttatttcagaaacaaaaagctctaaagtcactgcttctgatctgatccatcattttcatgtagctaatagtcatgtggttcctgttgatcaagcttctggtggtctgtggctgatgtgggatgaagacatggatcttactatagttcagtctagtattaattatatcttagcttatggagtctataagaactctggtcctattttcaatcttctttgtatttatggtgatcctagtcacagggccactagtgccatgtggagtgaaatctcctcttttgttgtacatagtagtcacaaacctaccttttgtatgggagaccttaatgagatcatgcatgctaatgaaaagtatggtttggcccctcctaatcagaatcgtattaatatttttaagcatcatgtcaataatctggggcttatggatatgggttataatggtccagcttacacttggtccaataagcaacagggtaaggatctggttttggaaaggttggacagatgtcttgcaaatgtggaatggtgttttaattatccaaataccactgtttatcacttgcccatgttgtatagtgatcatgctcccatcattgccattctcaatccgaagaacaggaggcctaaaagatctttca

SEQ ID NO: 72009 - DNA, 2283 bp, Oryza sativa
atttatcttagaattacggagattatatacataattactcttaaaaggtactccacttcaatagcattatatatttattgatatttttggagatcatgttcttgtccaaaacgatggctcgatgagtatatcagtccaatgaaagtaagtattaattgcttatatggatatataaatggagcttacagtgcaattaattgggataacgtattgttagctcaccttgcttgcatggctcactgcttagtgctcactattatgttcgcttgtagctgctcactattcttcggacttgagctcaaggccatccggcatccgccacatatagcaatcatctaccttaaatcacgtgactttaggattactgaaatgtagatccatatcaaaaaagttccacatgtcaatgactcaaaatcatgtgacttaagatagaggatctccatcctagctcaataccctactactattggagttggtgtttatatcaaagttgttgaatgatcagagcacaacaccgtatggcaatgtcatccatgataacgtgggttacttcgttgatgcaagctacaaccatctcgaatgaagaaatataggagacgagcaaagagaaatgatcgtcgtcacacgtagttggatagtgaatctgtgaatgtgccaaatagtaaacattgttgttccttttcccaaatactatatggatcctcacgagcatatatgtatgagttttgaaacatgattgaaccatctttaattcatgttttcaaatcctggaataattaacgttttgccacttttacgagtggttctaaagaatttgccactagacccacatatcatagatatcgatatcgagtggcaaatcattaattggcacgtgacaaataattatgccctatttgtttaggcttaggcttattggcttagatttttaagtcagcttatttgcttatatgatttatatattataagctggtggatttaatgtcttaagtttaatggtggagtcatgcatctacctcacgtaagccaaaaaaagcttctccaacctagcttttggcttaatagtgttagagtggcttatggcttcaaaaaagacaaacgaaaaaactatttgtttgttcaggcttaggccctgtttctttcagcttgagattattataatccagattattgggagtaagctgaaagaaacatacaacttattgaagcagcttattataatctggagtccagcttattataatctgataagctcatttaggtgagctttttccagattattgggtgaaaaattactcaccatgccactccactccctctttagacttgcaaacccaataatctaggctctaataatctagaaaagaaacaactaaccgcttattctactacagattataacaatctagcttatagtaatctgactcaataatctagattataataatcttaagctgaaagaaaaagggtcttagacttttcggcttataagttggcttataaccctaaacaaagagggcctaatgtcccttcaatctcatgtcattcttaacgctgattttacacttaacaccctcaacttcccacacccttccgatccaccctcgcatcactcttccagcctcccctccccccaactccggcgatggccggccgcctccccggcgccgcctccgccgccgcggcgcccctcccccgagcgctcctgctactcgccgccctcgccctattctccctcaccttcctctccctccgctcgctccgccccgccgcggccccaccctccctcgccatcggcggctcccgcccttcctccttcgcgcggccgtcggtgtaccactccgccgaggccttcgcggcggggtacgcggagatggagcggagcttcaaggtgtacatgtacccggacggcgaccccaagacgttctaccagacgccgcggaagctcacggggaaggacgccagcgagggctacttcttccagaacatccgcgagagccgcttccgcaccggcgaccccgacaaggcgcacctcttcttcgtccccatctccccccacaagatgcgcggcaaggtccattctccgctctacttctatttacacttccatagcattgtaaggccatgttcttttcagctcgttcatcggattattgaaacagattgtttgctccatgcttcgagaaatacgttttctcaaaaaaaaaatatcgtctactgtattgtatggtttagaactttagatcacttgtttcaagctattttgttaagtttatttcttaa

SEQ ID NO: 72010 - DNA, 1786 bp, Oryza sativa
cagagggagtatttaacacgtaaatattccgcagcaatacgtgggggtgtcatctagttaatttatattttgaggtttgcccgtctataagggttggaacccctctcggcatacaaaataaacaacgtttctaccgtctataagtttctagacatctattggaatccatccaaatatttccgacattagaaatttacaaatgctgtctccggcgccgccgctcctgcagccacacttcagaactttctacttgctgtgtttctattgcctgtggaaccatcgacatgatgtggtcttttgaaacttgcaatctcttctcaaccttttgagacgatgtttagaagaaacaaacctctaggaacaccgtttcaaaatcccagagagaatagcagtccagtcttggaaagctatattttccaattctattttctctttgcatttgtaactgctagctgctagctagcttgaacacttcaattgtaccctatttttctcttcaatggaaatctaggtggggaacctctcccctccggtgattattaaaaaaaattaaaacaatgtatcagcgtatgattcattaagtattagtttaaaaattttagagaaagaaatctatctattatattattaaaacagctttgaaaggaggcaccacattcgctgtgggagctagaaattcccacattaatcggagaaaaagaaaaaaagaaaaaggagagtctaagtagaagtacaatttaaaaatagctaaaattcggaattaaaataagcaatattgaaagaagtttccacataagaacccaatacgagattaatcaaaattcgaaataaaaataaaaaaaaatctaaaactagaaaaggaaaggagagtccaagtagaaatacaatttaaaaatagatgaaattcggaattaaaaataaggaatattaaaataagtttccatataagaacccaatacgagataaatcaaaaatcgaaataaaaataaaataaaatctaaaattagaaaaggaaatgagagtccaagtatgaatacaatttaaaaatatctgaaattcgaaattaaaaataaggaatgttaaaataagagtccatataataacctaatacaagattaattaaaattcggaataaaaataattcccacattaatcggagaaaaagagaaaaagaaaaaaaaggagagtccaagtagatgtataatttaaaaataactgaaattcaaaattaaaaataagcaatattgaaagaagaatccaatacgagattaattaaaaattagaataaaaataaaataatatctaaaactagaaaaacaaaaagagagttcaaataggaatacaattttgaaacaactgaaattgaaaataaaaaataaaaacattaaaataacacaatacgatattaactaatttttttaaaaaaattctgaaattagaaaaagaaaaataagatatcaattaggaatacaatttataaataactaaaatttgtgataaaaataaagattattgaaagaaaagaccatctaaaacacatgacgagataaattaactaacatgcctataaagaagtagagtggtggcggttgatacgagatataaaaattgttaataaaacatcaaatagaatcctaatgacgattaaaaggagagacgtcaggcaggccgtgaagcaaacgagtaaggcgattgccgggacttctagaaagtaaaaaaaaaacaaaccccattgataatcatattcgatttttaaaatctcaatgataataaaaaggagaagcag

SEQ ID NO: 72011 - DNA, 4443 bp, Oryza sativa
cccagtagattggatctcatccgagtggtttgaagccgactcgggagagatgatcttggagtaggcctcggccgagttcgcaataccgaacggcacggggacctggtctctccccgactggtttgaatccgtgtcaaggagagagatcttgccgaagtcgttggtgataaacttgaggctgccgaactggaacgcctgcccgggaggaaaggcgaagtcgtcgatgccagaaacaaaacccatcacacttagtcagcgagaacttgacgctacccctacctggcgcgccaactgtcgaagcaagatttcggcaataataaaagggggtggctatcaagctaggaaagtggatgggtttggaaacaaggaattttatataggttcaggccttcttattcaagaagtaataccctactcctgtccggggatgattccgccgagtgtgttattgattgtataaactgggaaaaagaatcgcccccaagaggcacacggaccctccttatataggggaaggagtccgctttacaaaatacagtccatatcctaacggaatatgggattatagataaaatacaatcgtaaccgactaaaatcccaggtatttccttgacatacaagtttagaacctaacccaagacttcatagagatattccatctatatttggtaccgtatatccgactaaattacaactgtcatgtagatatagggtatccataatctccacaccctgtatatgctctatgttgatattaggaaaaagtacaccgaaggtccctcaacttgacaccgagttacaaaaacgtcctcaaaccgcaaaaccagatatcaggcgtcccttaactaatctaaaccggtcactttaggtcctgcggtggttttgaccccggttttatcctacgtggcagctaagtctgcgtgggacccacgggggccccacatgtcaggtgtccacgtcagcacctctctatttcccctcctctttctctgtttctctccttccttcctcgttctcgctctctgctctcgcgagcttcccccaggcggccgacgagctcgaccacgtcatcggccgcgaggcggtcggagacccacgtcttgagctcgcaccgcctcgagcaaaaagagttggatgaggaggcggcggccatggcggccatggggctagcatccacgaagcagatgttggacgcggtgtcgtggtggtcgtctccgtcgtagcggctggggatttggtggttcttggcgtcgtggctatgctgctgctattgctgccggttcgctggagggacgagacgagctgtctcgatgagctgccgagacggagcccgagaagtagctggcttcccgaagcgtccgtgggttcggcggcgacgatgacggcatgccggtggccgagcgtctgcagcggcaggacgccgggccgcccgaacggcgtggccgcaactagcatgccggatcacggggtcttctaccccaaatctcacgcgccggtcgctgccgcgagatggacgcggtagcgtcatccttctgctcctcgccagcggcggctgcagccgcgaacgcctcatcgtccggctcgcatgcttcttcaaggaacgctcgcgtaagggggtccggccccggatgctgcgacggcgggggcggcagcctagccgctccggcagcattgccgatgtcatcacctttaggagaaggacggcgtacacgcgcgaacggtagttcgggcgtcggagcacggaggcgagggtgtcgaggaagccgccattgtccttgccgaggatacggcgcagggtgggctcggacggcttgagggagtagagcacgcccagtgcctccttcttcggcgagctcgtcgacatgggggaatcgatcatcgagtcgagcaggtcatcgtccaacctagccgacgtggaggtggaggcggcggcgtggctctggacgacgacggagacgaggaacttgacggcaccgggcgtggcctcgatgcagcgcttgttgcggtcgctctcgacggcaatggccttgatctccctgagcgcggcaagatgccgctgcctgccaccgccgccgccgccgccaagcatcgtcgtcctccatcaatgaggcgcggggtggggaatcgctcaacggcgtgcgcagcgcaccacgcctggatgagtcgccgcagcgtttggttgggcgtcgcctcccactccgccggcgctagctgccgggtgatctcgcgcttcctcttgggatgtccttcgccgccgtcctcgcgcaggtgcgtcatggcgagtggatttccttggcgttgttcgtgatcctctcagtgatgttcgtgccatcaaatgtacacccagtccatgacaacgaacacgcgacgcaccgtgtagagcagcgacaccagcgccctcaccggcggccagaacgcgccgcgcccagggtgccgaccacgttctcggtgaggatctggcacgagaggagaaacagagaaagagaagagggggaagagagaggtgctgacgtggacacctgacatgtggggcctgtgtgggtcccacactgactcagctgccacgtaggacaaaaccggagccaaaaccaccggaggacttaaagtgaccggttttgattagttaaggggcgccggatatctggttttgcggtttgaggacgttttgttaactcgatgtcaagttgagggaccttcggtgtactttttccttgatattaagaaaagaagagaagtgtaaaagaggtgatttctctctcttttgccatcggccagcccagcccattgattgggctttctggttttttctttttcatgttatttttcagtttatgatgaagttcatgttctcattttggttgcatttgtggatctaaatctctgaatgtgaatatttcctggggaggagctagggttgttttgaagtggcagtacttttttcttttttgttttgattctttagaaaaaaatcataattacaatcgggtgtcttaaaacatagctaactgcaataagtgattttcgtagacggcccacactcggtggatcgtttgagaaaagcaaatttggaggatgattgtacgagccacatgtcctgattttcacatatctctaggtgcaggcgagtgctacatttgtctacgacaaaccatttcgaccgcatttggtagttgtctcgacgctacaagtctattctgctgctactgaaattcctagtgccttccattcaacaagccaccgtgatcatctgcgcacagtacacataagctctccttgatgtgccccctcctattatcactccaagattttattatccggaaaacatatggtgtgctctctagctagcttctcgttgagtctgattccaagagcattgtagtaagtctgtccatgcacagtgattttcttctccgtattgataccgtctgtctgtccagggcaagggtaagcagatctaagtatccctcattaataaacacctcaacaacctgcaagctagtatttgatatggatgaaatagacaaatagtcacgttgctctttcgataaaaatcaatgcgtgtactattttttttttttgtcctttttccaaatcaaaggttatccctgggtctgcattttcgattttgatcaaaatttcggtactttctggatttttggcactttttggcacaaaattatttgaattttaataaattttgattgaatttcaataaacttggaccaaattcataaaaaattaagaaaatttctgaaaattttgggtgagacaattactcgttggggatccaaaatttcgaacctgaattgcaataactcgacgccataataccttgcattttcgcaagtaggagcccagtttttcgtttaacaactttgaatcaaatatcgctgaaagaatcttgaatttaaacccattttttagattaactcaaaccagattgaatgaaattcaaccaaatttgaacaacttttagtggatcattaattttaaccaaatttgtaaaaatcttgggaggttctgagctagcgcgatattggcatgttccagctatatatctgtagcgcccgttccgtcatggagcctagcggaaaaattatctcttaaaaaccctaattgcgaaatttgtttctttgcttgttgtctagtgtccgtgccatctcagatctcaatccccgatctatcgtcgagttcaattccgaatccaaatccttccaaatcaattcctccgcaaaagtctattttgcctcccccggggtcgatgggccgaatttctctcggcccatctaccccgggggtggctaggctgacttttgcggtggacttgattcggtcggatttggattcggaattgaactcgacggatcgatcgggggattgagatctgagatggcacggacactagacaccaagccttgaatctaatttcgcaattagggtttt

SEQ ID NO: 72012 - DNA, 2022 bp, Oryza sativa
tggtacgtcatccgtatatgagttggtttttaagttcgtttgcttttggaaatacatatccgtatttgagtcggtttctaagatcgttcacttttggtaatacagaagggatcatataataaatctgtttaaaaaactcgcatgctaacttgagatgatcggattcctaaccacagctcatgattttctatatatatatatatatatatatatatatatatatatatatatatatatatatatatatatccaaacgaactcctacagtaaatttcgtcttaactaaaccatataataataataagattaaaatagttttcacccgttgcaacgcacgggtatttttttctagttaagtataagagtcaaagattagtgttatcattggttacggcatggtacgggacttattgtcgaggtctagtaatgaaaactgcttgatatatcaaacaactttactactgtatttctcttttcaatacagctcgaatcttaataaaaacatacaaaatgactcaggatgtaagtgcacatgcatttgcagcgtcaaattcctcttcaactctacaaatacacacacattattactgacgagagtggaacatacagattaatattaataagaggaattgcacaatggactaggctttttttttctttaccacagttgaataatgggccatatatttacttcatgttttcacttaggactaggttttctcacactttattctcattggactagtttagacttggatctttttttctcatcgatgctgtccatccacaactcgaagcttgaccatgaccatatgcaattgagtctcttggtggcatcctacaggactttgcgtaacaccacattcaccttaggagaatgggcataaggtatagggctgacggataggccggccgacaacgatcatctcgagccacgggttcaaagtgtcaagtttggtaacaaaccatgattcaacgcaaatggttttctaaaaactagtctaatatgctacttagataataaaacatgacccagagtgaaatttggtcataataatatactccctccatcctaaaatataagcatttttactatagtgacgagtcaaacgtttttaactttatctattaatagaaaaaaaatattaatcacgtaaaattgatattattagatttatcattagacaaactataataatatgtaactctttttatttaaaacatcttacttttatagatattgttggtcaaagtagtatcacaaaaaccgtgtcacagtccaaaatgcttatattgtgggacggatggagtaaatgtaaacttatatatgttgtcggtcagcaaaattccaataaagcaaaagtcttttcaatttttcatctacaatgaaaaatgcagcagatacgaggagtggtaaaagaactagtaataacactctagtagtagctgctgcggaatgagttggcggctcagggtgtaacccatttataggtcaaaataagtggactcgcggcgcttattttagcatataagtaggtttcgcgggttagacacttacaatccttagcggccttcttcagagtcatagcaaaaggtttgtttgtgtggagagatgttatacaatttatggatatcttcacagtcatagcaaaatgtgaggtaaaggatgaagaaacctccttttgggggtgatgtatggaatagcatagtcagatcaatctctttcccaagagcatattcttttgtttccaacgaaaatgattcagtttgcatcgcaagtttaaaagacatatctcaaaccttcattctccactttataagaacatgcttatcaggaatatatccaaatgttctgaattacttgcatctataggaattcagtgccccttcagtcaatgattgttggttgaaacctgtaataaattgggattcgtctttaagctttgaagaaattctacatcaaggcagccaagatgtcacatgcttcttctcactctgttgaaaaggtcctatatgcaacat

SEQ ID NO: 72013 - DNA, 16369 bp, Oryza sativa
attaatgtgtgtttgattattattttgtgatgaacaattggtttgatagattattggttttgatactttgtgtagtggtgctccttgtgtggacccggtcagaccgggcatgtttggtaggtcagaccggcgtgtgtgcagtcagcccgacggtctgaccagtcggctcgatgtcattttctgttttggattgtttttttatactcataattaattcatgtttataacttctagatgattaatttctatacaaatgtagtaccgctgtgtgctattgttgagtctagttgggaaaataacttgtgctcagatatgatttcttgtttgattcatatgtaggtgtatcttgatgtctcgagagagtattgccggtaattgatcgggagttagtttgggagaagatgtcgtttgaacaatctggatatcatgtgggatttttacactaaacaacaatgcacgtggttggagaatatttcatgtgacaagtttgtgtcttgtacaggaacgttttctaggtgtttaggacctcttgtacaagttggattagtggttttagattacctatctatggttataaatagtagatgtgttgaggcctctagatatcgatttggtaaaaattaagtttagagaaaagttaggtttcgagttgagtcaagatttctgagagaagtgttgttgttacactttgtaaacacgaacataggcaatataatttaatctcctttcatgagtcttcgatttgtgtttttgatcaggtgtgggtggttacaccagcgggctaccggctgtcagaccgattacattgcgatggttagaccggccgagcaactgcggttggaccggtggcggctagagacaatgatggtgtgatcacgcggtcagactgatgcatcaactctgctcaaaccgagttccatcagctacgagggtaacttttagttctgctaacagttatcggtttttggtagatcaaccattcaccctctttgattgattagcttagttcttgatgtgctacccaactgtctttttattggtgcacgaagaataaacttctcgagtaaaaattggtccaagaatgtcggtgaacctgcggtaatataaattatcattcatcactgccggctcatggcacatggtgatgtgcgatgtgtgatatctctaggtcatgcccaaaatcatgaaggcgtagcaattagaacaactaccatcagtaatatttatgttggtataattgtctccaccgacgcaaatgtttttttatgcatgcttttaatccttttatattatatcttgataaattttatggttgctgaaaggtatcagttagggttatggataccacatacctgatagtagttgactaaatctcggcaagacccaccacataccatgtcttatacggaaacaaccttcgaatataggaggagttccggataaggaaagacaactagagctctacatggaaacgacaagtactactcggattgtatgcatattggtttcactagttctatttggacaaggagacacctatgggtataaatacaatgccccctaggaggagaggggacacgaaacaatagatcaatatacaagccaacataagccaagacaagccgccggatatcaacatcagagataagcctagtagtccccatacggtacctacgactaccgtcaagagggatctaacgctatctctgatctcgctggacgtggattcgaggaggaagactactttgttgtcgactacgtaacagcacttcagactgccatgtcgacaacagatagataggctaccccaaatattgtactggtgtgattatggtaaataagagcaacaaccggcttcggccaacaggagtagggttattagctgacaattcaggggtccgaacctgtataaaaatcctcgtctccatcttttttactacaatctcgcatatatcctagtaccaacgatccctatactatgcaaataccggaatcgcgacatcaaacgtcgccagtggcacgccaggtaggggattttggtgcttcaggattttgacgagatgggttcaagagatggattcttcaacagcaaactactcaacgacttcgtatgttgggtgatatgacccgaacgaagtacgttctccggcggatcgggatcatcgtcaagttttgccaagtcatcgtcattgtggattttttgacgagggatacttcaactactttggatctgagaagtctaacctagccagagtacgtgccccgacaaggtcagaaccatcgtcatcaacagttcgatctctcgagatcgaccaagcctctagatacacggcgtaccaaaagatgtcagaccgtatgatgtcaaacgagtacgcaacaaggtaattggtagattggttttttaaattaatctactaatatcgtagatacatccagcatgtatctacaaaggtacgcattattatatatgcaatttatggtacctacttttcagatcatacaatattgtcagatcaataattattatgtttacctagagcatgttttttatacaatatctattgtgtgagcgtttccgatgttaggccaactatagtctaacactgggggctcgcactattttcttctgtataaatcatgcttgtttacggtttacataatccatgatatttaatctgctcgttatatcctaataatactagaagatccatgcagttttttgagtacatactcgatattctctgctatatatcttgccttctagaaaatatttttcaggaacaattgagcactcgagtaggttgtggtcgagtacaccccattatccagaacgatctcgacaaatgcagagtcgtcgtgccatacctaccaacgaagaccgacaacctatctcatagcaccggccatagctgcgctattcgagaaaaggttgttaacggataattcctcgtgaacgttatcggcttgatcacccgatatgattgtgaacggacatctggatacgctataagttaggtatgtgagtcatgctggccacatgagatgcacatgtaataaaccaactttagcgcccctacaggtgattgagagactcctacttcttgttcttgaaccagtaggacgtagcgatctctcacgccttaacttccagtggtcgaggtacgactacagcaatagcgtagcggtccttgcaccacgacctcaaatggtcgacgtacgactacggcaatagcgtagcgaccctcgcaccatgacttcagatgacttcggatggttgagggacagctatgactagtcttcgaccggcagcgtagcggtcctcgtaccacgactacaaatggtcgagagacacctactcactggttctcaaccagtcaatcatagcaatctctcgtacatttacttcaagtggtcgagttaaggctagacctggttctcgaccagcggtgtagcgattctcccactatttccacttcaaatggtcgagttaaggctacacccggttctcgactagcggtgtagcgattctcccactgttgacggtcgttatcgatcagtttcgaccatcaatgttactaaaacaggagagaattagtgatgcttgcaatgcataaatatgttagaataataatattccactagtattaggtctactaaccttttgcagagaatgacaataaagtgaaggaaaattgacatcaactcagacgatagatcaatcggacgatatcgagaaccagacttgtgtatgaatgggccaagaacgcagacttgacacgatgaatcaggccaaaattcacaagtctacgaagtgaagcagtagagggggccaccagccaaaatgtgggctggttgggccggccccaggttcagccgaacctcccatgaaaccgatggatgcagggttttgagggaacggtggagattcactcccaatggcagttggagggtattactgacctttccaatcgccataaccgtcattacctacctatttaaggagttcactctcttcacttcaacacacacctcaagcaagagctctctcattcctctcaaatttagtttagtagtatctagctagtggaatagaattagaataggaatcaggagtccggaagtcttcggaagagttcgggtatggctctagtagctttcctttcctcttttgtaagctttgtacttttattagaatattcttctaaatacatttctggtattgaaatactttccgagtatatgagtacctactttacattatgttcatgttatactgaatatatgacactagtggagataggcacatctatgacaatctacttttgtcatggaagacgcgcaaatcgtcataaagtaacttctatgacgaatttatgacgaaatgggattcgtcatagaagtcgcgtcacatatgtttttctatgactaaacagtagatttcgtcatagaaatgcttatatccatgacgaaggtgctcgtcatagaactgctttccagctggctaggacagacgtcgtccatgccacgtggctatcacacgtggagtccatgttggctgtgatgtggcggatgacgtgtacgccacgctggatcatcatctcccgtacgctagagccaagtggtagtcgtatttaacgccacgtgttggcatttggtatgtccacgtggtggtgcaagctgatgccacgtggtcgaacgtggtggcgccacgtggcagccatattaacgccacgtgttggcatttcttatgtccacgtggtggtgcgcgctgatgccacgtggccaaaggtggagacaccacgtggcagtcatatttaacgccacgtgtttacattttatatgtccacgtggtggtgtacgctaacgccacattgccgaaggtggaggcaccacgtgctctcattttgaagcgccacgtgtacatatctgatttgtgacacacgtctttacctgatgttgccacgtgttgatttgtttggatgacacgttagcacagtagggatgaaggcccgctcattttttttttcttagcccagcccatttggccacatacttcacatattgttgtggcccatcccactatgagatctaggaaatttttagcattcacccatttcaagcaacaattaatcagaacttcgcagcacataagaaaataggcccaacatcaagattcatcacatggacaaacaatcagaacttcacagcacattacaaataggcccaacatcaacatatatcacatataccaacttcacatagcaccatattacaaaaaagttcacagaacctagcacacatatgttcacattaagtccacaaaagtttgccataggatgacattaagtccaccatagcaccaaacatcatttcacataatcaagtccaccacatgacaataagttcacagaaccatcaaacaactaatataagtagatagagttcatcacagtgcagaagatcataaaggagactaggacagatttaagttaccctgggaaaggctcaagatacgtcgaaggagcaaattgttctcttcctgctgctgcttgaactctgccaactccttttgagtctttgccagtgcttcatttgcaagatttgcttgttcttttagttcgacaacttctgcatggagaatggctgaactttgcttttcagctgcaagttcttcctgaagtgctgcttctgtcggtgtcactgatttcttggagctcatctgcagaccggcatttttcagaaacgtggtattggagttgtcccgagagagaaccttggacacaacttctgcactagttcttggtgtctcaccatcaggtacaggttcttccataatagctttcatacttgactgcagcaatgattgaacattagctatgaaattagatacatgaaaaactggctgctgcataacacattcaaaatactggcagctgcacaacacattcaaaaagtcactgaaaactgatggaaagctaccaggaagcacaaactagaggtaaggaaacttgtatagaatgcaaatttaaccaaatttgttttccataagccaaaacagaaacaaattatatgagtaagccaagcattcccatatttagaaatattgcattgccctcttaactgtgaaagagaccagaaacattttgagctctaactatggtagaatgtaattattttctatctagcctctagcaacaatgcaggccaaatgcttcttgacagaatctaggatactgttttagcatatatcagaaggctgactttagactatatttgattagctttcatggcagcttttgattgatggaacaccttggtagctataaaagaacaaggttttcccctcaactactttcataaaatttggagggggtgcaatgttacttagcgttggttattttctattcctcctatgatgcctaaatattttccctagaaaccactaatgtttagaaagaaaatactagtgtggagtacataatccctcataattaagtttacttttccaagttacaatgaaataagttttgaagtagtaaaggctgaaatatgttcagtcttatgttcatatgattcaaaacctcaatacatgcaaacaccactacaacagcttaggtaaaaatgaattttcatgaatcacaccctcaaacccgggatattgataaaaatacaaactgcaaccaggatcaattgatgaaaaaatgtttatgtagcttatttggcattttaacccaatctcaacttatgttgtatatggtaagttgtcttttccagcagctacaaatttagtttggtatgtattctaacattgttagagtctataaattccattaagtctgtaatgatcttagctgcaaatatctctgcacactaaggacagaaattatcctatggatgtaaatataaaatgagctgaattaataatatgttggcataggtaacaaggaattgagttcaatgttgtaagaatatacagagtgacttacaattgcatctttggcagcatcacttagacctttttccctactggtatggcagtcctcaaaggcatccacagcatcaagctctacaaccttgttcttctccttctatttcagtacagaaaatgcagatcaattattttatatatctattacattagataagtggttcttaactacaattaatgctaaaagataatgggaacttacgtaagcgtgcaagtgtgcagcatagctgcgagatcccgtagcctgatggaacctaacattaagccggttttgcttgttctgttcagagatttgctacaaaagatgtatgtgttagacatagtcgcaagtataaaatgaaacaaatatgtcattagagatgacataccatattctttggatttgaccactttgcaacaagttccagccactgttcatcagtcatgctacttatgggagaggtagttctaatctcgttagcaggtactccattgaagtaggccttcttcaaattataccgtgtttgtcgtatccctttctgcaatacatcagcacaagcatcccttgttggctggtgtttttggttaatggccaacctgacctgatggtttgaattgcaatcattaaggagtaacactaggtcatataatagatgaaatataaaagaatatagataggctcttacagataacttgcccatgaagttgttaatatagccttcatcatccttgtactgcttccaatgagggaagacatgaactttagtcctaatgataacaccagcctctgatgcaaacttggcagcttgcaccggttcatctggccttttcttcccttcggcaacagcaatgggcattcttcccatagctttggtcatcttgtcaagcattattcctgcagttggtggccttgattttcttgtgcctcttcgtataggtactacagagtattcaattacaatgttagcattcatcaaatagttaaaaataataaatttctcttcgttgaactaacttgccttcaacatcagaattggtttgctgtgcaggttgctcttcatggttggcatcatggctcgggggcctgttcacatcattatcttgaagcaaatgtccactgcccacatcttcatcaccattgttttctgtttctggaggcagttcttcatggcattacctttaccttgtgctgctatgagttgccttttcgctgaccttgttgagactccaggaggcatttcggttggagcacccgccctcactctctttgatatccttactcctggtggcatcttgaaggtaggtttcttcttcgtcgcacacttctttcgtctagtttgtcgagggtactacaataataaacacaaaagttgtaagcatgtgaataaattagcaacaatcattaaaaaaataatcaaatgctgcacaaattaaatgcggaaaaattattgcagatatcctagccccccccacagccaagatagaagaagcacctcaatcattatggggacgggctgctccggttctaaatataaatcatcatcacactgaaccccttgttcatcatcttcagggagaaactctgatgtatcagaaccttctccatgacttttcttggtgcctgagttttttgtctttgaagatgcatgttgtgtttcgatatgtttaatagtggcagctatgtctttgatgccaagttcatccatccttcttatattctgcaagattttctcttgccgcgttctttcatattcgttttgtgtaggttcttacatgaatacacatattttaatggtcagaatactagatggcattttgatggcatttcctaagcatataagcattttcagaaatagaaacaataaagtatctaggcatttgggatgaaaaaaaaagagaccatgctcatcaacattggggatttaatgatcaatggtgaaaaacaactttacttcaatatctagtaaaaacaacagggtgattcacttttccattttaaaagacaattttgatgagaactctggaaacacttttacagtgaacaacattggtcatataaatgatatagccattatatcattctctttcacctaataaactgtatctatatatacgactaactcaaattattggtacattcataaacacaaacaaagcagaatctaaataaaatttccattgttgatctgaaatccacactctggaagatgcttatggcaacttgaggcacaaatttatttgagaatcaacatagcatgattaatttaaaggtgcgcctgaataacacagaaacaatgccatatgcagtagcaaactagcaatagcatcaactgttattgtagatagtgacctcaatcggattgcacacagaaaattcttaatagaagttggacggcaaatcaatccacatgatgtataacatctaatagcttgagacagtacacataaacatctgagcttgagacaacaagataattttgcgtacctcgtgctactggacgtcgacgtcttcccatcggctaggtacggcgacggtgcagggaccttgtcgatggggtacccggctccggtgcggcggtaggcgtcgacggtgttgtgggagatggcttcggtgcggcagtagtcgtcgacggggtaccggctccgatgcagcggaagtcatcgacggcgtagtgggggaaggatctagtgcagcggtcgtcgtcgacggggttgcagcggaaggcgtcgttgcggcggctgtcgacgacgaggaagtaggggacggatctggtgcagcggtcgtcgtcgatcggtttgcacgggaaggctccggcgcagcggtcgtcgtcgacggggttgcgggggaaggctccggtgcggcggtagtcggcggcggctctggtagagtggcgccccgatggtgtggcggctggatttggggattagggtttggtgggtgagaggctttgtaaatatatagtggttgcacaaatgcccctgggtgttgttttgctcttcgttagatggaggataaaagtgacatttcccattctgatttgggcaaatgggcggcaatggaatgttttggggctgtcattggcggtaggtttaggcgccgaacgaaaaatcctccatccatgagtaattaacattatccataaatcgaaaacattcaaattatactaatctatctggattaacaatttgactttaaaaatatactccctccgttcaatattatataacttgaaaatttggattaagggggtgtttagttccagggtgtaaagtttttaaagtatacggacacacatttaaagtattaaacgtaaactaataacaaaactaattatagattatgcccgtaaactacgacacaaatttattaagcctaatccatccgtcattagcaactgtttactgcagcaccacatagtcaaatcatggcgcaattaggctcaaaatattggtctcacaatttacacgcaaactgtgtaattggttattttgtctacatttagcactcaatgcatgtatctaaacattcgatgtgacatttttggaaaaaaaatgtgggaactaaacaccccctaatattatttttttaaagcaactttcctataaaaactttttggaaaacacagacaatttagcagtttaagaagcattcaccgattaatcggaatacggttgtcagacggaatacggttttccacaacactgctttaagcatgactgaatttatttttagaaactagcacctataatatattataggtgtctttttttaattaattggcacctatgacaaattaaaggtgttggttttttttttaaaaaaaagaaaaccaacacctatagtattggtgtcggctcttctatgtcgcgttttccatctactccctatccacgtcgcgaaatttgccgacgctttccctttcccgtgtgtgggagccgccgccactgcactcgatggatatgatcagtgatagggaagggtgctactaaccgggactcgtctctgctgtggacgtctaccacaggggcgcggtcatcgtctcccatgtcatcgagacctccatgtcatcctcgtggttgctcacctcgccattcaccatcgtcaccgtggaatgcaagaacctggttccagcctcggtggcgtcgccggtggatctaaagccaagctggaggatgatcggcgacggaggatttgagccaggcaggtgataaaatcgtctcagtttaccattcatggatactccctccgtcccataaaaaaatcaacttctggctatgaacctggacacatgttgcgtccagatttatagtcagaagttggttttttatgggacggagggagtatataggtccaattgaaaattgaattttaaaaattttatgttcactttaatctgggtgaaccggtcggtgtttgtaggaaaaatgttggaccggccggttttaatagaacggaccgggtggtttggaccgacttacccctcattcttatcggtagaactcacatataacgagggtacaatcgtaaatcaacacacatataacaacggattcagatccaaaccaaaccaaatcgtaacaaaaaaaaagagcttcctcctccatggcggtgagaattagcaggaagcgcaggagcccgccgacgcgtgggctggggacctccacgacggcgtgctggagcgcgtcctggcacgcctcccgccggacacattcttccgcctccacgccatctgctgccgatggagcgcggccgccgcgtcaccacacctgcggccgcatcccgtctccgactccgactgcatcgccgcagtagcagctggtccaggtgccgcatctccaaggctgatgctcccagcgctgctggtgaagaggacctggtgctggccatgatcgagtagcaagcttctggtgcttatgctgcttgcttcctggatgtgggcgacaacagtagcttgagaagaaatgatacttctttgtacagcttggtgaattcagattgagatcgtgaatgtgaataaacttatggctgattattgtgttattttgaaaatgtgaagaccatatttgtgtcatttttttatgtcaattgaatatgacaattaagaaaaaagtgtaatgctttgaacagatgcttgaagtgtaagttgtgtttgtacagattgaaattggtttttgctgcttgaaatgtcatggtctgtacagttttagactgatatgcagtatgtcacttggaacaaatatatatgtacatcactttgcatactgtttcaccaggaaacttactggattgcccaaaaaacagaagtaaaatattttctcttctcctgaaatttttgacccaactgcttcacatattgttaggaatatgagttagcaccatgaacctgggaaagaaatcaaataaatgcaaatcattgctggtaacaactctgttcttaaaattgctagctcagaatctcgatgtgtttcagatatgcaatggcaaatgagttcacagaataaatcagttgtgacatctcagttacataacacaaaataaatgagtttatagctcatcccaattacatatgacatatcagatagatgacacaactcaagatataatttaatcatcatcggtgtcttccggcatgtcatcttcagcgttcccattgccactgtcactacagtactgcaatattgtgtcatctttatctgcatcatccctactgtcttcagtcaagttacttggttgttaaggtcttctaaattagcttcaataatagtaacttctccatcttcctacaaatggtctagatcctcatcagcattaccttcatgcacttcatgttctgtatcagaacaattatcatcttggtgtacatcaaaaatgtggtcatctttttcagacacattatacatgttcctatgttcgaatttctgcacaattcgccattcgttgcccaaagaggtgtcctgcaagtaaaatatcttcttcgattgagttgctaaaatgaaagggtcatccttgtaccaaaatgattggatgttgatggatttgaaatgcccgtcatccctaactcctcttgtcttgccaacttgattgaaccaatcacaacggaaaagaaccaccgatcgatagatatctagatcagagttatactgcaaatcaagaatctccctaaggacaccataaaattcaatgttatccccttcatgtgtaccatcaaccattacaccactattctgcgtttgaggtatttctcacggtcaacagtactataccggactccgttgacaatccaactctttactcggagatcaggaccacatgacaatgcaaatagtgcttcactgaccacccctggattttctttcctcagcttccagatctgatatatatatatatatatatacaagaaaaatacacatgttattcccaatttgaaatttcatcaccaaaaaatgatatttttgtaagtgtgtgtcacttacatgagtcttaaaccacctagcaaatcctttttcaagtcttctgtcaacatcatgtgcatcttctttctccaactcttctctatgcatgctgtagcaaattatgactcaacaattaggaaaatattatatttaatacaatacatgtgaaataaacctacataaatggtgcttactccaaatatggttgaacctcctcacagttatttagcacataccaaactagcttatccatgatttcatcctccatgtactgtatcctagtggatcctatgagtttaacaccatgcataaaaacagagctgttaccatccaatggcccatccccatgacgggcgtcccgattaaatctagtgtcaacatcctccatgtaccttgaacaaaatgtcaaggtgtcacttgctacataggcctcagtaattgatccttcaggcctagccctgttccgcatggaattcttaaaggtgccaagtcgtctttctattgggtacatccatccaaattgtacaggacctctaagtagtgcctcatcaggtagatgtacggccaagtgcaccatcacgtcaaagaaggctggaggaaaaattttctcaagtttgcataggatcagcgggatgtcttttttcagtcgtttgaggacatctatccttagatttctactacacaattccctgaagaagttaccaagctctgcaattgcttcgtatatatccttgtccacaaatcctcttatgccggcaggtataattcttaggagaaggacatggcagtcatgagttttgagcccctgcaccttggaaccatctgaacttatgcatcttgctaggttggctgcatatccatgtggatacttgacacctttgaggaagttacaaaactcaattctttgttccttcttcaagacatagcgagcttgtgggatgcgaactgagttgccatcctgctgtaagtgcaagttatgtcttatgttcatatcatgcaaatctatcctcgaattgactgtgtcctttgtcttgccctcgattttgagcaatgtgcccaaaatgttgtcacatatgtttttctcaacgtgcatcacatcaagattatgtggcagcaacaaatctttccaatatgggagcttccacagacttactttgcggctataaattagtggcccttcatcctctccacgttttcttttcttacttgtatcatgcttacccggtctaacatctttcaccttctctaactgctcgaggacctcatctgtgctgaattttcctggctcaacctggttttcatggtgtccatcaaaagcatggcttcttcgccaagcgtgtgtccttggaaggaaacgacggtggccaaagtagcctatcttatttcttagtgctcgtgacaacggatttttgtcacaatgaatgcatgcataataaccttttgtagttcgccctgacaaggtgcttagagctggataatcatgtatgcaccatagcacggcggcacgaagattgaactttctagcactgaatgcatcataagtactaacacctatccataattcaagcaattcttctatcagaggctccaagaataaatcaaaatcctttcctggagatgttggacctgggatcagtaatgacataatgcagttcgatggatcgacagattcccatggtggtagattcaaaggcataacaaggacaggccacatgctatacgaattgctcaccttgccaaatggattgaatccatctgtagctatggcaagcctcatattccttgcatcttctgcgaaagttcgatactttctgtcgaagtccttccaagcctccccatctgctgcatggctcatttcattatccactggcttccgcttgattttgtgccactgtgtgtcttcagctgttcgttttgatgcaaatatcctctttaacctggataagtggaaactgcctcaaaactttgcgaggaaccttcctgtcgccaaccccatcttcccatctggattcaccacatattgggcatagatccatattggcatattccttccgaaatagcacacaattattcttgcacacatggatcgacacatatccaaggcccaattcacgaagatatttctttgcctcatcataagattttggtaattgacattgagggaatgccgaggacaacaacttcaataattcagtgaaagctgtattgctgattcgataatatgacttgatatggagcagcctcacaagaaaggaaaatcttgaatggttagatcctgggcaaagtgcctgcttcgcatcttcaagaattctagcaaaccttggtggctgtccatcttcctctgccgcagtgtatagttcacctattaactctggaactccattgtcatcctcggattcatacccgcccacatctgtcccttcattatggttagtttcatgtacctgttccaaatattcgacatcttctgtatcaactaattctccatgataaatccactgggtgtatgttgatgacatcccaaaaatatgtatatgatcatgcatttcttgctgaggcagtgaagtgtggttaagacacctacagcatgggcatggtatgtcaacgtgttcatcaaatctttgtccaacaaattccatgaactgtttcactccctccatgtatgcaggtgtgaattgtctcccatgtatccaagttctgtccatctgctttggcatgttaaaaaaagcaattaggcaaacaaagctaatccattttttaggacagaatattttctaaaacattagatggaacagctggttgctacatgacttaaaccatgttgatttgttcataatactctgacttgtttatctgttcatacaacacaaagcataatctttcatagctggacatgcatttcatactcagagtaatgtacttatggaaaatcataccttatatctactg

SEQ ID NO: 72014 - DNA, 2451 bp, Oryza sativa
aaaataaaataaaatgaagaataaattacactgtgaactatcttttattaccaaagtttcattctagaccatcttttatttttttttcacttttcgctaggtatttttggttttttattttactttaaccacccaaactttcttgttttgataaatacatttgagagatccaagaaatactgtagaagaaagttttttaaggaaattaatttttagagacataaagcaaataatccgcaacaataatctagcgaagtagctaaacagaacatagccttaattcacgactagacatttctaaatatgagagctttcttagagggttcccaattagtataggaataaaaagatcaattgatcgatgtagttgcttctttaatcgtatgaatgaaaaaaaaatgtggataaaacttttatatgttattagcagtttaaaagcaaaatgctggaaatagagcacgatgaaaaaaaaaacaaaatcaactcttaactttagtttcaggtgataaattaagtttcgaggttgccactctcaagatctgatccaagggatcaaagatgtagtaataaatgtttcatccttgtttcatcaagttctacggagtactagcaagggtcagccacagatataaagaaatgaagtgccggggaaaatagaagtccatagatcgcatggtgcatggtgaaattaacccctgaaagtttgctgatcacaacaatattctactcctacttggttcagttctctgtcttgttagtaacatcgtacattactttacatgagtaagaaatgggcagatccgtaaaggataccgtatcacaggcaaactagaaaacgcagcttacaaagagtgcaatatggcggaaaaacaaaactattcttgaaagaatgaactaatcagtctattacctagcaactccattttgatgatttatggtcgatggtcgccaacttctctgatgcagatgctcaagatgacacctacgcacaatgatccatccagttgctgatatatgagcataagaatgaatgcatgttcagtagagcaccggatagttgtcagactccgcatcatattcatacggataaggctttcatgtttgtatctgcccagacttggatggttgaatttagtacttgatcacatgatgtcgcaaccatagttcatacataaccatgtggaacgcgtcgtaaggaagaggaggtgaatgccacacaaagtgtttctgtacctgcaatcccaattaaacatgttacagtatagtaccgcactgctgaaacttcagtgcctctaaacaatggctgaatcaaattatttacacgcaaacagacctgagggcagctaatgttctgaacaagacaagtgacacattacaatcttgaccaagtagcttatttgtactatgaatgtgatctactatatttattttccattacagttaagtacaacgctgaattacatgcttccttttgtaaataattcggcggcttcatagaaaaaaaggagggtcaagagttgcaaacctgaacaagagatttgtgcaattcaacaaactcttcctgtgatatagatttaagtatactttttagttgatatacatcacgctccttaagtacaacagcaaattttctccagtctaggatatcattgaaaggcaaatcgtagtagtctgacaaaataactaaaaggatgaaacaaaatggattagaactcaataatcagaagggtactgaaaatatcagttcccgtgaaataggaaaaacagcataagtagagtggcatgtattatgaatgtcactgggtagaaatactaaccaggaacacaaccgtagtgtattgaatcagatatacgggcactattacttgagagccacccaggacaaatacagaactttgtgtggtagaactgcttctggtaaaccagctctccaatagctctactgatccgattgttactgatagcaagctctgtatcattctcccagacttgtgccaaaatgactcttattttagaattgcgatggccagcccaaaatccaaggattgtcctgttgccatggcaaaagcaacaaaagacaaattttgtaggagtgcaaatagatgttcaaaccatagcatcgtcacaaatttatggtcatgacaactttcattttgctacaaggtgattcgttgcacatgaacaaagtgctgaactaaatgtaaaaccatgtagtcttctgaattaatcataggttgtaagattcaaggcatgatcaacaagataaccacgtgagtaagtgtgagtgttttacagaatttctcaagtaaacagatatttttcacttgaaggcactattactagaaaagtctagaatcatacatggaggcacacatatatagtcagtctaggaaaaagaatcattcagaagtcccaaatgaacaatttttttatgaagacaaccatagaaga

SEQ ID NO: 72015 - DNA, 624 bp, Oryza sativa
  unsure (1)..(624): unsure at all n locations
aaatagcctgtaatgagttatatcacaaaacaccgtaatggcctgacataattgataacgacaacggcgaagttatgaacgtactcacggntgaaaattggccaatttctggttaaattaattatgcccgttggagagccgtccaaatcgcgctgacacttcccttttgtaattatccgcagtactatatgactagacaaaatctgctgccgatctatgctcctttaaagaatggaatggcttgtcaccagcatcaactccccaaaattctgacatgtgagactattgtccattccctcttaaaattaaatgtacggtaaaaacagaattaattgaaacaaatcaaaattgtttattgttggcgaggagaagcagaggagtggatggatggtgcggatcgatactcgatcataagctcgttgcggtcacaggctcgtctcggtagacgtcgctacgctacggcaccgctaatctcgactccgtgctattaagttaatcacatcgctaatctcaggagttgggtggggcccctataatcagaggcacggtccgacaaaaccgacatgccaagagcaagtataatagtaagctataagcctactataaacttatgtagaggagaga

SEQ ID NO: 72016 - DNA, 2406 bp, Oryza sativa
cgcgcctgtcgcccgtgtcgccgctccgctccaaaccacccagccgtcatcgccgtcgtcatcgcccggcccccgccactccgcgcgcaagctgccaagggacggaggcagagctcctcctccctctgccgcgtcgcccctgctccctcctccttttcccgaagaggcaagggggcaagcccccttttctctccctcgtttcccctttttcctcccgccggcgtcatcctcctccctcctccctgtcgccgctttggccgcgactgccgagcgctagccctctcctttgaccgccctaagtcggttcccaaaccgacattgccgtcctataaacccaagcctccccctttcctttcctctcccattcgcctccacgccattgccgccgcctcccgtgctcttttcgccggtgcgttcgtggacgcggaaggggactccgggcgcgccctctccttcctcttcctcggcccgaggccggagagattactcccgcgccgtcagcctctcgtcactgcgccccgtctcgcacggtagtgcatctctccgttctccctcctcgttccatctctcccccttagttttcggtagtagctcgagtagcctccccgtagctagccggcgccgccccgaccgttgccatcgctcgccgagtgctcgccgccgtcgccgcccgtgctccgtagcacccgctcgtcgccggcctcgctcggcgtagctccgcccaatccgacgctagcaacggattcccgcggccgcataaatgctctcgccgccgggaattggcccctcgtgacctcgtcgccttttcccccttcttccgcggccgcttgccgccgccgcaattcgtcgccgtcaagttccctccgacgaatccgagccgttggctcgtctccccttgtcctgtgcaaccacccggtgttctcgctttcgcctgtatcgccgtggttcgctccgccgctcgccgctgtcgtccgccgtccgttccggccagcgtcgtcgtctacctcccgccggcccgcgtggcagccacgtaggcgccacgtaggcgccacgaaggcgccacatcggcgccagctcggccaagaccgggtcgagccgaccccggtcagcccttcaccgtgcgcgcgttccaccgcgagccgtgaggctgcgcgtgggcccgccgcatccgttcctccgcgaaccgcgcgcgtgcaccgcgtgcaccgcgtcccagccccgcccgcacgcgtgcgccgcgtgctccctccgcacggtgagtcgagccgctgacaagcgggtcccactcgggaccgcgcgcggtgagcccggtccaccggctctctctctctcctccctcccgcgcgcgcgctccctgggtcgccttgggccgcccggcccatttaagctcggccgagccgccccaattctctcgggcagcgccctagccgcccgaggaaagtctaatttccctccctcttctcttttcttttcttttcttttccaaaaaggatttaattaaatccttttcccttagaccaaaaatccaataatcttagaaattcaatatcttcccaaccgtaaatccgtttgactccgtccaacttccaaaattcctcaaatctcgagatctacctaatggcacgcttagaggtcattaatagggctttattttctccatttgttgagttgtcccgtttcgcgtgtagtttcggagcccgaagacccgcagtgcgaggatttcgaggatcaagctccagatctcgagcaaggcaagccacctttgaacatcttgaggctatatttgaaatttaattatgttgcttgaaaaatattatgcattgttaggatcgcacttaatctgtttgtcccgtctacaaggcagattggcggacctacctaatttgttacatttgacccttcctttgttatttgttatatcatgtcccccttgtatccatctagttgcgtcatgatattcgtgcacccagtgcgagtatcgacggacgccttcaaacttaaaatctgaaaaaaacaacttgggtaaacttgggttttacaaagacttggaaaacccgacacctgggtcggtgcttgcgaattaaatgaatttccaaaaccgcggatcggggaacgtaccgggtgtacggctttccgctctcgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggagctaacctgttgttggtctgggacccctctcgtcggcatatggtaaacctgtgtcggctttggaaatgccttgtcatg

SEQ ID NO: 72017 - DNA, 1678 bp, Oryza sativa
tggcacagggcgactggatgttttcttccttggagtagcctgttttggtagtttcttggttgtctctcggtctccaggcctcctggcggtatcatcggcttcgtcgtcacttagaaccagcttcctctttcgagaatctgactggccaattggatcagaagcacttggttgagtttcagacctaattcttggtcctccgctcccttgcccagtttggtggcggggcgatcggcgttgagcgattgggggatccgacttcatcaaagcaaattcctgggtgtaatatccttcattgttaactgattcaataagaaagcaagatcatattttgagaaaggttgaagtgtatgaatacgtaccggtggaggaggattgaatgcattgaacggtacgactagcagcaagtgtgagtagctgacaacgatggcgtttgagaagatcttatacatcctttccttcatgaccttgaagtcaagagaatctggatcttcacggtttgggtcatgcttgccgtcaaattcgaaggctgtgcgagatctttctttgattggagctaactgacacttgataaagtaccgggtaatctgttctccttgaaggccctgttctttcagctttatcatcctctccatcagttctactgcttgtgcagcttcgtctcccattggcagtgagttccaagtatcccgataaactggaggaagacaggagtattcgggaagaacaggctcggggttttgaacataaaaccaatttgcgtgccagcctttatttgaggtcttgaagggcatggagaagtatttttggcttagtgttcccctgagttgtaaaccagcacccccaacgacgcatggtttactcttgtttcgttggggcttgaggaagaagatgcggcggaacaaggcgaaatgaggcctaatgcccagaaaagcttcgcaggcatgaataaaattggcaatatgcactatggagtttggattcagatgatgcaagctaatcccgtagaagtttagaattccccggaaaaatcttgaggttggaagagaaaatccgccgtagaagaaatgagcaaataccacgatttcgtgtgtatcgggggtctggaatgcctcaccaaatgccagtcgccacccgatgatctcttttgctggaagaacgccgtgcgccaccatctccttcagattgtcttccgtcacatcggagggcgcccactgactctcgaagctttctctttcttccgccatgaatgtgaactggatggtctgatttagttcgagatacggctagaaagggatggggaatcggagcggtggatgcggggagaaatttcgtgaagtttttgagggtggattggagcggattgatgaaccctagtttgcccggcgcagttttgcactgtagcaggaaatagggaaaatggtgagagtctcggcggggaagacgaagagacgtttttcacttcggtattattagggtatcgggagtattaatgggcctgggcctgtacagtacttcagcccaatactataatcagcgtggcctgttgtgatctctagggacttaggcactttttgctttggcaatctgtgttcacgatggtgtggcccaatgctgttaaaatcctttttaacgcgattcactaattctttggaattattatgatgcacataaaaaggtg

SEQ ID NO: 72018 - DNA, 5177 bp, Oryza sativa
ctgacactgttctcttgtggctggtgatcttagagcaggggaaagaggacatggtgttgctgattgaggtaacaaatgatcaatatggtggtcgactcaggccatcagttcaaggatgcccatatggaggcgatgctgagggggacaattcatatttgaggtcgtttaggtatccaaatatgtgctacaatacgtgttggtatctatttggatatatctttagtatatgattgttttttttttcaaatgccttcggatggaaagaaattttcatatcagagttgtagattccgatgtacatcattgtaatggacaattttcatatttaagataatcgatagtgtacacattatatgttttggatagggagattaaaaaaaatagaatttattatagtcaagaagtgctttacatgtgagattgtaacaacgctacttaaggagtcctttggcaagtcaaaggatgatatcaacgcctccaagagcgtgtattagccaaatcaaatctaggtcaaagtatagtcacaggaaacagggttgaagggccgaaggcagcattccttgacccagaaaagatatatccccatcccaggaacgagaggacattatcgttaccacatcataaacctctcgcaattagcgtatcacactactacagaaaacacatacagttcaatactatatgtgccggaacagttaaaaccaataactacagatctcttcccacctttgcatggtgaaaaaaataaaataaaatcgacaccttttaccaactataggtgttagttctaaagaaaaaccagcaccaacacttttaagtcccatttttttaacaaaacggtacctatatatgtaggggttaaaagtgtcagtttataaaataaccaacactttaatgcagccgagccgagcggagagagagcgagtgaggaatccttttctcctccccatcttttctgcgtctcccccacccctcattctcttccgcgtcttccggttgtacgtataacaaggcttgtctaaaagaagcaaatgattaataaaattatatgtgggtaattctatttgatgatttcgcttgaattaatataaatgtgtgctttattctctatgaaatttaaagttagtactataaataggtaggttggtccactgtttatggcggagctcacctagctagctattccacaaataactggcacctcttaaaggaaaaattcagagagaaagattagcaagaagggatgaatgttttcttgtatccacgatctacagtgcttatctgtacagccacgggcaatattacggttcatgggaatgggaggcattggacttcttctgatatgttgtatgtgtacaaagagggttgttcatgcagtttgtttgtatgtttgggactaatatatctaacttactgtgcatttttctgaataagtgatctcaaatgagaagagaacacccggaggtgaattgttggtccactacactggacagggtcacctgtgacgggcccaaaccctcacctttaacggctttggatttggtcagtgatcagtggtcactggtgagtccagtcacctttgacgggtggaggaccgtcactaatgacagtcacctctgatgggctagaactctacggcccgtcagaggtaagtgtctgcgctaatccatgccattttgcaacccgtcacagatgactcacctgtgacggctcggagagtaaaaaccgttacaggtgtgtcacgtgtgacggcatgtatgtgcaaagccgtcactggtatagttacctgtgacggctttttcaatatgaaccgttagtgaggaggtacatccagaaaaaaaaaatttctaaatattggctagccctaggatttgctagccaatatttagaaattatatatcagcagcagcacaaaatatatccatcacaaattagccagaatataacctaaatttctcatcaacaatatatccatcaacctaatttgcataacaaaatttccctgcatttccaaatatatcacatatattcccaaattccaaatctatcacccatgacagtaagggacaaatccatcacacacatgagcaaatttttctaaggggaggagggaagaagggggagaggggtgtacctctgcgttgggccatcctcctctcctccacatccgccttgccgccgcgcaccgctgcccctctttacctcgccgccgcaccgtgccactgtcgctgcaagaatcatcggatctagaaattagagaagggggaggagaggagaaagaagggggaggaggatggggatggatgcggcgccgccagatccggtggttggggctgggatccgcccatgagctccagatcccgccggcgcatgcaatctcccggcgaaggctggccctcgagaagaacggctcgcggtggagaagccagcctccaccttgcctccttcgacccttccctcgcgccgcgccactgccgggctgccgcccctatgcctcccctccagcccctgccggatgtggaggaggggagggcgccaccgccaccgggccgccgcgcctcccctcccgccactgccgggccgccgcgcctcccctcccgccactgccggaccgctgcccctgcgcctccctcctgctcctgccggatctggaggaggggagggtgtcgccgcccctgtcggaccggcgccgccaccgcgcctcccctcccgcccagctgcagaacaatcgagagggagagggagagggagagggagagcgagtggagagggagagaagaatcgagagaagtggagaaccggtcttatctcctctaggtgtctgccccgttgggagaaaatcgagagaagtagtggagaagccggccttacctcacctttgacggccatccgggttgcgatccgtcacaggtgactagtcacctgtgatgggttgaaaatgaaacccgtcataggtgaggtttacaccaccttcgacggtttccacttccggcccgtcacagatgactagttacctgtgacgggccgtggccggatggctcaccgatgacggcatcccgtaggacccgtcaaaggtgaccttcatcagtgaccgttttctttgcccgtcagagatatgccgtcagaggtgtgaggatctggcgtagtggtcttgcttgaaagtgtttatggattaattgatctcgaaatgcgtgtgcattgtttcctactagcacatttgaagatagcactgtacagtgtttatgaaattgctgtgtggttggtcacgtatggtgtgcagtgtttatgacagagttccacggctatttcataaaagcaggcattaatattttattaacaagagaggttttacattgtttgcattttaaaaataaaagtaaacatctaacgctccacagtaaaagataccattaagaggtatttaaaacctagcacatgtacttaggtagttagggtaaaataataattgttctaggagattgagaagggtttaattgtttttagtattagttctagctacataggtacctatcggtaattgtacttgtcttgtcttatcttgttatttacgtgttcgtttttgagatttatatttcttcgtaagaacatgttcacaggtaatcctccgttacattatttaaatgttttgtagaattaattatttatcaggatttacttctccctctatttttttctagtaaactaattcaaactctagaataggaatgaaatgatgtgggagaaaagaaagaagatacaatctgatttttttggtgtgtagatccaatcggtgcttaggaatatttacattttctctaatgtacatgcagtaccgttcaatggagccaggtatccaattcgacaataatgccaatatttcattagttaattactccgctatcaatatatactataatttctatttcatatcttgcccctctacagatgaactgttcatattactccacctctcaatatccctaaatatctcgtgaacaccatagaatctgtcgactatatatataggtcagggcatcaaacaaaaattgcttcaactgcagaggtagctctggttgagagagcgggaaacgtaaaattggcaagaaaattaaaggttgtgctcttattcaagcctgcattcacaggaaactagtgatttttcattttttattgcccgaaagtagtctagaacaactttggtgaacaataatttatacacgctcccttgtgctttagattacaataagaggctcgacatctcggcatctgctaggttcctcgtttgtaaccctgcctctaacctatataagatgggtagggagccctcgaagaacatgagcacagagatttacaaccagatcatcagatctatactatacctgttgaaacaatatttcagcaatataaaggggtaacgcacaagacctaaaagtggatggatgcggagacaaggatttaaacaggttcaggccctttcgatgagaagtaataccctactcttgtttgaggatttgaatccgccgggtatattatagatctgacgatttagttgtgaatcatctgcccctagaggcctccttcccaccttatataagatggggggcagtattacaaaatagaaaccttaaccaatacggtatcagtttcctaaatctactttataatattatcaaatcaggactttaggccgttccataatatacaaggaaacgtaatacccaagtcatgatccgttacatatttcataaaaataagttatcccctataaccagtcggataaccatgccgtgtgggtattgtcagggttacgggttaggtataccctttaccctttgatatacgtcacatatcgatatggcatgtccacgtgtttatgaacgatcctctacctacatggaggaaatccttcatggagttacagatggaaagaatcctactcggacaagactgggtcgtcaatgtatcgtgtagggtccgatgtctccgagttctacttggaaaccgcctgacctgcgatataaaagggaccccctgagaggacctaaggcatcgaatctcatagccaacacaaccaccacagcctatgaagtcggagcttgcaggagccaaatcgccaggagatctagtcgaaccaactcgattacgatctcgtcggtttcatcgagttccatcgttcc

SEQ ID NO: 72019 - DNA, 30088 bp, Oryza sativa
  unsure (1)..(30088): unsure at all n locations
ccggtgggataaaaacctcctcctctgcgccgtcccggtggctaggatccgcccccactgagctccgcctgggccccgccaccctccctccctgggtgtgaccaaaccctgtgccaccccccccctccctccctgaccaaaccactaggtcgcccgcataaagcattcaatcattcttgtgttcgagaattgaaaggaaaactaaaagtaaaacatcatcagcatgaaagctccttgcagcgtagtggttaagctagaattatggttagtcacaagtcgtgggttcgacccccaagtgctgcagcattttttttagaaaaaagagttcacatgggctgcacagattcacacatgggctgcacaaattcacggactgcacaaatttgggctgcgaaaaaaaagttcacatgggctgcacagattgacacatgggctgcacaaattcacgtggactgcacaaagcatctgctggcccgaaaacgcacctatgctgcatatacaatgtggggtccaataacaatctggatagccacgtatacaatgtggggtctagtgacaacctagatagccacatatgcaaggtgggaccaacagcagaatagagatttacttacaactgacgaaatatatttcagcatattgtattaataaaggagcgtcataagtgtgttacatgaatggtgcgcaccattttgtgacgaaattatctattgttttatgacaccattttaaatttcgtcatggagtttcgatgtctaccctccgccatgagtgatccatgacgaaacatgaaatttcgtcatagatatgctgtattcaatgacgaatttatacaacgtcatgagcaaaacgtcatagatggacgatttcctactagtgtgactagcttatctgggagatgctttggtgccggtatagtgtttgcttatgcaattactctatgtcatgacgatgatattagagtagtatctggtagtttaggcgtggtgtctagattacgggatatcattatttggggttatatattgcggatgagatgtgggccgctgatggtgacagctcagtacgggtattcctccgcgcctatatataatcctaagctaatttcctggggagggtaatcctccgtatttagcctcggttggatggtcttgacaggctgtcgtaaggaactcggcagtcaggggtggcttctcgaagtaccaggagggcatcggatagagggtattagctagtatatcagttaactagaatgtatgtataatatgtatattagaagtataggaatggattctttttcttttttctttccacctagcttagattatttattatgaggatgagtagttaaatgcttgtgtgtcactctacccttagattatcttaacccctgcttagaatatgattatcacaagtaatatataaattattagttgagttctctctacatgatcttcccaccggataaaataaatacgataccattggaatactctcgagtgaaatgctacaatggtatatgcgtgcgcttgcggatgaactctataaccataatataccagaagtatttcggcaccgttgctgggaattatatttctagtaatgtcgttaataaacaccaacacccactacatccacttctattggtcgagttaaggctacacctggttcttgaccagaggtgtagcgatactcccactacccttacttaaagtggttgagttaagactacacctgtttctcgaccagaggcatagcgattctgccactatttctactttaagtggtcgagttacgactactacctagtcctcgaccagcggtgtagcgattctcccactatttccacttcaagtggtcgagtgaagactacacctgattctcgaccagcggtgtagcgattctcccactacttccactttaggtggtcgagttaaggctacacttgattcttaaccagcggtgtagcgattctcccactatttcctcttcaagtggtcgagttacgactactacccggtcctcgaccagtgttgtagcgattctcccactacctttacttcaagtggtcgagttggggctacaactagttttcgaccagcggtgtagcgatcctcccattacctctactccaacaaagttgatatcaggtacacaatatcgccaagtgttttacccagagatcccttaccacgacgacacttagagttgaaaccaatcctactgtccctttacgccgccctggcaaggcctccgaggaacctatgggaactttggctggggacgcctagagcagataaggccttgtcaggtaatacagagacgaacgaccatgtaagatctggttatgtaagagttctcaccgagcatattaaccaagctgtgtaatcggaaattgggttttccaaattcactgttgggggctactgtaagcgctttttcaaccaaggcaggtcaagggtccaagagccttatccttcgagaacgattctccgatgacaaggctgggggctagggagagtgtatgactcaacaaattgactgatcgaagtccataaaagagaagatgctcgtacacaaaacattggtctgtaaatttttatttattttagttttccatacatattataacatgtcaccctttgagcgttcgcttaggggctatttctatctaatattcttttctaagtattgatttcaggaaaattctattcgacattcttgaagactccatgtctctatggttctacaccaagatcgactaaggcgagtacgacaaatgttgacaaggcttcgtcatagattctacgccttctcgatcgctcgagaacggttggtggatctcgacaaggaatacggaatgaagagatggtgtacccgccgagataaaatttcttgacttcaatccaaattctcgattacagcaagacggaagacttagtcgtatgctctgtaccttcttggttgacatcagagattgactcagacaaaccctatacgatgcccgcacgaggcagataagggaagtctaacgttatctccgaactcaccgagaacggtcacgtgagctcgacaacagttattccaaggtctttggattgagaatatgaacttgttaatttgcattgaagtcgtgggctactgtcagggttatggataccacatagctgggaaccggctcatctgacgttgtggaggaacgtcacagcgtaacgtagccgaggcaatccaccgtccaatctaatccaacgcctctctgctcattgctctgtttgttaacttaattagtgttttggagggaaaataaacatggtaactatgtttgccgccaaaatcacagatcgcttccccttctcttatgtgctcctcctaacagaaccttgaattgacaaggtttggttctaatcattactctgcatctctgccacaagcccataacatctcgcctcattcatatcctgaaatcctgattggtggagacaagctgcaaattccgatggaaaaccagatcaatgctgattaaaaccaggagggaaatcataatggtgactagttcgattatgcttcacaataatgttgatttcatcacctgtttactcgtataataaagatcaaaatgatccggtagataaaatcataatggtatatactctgaacaacatattatttggagcatgggttcagagagcatgaaccggcagtgaagtgcaacatatatactagtccgtagtcatacaataaacatatctttgaaaattattatgcatcaatagtttttttttctgtgtgttttcgcagagcaaatcccatacctagttggatacctcaaataggcatgaagttcagcaccttagatgaggcttgtaaattctgggagtactatgaaggtcagattgggtttagtgtcagaaagaggtactcaaacccaagtaaatttgatgggaaaattacttcctgcagatatgtttgtagcaaggagggtcaccgggtagctaataaaagagatcacagtactaagcaatcgcgagctgaaactaggactgattgccaagtctgaataggccttacaatagatcaagaaacagcaaactatgatatatttgatcttgttcttgagcacaatcacatgctccacttgaaggaaacatgccaccttatgccatcacaacgaaagatttctgaagtccaggctttcgaaattgaaatggccaatgattcaggtattggacccaaagctgctcatgaattagctagtagacatgttggtggatcttgcaatctcagttatactcgttaggatcacaaaaattatttgcatactaagcaccaaaaggagctaatgtacggtgaagcaagtagtatgttaaaatactttcaggacaaagtcactgaaaatccatctttccattatgctgtacaactggattgtgaagaccaaatcacaaatatattttgggctgatgctaaaatgattgttgactatgctcattttggtgatgttataacttttgacactacttttgaaacaaacagggagtataggccatttggtgtattcactggattcaataattttagagaaactgctatttttggtgctgccctcttatatgatgagacatttgagtcattcaaatggctttttgatacttttctggcaacacataatcaaaagcaacatagaactatatacacagaccaagatattgcaatgggaaaggcaattgagcatgtatttacagaagcatggcatggattatgcacttttcatataatgcaaaatgccaccaagcatttacctagtaataggaacagtgaaacaaatatgcttacagaattcagttcttgcatgtatgaccatgatgataaagtgaagtttgaagaagcttttgatgctatgagaaagaaagtacaaaaacaaacatggcttgatagtatatataaagtaagggagaagtgggcagaatgctacatgagagatgtttttacattgggcatgcgaagcacacaattaagtgagagcctgaacaatgacctgaaaattcacttgaaatcgaatcttgatattattcgatttttcaatcattttgaaagggttgtgaaaggcaagagggacaatgaactgaaatcagaatatgaatccagggaaaaactacctagaatcaagatgaggtcacccatgttgctccaagcaagtaagatttacactcctgtgatatttgaatgtttccaaacaggatatgagagatctactgtggcatgcactaatgtattagatgggaactaccagttcacagtagcaattggtattctttctgatgatccaatatttgaagaggaatacaatgttattggcaatatttctacagagacagcttcatgcagctgtggtcagtttgagagaatagggatattatgtgcccatgtatttgaaggtccttgatttgatgaatattaagttactaccacctcattacattttgaagcgatggactcgagaagcacggtctggaactattcaggattgtagaggaaagaatattattgaaaatccaaatttggctgcaatacttcgttacaaagttctttctcataaatttgtcaatttggctactgaagcagccaactctgaagaatgttgtattcttattgagaatacactcgatagccttagcaagcaagttaaaggccgaatgaatgcatgccaaagtaatcatgatgctgaatgtgatgagcaaatgatcctagaagcaccaaaagtacatctaagagctgcacggctgaagaagaaccagttcagaataaaagcttaaagagataacgaaattggactaaaaaacagcacaagaaaaacaaaaaagcacctctaaagttactgctgcacatcaatctcctactgtatgtttctttatcatatagattgattttcttgccttatttttttcttattgtgaaaatatatcatatttcttgtagaccttcacactattatgttgcccaggaacaagaagatgggaacatatcggcacaaactcaattaccagcagagaattcttgtagacaagaagatgggaacatattagcacaaactcaattagctgcagagaattgttgtagaagaaatgagaacgatttttagggatatgagttcatcagtagctacactgaactactgatggtagacttctttgtacaattccaattatcttgtattttaagaaattttagaaacgatttgttgtcctatgctaacttattctcttaacaatgcagggttccagtgtagagatttttgatcattacacgactttgtaagacttgttgcttaaagatccaagctattattagaatttcatttattacaatatttttattcagttctgccacatatttgcagactcagttgtgttataaaatggataccatcaatctaaattttttgagctaaattgtttgaggagaagtttcagtgtcctagatgcctagtagatgaatgaagccactagctttgctgttaatcagttaattagcgtgatcatcagcagttaattataactgagtgtctctgacaactaccaacttgcacttaacaaatagagcagtgggcagagaggcgttggattagattggatggtggattgccccggctatgttacgctgtgacgttcctccacaacgtccgatgagccggttcccacatagcagatagtagttgactaaatcacggcaagacccactatataccatgtcttatacggaaacaaccttcggatataggaggagttccggataaggaaagacaactagagttctacttgaaaatgacaaggactactcggattgtatccatattggtttccctagttctatttggacaagggatacctatgggtataaatacaaggccccctaggaggagaggggacacgaaacaatagatcaatatacaagccaacatacgccaagacaagccgccggatatcaacatcggagataagcctagtagtccccatacggtagctacgactaccgtcaagagggatctaacgctgtctctgatctcgctggacacggattcgaggaggaagactactttattgtcgactacgtgtcagcacttcagaccgccatatcgacaacagatagaaaggctaccccaaatattctactggtgtgattatggtaaataagagcaaagaccggcttcggccaacaggagtagggttgttacctgacaattcaggggcccgaacctgtataaaaatcctcgtctccatcttttttactacaatctcgcatatatcctagtaccaacattccccatactatgcaaataccggaatcgcgacatcaaacgtcgacaatatcaatgcaaatttgataacatctagcactggagaagctgagagatacttaattttacagtaaaaaaatttggtacctcttgagaatcactctcatatcttagtccaaaaattaaatgttgtttatttaatcataagaagacttgcagtttagcagtattattgatggcactagcagactagctaactgaaccagagcacaacaatgtgatgtgaggagtgctgctcatctccacaattaagcaagcagatatgacgtgagccatggactaattgaaccagagcattacattgtgacgtgatttatgactaagctagatgtacactgttcatatgctcatggaagttgtgtaacaaacttgttgcgcctagcatttttaattccttgagatttctcactgttctttcttggcaacattgtggggatgatcgggcacggagaacaacctttttttttccattgtgaaattttctgcttatttctcacatcgattcgtgggttcatcaattaataagaagccttcaggatcacattatatatgcttacaagaaggaactctgaagttcagagatgttctggcttccagtgtcattattcaccctccgaggcaaaaattatcatgcatagtgcaataatcaaaaaacctgtgtattgggagctggttgttgtatatacaatatatactccttatgtttcatttttatgacgttggttacaacatatcagaacggagggagagtgtaaaaggaggtaccaatgacaattatcctcttgttaatagaattgaaaggagattgtctgcaaactcagctttcttgtcttatggtgatcgggttgttggtgatatgccctatagccaattataaagatgattgtatcacatactatgtttatatatttattcgacattgttccttgaaatagataactcactattattagttaatgaatatatgattctttcatgggactatttatgttgtttgttactatttctaaaggatccctgatcaaatatcatatgtagaacaaatatgtttaaatgatcagcacatgtattaattgacgatcatgtcttatggatcatggtatagagataccaaattaataatgtggacacgtgttggtgaacatgttgttggatagacccaacatgagatactgcaagagccatatgtgttgtgtcgtcagtgatctcatttagtgttggtgttgaatccttagacctgagattatcatggttcccaacatatgtagtagcttacttagggactgctaaacgctactccgtaattgggtagttataaaagtagttttcgggtatgctatgaaacatgtagtgggatatgaataatcaagatgggatttgcccctcctatggagagatatctccgggccccttgatgttatagattatggaagtgcatggccatgccaaaggtgattgaggagtcaatcacaagttatgtaatctatcacaagttcgagtgaatgattgagctattagaggatggcacatatatagccttaagcttaatcgatatcgtgaggcaaaggggttcatataagtatacactagaggtttagtcgatacgatctttatgtacgtccgtgggtcattacgttctgctagggaccgctgttgacacgtggaccgaagaggagttattaggttacagccaagtgtatatgaacctatagggtcgcacgcttaatgggccggaataaggggattggatggagatccaatataatcttaattcagataaggatccgaataggagtcctacgggccttcgaggcccaagtcatggatccgatatattcgtgaggggcgtgactggtggaggtactgcatcacatgagaaaccctagccgtcactctcctccccgagcaaaaccctagccgtgcacaggtgctagcacatctgcgcgtggcgttccgcccctgtacgtgtggataccggtagaggcgccgctgctttgcggtgctaataggcatgggagtacggcgaggagaacgcacgaggaggagaaggtcgagccggtgcgatcgactacttcctctacatcgacgcgccctacttcgtgaggattccttcgccttcttagcgctttattccactgtgcagcgcgtcgagtggtacaatctatgatctaatacttacatgattcctggtttatgcactagaaaattttgatttatactattgtagcctgcgcgtatcccaacaaggcatactctacttaattcagtttgtcctccttgccaacttgcatgtgcagtttaatgttgcctaagacaatgattgataatattgatagggcaaggaaacattttctttggagaggttcatatgtgaattcaaatagaaaacctttagcagctcaggataaagtttgtaaacctaaagtaaaaggggggcttggagtaatcaacatttctatatagaatcaggctcttttgttgaaatttttggataagttctataatagaaggaatgtgccatgggttgtgtaggatcgaacacaagctaccaagcctaccagaggggggtaaatggtagggaaaaccaaaaacccaaaaacttttagcgcaaataaaagttaccctcaaattgatggaaatctcgacgtagtcctgtcgccgccggtcagaccgctcacacaccgccggttgaaccaccttgctgccgcctgaacccgaagaaacacaaatcgaagaacgctcaaagtagatgacaacaacaacagcactccttacaaaaatctcgactaaactcgaaaccctaactaaactatcaactccacgctctgaaaagcgatacaagaagcctcacgctccctctctatttatacccaaaaaaacccctactaaaaataggtgtagaaatcctattcacaattggactcaatacctcaattaacaaaccaatttacaattactaaaacgaaactacagccggacgcatctcctgtgtcggctcggtctcggtctcctattcctccacgcgctgacccttcctccaatgagccagcaaatcaccaagcaggccgccaactcaccacctgggccggccggtctacaacacaagcaagcccacgtgcacatcccagccgaggcactgatgcttgccttcaaccagtaagccatcaaacatgtacaagtcacaccactcatacatgcatccctgctacagtacctcgtgtactttagcacatcttttcttcgtatttccttcacgaacaccgacacttgcacgtacacgtgaagcctgttgcgaagatctctcccacacggtgtccatccaccgtgtgccatctcgtatccaacttcctcacccagtatccttgaccgtctggacctcaactcctccctgagtttagtcccgattcccaccgttgaccgaagttgaccttcaagaatccagactctagtcaccttctcacatggtatcccgaccgcactagacctctgctcctccctgagcatagtcccggtcctcaccattgaccaaggctgacctcaaatcacctgcacacaatcagacaaaacaaccgtttctgggcacagatatcacaacctgacccacattagtcacacgcactcacaccaacatctacacatcttttcaaactaattcattgataaaatcatttgcacagccaattgttcatcacaaatattaatcatgacaatgatttcacaggatgaacttatctggtcctcttattatgatcaagtagtccctcctttgtcatctctaaaagggtctttttgttggagagatatttgtaagttgatggacttctttagagggattgctagatgcaatgtgggagtggtttaacttgttctttttgggatgatgtttggtctgataatccccatctcagtttctcaatgcctagactttactcatttgggattgctagatgcaatgtgggaagtggtttaacttgttctttttggatgatgtttggtctgataattcgcctctcagtttctcaatgcctacactttactcatttgctgcttacaaaaattcctctgtgcatagctatatgacagctccaatttcagacaattttcagccgcctttgtctcaccaagtttaaactgagtttcaggctctttcagatattattagcactattgacctttcagagcaaaatgatatatggtcctatatttggggtagtttgaagtatacttcccaaaagttttatgctctgcatttttttggctttggaagagtaaggttttctccaaagttaaagtatttggttggcttattttcatggacagattgaacactaaatttatactggatcacaaaaactgttcatagattgtgatacgttttgtattctttgtcggcagagatgtactgaaactttgatgcatgttttctttcagtgccctttctcggtgtcatgctggaatcatttaggtatcttgtgggatagttctctcaggctgaccaatatgatcatgaaggctaaacatggtaacagtgagcaatgcttcatggaaaagttccttttaagggcatggaatatttagaaacaaaggagtggtttcatttttgagaatagattacctttgttttccttttggaggcaacttcttaaaggggacctccttcttttgctgttttaggttgaaagtgagtgatcaaggtgtacttagagattagatcctcttgttgtaatttgttgttttgtaaccctttttttttaaataataactttaacaggggaggccccctgttgtgctcctttaaaaaaattactgattataatggctggcattaccacacaataaataaatagggcttaaattaaacaaaatatccagcggatcctcaactaactgccagggtgtagtattaaacacgtaagcatggcattacttctgatttacacgtcatagcttgcgtagaatattgctcaatattctccgcatgctatatatcacatggccatgtgcacacagagaactagagaaggagaagcgtagtgcctgcatttaccctcgtcaatgggcaccgagaaaactccttgctgtctttataccgtggtttctacgggccgtaactctcgtgtatcatacgagttttaccatccatcagtttttgcctgtcaacttggcttcggtcagcttccagtcggcgtctactcatcgataaacttcaagccaggggcccagtacccaatgccctcgaattcgatcgcatgatgctgattgaaggaactcctctttttggaagagatttgctccggtccaacaaaaaatacctcgaggtatcggtacctcatggtactaaatcatttccgatcgttggacctagctagacaggatgggtattgttagatccaacaatcggaaacgattttgttggattagaggaaatctcatttctttaacttgcaaaattttccagctaatctcatcaagcttttatcatcttgtaggctgttgaagttgatcccacccctcacatgggtttaggtgaaatagactgtcttagttgatactgggttttcaatttcgattttggctaaaatgttagttaaatttcggtattttgtgggctaaaattttctgaaatcttaacacaatttaactgaatttggctaaattcacaaaaaattgagaaaaaccgaaaattttggccaagatattggcttgttgcgcgggtgggggggtctgaaattacagaaatttcgaaacgaaatttcaatccctgagttgatgtacacattagagacacatgggtttgggtactacaagagaagtagaacgtggcatcaaaattctaatatgcatgccctcttctagaaagcgagaggtacaattgacgtggaaaaattattcactatctgcagctcaaatgtgctaagaggattatgaaaactttacagtacaacaaattttactatactatcgaaaagcattgactgagacaggaggatgatgccaaactcagaatgatgaagtaaatagttaagatggatagtgatggatttcttcaactagaagtcaaaattatttgatttctggcagacgttaccagcgcccctgttgtgggcagtttgaacccaaaaacttttatatgactaaacaatttgaatgcacccaggcttaagcaaggtctacatctctagaaaaaagctcagactaggacagcatgctctacctctatagttatcatcagcgttctctacatgcacaggctactcttctttcggatggccaggatggcatgaacaaaagcagttggcacattgaagctacagtgtgcagtagaaccaatcgtcctccacttgcaagcagcgcaattcgagtcgatttctgatgaattagaccaagatcatgacaatgttggttttctttcctctaagcctcccattcttatcacaaccattactatatatgagtggaaattcatcacggttatgtcgatgatcgagaatgagttgggaatttgaggtgctgagattctccgtcctgaagaagtgccttggcagcgtatataaatttcgaattgttgtacttgcacacaacagcttcccgaagctatcaattgtaggcatttaccccttgatgttaggctgcttatctcctcttcgcgtaggacatttgcatcaccatataggactgccgatcgggtcaagctaataaatattccagttctaaaactaaatatatatagaggttccttgctttcaaaataaatattttaaaatcaaaatgtagttacagtctaaaagtttaacttcagcctaatctaaaatggcaagtattatggaaccggagggagtagcgaatagcaggcaggtaaaggattagtatctggatagcaaattaacaatcacagaataatcataaatttagaatatatatcattaataacatcaagtttcactcaaaagacttgttcacttcaggaatcctaattggcgcgtacgaccccccccggcgcgcacgcgctggcccacacggcccgtctctcgtctactagtactcttaagtgttaacgtaactagttaattaaggataatgacaataattaaggaaatattgtttttttgggagattttttttactaatagattgtaaagttttaagttacatttgaaaagttttgacttacgatttaatttttaaagtcaaattttgaaaactttcaactcaaactttgaaaatttcaatttgcaagaaaattttttaaaacttttaactccgacttaaaaacttttcaatttctacttgaaaactttcaactccgacttgaaaactttcaactctaacttgaaaacttccaactcagattcgaaaatcttcaagttagatttgaaaactttcaactcgagatttgaaaactttcaactcagattcaaaaactttcaactcgaatttgaaaacgttcaaatcaaatttgaaaattttcaactcgagatttgaaaacacgtgtattgtagattaaaaaataatcagaaaaagcttaaaatgggaaaggaagaaatgcgaataaaaaacaaaagaaaaaaaatcgggcagggcggatttatgggcgcttttttctgctagctctacatatcaatgtaggcagaactgatagggggtgcccctaaagggcgggtgatcgcacccagcgatcaacccgcccctccccctatacttctatcccttctcacttttcatcataaattaaaacaaaaacaatgttagtaaaagaaattagaaaaaaaaatctaatactctcattctctcattcatgtgcatagattttataccataaactttacacgcataaactttatatatagaaatattctatctacaaaatatttgaatccgaatttaaatttgaatcgggtatataaacttttgacttataaactttccctctacaaactttaggtgaataaacttaataaaagaagaaaataatattctatatataaaatatttgaatctgaatttaaatttgaattgggtatataaacttttgacttataaacattcggtctacaaatggataaacttactaaaagagagaaataatgtggtgacaaaaaaaaaagaaaccaggcgtgctgcggatgggccaagcacaataagcaagaaaaagactaggccgagaaagccagaaaaggcatgaggcacaccgcacgtttggactagaaaaggaaaaggaaaaccgatcgctacgcttataactcagcgattaatcgctcattaggaatttcggaactgacaacaacaggaggcaggcaaaagtgtgtaacaacgtccccagctgatactatgccttccacgactaatttaaatttcggagtttattactcttttgcttacagaaatcaactataacttatcccttaaaattaggcaagtttggagtgatcatataagtaccactagaaaatgagcgtgccagttgggacgctagctatagtttataacctgcgtgtatttcccttcagaaatcatatattcaaaaggattattgaaagtcttttttttatttttatgtttgtaaacaaattaaaggaaaatagtaaaatcatcctgattagtggtattatcatgctgaacagactatatgacatcaagaaatgattaatgatgatatatattagtaacacaaacatgttttattaatattcaatacaattctcatattcatgtaagtcattgagtttggattagtaggaaatacatatctaaaataaatttgtctttgattgcctatttctttttactagtttcatttagaaataaagacgacgacatggcaaagacaattatgttgttttcttatatctagatatactacaatgcatagctcagttggttaggctctctatctatacgagttcaagttctaaacttagcatagatgctcgtatttacggctatttgttttttcaatagtaggaaacccattactcttcatcaatcccaagagtaacggctcagtcttcggaggtgctcgtagtgattgggtttgtatgtgtgcgattgcaagtatgaatatacacatttgtatatgaacatcaatgtctatactatgtagcaaaatgattgttgttacttaccaatgttccaaaataaatgaatatgtagcataaaaatgtataatgtgaggagaaaaaaaaaagaaaatgctctgaattaataggaaagtagttataaacttgtcggttcacagtgtaatttcacatctattctttccattctatagaaattcaggtattttcctcatttgaagtaaaccttatctgaagatttttacttgtcctaacgcaatccttttggctccaggcccaagcttgcatggccttgcaagatgccagggccaggcccacccagcaagtgcatccaggcgaatgtttttcggctatctcgcgaagtgaataccagggtgcagatcccctggagttggcttccaactccaaccggtgaatttggaccaatctgaccccttactttgtttctatgggctagatgtagccatgtcacctctttctaattacacatttacaacagatataatcctatttacttttatttttttgtgttgtccgtccattcagatcaatactctcggaagagcattatagatcatggagtaaaaaataattatctttaaacttttttaactgagttgttatgaaattaacggtattgagacctgtatcgaactcattcatcctaataatcgacagaacaagaaacttctatcggtgcaatatttttgttttgtttgttcttatctaattgttgccagaaagtttgaaggtaacatgttctctactatactagataatatttttttatagactctacattgtagtatttcttttaaataaaacgggctagttgtaaccaggggaaaagggattggatttaatctaatccatcaaattaaagggacggcttggattaagtaaatccaccgtgtggatttggagacaactccaggggatccacacccgtgaataccatcactttgacacgtggcaaatctttgaagggtgtaaccaaatttgtagggagccacatggcccaatgaaaagccagatctctggccctgatttcgggattaaagatatgcggtgtaatcaagaaatcagactatataatgctcagaatcttattgttgttctgataagtatataaaaagagtgtactgtgtggtgtggtaggaagaaataataagaattagctccgggttttactatttcgttcatgtttgtcatcaggtcctcactaattctctttcgtgtgccattttccccactttttctcctacatgtgacttttttaaaaaaaaataacccctggatctactgtgaaccattggcgaaaagacatcgttgcctgcggtcatacatgtgatgtaagatgagtgagagcccatatgccctagcacgaggatcgtggcctccagaaatgcctcttcgttgatggtcatggctttagcgactccacagtggggtgaaatggaaggccggcacttaaggctgggtcagcgaggcaggagagcaatgagcctctcaaggccagcctcgccgagggcatctcctctcactcctgctcaccggccggagatggacgcggagaaggcaaaataggcagggacaccggtgtgagctccaccctagtgatggctgaacgatggcgatgagctcgggcaagtggagattatagttgtagccggtggtttcccctgttgggaactcaacctccaccccagccttgcccagtgccttcctctactgcctggatattgccacacaaaacatctgctttggaatgatattgccacccctgcataggtggtttggatgttgcaatggctctgagatatctacttcctccgtttcatattttaagttatttggattttttttctagtcaaactctattaagtttgatcaagtttatagaaaaatttagcaacatctaaaataccaaactagtattattaaatttatcattgaatatattctaataatatgtttgttttgtgttgaaaatactactatatttttctatgaacttattcaaccttaaagacatttgactaggaagaatgtcaaatgacttataatgtgaaacggagggagaatcatttatcttcgtttgcatgcagcaagttggttttttcatgataatgtatagagtaattaaggtgttgattaaaacagttggaattctcgacttagaattctgatttgttctccaaaatcagtcgtctcctttgtggcggtgcatgactccgttgattggctgtgcctgtccagaattttctcagttcgtgcccatgttgcactgcccatgtacgttttcgagtatactagttgatttctacaaaaatagaaaagagaaaactcaggaaacatgagcagttcacgctctcgttttctacgtgtttcctctattctgctatgttgtgtgccctgtttagtttgtagagatctcaaacttgtatgcgctcacttgtaaaccttcccggtcttgaacagtaaagcacaacaaaactcgagtagatgatattaggacatagaattggtgacaaatagtagaggacatgatcttaggaggccgatgctaaccccaatcagcgctttagaattggtgacaaatagtagaggacatgatctaaggagaccgatactaaccccaaccacgcggttgatctagggtgacatgtcatagcagcattgcaatcctagaatgtacatgcaggtctacggagcacttctttcttgatgcattccattcgcagataaatcgatataattttgatcctcgatttattgctaatacgtacctagacatgttgagctcataagcagagtatgagaactgtgttgtgctatatatcggtgcagcatagctcttgtcttaataagagtacgtcgacttagatgcttgtcctgtatgcacgagttctagatacaatagatgctagtgctgatgaaagtaagaagtcaaaaggagtggcccgtagaggttgtggtgaacctcccgatcaccgaacacatcaagataatgtttgccaattccaaccaaactaacttagttcgttggtacgcagaagaacataacgtcgatggtaagcatgcaaaatcatgcttactatgatcctttcccagcttcctccaatgtatttgtgagtttactactagcacatctatctttatcatctctcatctattccataccccaaccgaagctcttgccatcgaggagaatctctacagccgatttcacctcccgtgagagaagtcaaggaattaatttgaccagtcgatatcttaatctataacaaagtatggattaaaactgaacaaccataagattaaaaagggctaggaggtgtgcctgcattcagataaatcaaaatggtttaaaataatgggtccactaatttaaaagggacaattgcaaatttaccactactttgaatcgttattgcaagactgccactagaaaattgcaaaaatgccactagaactgtcactcgagtggcatccttgcaaaattgaaaaaaccggtggcaaatttgcaaatgccccaatttaaaaacgttcaatagctatattatttttcttattcctcagattttctagcatttatagaagtggcacgtgatgacttaagtgtatttgtaggatgtgcagtgggatattagtatataatatagattgatagaagaattgtcaatgtactcctaatcctaaaccaccaccctattcacacacctagtaatgcagcagccacccaacactccaggctaacctggtgttatattaagcagggaaaaaattatttacatgatcaccagcgatgaaagaagaaaagggaaaaagggaagagggatgaaaagacaagtagaaaataccactaatcaatcaatgagtattaggttgataatctcgcgatgtgttttgctccacatatgctccatagcttgatttcatcctgtatcttggcccgcagttgcggcatggttttttcttgattccaaaacactcgtctgttctgctcacatcatatttccaatgctactagcatgtggactgattttattgctttggctttgtctttcccaccttgagatgttttcctgatccaccagtctagcaatagttcattttcatcatctgtcaggtcaatttcactacagttcagcctacttagaaccctctcccaaatctgtcgcacaaaagggcaatctttaaagagatgttgagttgtttctaggttcctataacatagttgataaaaacaattatttggccattgtctgatctgtagccgatcctctgtccaaatcctattttgtagcaagagccaggaagtgtttgcatttggagggttcccattgtttccagattagttttgctgcagccggtattatccttccattgaactgcgctatataggcggacctcgcactgtattttccattgctcgtccatctccgagttatggtatcgtcgacaccttccgtgagggtgatgccgttgctccatacttggttgaatacctcaaagtacgccttgactagctgatttgtgaggttgcgccagatatcgtctacccattggtcattagcttatctttcctggactgaccttactttgattttggcatgcttgtataaagtcggagcagattccttgagtggttgttccccaatccagttcgattcccaaataattgctttgcatcagtctccaccttagttgctgatccaaatagttttctattgagctcatcacaaggtgggggtgtgtcactgcccaaggcttgtttgggcacacccaactgaaccatagccatcacactctcagtgctctcgcaaatttgtccagatcgaccactcccattcttccgaaagtcccattataaatatggagagcgtatattgttgcagccggtgatgttcatgttacacccattatatatatgattcctaccaagatgacagaattgacactgtggagattatggataccccatatctacacggcatgtatagtctggttgggtacggggtaccagatatagatagaatatctttatgaggactcgggttagtttctaaacttgtatgtcaaggagatacctgagattctagtcggttacgattgtaatttatctataatcacatattccgttagggatatgaacagtattttataatacggactccttcccctatataaggaggggtccgggtccctctagggacacgactttctcccagatcatacgatcaataatacactcggcggaatcatccccagacaggagtagagtattacttcttaactaagaaggcttgaacctgtataaaattccttgtcttcaaacccatccacttttttagcttgatagccacacccttttagtattgccgaaatcttgtttcgacagttggcgcgccaggtaggggttgcgtcaagtttttcgccgatcagtgcaatgggttccgtctccggcatcgacgacttcgtcttccctcccgggcaggcgtttcggttcggcaacctcgacttcatcaacaacgtcttcggcaagatcttctctcttgactcagattcgaaccagtcagggagagaccaggtctcagccccgttcggtattccgaactcggccaagatctaccccaagcttatcttgatcgagtcggcttcaaaccactcggacgagatcccatctactccaacaacaccagatcgagatgatggggcctacccgccaatcctgatgaaactccccgacgatttggctgcgtcttcactacaagggcgtctcctccccgtaggcctaggcggaactcagcttcaacaccgatcctgcctagctccagggaagtcggcgtcatactccagccactcggcacggtttcgacggatcaattggaaggctacttcagttccccttgcgtcgactcacgaccaacagagatcgtggagtacgacgaattcagctatcgatacgacaaccgcgacctcgacgactttgacgaaagctttgaagataattacacccctctctatttcagcgttttcatggccgacaacgagacggaagaacaacgccaagcccgagaaacggaagcacgacgcgtacaacaggaggctgagcgacgccgactggaagaggagcgccaagcacaagagcaagaacggctgcagcgtgagcaacaagaacgcgaatgggctgcaaaggaggccgaggaccgacgacaacgagccttggacgcagggcgatgagcgcgagatctcatcgggcagcaagacgttgaggggacagcggtcttccgtacccctcaacagaacgttgtcgcagaaaatcaccctcctcgacaccctcctcaaggaagacgcactcaatcaagctgatcaagtcgtcaacatcttgaaccagaccaagaccatgattgccacttcggtcccggttaactccggaagcgtccgcatgtcgactggcagccgggttccccatctccgatctcatgattatcaccagccaagcctcagcatcgccggcgcaggatccaatcgcaggagcaggggccacgacgagcgatctgttcactcgcctcctgagcgacacaagtagcgccgagttgaatggcttttctccccacctcgtcggtgccccgtcgatcttcgtgatacgatcaaccagcgccgtgcagcacgaggccatgcccaccgccattcaccagaacgctacgacgacgacgtggatggagtagctgcctttactaacgacatgcgtcgagtggattggccagccaacttcaagccgactggaatcgagaagtatgacggcaccactaatccggagtcttggcttatcatctacggtcttgcaatccgcgcagcaggaggagacagcaaggccgtggcaacctacttacctgtggccctagcggattctgcccggtcctggcttcatgggttaccacgtggcacgatcggatcatgggcggaacttcgcgaccacttcatcgccaacttccagggcaccttcgccccggcacacagtttgatctctacaacgtcattcagaagtctggagaatcccttcgagattacatccgacacttctctgaacaacgtaacaagatctctgacattaccgacgacgtcatcatcgccgctttcaccaaggggattcgtcacgaagatctagtcggcaagttcggacgcaagcctcccaagacggtcaaacagatgtttgaaaaagccaacgagtatgccaaagccgaagactccattatcgcatccaagcagtcgggtcctacttggaagccaaagaaagatgtgccgactacgggaggggttggaagtaacaatcacaaggaccgcaagcgtaagcctgaggaacttgttgcgactaccacacactcctcccgacaacgttcgcgcgtcaacacttttgacaagatcatgaactcccaatgtccgcatcatcccaactccannnnnnnnnnnnnnnnnnnnttcgtctacaagcagtttgcagagcaatatgccaagaatgcacgaaagacctctgatggagaacaaagcacatcgaaaaagaaggatgatgatgatgatgccccgacaggttttcaagatcatcgcaaggaactcaaccacatctttggcggccctctggcttacgagtctaaaagaaagcaaaagctgactgaacgggagatcaacgctgttcagcccgatacgccccaatatcttcgatggtcggagacaacaatcaagtttgaccgctcggatcatccagactgagtggtccacccgggacggtacaccctggtactagacccagtggttcgcaacatcaagcttcgcagatccctcatcgatggcggcagcgcactcaatatcctcttcgccaagaccttggacgacatgcagatccctcgcaccgagttgaagccgagtaatgcgcccttccacggagtcatcctagggttatctgccacaccactcggccggattactcttccggttacctttggtactcgggagaacttccgcacagagaacgtctgcttcgaagttgctgatttcgagacagcgtatcacgccatactcggacgcccggcgttagctaaatttatggctgtcccgcactacacctacatgatgatgcagatgcctggtcctcgaggagtcatatccctgcggagcgacatcaaacaagccgtcacatgcgataaggaaagcggcgagatggcccaaacccgcgagatcgcggtcgcccgagaagacatccgactggccgcaaccacggcaagcgaaggagaagtggctacgaccaagatctccaagactggagaaagcgaagccaagaccaagaaaattcccctagatccttctgatcctactaaaactgctgtaataggcgccgagttagattgtaaataggaaagcgcgctcatcacctttcttcaaaataataaagatatctttgcgtggaaaccatccgatatgcctggtaatcctagagaggtgattgagcactctttgcatgttaaggaagacgctaaacccatcaaacaacgacttcgccgctttgcacaagacaggaaggacacgatcaaggaggaattgaccaagctattagcagcgggcttcatcaaagatgtccttcatcccgattggctggctaacccagtcctagttcggaagaagactgggcaatggcgcatgtgtgtcgattacaccgacctcaacaagtcttgccccaaatatcctttcgggttgcctcgcatggaccaggtagtcgactcgaccgccggctgcgagctgctcagttttttggattgctactcgggatatcatcagatccgattgaaggaatccgactgcttgaagacttcgttcatcacgccctttggggcctactgctacatcaccatgcctttcggattaaagaacgcaggagcaacttatcaacgcatgatccagagacgtttctcaactcaaatcggtcgcaatgttgaagcctatgtggatgatgtagtcgtcaagactaagcagaaggatgatttgatcacggacctggaagaaacctttgcgagcatccgcgctttcaggatgaaactaaaccctaaaaaatgcaccttcagagtaccgtcagggaagctgcttggatttatggtgtctcatagaggcatacaggccaacctggagaaagtcaacgccatcctcaacatgaaaccgccgagttcccagaaagatgttcaaaagctgactggatgcatggcggcgctcagccggtttgtttcacgactcggcgagcgggggatgcccttcttcaagctgttaaagaaaacagacaatttccagtggggacccgaagcacagaaagcctttgaagacttcaagaaacttctcactactccaccagttctggcctcaccacacccacaagagccgctattactgtacgtatcggcaacttctcaagtcgtgagcacagttctggttatcgagcgtgaagaagaaggccatgttcagaaagtccagcgaccaatctactttgtcagcgaggttttggccgactccaagacgagatatcctcaagttcagaagctgttatatggtgttctaattaccgtcaggaaattatctcactacttccaaggtcactcggtcatggtggtcacatcgtttccactcagcgatatacttcataatcgtgaagcaaacgggcggatcacaaaataggccttagaactgatgtccttggatatatcgttcaagccgtgaacttcgatcaagtcccaagctttagctgacttcgtcgccgagtggaccgagtgccaagaggacacgctcgaggagaagatggagtattggactatgcactttgacgggtcaaagagactttcgggcactggggccggggttgttttaatttccccgactggagaaagactgagctacgtgctatggatacatttctctacatctcacaacgtggcagaatacgaggcgctccttcacggactatggatcgcaatctctttgggaatcaggcgtttgatagttcgcggagattcacagttagttgttaatcaagttatgaaagagtggtcctgccttgacgacaatatgatcgcttatcgacaagaggtacgcaagttggaggataagttcgatggactcaaactcacccacgttcttcggcacaataatgaagcagccgacagactagcaaattttggatccaaacgcgaagcggctccttctgacgtgttcgtcgaacatctttacgaaccaaccgtaccaaggagagaaacagctgaggccacggacactcaagacatagccatggttgaagccgactggagagagcccctcatacaatttctgaccaaccaagaactcccccaagataaagatgaagccgagcggatttccaggcgcagcaggctttatattattcatgagactgagctgtacaagaaaagtccatcaggaatcgtgcaacgctgtgtgtctttggaggaaaggagacaatttgctgaaggatatacattctggtatctgtggcaattacgctgctgcacgcaccattgtcggcaaggcttactggcaaggttttttctggcctactgttgtgtccgatgctgacaagattgtgcggatatgtgaaggttgtcaatttttcgcccaacaaactcatctgctagcccaagagttgcaaaccatcccgctgtcttggccgtttgcggtttgggggcttgacatggtcggcccgtttataaaggcagttggcggttacacacatctctttgtggctatcgacaaattctccaagtggattgaagctaaactggtcatcacaatcacggcagataaagctagagattttttcatcaacattgtgcatcggtttggggtacccaatcggatcaattcacaggcggagtatttaaagatttttctgaaaacttcggcattaaaatttgttatgcctccgtagcgcatcctatgagcaatgggcaagtcgaacgagccaacggcatggtactccaaggaataaaggcacgagtttttgaccgactgaatccttatgccggcaaatgggtggaacagttgccatccgtactttggtcctttcgcaccacccctagtcgttctacgggccagtcgccattcttcctagtttatggagcagaagcaatgttgcctagtgaagtagaatttgaatctttgcgttttcgcaattttcgcgaggagcgctacggagaagaccgagtggatgatctacaccgactggaagaggcccgcgaagcagccttaattcagtcggcccgatacttgcaagggttgcgtcgttatcataatcgtaacatccgatcacgagccttcttagtcggcgacctggttctaagaaaaattcaaactacacgggatcggcacaagttatcccctttatgggaagggccatttgtaatctcagaagtcactcggccaggttcatatctgactcaaacatgaagacggtacacctatcaacaactcttggaatatcgaacatctacgtcgtttttatgcttaagttttgcttctgtattcccctattttgactgacaacatcaagcttctccttgaagttattagtcaggggctattataataataatggagtgtgatctttatcaattcaatttgcttacttgatttatcattgccttgcctgatttttcgacttagtccatgaggactgaaagctttttaatagcttttgcgggttttaggctcaataaggcttgacaaaagcttttaagaaatcagaagctaagtttgaaacactaagcacaacatatattcatcagtattgtacaaattgtgcctccatcatcatcatcagaatcattgttatcacattacatcaatcagtatcagttttttcatcatcggagttatcaggaccagtcggtcgaagctcggtgtcttggaatctctcgactacataaactgctatcttgtcgatggctttctacgcatcattgataaggtcaagagcagcttcttcgctcgtcccgtctgcaaatccatcaatggcatcaatgtcgatttttgggtaaaggaacttggtcattgccaacgccagactcgctcccatactcccggcctctttgatgttcttgaaatatgtatccggagcaactctcagcttgtcgaagatttcggaagcatcgaatgtactcggaccgttgttattgaagaacattgcttggaccagtggggtagcatcgttagcaacttcatccctggccccttcgagcctcttgattttgccgactaggacgtcgaattgagcctgcgacttgatcttacggtctacatcaacaaattcacattaatgagttagcatatagaagataatggcttttggggtatcgattgatggtaccttcaacatccttcaaagccgagtccctctgtcttgccagttctgccttgtcattttccagagtctgaatctgcttctctccagttgagatatcttggcggcttgcactacattgactctggttaaccgaaattacaaagatgacagcacaagttagttggacagagtttgtgtgtaccttttgatgagccactcaattcaaaattagactcctggagctcagtgatccgatcccttagatcatgctcagttttcttggcaagttcttttgcctcgtgcagttggtctctggtagcttcaagggttccgagatgaggaactaatttctctaaggttgctgtttttgcttcattcctaaggtgaatcctctgcaaaatagttttattagcgctcgagctaaatggcaaacaagatggttgacgtcaggcgtcaaggaacttacgtttacaatgcgagttgcctggccgagtgcctttttcaataggcatacctcttcatcctctttttgcctatttattacgattccttaaggttgtatgtcgtcatcccaccacttgaccagaatgggagggtgcgaatcttcagccactcgtattcggagaatttcttcttcatcaccaatcattggtcctaatgtgtccatggataaaggttgaacaatcaaatgaagtcagttggatcaacatgatttcagacaaagtatttacccgtgatgatttccggacgaggacgagtggattcttgtgcctttgcaggagatccagatcttgggtcattgctggcatcctgtccgcgagggctgtttgcttgagtttcaacttcaggaatctcttggcttggccctatgtccgactggtttccagtcgggggctcctggttaactctgacttcagcttcggccgactggtttccagtcggaggttgatagctagattctacattgtcggttgccggctgattgtcactcggatgatcctttgcagtcggcccagtttctttggaggaactcgtctccatgttagtcggatcagagtctttcccaaaagggtctatatcagatggtttcctacaagtttgagttatattatcagcattgttttcatgataagtgagcgtcaatacaaggaagatcgttatatgattcgtacctggaaaacttcctgatcttcggcataggacgactggatgttttcttctttggattggcatgcttcggcaattttccgattgtttctttatctc

SEQ ID NO: 72020 - DNA, 46616 bp, Oryza sativa
agtacgaatgtactcaattcccaattgttgttgtttgtcgtccattctgagtcgaggttgaagataacgaagattagggtatcatccctagactaaagtctttgccgtggattggtaatctagctacgctaagtttcacatttgttgtttttgattgagggttgtatttcaggagaaatttgtatatgtaccaacataaaaaacagcttcactaaaatgccatcactggaacgggcttggataaaattccacccttaagcagagcgtcttcaccatcctgtggactattttgccattaggatgcatgcttcttcctcactccaacgcctcttctttttgcccttccagtgctcaccagtgaccatggtgtttgcccattgtaggagacgcaacatttctgaggtggctactggtgagacatgtagttgggatccatcggcagcagcaatggcaaggcgagggatggcgtccgtgccgggatgtgcagcggcgaggcaagggatgggtctgacatccgcagtggcggccacaaagcagtgctggcaccaagatggatactgattgtgaatattttgtgttcttgttgttcgtcttctataatggggattaggggagcatgatctcagaggggaccgctcaaagcatgggctcaattcatcaagccaatgctttgagcagctcccttttttttggacttgggggaacataccagttcttgttctaaacttcggcactagtgagtccccgtcatccatgctgaaaatccagagctggttggggaccctccattgggcccttcctaaccgggattgaccctctttgtagcttatagacatatgatcatatcagataaagatttgcagatcgatctatttttatgcatgcatggtgagagaaagtggacacgtagtaaaccaataaaatatattctcgataacaatatatatagcaggttttacatattacaatctcacaaaaaaaccagcttaattacaacaatcatgtgattcaaggttgatacaaatgcagatcgattagcaaacagacatgatcatatcaaatacgaatctataaatcgatctttttttatgcgtgcagggctgagagaaaacgaacatgtaagccattaaaattatctcgagataacaatatatataatggattttagaaagaaaaaacgacttacaacaatcaaattaaagtgattcaaggatgataaaaccgcacatcaatctgcaaacccgacaagagacttactcacggggaacaatagccaacaaccacaatagcgaacaaccacaccaaattaaactctggaatattataactgtgccgcttagcaggtgaaatcggtcggataggtcttgccacacttgttgaggatgagtccgagatcaactgggagggttgaccctaatgccaagcacattggccttcacggcggtgcaaaggcagatggcagcatcgagatcggcgatccctgacagcaacgagcagcagtcatcggggccgtacccaatcttcacatcgaccagccctttagcacgttggcgcacactctcagcttcagggcgttgatcgggcaacgcccgtgatcactgtgcccaccagggtgcaatggcgccggcactgcttcgggtgcgtagggatgaccttctcactagagcagttgggtgtgcagccgtgtgcggtgacagcaaagaggaaagggcaaggaaagaagcaacgaccttggaagccataattttgtctgaaatcgaatgagccggtggtaatcagtcactcagtgttctagactgctctagcttgtgtcagtttgggatggtttgcttgtgggttttcgtctgatatttataggtgagctatagcttgctatagtttagttgcacgcaagttgcttgtgtaatagttcctttgttttcctggatggatttgcatgcaagcatggaccagtagttggtgggatatatgacaagttaaattcttaattcgatgaaatgaattatgcagtcatgcagagcaccaatcgaacaatcatgtccagtagtacattttacgcgatactagctagttgagtattcgtgctttgctatggataaaaaatatattataatatcacctgaaataaagaatatctacattctagccaaaggtctctatttagccagtttgcttcattgtgaaggcatagcatcgctctatacagtctccatttaatgacctgtaatcccacgggaaggtccatgcactctctcgctgcatgactcacggaaccacaatgaagccgatacactcgaaaacctaggcggtggcacagggttgcttggggacggtgacttggtctactcgtgggtgtgtggaactgatggcctagctgcacgggaactgattcaaggctctgttgtaagatgggcccaaatgttagtcttcttgggaacaaccatgtgtattgtgttctatagcatagctaaggtggtgtttggattcagggacttaactttagtccctatatttaaacactaatttagagtattaaatatagactacttacaaaattaattacataaataaaagctaatttgcgagataaattttttaagcctaattaatctataattagagaatatttactgtagcatcacataggctaatcatgaattaattaggctcaatagattcgtctcgcgaattagttcaagattatggatgggtttcattaatagtctacgtttaatatttattattagtgtccaaacatccgatgtttgatacgtggtctattccgagaagtgacacgaagtcacattctaagtggtcggctgtggaaactcctcgatagcccgggaaaggctattgtggcatttttataggcctgagggaggagacatgtcccatgggccttatgtcctcgtccgacgcggtgcactgccaagcctgacaatcgcatttgttacgaattacctcgagatgtcccgttgctacagtccttttctaaaagtcatattttcacactagctcagcaggaataacaagacttggcaagtgagcccggcgtaacgtcccacatatagttgcctcatcggctataccgatgcggggctcaaagggcaaaaagagtactcatgattgtaaatagtagattatgtcatgcagcggagaaatcaagagggcaacaggaggtatataagcctcaccgaagcttgatacataggttagactccagatccagaaggaactaaatttctccaggtagagaactttgtaatgcttgatcgacatagtgatacaaacatgaataggattgttattctccaagaggtctaagcctgtaaacattttctgtgttgacttagctccggagcaggtccaagcataccaaggatcccaaaacccctcctcgaccgggatcgtttgtttcccatgtttgtcaaattagtttgtttttccgacaaataataatatatattttccataaaatgtcttacctataattttactgcagagattattcatattaaatagattttatatgtggcaatctatttctatttcattgattttttaataataagtttaatgggtaatttgcacaactccaataggaataggtggtgtaggatattttctgttacaaccattaccttccaataggagtaggagtattttttttttcgtgaccagcattgtgttaatattattattcttttcacgtgcaccgtaccctctaaattttaatcctgttttcactactgctgcttgtctggttgtagcgtaagggatgaccttatggccgaactactgctcgcaaagctgcaatgcatccatctgaaccatctttttctgagggctagcttgagggaatgggaatgccaccaacgggctggacatacttgtgccgaaacgactacgtagttaggcctgaaccgctgtgataaaattcgaccggtcatatacattacaacaataattgcaggaccgtctatacttgggtgcaaggtcgacattggtgtgcacgacacagtttgaagacatgatcatatcatatacagatctacatatcaatctatttttttcatgcatgggtcaacatattttagttgcttacatttcatctttatctcacccatgtggacctattaatttgatctgttgatctttatcttcatatcgaccagcccgtttagcacgttgatgcacactctcagcttcagggcgttgatcgggcaacggccatgctcatcgtgctggccatggtgcgactgcactggcactgcaacgggtgttgccgggacagcctgctcgccggggcagttgggtgtgcaaccgtgtgctaccacagcaaagaggaggaggctaagggccagaaagggagcgacgaccgtggaagccattgagctgggatcgagtgagctactagtagtcagtgatcactcaagagctggcttatggctgctctatcttgtgtggcttaggaacggtttgcttctggtgtttgggtgtgcgtctgctatttatagatgagctagcttgctataggtagttgcttgcatgatgcatgcatgtgtgacatgacagtacgttgcttggttttcctggatggatttgcatgcatctgcctgcatgggtcggttggttcttcgagttggcaagataatttcttaattgcaacgttgaattttggcatgcagtcatgcagagcaccaattaaccaatcatctccaattcaccagttgtccattttatcacaatttcttaatatattacatgattacatagtaatatactcccttcattccaaattgatctgcttatagttttttttgagattattactaaatgatctatatatttgtgttcatttattaagtctattcgttatttgtgcattagagtaaatggacattgatgcatgcatccatgcacacaagtatttataacccacatgtaatatcttgatttgctattggctaggaaatagtggggatggtgcatatatggagtttgttgctaaagtaaatatagtataagagagttattagcttttcttggtctttgtgtacctgtgaaatatttagatcaatttggaatggagggagtattagctagtagtatttattttccgtagttacatggattacatagaagttgaaccaaactgcgatgtattatgctgacgagagtctactgattacgcagcaacttatctggcttccaagagatgagctacccagccaaacctcgtttcaatatgaatatcctatatgtcggtaaacttattttgtccactttcagactcaataaaagacacctcgtttcgactttcgagctaagagtaattgatattttattggaagctgcacaggtatcagatgttgcataagaatcagaaaagactccataaatgctccaccaagataacctcactaaggcctacctatgatgggcagaagtacctcgcctctaacgggctaaactaaagcccactctagataaggccccacgggcacagctcgtcacagctaagaacttaattgtgacgggcccatttgtgaacccgataaagaacacctctaacaagcccacatataggccatcataggtgacaacacacctgtaggggtttatagacataatccgtcgaagatgaggacagtcatctctaacggttcccttttttacccatcacagatgaaaaccaccgaacaatacccatatcactctcccacccactcattttcttctctctttcactctctctctctctccctctctccctctctctctcatttccttccaccaagatcggatccaatgcaccggccttagcctccaaccccgagctcctgtcgccaccgcgacctccacctccccctccccgagcacgggtcctcattgcttccatccacgagcgcccgtcactgtcgcctccacctctgcccccaacttctattgattgccgcctcaatccacgagcacccaccaccgcggactccacctccattcccaagctcgggctgcctccgcctccatacacgagcacctaccaccatggccttcacttctgccctcgagctccggtcatttccacttccatcaatgatcgtccgccactaaggcctagacctcttcccccaagatcaggtgaccgtcgcctccatccacaagtgccaaccccctctgcctctgcctccacccccacatccatccacaagcacccaccaccgtgccctcactacaacaaaacaacccaaaggagacatcttatttgtaagatagagacgttttatttcgtctcccacagataactgagacgcttttataaagcgtcgtaggatcgtctctgtttgcaccgtctcaaaattatggagacgctttttaaagcgtacctatattatttaagacgttgctagagacgtgtaaattgcatctctataaaatatagagacgcttttatataggcacgcacatcttaatatatttgatattaatgctttcatctgggctcgaacacaacacctgcaggttacaaagttcatgcactaaccaagtcattaacgtgacaatcttgaaggtaaatagatagttttttttatattgcaactctgcaaacatgcgtcctgtagcagttctcttcttttttaatctaagactgaatattaaatatttattttttttggtccaaataattataatattattataatggtatttgatgatgacgattaggatcagtgtgtttattttcttctttctctatataaataattatatattatctaataacgatgacacggatataataaaaacgtctcaaaactcatttctacacatgagatgttccaaaaacgtctcaatattcatctctaaacgatttaattttgtgctaacctgtaaagcgtcttaaactatgtcctcaactaataaagcgtctcaaacatcgtccctattttaatttcatttataaaaaagagacgacttatagaatgacttaagtgaaacgtcttaaaacaatggttttgttgtagtgcctccccctccatccctgagctcaggtcatcgccgcctccatccacaagtgcacaccatcgagccatagtcattgcccccctctggtccgagcgtctaccgctgtctcttcatctcctccgcaaccgcgccagtcaccgcctcaaggacaagcatgacaagcatggtggaaggcgactcaccaccatggcaatggcactaagatccattgcttgcaagttctttttcacccaagtacttttgcatgtagttcacttgctgcttcatgtagttcatgttgttcacattgttgccgcagtgatgattccaatccctgtggttctatttgattgtggtgattgagattcaaggttttgttttttaattgggacaaatgcgatggggacgagagggattgtgatgatttttgtgatttgtgaatgcctaatgtgatctgtgatatcctgaatgagtgtgatagcatcctaggtggatgatattttcttttcccattttccacactagtgatgggtccttactataacctattatagataaaggtaccagtaacaggttaaaatatatagccgttagaaatgactctcacatatgacgggttttggttggggcccgttaaaggtaactcctaagtccgagagatcttcacctataacaggtgactcagtcatgactaaccactaatctcttactagggctaagcatgtcagaggtgatgatatgagcccaatggtgacctgacctgttgcatgtgtgcttgttttcacacccaactaggagcgttattcttagtagaactaccattatactctatccattagagaatatttgttcaattgaaaaactcatgtacgagagaatgctaaagactgcatattgtcttacatcctcttgggcctcctagttaatgcatttgcttgggcttgttgtgtggattagttaaatattatggttctgtgattgctcgtgtgatggatcgtagttcaggacgctttgggtcgttctcaccctcaccacttggtttacgccagtgctcctttcttacacttgctttaaacctactatcgtggagatcgggccaccccttgtgagtgagttcgtgttgtcttttgacaggtctactggttgcgatatagccatgtggaccatcttcttttgagggctatcgtgagtaactcattctggatagggtggaatgggaatctcaccaataggctgcacatacttgtgtcaaaatgacttttttgttaggcccgtatgtgggccagtttgatgaaattcgatcggtcacctcgtagaatttcaacatcgtcttttctcccagtaccagtaactggattagccctgccagctaaaaactgtatggaataaatgaaatacagtcagaaaaatggctcctaatgtgtcaacgataggaaatttccatcataactagctcgtcggagaaaaggaaatttgcctggtgcgtacacgtcaaggaaataattgtcctgacgtggaatggacagtctgcgatagttgcatatcactgataggtttggcggtcagagatattggaatatttttttatgggtacgaccatcaggaaaataagacaccacacctcgctagatagctgtatccatgtcactaaaagcagcggtcgtcagggcaaatctagtttctgatactgtgatcaggtgcatggtccatatcaatgtgcgtaatgcagtttaatttgaagatcgatcaatttttatgcttgcatgtgtgagagaaaacgaacatgtaagccattaaaatatctcagggtaacaatatataacgtgttttacatattacaatctctgaaaaagtaatcaacttacaacaatcaaattaaagtgattcatgtggatgataaaacaaccgcatatcaatctgcaaaacagacaggagacttattcacgaggaatcgtacaaacggccacaataaccaacaaccacaccaaattaaactctggaacattataactgtgtagcttagcaggtgaaatcggacgggcatgtcttgccacacttgttaaggatgaggctgaggtcgactggtaggttgaccctaataccaagtacgttggccttcacggcggtgcagaggcagacggcagcgtcgatatcggcgatccctgatagcagcgagcagcagtcgtcggggccgtgcccgatctccacatcgaccagccccttgagcacgttggcgcacactctcagcttcaaagcgtccatcgggcaacggccatgcccaccgttcttgccatgatgcgtgggcgtcgggacaacctgctcgccggggcagttgggtgtgcaaccgttagctatgacagcaaggaggaggaggctaagggcaatgaagggagcgaccaccttggaagccattgatctgagatcgagtgagctgctagtagttagtgattgcactcaagttgccttggacaatttgcttgggctgtttggacgcgcgcctgctagttataggtgagacagtatagttgcttagcttggtataggtagttgcatgcatgatgcatgtgcgatagtttgcttggttttcctggatggaattgcatgcattagcatgctagctgcataggccagttgttcagagttgacaagataatttcttaattccaacgttgaattgggtcatgcagagcaccaatcaacaaatcttgcccggttcacaagttgtccattttacgcgatatcacaatttctcaaccaattagtattgttttttcagtgttttctggatcctcagagtttaatctccattggttatatactcacacactacgaggacgttttggaacgatttatataattttatactccctcagtcatgcatgcaagcgtgtgcgacgagttgatcagctggctggaaaatttatacataatgcatgcaagtcatgaccgatctgaactgtttactctgagcaaatctgacgtctgaaagggagaaatgagaacaagctgccagatagctggaactccccaccgcggcattagacaaacatggcaagcgagcaatatgattttatctccatgttataatgcgctgagcatgcctttgaatcaaaggatttatgtaaggaatttcataagattcaaatcctataggaaaattttctatttggcacattgattcaaaggattaaaactttccaaatcatatgaaattcctatggaatgacacattgcatgtatattttggaggaaacttagcaagaggtctaacctcttgaaaatttcctttgagtctatctctcttatccgattcctgtgtttttcctatggtccaatcaaacgatcattcctgtgttttttcctatgttttgcaatcatctattttatactttaattcatgtcagaatcatgtatttttcctatttctctactttttttaaccctgggattcaaaagggccctaatgatgagacatagtcctgatctttcgatagatactgataagtcgtttgtggagaactcatcattgatgtaggatcgaacaacaagaactaaggtcctgtttgtttcagcttaggattattataatctggattattaagagtaagctgaaacaaacaagtagattattatgatagattattataatctataagccatattactataatctaataatctcctctggaggagcttttttcagattattgggtggctaaagaccaactaccattagatgccttcaataatccagagaaacaaatagctcacagcttattctatgtcagcttattataatccaacttagagtaatctgatttaataatctagattacaataatcttaagctgaaacaaacggggcctaagccaaccataagagggtgaatagttgtagtacccaaaaccaaaacttttagtggaattaaagataccctcgaatccaatgtagatcggtctgaccggggttaatccgccgtgcctatgctgctggtctaaccggtgttgatcgcccggtctaaccgccctacaattgcctctacctcctgtcgccgccgtcggtctgaccaccgtatacctaccggtttgaccggtgcgatgccatcggtctgaccaccggtgtcccgccggttggaccgtcgaacccgagcaaacacaaatcaaagatctcacaaagtagattgaaactttattacttctctctatgtttacaaagtgcaacaacagcactcctcacgaaaatattgactaaacatgaaacccaaacttttctctcaactcaactctctctaaaacgatatcgggaggccgcaccctctctctctatttatacccaaacttgtacaagaagtcctaatcccctaggaaaccttcccgtaaaagaaacaaactttacaaactccaattgtaccaaatttggactccctccaaattcgactccgtatcccatactcacacaatatctccatcgtatgacaaatggaatcttcaccaaccacgtgcattaatatttagcctaagcatcccgcacgatatcctgatcgtccggacgtcatattctcataaattgactcccgatccatcaccggcaacactctcccaaggcatgaagaccacctacacatgcatcaaccaagaaaccatatccgagcacaagttctcaccaacttgactcattgttaataaacaacaatactacatacacatagtatccatatagaagtcataaacatgaattatctacggatatccaacaaatcaacccgaatccgaaaccgacatagagttggccagtcagaccacgtgctggccgatctgaccacacgatacatgccggtctgaccggcaaccactacccggtctgaccggacccgctcaatcagtagtctttgttcatcacctgcaaatccaatcatctccaaaaccactttgccaataatctccaaatatcaaaaccaataatctcatatgccaattattcatcacaaaataagcattagcagggtcctttatgtatacaaagtttcgttagaatcaccgctatttagttcgatcttttttaccttgtactccctccgtcccaaaatataagaacgtaggatcggataggacatttcctagtagtacgaatttggacagacatctggtcctagattcttatacttcgggacggagggagtatttttttttcaatgcttttcattagttaaatgacatgtaagaaaatgagtaaacattccctccgtgggaaaaaaatccatatcctcttttaatgggcctatatatatatatgtccttttcctttggcgtcgttagtgtctatgatttctcttttgccctccttctataccaaatctaggtaattcatttggccattttcattcttagtggaaaatataaaacatttataaggcacaccttttgggtttagcctatgatataattacgaagtccaatacctaaaaactgactttgacgtggtttgtttagaaaattccaaacagcttaggaggaagaccgaagtgttcttcttaatcagcagctaagtctgtttgaagttaatgttgttaggagacccgaatctgactccaaaccatgtatctcttgccttctatggctcaataatggcatggtggtgttggagtagacttgaggaaggccgtgatttggtccccaaccaacttcactgatcataaatgtaaatgtattccatgaagacgctccccatttcttcacccatgcaagggtttcttcaaatgacaaaacataaaattcatggtgtacatagtatgttttgttcgaatattgtcagcgttctggatattggataccctatatatagtatttacctcgcaagaccactgtagaccaagtccaatacagaaacaaacctagataaagtctggaatagataaggaaggattcctagataataaatgaaatacataggcctacttgcgctgcttggactactcggatcatacttttttccctagttctacttggacaaacgggcaactgagggtataaataccaggcacgtaagtgaggagtaggacaagtcaaaacccatgagagaaactaagacaacatataacacctccgatctcgtcgagtcaacacccaaagaagtcgataacaactagtcgccaaccactatgcccaagctctgcaccgatatactagcatactagattaggttttttttcctcctcattattctcatgaggatgatatatataatacactagctccggtcaccaaaagttgggctattacccatcttggtgtgctggatcagtataaaaatccttgttgccttgcgttccattatctaaactaaattggatagagaattttgcatcataattagggttccaaagaatgatttatttgagaccgtcgcacaagatcatagatacacgcacagaaccagaaaaattttgacactagggtattattttgtaaaatagtttttgacaactaagctaaaacctggtgttacaaactcattaatattgtttttaaaaaaaatagacaataaggttctataaatatcatagtatttattgggttgtcttttcgttttttttcctcaataacaccgaatttcatggcagaaaactaatgtgataacgagcgggtagtaattaaggtcgtttttttttaaaaaaaagaactttaaggatgttctaacaaaatatcggctcattctgtctcgacgatgttcacagctaggggtggagatagtcactacaaaaccgtttttactcctagttgggaacccctatagtcccgattttccaaccggtgttgaaattattaacacataataatttaatttattccataaataaatcatgacattgcatatgtaaactagcatgaacatatcataagatctacatatgtaaactagatagtatagcataaacagatcaaatatgcgtaacatagtgagcacgtaccaagggtaccggaagaccagttgcacagcaggaattactcgcggttgcgggcgttgacaaaggcgtgcatcacgcgagcaaacagaaagacgagccgtcgtgaacgaatagggagcagtcgtgcgaagcgcttcccaaaaaccttattgccgccttctcccggtgcaggacgtggaaggcagaggttccggagacatgctatcccgatcgccgctgcatgccggcgagcggaatggagtagtctacaagcgacggcgcagtacagagtaggaggcaaaccctagattgatttcacgtgtgttgcgtggaggcggcggctcggtttatatagagaaaggtcgcttgatctccactccgcgtaaccgaaccggataagtcacgcgtaacttattcgaactccacgccgttttcacgcaacggatttttctaaatttcccgcagcaaaacaaaactgcaaaagaaggccgcatctgcgcaagggtgaggaaccaattttgtggaccattcgacgcgtacgttgtgccgcccgccccgccaggcgaggcgagcgagcacgcgtgtattccccctgttctctccacctcacatgcttcaagtggctaggagggcatcctcccttttaaggaggtcctcctctcctagaataagcaaggtgatactaaactcccatgcatgccatcccatgaggtgggcttttgtgattttcaaaataattaatcttcgagtgggataaggcccatctattaattccaacaaccgggactacgaatctgggactaaaaatgcgcatcttcagtccggggtgaaataaccgggagtaaagttcaatctttagtcccggttggtgttaccaaccgggactaaagagagcataggcagtccccgtcggtccccatttctttttttttcattgtttctttgctaattgaaagagttaatccctttattttctcccaaatcgagtgccatgcatatcctcaaagcaaaccccaaatccccaaatcaaagtaatatcccaaatcattcacatcacaaatccaaagttactttatacacataaatcaaatacatcacaaatcctaaaaaaattacacacaaatcaaatacatctaagatccatgcaatgaatcacaagttgtacaaaaaaagaaattatacatctcagggaatcacaaattatcaaaaaaaaaaagaatggacgctgtcggctgccatggccgccgcttgcggccccgtcgccgccgccgggcatgaccccgcttgccgccactcgccacacctgaccgcggccccacctgcccgccgctgccgatcgccggatgggaggggaggagggggaggagaagggaggaggaatgggaggaggggggaggaggaggaaggggatctgaggggttaggagcagagggggtgagatcgatccaatcttatctaaatatctcggtgaggaagaaagcccgtctgggacttaaccgatcagagatgggagagaaatatttactcccggttggtaacttcaaccgggactaaagatagatttttagtcctggttggtattactaactggaaataaagatctaaatgatctttactctcggttggtactaccagccaggactaaagtggtaatctttagtcccggttagtagtatcaaccaggattaaagatcctcagccccctgacacaagcctctgacaggggatgaaccggtacttaaaaaaaaaaaatttaaccgggactaaaaacaatatttagccccggttctttttagaaccggaaatattgtggaaatcagccgacccagcaaagatcatttctccagtagtgagtgtatattaatttggggggtgcccaggaacccggtcaagaaattttttagctatacccttaactattttcatcatgtatgcacccctcaatacaaatttaggcacccgcatcatcttaaactcgatctaaagtagagtaaattaagcaagtggcaccaccctctatttcgctctatctccacctcacagcagccccaaatgctgtatatacaaaggcggaaggggttactatactgttgtattggctacaattaattatcttaattcactacaccgaatcgttaagttatctctattctattaatttcaaatcaagtacgtattcatcccgtcccgtgcatgtattgacaaatgataaatcgtgtgctgaaaagcggcggaggcgcgggaggtaggcaccggcgccgcctcctctcgccaatcgatcgacgtacggcggccattcaccataaaatgattacacatgccgtactctagctacttgacacttcacctacccagggcaacgatgccgaatgggttgtccacttaatgcgcctaggctcattttcgtgatgggcctaggttcgtggaaattagggctgccagatgaatgtatttcaatttatgcatccatatttcgtactccctgggctccgttaaaaaaaacaacttttgtatatatctggattcatatatatagaagttggcattttttttgacgaaataaaagtactagtaacatatactaactaatagatataaaaagatatcgtaaatatatgcattttatgccacctatatattagttttcaaattcaatttcattgtgtttcagcagaaatcaacagggaaaaaataatatgatagttttaaaagtacaattttgctagatttttctctttttaggccagccatatctaatactccctccggttctatattaattgacgttttagacaaggttaaaatcaaagttttataactttgaccatcaataactttaaaaatatttagtttaaagaaactaaaacaatatatatagatttgtcttttaaagcactataataaaagtaaatatgcatttatttattatatatattatagtagaaaaataaggtcaaagagatatcttgtagaccatgtcattgttcaaaacgtcaattaaaatagaaccggagggagtaatgtgtcagtataacttattaggtatacctattgtacttggattcgtatctaccataatatactgcaaatccaatattatatggaaaatcatattaaaatagcctatcaacataatgaatctaagaggaatttttatagaagcttacacttacaagtaaaattatttttattttattactattattgtgacatttattagttagcacgtgtgataaatgtatcttaaacttgtgtacaaataatatttttgccggtaattatcgataagttctatctcaccatgatatagatacagccatacatataagtcgtgctttcctatgcgggcatggaaaacaaagaaattatatcaacgtgtgagccatgataatatgaatagactaaatttcacggaactacatatattttaatcaaattatcgtaaaactagatatttaagacgtggtatgataaactacaggtttagtgattaatttagtttttttttaaaaaataaatattcaagactaaatattatgaaattacatacttaatattgaagtgatcacaaactatatattctaaattttaaattcgtaccactatcttcacgcgttaaagctatcaacattctagttttgtgataaattggtacaaaaattataattttgtgataaattttctatttaatctttatttatgtgacacttcattctaaatctgtagttttgtgagaaatttcaagctaattaagtctgtagtagttttgcgatcctttaattaaatatatgtaattttgtgagatttactgataaaaacgatctaatatatataagatgggtattacaagttagaataaccaggtggtcaaggacggtagaactggacatacatcgatcgagtactgcctgcaaacagacgcgagacgcttattcaactcaacagcgtcaacagacagacattgcacgaaactaaactcgtcttattgagacacataaactctagtgaatattgttgcagctcaaataattagcaggtgaaaccggacgggtagttcttgccgcacttgttgaggatgatgctgaggtcgacgggcaggttgaggttgatgaggccgagcacgttagccttcagagcggtgcagaggcagacggcggcgtcgaggtcggcgataccggccagcagcgggcagcaatcgtctgggccgcgcccaatcttcacaccgatcagcccgttgagcaggttggcgcacaccctcagcttcagggcgtcgatcgggcagcggccgtgatcgtcgtgcgacggcggcgtcggggcaactggcttgccggtgcagttagttactgcacacccgaagaacaggatcaggagggtcagggcaagaaggggagcgatcttgttggaagccattgctcaagtggtgaagtgatctagctaagctagtaatggtgctagctagtggagtagacagtgcttcagcttgtgttggcgtgtgatggttatttatagatgattgctactccctctgtgttccatttttatacactacttaaaaaaaccctgataggtacctgctcatatatgccgatttatttaaaactgacacctattgaccatttctcaccttcacatgaggaaaaaatatgtaaccggcacttttgacaattataggtgtcaattctaaataaaaactggcacccggattttttcaaatacctataatatattatagataccagttcttcgaaaaccggcagttgaaaaaaattgagccgaaccgagccaccaattaactcccaccaaagtcatcatgcatccactccattcatatccgatccgcttgtgctctctctctctctctttctgtctcgcacttgtcctctcctccctctgcaacgtcctctcttccctctgcgccactgctctgtcgcctctagcaccacatccattgccactgccaatcgctacatccggcgccgccgcccattgtgccaccaggtctggcggcgatggcattggcatgcagagggcaatcgccggcgacctcggcaaggagagagaccttggcaaccggcaacagctacctccacaccgctcctccgatggcgacacatattgccaacgatggcgggaccggggagagtaagttcatcttgcttgtgtagttcttgatcttgtgttgttgttgatctgtaatctgtgataattgttgttgttgatatgtgatatgtgaaggatgggatgaggatttttgtagttgatatgtaatggatgggattaggggcagcttgaaagaatcgactcatcgagccgagccgatgcttggagctagcttctcttttcatttttttttcttttttgaatcggaaagagcacaaaggaaccggtaccaatgacctagtgtcattggtgccggataattggtcttggctatgaaaccaacacgtatgccaggtttgcaaccagcacctttaaggtgttatgctgtagtaatatgatgaactcaccaacgtcataaatttagggatagaggtaatataaattatatgtcgttttgacttttttaaagttattaattttttgttgaaagcttgatcaactttatataaaaataaagcaacacttatagcaccaaattagtctcattatatttaacattgaatatattttggtttcttttttattttgggttgaacttgatattctttatgaacttgatcaaacctaacaaaatttaactcaggaaaaaaaatcaaaactacttatactataatatactagtaatatggttgtgctaaaccctatggtacaattctatttgtctttaataatttttaaaacttcatgctagcaaaaaaaattttacatgacagggtgtcatagacataatgacggaatccttatatgacaagtgtgttgatgagcacggttttgtggactttgctcgaagtggcgggatgagcaatcaaaagcaatcaaagaaatttctccgcgccttaaacgagcagtgtgacttgtagaaaaaggattgcttttcaatgaatgtatgtgtcatggcaattatgcttcaaatgtcttttttgttgaagagttcttgtctcagttgtcacattatgcaaaatcacaccaggcaaataaattaaaatggaaaaatggacacaattcttattctgctctattgaagaaaatgttcctttgctacttcttgagcatttttgttcttttggtatgtggttgtcaagtgatagaagatatgcagttttcctgatttgtttacggtatatttagtcacaaacaaagcattgtaattagtaggttcttttttccttttacttttttctttttgtgttctttgatcgttccatcatgttctatcccttacctactggattaagatggatgaaacatttgattttttttctcgaatgtatgtgttgacaaaaatccaggaagaactccacaatctaacatgtctctaagtgtaaactggcatcaaagatagttaactaatgtaaattggacatgagcaaaaataactttatcacaatgataatcgagcataaaaaagggataattgctcatttgacgctctttttaagcataataactaccaaactaaccatatattttcaagtttgcttagttgaccctgttttctcaaatcgtattttccgtttgaccctgttttaactctaccgttagggtttcatatagaaaacagagaaaaaaatatttttaccaccccaaataaccaaaatacccttattacactcaaccatatccccaagcccccatccttatccagtcccaacccaaatcttggcaactatggcgtgcagcaccggagctcgccggcatgcagaggctggaggtcgggtggcggcggcgtacgcatgaagggagatggagcccagcatgtggagggcaggcggtgatagcgcgcgcgcggagggagggagcggcacaagcacggagggaggcggacgccggcacgtggacggctagtggtgacggcgtgcgtgcggaggaagggagagacgccctgtgtggcgagaacgactgacggcagaggggcgtgggcggagggaggcggaggccagcgcgtggatggcgggcagtgacagcatgcgcgcggaggaagggagcggtgccctgtgcggcatgggagctcgccggcgtgtgaagtctgggtagatagaaactaggtcaaatgagaagggtataaacgtctctttttccttttattaacaccgtttgcttggcttcacgaaatagggtcacatctgatgttcccttttagaaaatagggtcaaatgagtaaacttaaaaagtagggttaaattggtagttacgctttaaaatagagtcaaatgtgcaattgcctaaaaaaccacaatcaatgatataatcaacatataaagacggagaaaactagcaaacacaagggaggagcgagcgcaatattaatatatatccagattaagggaacaaaactcttaatagtactgttaaccaaagcaacagctgagaaggaacaattctcgattataaagcttgagttaccacggggattcccaacatagctaggatctttcctactcaaaacattcagagccttgacagtctagtccaaccttttgcctatcaaaagtaatctaagacctctgcttcttcttctccttgaagagtgcgagcagtgacactgcagacaccttcacaaccttcaacctgacacctggaatatctcccaaggcatgccctttccaaccgaatccaacaatcagcacctcatcctagagtatccaagatatcagaaaatccttgaaataccatcggcgagtacactaatcccagaaataccatcgacaagagcaactttctgaaaataccatcgtacaagcctttttctcccaaaaatgccatcaccgtcaacttaccgttgattccacaccgctacaaccattttttttcaaaaaatgaccagattgccctcagtccaaaatatacccctcccattctcccaattcacggtaaaagaaagaaaaagaaatgaaaaaaatgtcaccacccttcttgtcgaaacaagattttggcaatactaaaaaggggtggctatcaagctggaaaagtggatgggtttagagacaagaaattttatacaggttcaggccttcttaataagaagtaataccctacttctgttcgaggattgatccgccgagtgttttattgattgtatgatctgagagaaaaatcgtgccccaaaagacacccggacacctccttatatagggaaaggggtccgtattacaaagtacaacccatatccctaacggaataggtagttacagataagatacaatcgtaaccgactaggatcccgggtatttccttgacatagaagtttggaatttaacccgattccctttgaagatattctatctatacatggcaccccatacctaatcggatatacatgtcgtatgggtatggggtatccataatctccacagtagcccctgacacctttacagtcgatgaaatagtcttctctcgtaattcaaatgataatccgagtgcttcaacttcctctgtcttagtcttctgagtagatgcatctaattaggtgtagcccccgactatgtgattagttaaataaaaactaaacatatagtcaaagtgcatcaaaacatccatccgagtggttttacaaccgaatcacccaagggattatatggctaagcatgtgtggcatctgataaaacatccagccgactgctttagctttaatgcgccaaaaatgaggtatagaaaaggcccgagtgagaaacactctaaaggtctataaaccaacatacatgataaaaatccgagtaaaaactctcaaaaagactcatcaaatgtggtataaagcatgataaatgatgagtctaaatagcctaagctatgacccacgccattattaaggtaagcatataacatgctgagagaatgaccatttaaaattagtcatctcaataaggcccgaacagctttgtagcctaaaaaggccaacaaaattagtataacacttttctgttgggcacccttttatttgcattgtagtaattccaaagaattatctaactacgtcaaaaaggattttagcagcattgggctattctgtcgtgagcaacttttgccaaagcaaaaatatatacctaagtccctaaggatcacaaccagccacgctgataataaaattgggctgaaagtattgtttaggcccaggcccataagcatctcccgataccttagtgaaataaacgctaaaatagagcgccgtttcgtcttccccgccgcgatcctctccattttccccacttcccgctacaatgcaaatactgcgccggcggaaactagggttcgcaaatccgcaccattccacccctctcgaagctccgttctcttgcatagatcttccgtacatccatcgcaccaatatcctcttcattcgctgccgccctcgctccaaatctaatcatccatctcgctcccatggccgaggagagagaaagcttcgaaagtcaatgggctccctccgatgtaacggatgagaacttgaaggagatggtagcacatggcgttcttccggcaaaggagatcatcgggtggcgtccggcatgcggcgaagcatttctgacccctgacacacacgaggtcgtggtattttctcacttcttatatggtggttttcctctcccaacctcaaagttctttagggggattgtggagttttacggaattagcttgcatcacctaaaccccaattccatagttcacattgccaatttcatccatgtctgcgaagcttttctagggattaggccacattttgccttattccgccgcatcttcttcctgaagccccagccaaacaagaacaagccgtgcgtcgttggtagggggaccggttttcagttaaggggaaccttaagccagaaatacttctccatgcccttcaaaacctcaaacaagggctggcatgcaaactggttttatgtgcaaaatcctgagctagcactccccgagtactcctgccttcctccaacatatcaagacacccggaactcgcttccaatgggagatgaggctgcccaagcactttctttgatggaacgcatgttgaaacttaaagagcagggtctgcaaggggaacaaatcacccggcatttcatcaagagccggctggcacctatcaaagagagatctcgcactgcctttgagtttgatggcaagaatgaccccaaccgtgaagatccagaatctcttgagtttaaaatcatgaaggagagaatgtacaaaatcttctcaaacgctatcgcggttagctgttcacacctgctgccagtggtgccatataatgctttcaaccctcctccaccggtatgtatcagacatctcggcctttcttatgacatccttttgtcttttgtaaggttggctgaaaacttgaaatatcatgcataggaattttctttaatgaaatctgatcctccaatcgctcaacgccgctcaccccgccggcaggctggtcaggccagtggagggccgaaaatccggtctgatgctcagccaagcatctcaaagccaactaaccagtcggactctcgcaaaaggaaattaattctgagtgacgacgagggtgacaatgttgaaaaagctggcaacaaagaggtgactggaaaacagccaaggcaagctaacccgaagaagaaaacatccagtcgtccaataccaaaaatcaggaagtcatccaggtacaagtcattaagcaatttcccctgtatcgccaaacatacaccatcgaagtagtgttaatagcatatctcaaatctgcaggaagccatctgacatcgatccttctaggaaagactaaaccgactagcatggagactggtcctacgacctccacagaaaccgggccgaccgccgaaaatcgcctgactagtagtcaaccagcgaccgataatatagaggccagcaatgagcccctgactggaaaccagtcggccgaagctgaagccagtgctgatcaggtgcccccgactggaaaccagtcgggtacagaacaaaatgaggacatcccggaaacagaggctcgagcaagcagccttccctaaaaagataccaacaccgacccgaagtccagttcatccgataaggtgcaagggccttctcgtcctcaaccaaagatcataacaggtaatcagctcttccaaattcattttgatttgacaaattctcttcgattgttttatcatcatcatctgtgaatacgtaaaggcccaatgatcggtgacgaagaagttcttcggatttagtcagctgaagattctcgccaacccatcttagttaaatggtgggatgatgaaatgcagccacaagggattataataaataagtagaaagaagacgaggaagtgtctttgcttgcaaagacgctcaattaggccactcgtctcgtaaatgtatgttttttgcacatagctttactcatcctgttggccacttcactgaatagagatgaatttgcaatgcacagaattcatcttaggaatgaagcaaaaactgcaaccctcgagaaactggttcctcaccatggaaccctggaagagacaagagcccaactccatgaaaccagggagcttgccaggaaaactgaacatgatcttagggaccgaatcgccaagctccaagattccaatttcgagctgagtggttcatccaaaggtaacattttttcctgtttgacttattccaagctgctatccgtatgtaattaatcaatggaaaatattatagtgcaagttgccaagatcaccgagctagaaaagcgaatcaaagctctggaaaaagacaagggtgaattgaccaaacagagggactcggctctgaaagacatcgaaggtatttgtagttaaaactccagaaccattcttgtcttcgtgcccagtcattgatgtgaaccatttatgcatattgcaaaattaaatctcaggctcaattcgacatcttggtcaacaaaattaagaagcttgaaggagccagggatgaagttgccaacgccgctacaccactcatccaagccatgtttttttaataataatggtctgagttcgttcgacgctattgaaacttcgacaagctgagagctgcttcggatacatactttaagaacatcaaagaagctggatgcatgggggcgagcatggcattggcaatgaccaagtccttgtacccgaagatcgatattgacgctgtcgacggctttgcagacgggaagcaaattgaattgataagaatcacactccattattattatagtagcccctgactgataactcaaggagcaacttgatgttagcaatcaaagagggaaagaagatacaaaagtaatgcctaagcataaaaacgatgaagatgctcaatattccaagagttgtcgacatgagtaccgtcttcacgcttgagtcgataagaacctggccgagtaactttagaaattatgaacggtccctcccataatggagataacttgtgccgatctcgtgtagtttgaattttcctcaaaacctggtctccgactaagaaaacccgcgatcaaacattgcggttgtgacaacgtcgcaacccttgtaaataccgagccgactgaattaaggctgccccacgggcttcttccagtcggttgagatcgtcaactcggtcttctccgtagcgctcctccttgaagttgcaaaatcgcaaagattcgaactctacctcgcttggcaacattgcttccgcaccatagaccagaaaaaacggtgactgacccgtggcccgactgggcgtagtatgcagagaccaaagtacggatggcagctgatctacccatttgccagcatagggatgcagtcggtcgaaaactcacgctttgattccttgaagtaccataccattggcacgttcgacttatccattgcttataggatgcgctacggaggcatagcaaattttgatgccgaagtcttcacaaaaatctttaaacacatcgccagtgaattgagtaccattatcggtaatgattcgattgggtaccccgaaccggtgcacgatgttgatgaaaaaatctctagccttgtccgctgtaatcgtgacgactagtttggcttcaatccactttgagaacttgtcaatagctacaaaaagataagtgaaaccaccagtagcccttttgaatgggccgaccatgtcgagcccccaaaccgcgaacggccaggataacgggatggtttgcaactcctgagatggtaaatgagtctgtcgggcaaaaaattgacaaccttcacatgttcgcacaatttaatcggcgtcggatacagtagtaggccagaaaaaaccctgccgataagccttgccaacaatggttcgtgcgacagcgtgattgccacagatgcccgagtgtatatcttttagcaattgccttccctcctccaaagacatagcattgcagaatccctgatggacttttcttgtacagctcggtctcatgtatgacataaagcatgctgcgcctggagatccgctccgcctcgtctttatcctgagggagttcttggtcaaaaacttgatgaggggctctctccagtcggcttcgatcatgcttacttcttgagtgtccacagcctcggttatttcctttcttggtatggtcggttcataaagatgttcaacaaacacatcagaagaagctgtttctcgtttcgaaccgaaattggccagtctgtcggctgcctcattgttatttcgaagaacatgggttagatcgaggccatcaaacttatcttctaacttgcgtacctcctgccgataagcagccatattatcatcgaggcaggaccactctttcatgacttgattaacaaccaactgagaatctccacaaactatcagacgccggatctccaaagatattgcgatccttaatacatgaagaagcgcctcatattctgccacattatgggacgtagaaaaatgtatccacaatacgtagctcagcctttctcaagtcggggaaatcaggacaactcctgctccggtgcctgaaagcctctttgacccgtcaaaatgcatagtccaatactccatcttttctataggcatgtcttcttggcactcagtccactcagcgataaaatctgctaaggcttgggacttgatcgaaattcgcggcttgaaggatagatccaaagacatcaactctaaagcccactttgcaatccgtccatttgcctcgcgattatgaagtatgtccccgagtagaaacgatgtgaccaccgtgaccgagtgaccttgaaaatagtgagataatttcctaacggtaattaaaacaccatataccaacttttgcacctgaggatatcttgtcttggagtcggctaaaaccttgctgacgaaataaattggtcgttggactttttcaacatggccatcttcttcacgctcgacaaccaggaccgtgctcacaacctgagatgttgccgacacatataacaacaatggctcttgcggatgtggtgaagttaagaccggtggagtggtgagaagtttcttgaggtcttcaaaggctttttgcacttcgggtccccactggaaattgtcggttttctttagcaacttgaaaaatggcatcctccgctcgccgagtcgtgagacaaaccggctgagcaccgccatgcatccagttagcttttgaacgtctttctgggaactcggcggtttcatgttgagaatggcgttgatcttctacgggttggcctgtatgcccctatgggatatcataaagccaagcaacttccctgacggtactccgaagatgcacttttcaggattaaacttcatcctgaaggcgcggatgcttgcaaaggtctcttctagatccgcgatcaaatcagccttctacttggtcttgacaactacgtcatcaacataagcttcaacgttgcgaccaatctgagttgaaaaatatctctggatcatgcgttggtaagttgctcccgcgttcttcaatccaaaaggcatggtgatgtagcactaagccccgaacggtgtgatgaatgaagtcttcaagtagtcggactcttttaatcggatctgatgataccctgagtagcaatccaggaaactgagtagctcgcagccggccgttgagtcaactacctggtcaatgcgaggtaacccgaagggatctttgggacaagatttgttgaggtcggtgtaatcaacacacatacgccattgcactgtcctcttccgaaccaggaccgggtttgccagccagtcgggatgtaggacttccttgatgaagcctgctgctaacagcttggtcaattcctccgtgatcgcatccttcctatcctgtgcaaaacggcggagtcgttgcttaatgggtttagcgtcttccttaatatgtaaagagtgctcaataacctctttaggaataccaggcatatcagatggtttccacgcaaagatatctttattattttgaagaaaggtgatgagcgcgctttcctatttacaatctaactcagcgcttattacagcagtcttagtgggatcagagggatctagaggaattttcttagtcttggcatcgccttctccgctctttgatatcttggatgcatgtcacaccctaaaaatcttaaatatataaattgttgtttaattggaattattagaattgattttaaaagcctagaagagaagatctaattttaaataataaattccaatataaaattgggccagataaaattttattaaaaattttgcttgattctatattccttgattttctgggatttatttgagccaaggaagtatttttaataaatggaattgaatttcatgaataatttaaattggaaaagttttaaaaagtcttcttttggctttgggccgaaagtcggcccaaatctctctctccctccctcggcccaagccgggcccgcaagcgagccgccgctcacgcgtgcgcgcgcatccgcccgctgacaggtggggcccaccagtcagggccgtcgtcaacctccagccgtcgcccgactgaaccctagccgagccgcgccaccgtctccttccaaattcgttcatccctttcccgatccggtgaaattgatagagggaaaatgatccccgagatccactctaccttttctcttttggaatcgtcggctaacatcgtttggaaattggtagattcgatctcgaatcggattcgtctctctccccgaaccctagactttccttcgggccgccggccgccgtgggccttcgccgccgccccctagccgctataaaaggaccctcgatgtctcctctctccgccgccaccctcgctttcgtctctcaccgccggtagagctctagcgccatgtagcctagcgccaccgtcaccgccgttcgtccagccgtgcgccaccgtcgctccggtcgtcgtcgtcgctcgggaaagccgccgtcgtgatcatcaagtcgtcgctgacctcgtccgcccctccgttgtcgctgtagatcgccggagccccgccgtcgtcgtcgagccgaaggtcgccgccgcttcttcctcatcgctgtcgccgtccgttgaccatctgctgccgttttggtcaccggtgagttcgccgcgtcgcccgcaacccgtaggtgccgtccgttcgcgccgccgtgccgtcatttgccggtgagcacgcgaggccgagccaccaccggtgatggcgtcaccgttgacgtcatcgatgccgtccgccatagacccgcggtagatcaagatgatctcggtcgttcattttggataggatcaatcccggccgttcgtttccgtgagtcaccgccgtgcacccggtccaccgtgaaccctagccgctgacgcaataatccccttttcctgttcaaaaataattcaatattgcgtcataattcaattaaaatctatataaatgatttaatccgattaaatctttgaaaattcataactaattcatcttagctcggatttagttggttcaagtctctaaatttttctaaaattgagatctacatgttaaaaatatccacatgtactgctcatgcttgtttatgtgctatttgggtgattttgttcttttctctttagattccgacgttcccggagagtccgaatttgcaggagaagactttgaagagttccaaggccagcaaggcaagtcacacagatcccaaacgatcctttgagcatgttgatcccgtttaaagctattgtttctattcaactattgcatttatttttgaatgtcattgggtggaaataacctattgttttgttatggcccttttgtccttgattactctattccttgataccttgggttattataattttactagttgagctttatatgttggttcagctagatattagacagaattgcttagccatgcttagagacactagctcatataaatgggataacttatgattcactattatttaatgatggcttaatgatagctcacgatggttgatcgtgattggttaattaatcaatttgccaaccaaaacctgataatggtgggttgtgagcatatggttttgatggttgtgctcatgacaattaaggaccggttcacgattttcggttgtgaaacatttaccgtgccaaccacaagccagcgttggcaacggctttactttctgtatagtatggttcatagtagagcaccagactgtgaagtggcggagataagcccacgggggtcgctggggagtccatgccttgtttaagggggtgattatgatccgggaacggtgcactgctttgaattgtattatatagagggtattgtcacaatctctattcgggtacttgtcaagtatcgcgacgcatggttgacatgatgttgaggttgtgtcttgtgggtacagtggtacacctttggccagagtttaaactattcgaatagtcgtgcccgcggttatgggcgggtctaacaatgtctttcgtgattagtctcacatttctcaccatattaatgttaataacttggttagctcctggtttggaatggttaattcctggtttggagttagaactgtgcagccggggttggttgttcagaatggttgggcctacgcaacagggtatgttgcatagcgttggattaatattgtttaattattatttaactgttttattaaattctgaaatatttgttaaatgctatttatgcaaatgagactatattatgccatcctttgctatcccgtgcacttgcatatttgctacgtggcttgctgaatatgtcatatactcaccttgcaatcattcatcagaggaggagttctacagtgatgctgttggtgtggatgattaggagtagccctggtcaagctgcctgtggagaggagtcgcctgcgctgtttcttttattttccgcttcttagaactttattgattgagaggaactatctacctctgtaatgacattttgttcgcttattaattagagtaataattgtactgtattatcaatttgttattgtgtgcctcggctgattcctggacgagggtttacatacatgtaagcgtttggaattttggatagaaattccgggcgtgacattgcaggcacttctccttcggttgctgttgatgcagccagtcggatctcctctcgagcgagcgtgatctcgcgagtctgggccatctcgcagctttccttgtcgcaggtgacggtttgcttgatgtcactccgcagggatatgactcctcgaggacctggcatcttcatcatcctgtagatatagtgtgggacaaccatgaacttggctaacgccgggcgtccgagtatagcgtggtacgctgtctcaaagtcagcaacttcaaagcaaatgttctctgtgcgaaagttctcccgagtgccgaaggtaaccagcaaagtgatctggccgagtggagtagaagatagcccggggatgaatctgtgaaagggcgcactactcggcttcagttctgtccgagggatctgcatgtcgtctagagtcttggcaaaaaggatattgagtgcgctgccaccatcgatgagagatcgtcggagcttgacgttgcgaaccactgggtctagcactagggggtaccaccccgggtggaccactcggtcaggatgatccgggtggaccactcggtcaggatgatccgagcggttaaacttgataactgtctctgaccaccgaagatattggggtgtatcgggctgaacaacattgttctcccgtttggtcagcttttgctttcgcttggattcataagccaggggtccgccaaagatgtcgttgagttccttgcgggagtcttgaaaaccagtcggggcatcatcttcatcatccttcttctttgacatgctttgatctccgtcagtcagcttgcgtgcattcttggcgtattgctctgcgaactgtttctagacgaagaaatatttggccgcatgatttgaattcggacgatgcgggcattgggagttcatgatcttgtcgaaagtgttgacgtgtgagcgctgtcgggaggatggtgtagtagttgccacaagttcctcgggcttacgcttgcgatccttgtgattggcacttccactcccccctgtagtcggcgcatctttctttggcttccaggtgctgcccgactgcttggatgcaatgacaacgtcttctactttggcatactcattggctttttcaaacatctgcttgacagtcttgggaggcttgcggccaaacttgccgactagttcatggcgaatgcccttagtgaaggcggcgatgataacgtcgtcagtgatatcagagatcttgttacgttgctcagagaaacatcggatgtaatctcgaagggattctccggacttctggataatgttgtaaagatcaaactgggtaccaggacattcaaaagtgccctggaagttggcgatgaagtggtcacgaagctccgcccaggagccgatcgtgtcacggggcagcccgtgaagccaggaccggacagagtccgctagggccacggacagataattagccatggctttgctatctcctcctgctgcacgaattgcgagaccgtagactgtgagccaagactcaggatttgtcgtgtcgtcatacttctcaattccagtcggtttgaagccggccagcaaatccactcggcgtaggtcacttgtgaaggcagcaactccatccacatcgtcgtcataacgatctggtgaatggtgggggatgtggcctctcgccgcacatcactggttgatagtatcgcgatgatcgacgggacgccttcgacgtggggagcgaggttgttcgacccgacgctccctgtgtcagtcggtgtgtcagtcgggaggcgagtgaatagatcgttcaccgtgatccctgctcctaaaaggaggtggctatcaagctggagaagtggatgggtttagagacaaggaaatttatacagattcaggccttcttaataagaagtaataccctactcctatccggggattgatctgccgagggttttattgatcgtatgatctgagagaaaaatcatgccccaagaggcacccggacccctccttatatagggaaaggggtccgtattacaaagtacagcccatatccctaacggaataggtagttacagataagatacaatcgtaaccgactaggatcccgggtatttcgttgacatacaagtttggaatttaacccgagtccctttgaagatattctatctatacatggcaccccatacctagtcggatatacatgccgtatgggtatggggtatccataatctccacacttctacaaccctaaaccagattcaggcgtctcttccgcccagcgacgacggcgaggcagcactccacggtggtggtgccgctatgcctgacgcagtagttccaggaggaggcgcgggcggtacatggcggtatcggcgcggcagtcgcaaggagcagtcaggagtccgaggcaatggcgcagggtccttaggcggcggcgatggcgctggctccacaggcggcggcgcggtggtcacatgcatcggcgcgggctccacaggcagcagcgctggcttcgtaggcagcggtgcggcggtcacaggcgacgacgaggaggccgcaggcgccggcgcggaggtcgcgggctatatatgggtgattttcttcttcctcgccttcttctttagctaactcgtagcattgctgctgtttgtttgtggcttgctcttgccacgcagagattctgagattccagcaacagcggcggcgtggtgggatgtgttgttcatatgctttgcttgactttatatcatagacccgcaatattgttgcctgtatttttcctcttgttttcaagatcgacttttttagagttctgctagcctgtactgttctgagcatatagtggtgttcatatgagttcttgcctagctattttgtcattcagtttaattttggtggttcctgacattcaataaatttggacaaattttggtctacaactcgaaaatgagttcgtatatcatagtgcagatttcagttttaggaatagtaatcctaaaatttggacagtttcagttgtgtgaaaattgaaaatttcagtttaagttttaggaagaatattacctggtgcaaatattccaagaaaaaatccactctttaccaaagtactacctccgttccagtaaaaaagaaaagtactacctccatttcaggttataagactttttagcattgtccacattcatatagatattaatgaatctaggcacacatatatgtctagattcattaacatatatatgaatgtgggcaatgctagaaagtcttataatatgaaacgaaggaagtatcaggcagtagttttgccgatacattatccagccttcgcaagggcagaatggtctttacaccatgtccaatggagtagagctgacagagcagtgatggtgatggcatttctgagagaagttgattcgcacgatggcattttggaagttagattcgtcaatggcttttcttggattagaacactcgtcgatggcatttcatagattttcactttgacgtaataattcaatactcatgtggtattcctccgttagagaacatgtaagctttgaaatcagtcgagctttactgtggtctaaatcaactatgcaattctctgtagactcaagggttaattagctccttgccactacaaatataccaaattagaaaaatattactactattcacgatatcagcaacgtgtcactggaatttggggaaattggaactataccactccgttgcattttccatccacttttctatcatccccgttaattctatctgccaactacggtggctagccaacaacgactatgcagggtgctcaactgccgaaagctgtcggacaaggcgtgcgcgcacgaggcacagaatgagctcatcccgctccgtgtggtggtgcaggttctcttctttgagcatgcgcgcgcggtgttcaagattgccatgcatccgatgaagctggaggaggattgatgaggacatcccttccaacgatacaaccatgcctattgcacaacaaggaccaatgactagagctcgagctcgtgaacttaattatcaggtaaaaccattcctagctaatcatacaagttcttctcagaattgggtgctactaaatagttgttgtgatctacttgttgttaggaatatgggagaggaaccagatcgcaagcaacactagcaatgctgatttgatgaagtcaatgctcttcactccggagggcaaacggggcaaatgagtacttgttggaaatatctcatcgtctactttcagctatgtatggcctcaaatttgacccaggctgctcagaatgacgaaaataattcttcacatcagaaacttgggcttgggccttgtatctttacagcccattaggggtccacaaaacctagggtttgctcccacctcctctcctgatcattcctccacttatataaactcctagcagccaccattttgcactttgggttttgtttggatgtaagtttagctgcagctacttccttgtactcgcgtgtgtcggctagaccacccggatacttgtattcagaaccccattctggtttgtttcagtttcatcacttgacaagtgacgtgagttgtttccttgtcaacttgttcttgctagttcttcgattgcttgcaggttcaaggttgttcttggcacggtaagaacagcaacaacgtggagtcagtgtaccggttgctaaggcgcagcacctctgtggtagttgtagtcggatcgccaacgtcgtgtcctcccccaaatcgaagtttatcctcctcttatcgaaagatcgggaacccctgctgctgcatcaagtggtatcagagctcaagttgctaggtgagagattttatcacttctttgtttttacctacagcccaaaaaaaaccacaaaaataggtcagatccgaaatcaccaaaactagttgagcctttgtagttctacttagtctttgcttgctgagttttcgattgcatcgattggttgagttgttggttctagtagtttagtcttttagagtttcgggttctactcacgattttgtcaccacatacacttccaccatcacttcatttatcttcatcccgctgccaccatcaccaccatattcaccacgaaatccacctccaaccccaccaaatttcgtccaccacaaccagcagcaccctcatcaccacatcaaccacccccaaatgcatttattgctgcctccaccaacagccaacccttttgcaactttttgaagtgaatcagcccttcccaagaaagcatttaagtactctcacttttgacttgttggctgaatcatgtaactagccaaccaacccatcattacttcttgttttgatttgttggctgaagcttgtgaaatttcgaaaatgtttgggaaaaggttattttgctaaggcttgttttgacttgttggctgaagctttgagcttgctgtaaaaaaaagaaagaaatgaaaaaaaagaaagaaaaaaatcagaagtgaagagaaggaaaaaaaaggaaggaaagagaggaagttgttgttgctgctgttttgtttgtgttattttcgtgctattttgcgtggctacgcttgtgactaggctcgcgtctctaaagggttttgcctaggaccagcacaataccatcgttgagcgattattcaacttgcattgattaatgtggttctagttgtaccttgatattacttgcagccacctatagctccacaatttttatctactatatcacaggatcgtgcttgttgtcggctccggtactactaaccattgttgttgttcttgctggttgccaatgccttttacataacaaagtaagaacatgtaagaactcgtttgcacaagtttggtagaaatggagatggacaacacctagctccaatagttgataggacatatttcttgtgaattgtttcttcccattaaccatgacaggaggatcgagggagcacactcaactttcaccacgtacgagggacatcatacaacattttgagcgccaagtgagggagcatgctgaaggccttgatgaggatgttagggtcgccaatgatcgccttggtcaattggaggctgctcaaattgacaccaactccaagctttcctcattggagaggtcccttgtggctttgaacacttctcttgcaggtatcttgaatacgttggagagaatgggccaagatggtcatgatggatcggctaggcgcaaccacaatggccatgatgctaatagcaacatcgcggcaagggaagaactggagtacgctactgacaccgagcatgatgaggagatacttggtcgtccacaaagacaacagtgccggcagcgccatggcatgggcgctccaccacgacgggaggtacgtgataatgatgattctttaggcacgatcaagtttaccattccttactttgatggaaaatatgaccctgatgcatatcttacttgggagttagctattgatcagaaatttgcttgccatgattttcctgagaataaacgtgttagggctgctaatagtgagttcactgattttgcatccatttggtggagtgaatttgttcgttccaatccaaataataacactccccaaacctgggatgcaattaaaagagtcatgcgagctagatttgttccttcatatcatgcacgtgatttgctgcacaaattgcaacaacttagacagggaaacaaatatgtagaagagtattatcaagctttgcaaacaggaatgcttcgttgtggattggtagaaaatgatgatgctggtatggctagattcatgggtgggctgaaccgagaaattcaggacattctagcctacaaagaatataattcaattaatcgtttgtttcatcttgcttgtaaagtgaaagggaagtgaacggacgaagagctagcttcaggactaacatttctgcaggtcgtgctagctcctggacaccttccaacgctgctgcaccgtcaaatcgagcagcagcaccatcgtcctcaagcaacaagctgcgtccctctacaacaaactctataccatgcccgagtgaaccaacaagaggggttgttgctacaccttccaagagctcatcatcagtggcatcatcagaaaggacaagagatattcagtgcctacgctgcatgggctatggtcacgtgtgcaaggactgcccaagcactcgtgtaatgatcgtgagagctgatggtaggtactcctccgctagtgatttagatgaagaaacctatgctttgcttgcaactaacaatgcaggggaaggtgacgcgccccacaaagatgagaaacacattggggctgaagctgcagagcactatgagagcctcgtggtgcagcgagtgctcagcgcacaaatagaaagggctgaacagaattagcaccacaccttgtttcaaaccaagtgtgtgatcaaggaacgctcttgccacgtgatcatagatggaacgtgatcatagatggaggaagctgcaataatttggctagtgctgaaatagtggagaaacttgcattgagcacacagccacatccgcagccctactatattcaatggcttaatagcagcggcaagataaaggtaacacgattggtaagagtacattttgccattggttcttatcatgattcaatcaactatgatgttgtgcctatgcaagcatgttctatgttattaggtaggccatttcagtttgataaagattctttacactttggcaaatccaatcaatactcctttatgtataatggaaaaaaacttgtgttacatcctatgtctcctgaagtaattttaaaggatgaacttgctgagctagcaaacaaaaaaatcaggagcatactaggagtgagcatcttattgcagctaatgaacttgagaagcataagaagaaacccaccaactctgttcaaaataataaaaaagagattaagctgaagggatcttgtttcattgcaacaaaatcagatttggatgaagttgacactgacactgttgtttgctatgctttggtttgcaaagaaaccttatttccaattgaggatactcctatttctttgcctcctccggtcactaaccttttgcaggagtatgctgatattttcccaaaggaggttccactgggactgccaccaattcgagggattgagcaccaaattgacctcattcctggggcctctctgccaaaccgtgcgccatacaggaccaacccggaggaaacaaaggagattcagcgtcaagtgcaagagttactcgacaaggggtatgtgcgtgagtctcttagtccttgcgctgtccccgtgcttttagttcctaagaaagatggctcatggcgcatgtgtgtggattgtagagcaattgacaacatcataatcagatatcgtcatcctatccctaggctagatgatatgcttgatgaattgagtggttcacttgtgttctctaaaattgatttgcgtagtggttaccaccagattcgcatgaagttaggagatgaatggaaagcagcttttaaaactaaattcggcctatatgagtggttagtcatgccctttggtctcactaatgcacccagtactttcatgagattaatgaatgaagttttatgtgctttcattggcagatttgtggtggtatattttgatgacattctcacatatagcagatcaatagaggatcatcatggtcatttgcgtgctgtttttgatgctctacgagatgcacgtttatttggtaaccttgagaagtgcacattttgcatagatcgagtctcttttcttggctatgttgtgactccgcagggaattgaagtagatcaagccaaggttgaagccatacatagctggccggttccaacaacgatcacacaagtgagaagctttctaggagttgctgggttctaccgccgctttgtgaaggattttagcaccattgcagccccactacatgagcttaccaagagaaatgtgacattcacttgggctgtagcacaaaggaatacattcgacactttgaaagataagttaacacacgctcctttattccaacttcctgatttcaacaaaacttttgagcttgaatgtgatgctagtgggattggattaggtggtgtattgttacaagaaggcaaacctgtagcatatttcagcgagaaattgagtgggcctagtttgaattattctacttatgataagaaattgtttgctctagtgcaaacattggaaacatggcagcattatttatggcccaaagaatttgttatacgctctgatcatgaatctttaaaacacattcgaagtcaagcaaaacttaaccataggcatgctaaatgggttgaatttattgaatcttttccatatgtcatcaaacataagaagggaaaagaaaatgtcattgctgatgctttgtctagacgttacacaatgctatcccaacttgacttcaaaatttttggcttggaaacaataaaagagcaatatgcgcacgatgatgattttaaagatgtgttgttgaattgcaaggagggaaggacttggaacaaattcgttctcaccaatgggtttgtgtttagagctaataagttatgcattccagctagctctgtgcgtatgctattattgcaagaagcgcatggtggagggctgatgggacactttggtgtgaagaagacggaggatatccttgctgataatttcttttggcccaagatgaggagagacgtggagaggttcgttgctcgctgcacaacatgccaaaaagctaagtcacgccttaaccctcatggtttgtatatgcctttgcctgttcctagtgtgccttgggaggatatttctatggactttgttttagggctgcctagaacaaagaaggggagggacaatatctttgttgttgtagatagattttctaagatggcgcatttcataccttgtcataagagtcatgatgctacacatgttgctgatttgttctttcgtgagattgttcgcttgcatggagtgccaaacaccatagtttttgatcgcgatacaaaataccttagtcatttttggagaaccttgtgggctaagttggggactaaacttttattttctactacatgtcacccccaaactgatggacaaactaaggtggtgaatagaacattatctacaattcttagggctgttttgaaaaagaatactaaaaatgtgggaagaatgtttgcctcatgttgagtttgcttataatcgttcgcaacattctactactaagaagtgcccttttgagattgtttatggccttctgccccgtgctccaattgatcttttgccccacccaacttcagagagagtgaactttgatgcaaaacagcgcgctgatttgatgttaaaacggcatgagaccactaaggagaacatagagcgcatgaatattaagtataaacttgctgggagcaaaggaaagaaacatgttacttttgaacctggtgatttggtttggttgcatttgagaaagaataggttccctaatttgagaaaatctaagttgctacctagagctgatggtcctttcaaagtaatacaaaagattaatgataacgcatacaagcttgagctacctgccgattttggggttagccccacgtttaacattgcagatttaaagccatatttaggagaagaagatgagttagagttgaggacaactcaaatgcaagaaggggaggatgatgaggacatacgttccaacgatacaaccatgcctattgcacagcaaggaccaatgactagagctcgagctcgtgaacttaattatcaggtaaagtgattcctagctaatcatacaagttcttcttagaattgggtgctactaaatggttgttgtgatctacttgttgttaggaatatgggagaggaaccagatcgcaagtagcactagcagcgctgatttgatgaagtcaatgctcttcactccggagggcaaacgaggcaaatgagtacttgttggaaagatctcgtcgtctactttcagctatgtgtggcctcaaatttgacccaggctgctcagaatgacgaaaatagttcttcacatcagaaagggcttgggccttgtatctttatagcccattaggggtccacaaaacctagggtttgctcccacctcctctcctggtcattcctccacctatataaactcctagcagccaccattttgcactttgggttttgtttagatgtaagtttagctgcagctacttccttgtactcgcgtgtgtcggctagaccacccggatacttgtattcagaaccccattttggtttgtttcagtttcatcacttgacaagtgccgtgagctgtttccttgtcaacttgttcttgcttgttcttcgattgcttgcaggttcaaggttgttcatggcacggcaagaacagcaacaacgtggagtcggtgtaccggttgctaaggcacagcacccctgtggtagttgtagtcggaccgccaacgtcgtgtcctcccctaaatcgaagtttatcctcctctcatcgaaagatcgggatcccccgttgctgcatcaagcacgaccacaatggcagtggtgacgaggacgacgagttcgtgcgctggtaatagggtgcgcaaggatagaaattgacaggaatgatagaaaagtgtggatggaaaacacgacaaagtgacacggttttaatttccccattctagtggcacgttaccgatatcgtgaatagtagttgtatttttttaatttgtcatatctgtagtagcataaatccaaataaccctaaaataaattgcacaacctgatttcccaattaacttatccctctggttttccgcacgcgcgcttttcaaactattaacggtgtttcttttgtaagaattttctatacgaaagttgttttcaaaattatattaatccatttttttaaaaaaattaactaatacttaattaatcatgcgttaatacacacaccgttttgcgtatcggagaggaggggttcccaactcctcctcccgaacacagcctttagtgattaggatctccgtaggggagacggagggatctggcagcctataggctctttggcaggaaacaatctggaaataggtggtaatcctatcccagattcaatcgggtctccagtctttgcactctagggtgtcgagacggacggcagtagcgacctccgggtgtctgtgcagcaccagcaagagttgaggcagacagcagcgcgcagcaacctcccagggaagtggctgacaagcttgcgttggtgcgaaagcaacatgctccctccactatcagcgtccacatctggacgcgactcctaggagcatccatgtttggacgctatttgtagtagcgtccttattactttggttcatctttcctcttaattactaataatttaatttaagggattttaattattataaataaaaaagctggtgctccaccactgcttcctcctgctcctgggatggagccccatatccgatgcgaaaacccgctcccctgcttcctcctcctcgtccttcctgtcacgggctcgtggcgtgggatgcaacgtggtgctagtgtgctactaattgagacgactgagtaagtgtgttcctagcaagggagcgtggtaagtcttccatcccgtgccaccctgttagatgaggtaattggtgctatcgtcgttgcgcattagactccggtcaaaatttggatctatagcagaggagaaaagggaaatagttaggcaagctcgtcatccctgcacgcggaacgtatttcacactggagatggggctccactgcggcactgccccagctgatgagaagtagacaagggagggggagacgagagggggggaattaagcacttgaactagaggtagaagataggtgctgtaagattcatgcgcacacgtggtggtagataaacggagtctttccaaacgtgagaagtaccgaggtcctgtacagttttcttccattgagtaagatggcttttctgacacaattgattgtggggtccagttcgtccaagatggacgagaagaagcacaacacggatccaaacactcgaggattaaatcgaaagaaattcatcctaaatttttacgaatgactgttagcaattttgtatattgtaaatcatgcttgcacatatagccatcaatttgggcagaaccatactttcctcttactgttatatagcatctcgcatgaaacatgttgcattgcgttcaaggtatatattaggttaaacaacaacaatggtattatttccataccattatatgaatattgtaaaatcacatgatcgtcatgaccagatgaacgaaattaatattgtttgtacatgaccaactagagagctgttcagctaaatttgcaaaataataacacacagtacaaaattggccggtagctagctaggtttcgtctaactgccatgcaggcgaaccctagcgcgaggttgccagccaggggatccatcgcgtggtcgtgagcaaggctgcaataaccgaagctcgaggcaaaagcgtccgcaagagagggctgcaactctggtgccggccactactagaaaactcattttcggcgtcgtagggtatcaattttcgcaggcgggcatgtaattcggagccaaaaccccactggcaaaaaatgtacccggggtggagggcgcggtccgcctgcgaagatcgatctttgtaggcggaccatataagcgtcgcctgcgaagatcgatgttcgcaggcggcaaacgtcgtgcgcctgcgaagatcgatcttcacaggtgccacttatatggcctgcctgcaaagatgcccctatatagtcttcttcctacccaagccctattcattctccccgaagtttctctctcctaaagtgacttaaatataggggggaggttttgaacttcaaatcttcgggggatttttctacggtgcttagatctactcatttcgggctgca

SEQ ID NO: 72021 - DNA, 2188 bp, Oryza sativa
atgtgagatgaaattcctcacacttgtctgaaatcttgaatgatcaatgaatgtggctaatcctatgctatgccactgcttaatttatagcttggttgactggttgtatggcttggcagtttctaaaatagcagtccaccgaaagatagtgggccaataataatggtatggctaataataaaggtggaatggcttggcatgcatgtaaacatgcaggaaccggtagagtgacatggcccaagaaaatttggacttaaaaagacattcttgctgcacgctagaaagtaaacatcttggacatcaattttagatctaatggctagattaatttgaagtgatgtggcaagctgtgaaaagagaaaattagcactagttgcacttagtgagaatgaaccatatagatatataaaattaatgcccttctcgattaattccttcataaaaagttaagaaggatttagagaggattacttaatctccaacattccttccggccttcacataagaattaaccgaacaagctttttttttctaaggcgtggaagaactctttttcaaaagaattttcaagcggatcaagaggatgttttgagaatgaaaagatcgaatgctaattttaaataggacctctcatgttctttttatagagcatgcatgtgtcatacgttcaaaacacgtcaattataaaaaaaaaaaaagaggtggtacactttaactgtatgatttagtgcaagcgcaacaataatgttcagatgatgatgtaatgctgtccgttcttaaactgcaagatttgcagacacttctttgccgactaatctcaaagacaatataagtatttattgatcaccgcttttcatcgaatcaatcactagctagtaacacaccgacacaggtggggcctggcccacgtggggagagccggagagagaccagcaccgcgtctagcttccacgtgcttatttttaaaagacaaaaatacaaatccatgtactcgcacactcgttagtataaatgcacgcgcgtactttatttttataagcaccttcaaaatacttaccggtactccctgttttaggttataacttcaaatttaactaaatttatagaaaaacagaaatattttcaactaaaaataaatttattataaaaatatatttaattattaatttaataaaactaatttggtaatgtaaatattacaatattaaatcttgagttgaaaatatttctattttttctataaacttggttaaactttaaatagtttgactttaaccaaagtcaaaatatcttataatctaaaacggagtatacctttagattgatgaagtcgtcattgatgtcacactatcgacgagtatattatatatcactgaaagatgaattagtcgtaaatgtgaacatatcaagtctagaatttgaattcggatcaactgattccacttcgcaacatccatgtgcttttgaattccacgtgaaggagaaaaagggtttgaaatattggacttttgcaaatttatcttctaaaaagacttcagattccgttgattaattatgtttgaaacgagaagttctggggagttaaaactgctaactggcatggttcagaactgagtcaagcacaccacaacatcgaccagagcaagaattccgaattccacgtttcgaaaatttcttaaaactgatcaaatcaattccactataagtttataattcgctgaatcgtgagcctcttttctcctctttccatccccctccttttcccttcctacttccaggctccagcagaccagcacgcctcttctcctcttctcttcacacaacgtcattgtgttagcagagtcactgtcagcaataggaggcacacgactattatcctccctcttacgtattgttcatggttatggcgtcgcagagtctacaccagatattgtgcatgcaagtacatatatgtgtaatgaggtgacagtcatcgatcaaaattgaaaagcagattattcatggaattattgtcatgagttttctacttgattataaaaataaattgaataatttgagaattaaacttaaataataatttataataggtaggataggaagtaggagtacacatcatcaaaagttacatagcttatcatttagacacgtacatacgagacaaacatactatttataagtgtaaacaact

SEQ ID NO: 72022 - DNA, 9138 bp, Oryza sativa
tagttctaagatcgtgtttacaaaatagccctgagcaactaaatgtcttttaaatgctgtttactgcaaaacttaatccctatattattattcccttgtacctcccttgcattaattatgcatccgccggtgtggcttgctgagtactgtggttgtactcattcttgctcaatccttcccctcttcagtaagagaagctttggagaagatgtcttagggggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacactctggcagaggaatagaagcaaatcccaagaatatcaaggcaatcgagaacatgaagtcacccacaagactcaaggaagtacaaaagctaaccggatgcatggtagcattaagctggttcgtcgctaggatgggagaacgaggacaacctttcttcaccctgttgaagaagtaagataaatttgtatggacacaggaagccgaagaggcattcattgcactcaagcgctacctatcgaacccccctgtacttgttgctccccaacctgatgaagaattatttctctatattgccaccatgccatattccgttagcaccgtcattgtcgtcgagagagagaaagtgcaacaaccagtctactacgtcagcgaagctctccatgacgcaaagacaagatatccacagatccaaaagctgctttacgcggtaatcatgacatcaagaaagctgcgccactactttcaagcccacagagtcacagttgtctcctccttccctctcggtgaagttgtgagaaacaaagacgttgttggccgcattgcgaaatgggtagtcgagctaagccagtttgatgtccactttgtgccatgaacagccatcaagtcccaggtactcgccgacttcgtagctgattggactatgcctgataacaaatcagacaaccaaatcaacaacgaaacgtgtacaatggcgttccatggtgcactcaatagccaaggagtaggggcaggattcatcttgacatctccttccggagatcaattcaagcacacaatccacctcaacttcagggcgaccaatgacacagccgagtacgaaggactactcgccgggataagagctgcaaccacacttggggtcaagcgactgatcgtgaaaggggactccgagctagtcgcgaaccaggtgcacaaagattataaatgctctaacccagagttatccaagtacctcgcagaagtcaggaagctagaataaaggttcgatgggatcgaggtccgacacgtataccgcaaggacaacatcgagccagatgacctagcacgacgtgcgtgcagacgagaaccactcgagcccggcacttttctggacacctgacaaagccatcagtgaaagaggttagctgcgaaattgacccagccgcccccgacatcagctcggaggccacagaggcagaacgcgccgttgctgatatcgagaacacagacgactggcgtaccccactgatcaaattcatcaacagcgaagagttgcccgaggatgacgcagaggctgagaaaataacccgtaaacaaaaatctactgcatgattggcaacaatctatacaagaaagcgccaaacggggtacttctcaaatgcgtctcgtccgacgacagcagacacctcctccttgatatacatgaaggcacctgtgggtcacatgccaaccgccctcaaagatacatgcgatatggtccagcggtgtgaagcctatcaattccacagcaaacacacaaagctacctacacatgcgctccagaccatccctctcacttggccgttcttgtgctgggggctagatatactcgggccatttccacgaggacagggcggctacaggttcctattcgtggcgatcgacaaattcactaaatggatcgaagcggtgcccacgggggaaatcaaggccgacaacgccatcaaattcatcaaagggatattttgcagatacggactactgcatcgcatcatcaccgacaacggctcccagttcatcagcgccgatttccaggattactgcatcgggctgggagtcaagatatgcttcgcctcggtttctcgtcctcaaagcaacggacaagtcgagagggcaaacggcatagtactacaagggatcaagacccgtgtctacgacaggctcatgtcatatgacaagaaatgggtcgaagaactcccatcagtactatgggtcgtacgcaccacaccgacaatgtctaacaaggaaacacccttcttcctcgtgtacggctccgaggccatgctccccagcgagctacgacatcaaagtacacgagtacagaggtattcctatggggatcaggaggaacagcgaaacgacgatgtgaatctactcgaggaaaatcgcaaacaagttgccgtccgagtagccagttaccaacaggccctccgccccacgagaagcgcatccgagcacgcatgctttcgatcggcgactacgtcctccgacgggttcaaagccaagcagggcgaaacaagctctcacccaaatgggaaggaccctacacgatcagacaagtcctgtggccaggcgcattcaaaattgcagacggcgatggccgtgagttggcaaattcttggaacattgaccaactacgtaatttctttgtatgagtcaatatcatccatacctgtaagacaccttacagcatcaataaagcctattttcaggcgcatattacaatcacagtgttccaacccgatgatcccttacccagatgacacctagcgttgaaacctatcctcatgtccctttacgccaccctgacaaggcctccgaggaacctaagggatcttcggctggggacgcccagagccgataaggccttgtcagatcctgtagagacgaaagactatgtatgacctggtcgtgtaagagttctcgccgtgcgtattaaccaagccgtataatcagaaattaactttccaactttacggctgggggctaggatcaatgctttttcaaccgaggcaggtcaaaggtccaagagccttgtcctccgagaagaattctccgacgacaaggctgggggctagggagagtgtaccactcaaacgactagccaaagtcgggaactgaggaggcgctcttacacactacatcgagagtaagaaggattgatcaagatagatttcttttctatttcacaagatacttcttacaattttatacatgtccaaaactatattacactttttccctaagatatctataacagggtacaaagactaccaggaaggccaatgccagtccatagactggaaaactttctccgccagcggtgccatcgacttcgctaggtggtctatctccgctggagtcccccgagaacgagcgaacccttcatggagaaactcgaggtgcagttcggacgatgatctcgtatgcaagccaacacgtgccctccaacatatcggctcgatcgacggcattcctgtttcagggctccgtcaatgcgcttgacgacgccttcgagctgagtacaggccccattcagccacgagatgtatccggccgccgactcctcgggatttccacgcggtactcggagctccctacaaatttcggccatggacgtgcagcaactcttcaagtacgagttgaaccacacctcatgacctcggagtgtttccacagcctgctccttcttcacttccagcatagttctctcaagtttcgctacttcaaatttcgtcttccaatattggatacgacgatcttggtcagtaagcgcactctcgagatctgtttagcatgaaagcgattaagtcaagatgctcttctctttcgggaacacagctaatcaagtcggaaggagcaaaagggataaagagaccaccaacctaaggaagtcgtcgccacccccgttgtcgagggtaaaatctcatctacatcgtccggcgacgcgtgtgcctcaaacgcgagagccggaatgatcgctggcgccacaggctgcccacgctgctggacatcctcgacatcgacatctctacaaaggacaacaaatactcgggatcaaaaatgctggggaaaactgaagtgacgaccgcacacgcgaaaaggttgagaacaacaatgtttttacaaagcgtgactggataaaaggtacaggggaactaagatcctactcttcaaagagcgggagaacagactctcccagatcgccgacttcctccatcacgcctctacacgcgtcgttcgtcgccccctgctccaagatccgctagagatcaagttccggatgcgccaacctgacacacgcgaggacgtgacatgccccggtgtagatcccgttggacgcctcctccccgatcctggccgtgtgcttggaggatatcgcctccatcgccgtagccagttcctcgagcaaagacgtcagcgagaacttgtcggggttcaccgggatcgtggtcttgacaccacattccccggcgagctggtgtaggccagtgtaggtgactcgcaacaagccacggagctccgataggttgctctcgagttctgccatacggccctcgagaccccgccgctgtcgctcgttgccggccaccagctccctcatcttctggaggtcctcgcgaacctccgccagtttacgctccagcttgtcggcgcgcttgttggccgacgacgccgccgctgtcctcgcctcggcaatctcgcgacttatgccacgagcaccagcttcgaggaggcgccccatctcgacttggagctcccccctgctgaggacatcggcaggcgggccgcgaacaggcccgagatcaccggccaggcagtggggcgtcgccttccgacttcgtggggcgaccacgacgtccgtggaggccaccgcaggagacgcgctggaggtctcaccagacccatcttgtgccgccttcgcccgcgcccacctatagaagattattgcatccgaatatcaagactagtcgccagatcttcaaaacaaggaaatacatcaatcctcgtctacttacttctcgcctagcgtcaccagcttttgtcgtcgaggaggtggcggagacgcgtccgacgcctgagtaaaccaagggcgatttgagggggacattttccgactacaaggttaacggcgcaggaaacctaccagtacggaggtgaactttcttcccctcctctgggggcggctcccactactcgcggcaacagcagtggccgcatcggacgtctcctggacgactcgctccttcaacgaggccgccgcctgatggtccacgagcggtccaatgacgtcagtcagagggagagcctacactgcatgaaatcattattcgatccaggagcaaaagtaaagggattgccgaatacactcacgttgatcaccgcttcacgctcggttgcctccttctcacaaaggggaacggggatgtcgcctgccattgtcgggccgctgatcatcagttggccaacgcagcgctccaccgttttgctgttcaagcctgcaagtcatgaaccggaattcggtaagccaggaggagcatgcacataaggaggtcaaatcaaatacaagaaaaataccccgaggagaaacccgggtcatctcctccagcccagaatagtcaaaggctggatgggcttgagcctggagcggctggattcgcctaccaacgaagtcggcagcgacttcataccccgacaaacctcgcactcggaggtcatcgatggccttgacgaaggaccgaagggcaggggtcaaggtaggctttgcggtccaagacaaaatcttgtctggttgttcctcgggaacaacaaagataaaatccgaattctctatctgaagatagaaccaccttgcccgccatttgctacgagaagaagggcactggaaggggatataacgcgacttcaggccatcccgaagtcggaatccgacgcatccagacaccctgttggattccatccaacgcaattcatagtaaaagcagaaaagatcaagaaagggctctaccccaatgtaggtctcacaaaggtgtgcaaagatactaaggaaggcaatggaattggggttcaaatggagcaaagaaaggctgtagaagttcaagaccaagagaagaaattcagaaagtggagggagaaaacgacaaagaatgtagtcctcgatcgcaaccatgcgaccaaggacaggctggggttcagtacctcctacttctctctccatggctccacgaccgggaagggcgccgtcctcctagagcttcttcagtgacgcgttggtggaggtagacttgccgagatccatcgccgactggagatcgctggagaaaggagggagattaacaagctagggttttttgcgggagctgagaagacgagaggcgcttggaggctggaaagttttttcacaacaggcagacttcaaaatgaatccccaaaactcccttaaatagacgcacttccaacggtgcgaattgcaaggaaaggagagagatagccgccggaaatttctaggtccgttacgcgcggcagtcttccggacttcagtttaaattcactcaagaccgttgagcttcacatggtattcttgactacgtcccgtctctgcggttctcacaccgagaacgacgacagcctcgacaccagaagtcgcgaattggttacacgagttcatttaagcagaagtcgggggctactgtcagggttacgggttaggtataccctttacccttcgatatacatcacatatcgatatggcatgcccacgcgtttatggacgatcctctgcctacatggagcaaatccttcatggagtttacagatggaaagaatcctactcggacaagactgggtcatcaatgtatcgtgtagggtccgatgtctccgagttctatttggaaaccgcctgacctgcgatataaaagggcccccctgagaggacctaaggcatcgaatctcatagccaacacaaccaccacaacctacgaagtcagagcctgtaggagccaaattgccgggagatctagtcgaaccaactcgattacgatctcgtcggtttcatcgagttccttcgttccctttgtaacctgtgatttccgtcatataattccatatcaactggattagggctattacctgttaatgggcctgaaccagtataatcttcgtcttctgtttgcttgatgtcgtattacgtagatctttgtaccaacgtaccccaataccctctatatccggtctacgggtatcacccgtcgacaggtatggggtacccataatctgcacagtagcccctgagaccttcacagtcgaaaagataatcttctctcgaacctgattactccaaagccgagtgcttcaatcatctttgccattgtctcccgagtacttttaccaaatctgaagactgcggaggtctgaaaaataaagtcaggtgcatcgactagatgcacctaataggtgtagcccccgactatgtggttagttgaacaaactaagcatatagtcaaggaataaataatccaaccaaccaagtggttttgataatcgtagtcaaccaagtgacttaatattaatatatagcatatgcggtatgaatcccgaataacatgatccgagtgatataccgactgctttgtaaaatatgatgccagcaacctaaagttgtgtacatcatgaaaaattcacatagcaaaacagctataaaaaaagcttgtatgctatgaataaagaaatttccaaagtattgggcatacagcatgcgcacactactttaacaaatgtgcttaattccctaaaagacacacggtttcaccacacccagaaatatacagcatacgtggtgtaaaatcggagtaaataaactcataaaggatttaccaaccgcctaaaaaatgaccaaacatataattagcctaagctataatattggtcaataaatatgcacaattacatggcaaaaaagcaacgatattgtatccaatcaagtttttgataaacccaaacagcgccttgactatataaaaaagtcagcggggcagcaatgaaaaacttcactgttgggcaccttttaaaatgcattgtaccaactcctaaaaagttgagtaactgcggtataaaatgattttaaggtattgggcacgtaatcacgtgcacttttgcctaagcaaaaaatgcttaagtccctaaaagaacgtgacaggccacacctgaaaatatgggctgcagacacattaggcctagacctaaaatatgtctaccgatacccttaaaatatgacgtatagaacacgtcaattaatatgatcccaagtgataaatatcctgggttatgtagatcaatcataattatccctcatggagaataccaaaggagatatgataattgaatcccgactggcgcaagcactcagctgatggccctcatggggaataatgaatagtctaatctttgagcataggaaatcgactcatgactataaattcatgatgcacttattcagaagaagtccaaactgaaaaatatgatccttgtgcttgagctagtaagcctctaagcgtatagcttgtccttctgttgtagtcaaaattgtccatcgaaggtaactgagacaatcagcatagaaacgagatgaccaacatgaagatgatatcacccatcaaagctggcgaagatgttggtagtggtaaaaaaatatcaccaatcaaaggtgatgaagtcgcatagccatggaggcgaagaaaccagtcggcaacagacaattcagccagcagtgtagacatggcagcgaaataatcagtcgataacaaacgaggcgctcggtgaagaagacgaagacgcacatcagcagaggcataataagccagccgtgaaagtgaagacaccatgggcggcggcggaggcaagccagtgtgaagacatagatactcatcaatggcaatggcgaaatcca

SEQ ID NO: 72023 - DNA, 954 bp, Oryza sativa
ggttttacttttcttgtcattaccttaaccaacccttgaagcaagggtcctagaaaaaaaaaattcagtatgactcagctttttggtcatctgtgtatgatgccatgggtcttacccatgttcctctagagaaagattatattcttcctttgttccatcttcttgttttctcgtccttcattattttcgataataatattgctaaaatcagcactattacttgcacatgaatactagtagctagctcatgtgtgtcctccgtaatatatattatctttgtttttacatgagtaaataattattattatttttgttgtatttatataaggtactcagtatcgtggaaaacggtcgtaccgatcgattaattggccgtatatacgttaacggtagtataacagttcgttaacgtgatacggtgtacatttatcgttcatgaatgttaaaactttgtttttaacgattagttggtccttttccatttaatcatccaaataatcgtttgtatattgtatttgatgataatttagcgtagtttttttacttaatttagattttttttgttttgtaacatatatttttatgttttacttatttaatgcaaccaattctaccaccatgtgatatataaatcttgtgttaaaagagttaatattttacttatctatttaattaaaaaaacaacatgaacatatttgatttatatagttgtacacatctaaatcgtatataatgttataaaatttgtacatatattcatgaatgttaaatttccgtataattccaattaattgtccgtattccgattaatcggtgaacgctaccttttccgtccgacaaccatattccgtcttacacaacactgaagttacttgactaggtttaagaactaaaaaagatattttttgctaaacataatctagaatgctatagattaataatattgaacaatat

SEQ ID NO: 72024 - DNA, 1153 bp, Oryza sativa
agatcacaacatatgctacaacttctgtaaatacaagattctcggattccatcattaagatcctctaaaatccctctgaacctcgactacagataaatgcatcgacattcagacagccaacttcagaaattgatacctcctaaaccacttgatataaaatcattccatttggtcagaagatagatatacacgttatctacaacttttgtatagagactttttgcaggaaatcccattatgttggccgaaaaggcatccaaaacagaactgcgcagggggcatatcagcaaaaacctggctgaggaataaatcggtggatcccaaacttactcgcttccaacacttgatctaaaccctaatagaaaaccaaaacaggggaaaaagatcatgtattggtacctaggcctccatgggcagcggtaatcaaacccctcatttccatcttcacattgattccctccgcttccttctttccctttgttctccttcccttcttcttcttccaaggtctgcaatagggaaggcatggggaaggtcgaccagagggggaggtgggcgcccccagggtaccaaatgatggctagggggaggtgggggggggacctcctagggttttggggatgtggagggggcagctgggccttgggctggccgaaagctcgcccagctagcatataactattgtttttcttctaatttcaaacaccaaaaccttagggacttccaatatatcctctacgatattctattttttctagggcattacaaatggacagctatacacactatgcaagcgatggttgaaccaatggagtagttggattgtgccgaggcctcatgcatggttgacacggttcctaagttagtggaactgttgttcctctgaggcggtgatatcagttatgaagtggtcaacccaagtcaaagcctcctgtggcgacatcctgaagctttgtcaatccaaagttgtcgaaatatccctcatcggaaaatccgtctcttgaagccatctctcaacgaatcctctgaataccggtgctcccctacctagcatgccattgttgatgggttataccctaatcccaagatccgtgcctatatggtatgttttgagggtgtagggatcagctgatatgaagatgcaaaaaaactt

SEQ ID NO: 72025 - DNA, 10164 bp, Oryza sativa
ttcacaatagcctagctctcacgtagcctagctcctatatgtagtggtcaatgtatgcataacactccgtttgtacttttatccttgttcgtgtaaaatgttcaacacagggttccatgtttggagtgtcgaaggtttataagctaaccactatcaacctaaactaaagcatcaacaacaatcatatctgggtcacataggtctcaactacatagggccgccccttgggaggcgcgaccagagcgcttgcacagggccccctaggcccaaaactccaacactagatataaagtttaacaagtaaattggtaacccaattagtcctgaaaatctgctatttttttgttcacatcgttttgcgttcgatcgcatgttcgtgccgctttggcctttgggctatggcctcgccaatcaccaagaggagtaaacgatgcctcgtctctctccccttgctctcgtgcggtcgtgccgcttgacgctgtcgctgcctatgacttgactcctgagtcccagatgcctgtcggtaccacgcccctaacgtgatgccacgaccgcttgaatgcctgagcggctgactggctgagctcctgcttcctgtctgctaggtgcttgcctggtgtctggtgaacaagtgccaccctaattcctacttcctgggaatttctaatgtggtaatccctaattttggtgtatcgattattaagtatttagattcatctactatatacacaaaatcaatttttgttcttacatcctgtattttaattttgaagcatgtcttcaataaatcggaataggaaatatgtcgcttttcaagtgaatattatgcaaaattttagaccattttacattgctatgaaatatattacagagaataaattattgtcatataatatcattaattaagtttttatcattcattacgactttgcacaggccccccaaatttgacgggacagccctgcaactacacacatactataggctgctaatgggataaggaaacacgtttgaggtaacacgaaggaaatcatcactgaaactaggaaaaataatcggcaaccgatggcaggccaagcttgatgctctagaatagagggaacacattctgtgcacaaaagcttcgcatgcacacaattaacacacttatgtgtaagtcttaatctcaaattcattatattttggctctaacagaaaattctgatagttttaagagtgttaatctatcataattttatcttttatgcagccattagtgagtaagtatagattctttgtttgttgaacttatctttgtctgctttctttttcttataatatttctattcatttcagctatgatatttgagaagaaaatacaaaaggtaaaggctgccctttatacccatacagagtttaaaaggattgttaagaaatttgaagagctgtacatccggagcagcaggcctgactgtgtagaccacgtgttcaaaatctacagaacaacggccctagaccagaaacttgtaaagaagacattcaagttgattgatgagagcatgagatgctccagggaaggaacttgattcagagctgagactgggttgttgtaagtcacacagggaaggtacgcaattaggatgacgagaagaacagagtttcacattgtcatagcgttatctgctgtaattcttttacatgtcgaccattgattgatcatatttttgttctctaattagccgttgtgtatattttccctgaattagattctctacctgttgtctatgtgcattatcgtgatttgttaatttgcatagcagacttttcattacacaagattatcttcactatttaggaaaaaaatttgaagatattatgactagaaggtggatgcacggtggtgtgaattgtgatggcacatatatagctatgaatcccattgtttcacatacaaatacatatgttattatagtttgcagagtacaccattagctgtagctacctggtccaccatagtaaacatgcataccattgggattatgtccataatattcataggtatatttccttcgattagtagatcctggatcggctttaactgggtttggaataacacgcatgttgtcgtcgttcacgacctgaatatctctaacaaaagctgctttgccatacccttcagaagcaaaatgtccactgcccatttgtggagagtcttctgaggctgttggaccctgaacatatccaccccacaatgctttactggccatttccttcatgtaactaaattgagaacttggccaatatcctattgctgttttctcctcaccatacaccaaccaccaattttcagtctttgggtcctaaaattcatcaagattaaattgtcaagtaaatgcttcttcaaaatcatctaaaaaatgattgttcaaaagactgcaagggcaatatgctattgaatgcacaaggcatggtacttatttccttattgtattctaggggtcttaataaacgtttgttgctataagtctataacatcatttcgtacagtgaggcattcaaagtgaaatgctattgttggaagtccatggaatgcctattatgatttaagatattgttgtaatggtgtgtgctaacaggtaatttaaatctaagcaatgcactgacacatcatatgtgaacatagtatatagatatgacataataagcgaaataaattaatgttttattaattttatatatcttaggtaactcaattaacatcatagtgaaccacttaaattttttattctcataaagtaaataatcaaggcatattaaactgcatgtaggacagagaataccttaaatataagaaacttaattgcgtattgcggtccgttatatacagaaactggctgtattctgcctccaagaacaacagaactgctaacttggacgaaaccaggacacttatgattgttgcaagacttgttttgtacttcatcacgctgttaccaatttttttttctaaagtcagtacctaagcagtggaaatgtagctctatactatctcagcagtatagagactagaaaaaaaatatagtgtagaatccaatgtatttctagaaaaaatgtatacgtattacccatgaaatatgaaacctagcaaagctatcaccactgaagcttggtgagacccaagagccagcaccaattacatctgggccattttcaatttgtatccatgatccactaagatcccaatgatgcttcaccattggttcataaatgtttattgtggcctgtgttccatatatgtcgtcaaaatattttatccctgctacctacaaggaaaaaaatgaaaagacttttgtgaataataataacttacatacatatgcaaagttttacatcatattaatacatagaggactgttgccagtcaggataaagctaatataaattcattagtgttctgtagtataactttgaaatacttaggggatataatatatttaaagtcggtatttttgttgaaaaacattcacaaaggagttggttttttaaagaggatgtgaaactgcaacaatataatcttactaacaaatatttcaaagtaaggcgccatcatttcctactattggcaatttgattgggactttatatatttgaaattgtttgaatgtgatggcagaaattatatgtttttatctaccatgtaatatactcctatttcaataacatacatatttttaatacctatatatttatttataaattagaaggagtaaaatcagtgcaaagtaggagggagtatttagctattgtgtaactgttttagtcatttagtaacacatatttcatctaatggtgttgattgccttcatttattagcacttaaagatggagattcacctaactcttttgtatagttgttacatcaaccaatggtaatatagtggttttgtgagtctattgtgagagctggacataagaacaactccatacaaaaacaatatgttatcacaatcaactcatgagaattgaaacatctaaaaatattttaaaaattcttacctcttgttgttgactggtgacaattgcgtcagtattcttagttgaaatattttcttgtctattgttgcatagtattgggatggttcctgtggggcattcagcagtgggtagttgtgcttctgagatgggatacataaatggattttcgacatcaatccccaccggaaatgagtttggtttcaactaaatgacaagcaaaacatggtcattttataaacaatgagtttatatctcactataaagaaattctctaaacatgattaggtttctacaacattcttttatgatggagcaaatatacacataaaaatagtgccaggtcaaagtgttataaacaaataaattaacgatattatcaaaaagaagccatattagtgaatattatagaccactcaccccctccctcccccccccccaaaagaaacaagaggaaagaatattacattccaaaaaaaaaactaagtggcaacacatttagacatgatgttaaatcttaggaggaaaaatgttggcttacctgaattttgtggtcttttaacaatggatggttaaaggctggttgcctatttatatcaatgcaatcatagacatcaccatcttcagcctaatttgacgtttcttttgcttgttaggtaaaaaaaagatgctaagtatacttaaaaggatccattttttcacatacctggatgattttattaacctcttgatttgtaagatcttgattagtacttctccttgggtttatatgttgaatttcttcccccctaatgattagaacaatacaaaatagaagaagagtgacgataatcacttgactttctttcattttgaaaatcttggaagattggtattgatacttggaaaagatatattatctgtagaactccaatggttactaaatagctgttagtctactaaaagaattaatatattcaatgcaatagatttgataatcttcttttaatgctttaagggaataaataaacaatatgagaagatcatacataaatgtagcattgaatgcataagatttgatatattggatatcatcaatacggcattaaattcattgttttaatgtttgaatgaattttcaagatatttgaagtggtcattgttaattccataagataccatcaattgaaattacatagagtacacgaataacaataggaaaaaaatacacttagatttgaatatatatgtgttgagggtagagaatgactctgatcttgatggggctaatcaatagtgcgtttgtaataccaaagcccgctaacaacttgtagtagtgttgtaggtgagagttgtgactgttggtatttcttaacgacattactagaaatataattcccagcaatggcgcagaaatacacttggtatattatggttacagagtttatccgcaagcgcatgaatatactattgtagcatttcactcgagagtattccaagggtatcatatttgtttaatcccgtgggaaaattataggagagagaaccgtactaatagtttatatgttacttgtaataatcatagactaagcaggggttaatataatccaaagggtacaatgacacacaaacataagtctactcattctcatattaaactatctaagctgagtggaaagaaaatagaaaagaatctattcctatacttctagtatacatactatacatacatcctcgttataagattaactagctaatacctctttccgatgccctcctggtactttgagaagccacccttgactgccgagttccttaccatagcccgtcatgaccatacaaccggggctaaatacggaggaataccctccccaggaaattaacttaggactatatacacgcgcggaggaatacccgaactgagttgtcaccatcagcggcccacctctcttccgcagcatataaccccaaataatgatacccaataatctagacaccacgcctaaactaccagatattactctaatatcatcgccatgacatagagtaattgcataagcaaacattatacccgtatctatgcatctcccagataagctagcagtataatcaatataactcgaatataaagtaaagttggcattcatatacgcggaaagtatttcaatacaagaattatataaagaagaatattctaaataaagtataagtcttacaaaagaagaaaggaatgctgctagagccatacccgaactcttccgaagacttccggactctgatttctattctattcctactccactagcttgagaatactaaactaagcttgagagaatatgagagagcttgcttgaagtgtgtggagaaagaggagatgaaggctttatatagcctcccaatgacgattgtgacggctggaatggtcagaaatatcctccaaccgtcattgggagctaatccacaccttccagtcacaaccctgcatccaacagtgccaggataggtttggccgaacccctggttcggccgacccatgggctgggccaaaccggcccaacttcggctggcggcctcctctattgctcctctctgcagacttgttcttggcccattcatgcataagtctgattctcaacatcgtccaattgattgatcgtttgatttgatgtcgatattcatccattttgtgttcattatctgtaagtggttagtaatcctaatactagtggaatattattattctaacacaaatatgcattgcaagtataactagttctcctttattttggtaatatggacggtcgaaactgatcgcaaacgatcgtcaacagtgacccatgtggatgtgattttaattggttctcacctcagaagtttaggtaggtgagtgttagcttatatcctattccactccaaccttaatacgttcgagttaattcattatattaagaaaggatagaaccacgagtgtgtatcagcccatggagggcatatgccacacgctaatattttttgaaattaaaaattaaaattcaatatattttagaaacatcaaaagtttaaaggaaaatctctaacaatagaactcgttcaagaaaagtttagatgtggcttggagtatttctagtagatctaaaaatacttgatcgtgttttaattgaattttcaaagaacgtaatttataaccacagtttatataaattgtggcttggagtatttctagatgctcatcggtggtttgttcttccgctctttcttacgtcctgctggcctactcatctggctgagcccatccagtgcatgctacctccggccagtgccctctctttgcttgtccaaaaccctacttgctgctaccaccatctcaaaaagacaaaaccgtaataatctcctctccttgttgttagagtttatgttggattattctcctttgttgctattagtccatgttagaaaaactgaaggaggtattgcccttaattaatattctgatcaaatcattctaatcgatctgtatcttgttactgctctgatcaactttgttgccactaagtttagttctgctctcatcatttttaaatatatgatgctgccgacttttggacatagatgtttttctagtatcttgcaagatgctaccgctatttacagttgcgagacacattcactactttgaagtatatatttataattatgtgatgcatttgctacttcctaccaacacatttacctagggatacttagcgctttcaaatgaaattgatacatcagcaatttcattagagttctgtactataaaaatagatgccatttagattctcttttggcatgagattttgtcatgcatatgaaaaatatatgcttctagcatgccttgtcttgggttcctttcaaacacatgtagatggatcccctacctttttcgccgatagaaaaactaatttcttccattaagtactctcaaagctgtgtaatcactgcatctcatgtaatggtggagattgttggaaaaccgctggcccaagaaggcttggcccaggtgaccaactaatggcccactcactaaatatgaaaagcatatattgctatgcctataaataaagaggagaaggagctattgtacactagcgaatgagaagagaatgaatgaaataatgcctcaccttcacatcttgtgtctctacttttgtaaacattatgcaatcatcactcttagactattctatagcaggagggggttgcataatagagatctaatcccattcctccaagagacattgtgatattaacacatcacatccatcagttcatgtctattaaccggtgtgtacgtagtacttttgcaaatgaaggagcaccacaattggcaagagatgataaaacagtgtgtgtgtatatattctcaataaaaaattggacaagatagctcaaaacatgtatttggaacaaaaacaggcgaacaggcatacaccgtgcccacatgaatatgtatctacaacccgtttttgtaactgcgtgcatgtgatgatgtcgtataatttattttcggataaatttatacatgaaagtttatatatacaccgaaagttttatacatcaaaaatgtatatccaaaactaatgcccagaagtttgtatatattaaatatagacggaagtttatacattgaaattcctcgtgaggcacatctgggatttgttcgtattgatgaggacatcctagctcggatatgaccatggctaccttatgtattcatcaaccaaagtgcatgttttctatgtaagatttatgtgttatatatttgaacaaacaatattgtaatatcagtgtattcttgtttgcagaggttcttgcttgggtaaagggaaagcgatcgagcgaaaggaatacagggataatcaaaaaagttgattggggaccaaaccaatatcctccctcaagtcaactcctatatcatcacgtcacttttggtccatagaagacgagagatgaacttctgcacattttggattcggattaggattcgggcctcttggaagaatcaacttcaaacagatctagccactgatttagaaggaatctcaggggctatgagtgcttcttgaaaattcctctttagttgtcaggaatctgcaaaacaagtcatgtacttcaatatgtccgagtctgatttaggcattggtcattgtatactttttctaggctaggtccaatgggtggatgctctagggctaaccctaggacgtccctaatcatatttattcaatagccgtcatagtttagagtcagattttatttagattatttttgttattacagtttcatcgttaattcagtttgtggaacccccaaccttgggatcttagaaattcgtctgtaaattgtgttgcaatctaccttattcttgtttgtgttctttgattgtatgcaacaattagccttctcgccgaggtcaaccgggtagagcatgattgataaccagagaagacgtggtgtggcaattatagggttcagatcatgttgatcggaagccgggtcatgtatgtcaagtttccaccaaattgagagttctcaatacctatcggaagatcgggcatcacgttgccatcacgtatgtgttgggtcccaatgctgagctgaccacggtcacaactgggcgcggatgcaggcttaggacatctagggcttgagcctaagcctacctccaaaatcttgtttaaattttgttaaattatcatgtactcaaattttataggaaaccaacacttcattatttgagatttaggccctgtctgtttcagcttaagattattataatctgattattgagccagattactgtaagctgaattataataagccgatatagaataagttgtgacctgtttgttttcttagattataagctgtttgttagctgttagccacccaataatcttaaaaagcacctttagagtggattactagattatagtaatctggcttatagattataataatctatcataataagctatatatatatatatatatatatatatgtttgtttcagcttatttctaataatccagattataataatcctaagctaaatcaaacatggccttacattagtcttgttttttgacggaagaaggtagagcgtgctctgttagatttaattgggtaattgat

SEQ ID NO: 72026 - DNA, 1371 bp, Oryza sativa
cacctgagattatgttagatttctcaatatcaaaaacaagtgcaacatgagcacaacttctcacagccacagtgtaatcagagcacaggcccaaacaagctgaggcatgaacatgtagcagagtacctagctgctttcaacaccggccacttgtccatgatggttgtgtcaatgagggcgattttatatgaatttattaggtcttcagtgatggtctcatataaaaataaataaatttgtacatagtacattgtacgaatattttcatcgacgaaaagaaatataattagattatgcaatatttttatatttcgtttcaaagagcatgtatttagctagtgattgacgaaaattcttcatccttttgaaaataatgtgcaaactagggatagggaacacctaagtacaatccctgatgaagtctatgaaaccacccaagcaattcttctaacagactaagaatcggtttcaagactattttatcaatcgttacataagaagttgatggtgccaagataacaaccccataaaaatggatggtgtaatggactcatgtccaagtcctacgtttgctagtactttgattaacgtgatgacaccttttcgtcagttgaaacaagagatcgcatgtgtatgatcagttgaaacgtagagaaccttgttttttttttcttttagaggcatgcaagtagcatcaaatgtgttgaacgaattatggcaacagttcagaagttcatacggtttcccattcggatgagcccggtcatcttgcatctgctctacaaaatgctcaccattgtcaatactaaagttctacaagaaaacacatggttgtgagatttttttaataaaaagatgccattgcatggctagcgaaatccacacggctaaatctatctccatgatagtttattgctacaaatagggctcatgtcacttgtgaatgggtagtgtcaagattgcaatgagcacattgcataatgtttctatacatgcattaataaagagaaacccgtgacattcaagcttggtaagaccaataatgtttctcatttctctttaatgtgaagacattagctagaacggagaatgaaagaaaactctcctagtgatgtcaccatatttgacacctagccgatcatatctgtttgagctaaacttcaactgtaattaaaggctaagtcgggaccaggttcagcgtacaattgatattcccactgtctctcattccgatgaacaacagtctcctcagcaacctaagcaagttccctttcctgtcctattgtcatcagtactaaaattttacattcaaacagactgatctgctgtgcagcttctgttcaatttggcgtgcagagatgtgctttattt

SEQ ID NO: 72027 - DNA, 718 bp, Oryza sativa
cacttttatgactttttttttaaaaaataaatatgtatttttttatttcattatctatcaatattttttgggataaataatgcatcgaacaacaaactcataactataatagtcttatgcaagaagcttttatatttttaataatgtaattcatgaatttctttgttcatccaagggtaaaatggtcatttttatagaaaatagacggtcaactaacggtgaactgacgggaggggtatggaagggatcagaattaaaaggaagtaagtaaaatttaggggtatagaagggattaggtaaaatttgaggggtatacaagggattttctcttaaacatatagtagtattttgatctcctgcttatcatggctttaactagctaaagctaatgtgaaacaagagtcttttagagccaggagtaatggccatcctacttggaaggccaaaacatgaccaaaaaaaaaatcaaaaaatgaagatctttttgttaggaaaaagtaacataacaaaagccacgagataaataagcaaacgtccagcctctctcaaacctgccagctggtgtcaattaatcttttccccttttgtgatcgcccatttatcatttttatttattttccagccactaaaattctcgtaagcatagccagcgcccagcgaccaccgctgaagtcaattaattacaaaatcggacgaccttaattagagtacatcatca

SEQ ID NO: 72028 - DNA, 2095 bp, Oryza sativa
gttcagtagagtttttcaggtgcacattaacaaagtaaaattcaaagcaaatttgggagaccgctgccgccaccgctgtcattgtcgcccgctccagacgctggatccgctgccgctctcgtcacccacgccggatccgtcgcccccatgcctccccatcgccaccgacgccaccctcttctccggccgtcgtccccgtggtcgccggccgaagacacccctagctcgtctccaccggatatccaaggggagggaggggaagaggagaggaggggccacgtgccgccatatccgctgcctccatgcctccccaccgccgacgaagccaccctcccctccgaccgtcgtcccttggtcgctggccggagacccctgcgcgtctgccagatctgcaaaaaaaggggcggcgatccagcgcccccccccccccccccccgcccacgccacgcactcagagaggatgggaggagaggagatgagagaaagagtgatggactgatgagagagattaataaaatgagagagtaggtgagagatgagaggaggagtaatggagtgaataataaaaggaaaaaggtagagagagtaggtcaaaattttgaagtgtatgggagagaatgcatttttgcgtgcggttcagttaagacgtcacctgcgaaaacagtctcatttttgcgtgcggttcacttaatacgtccgtctgcgaaaattaatttttccgtgtggtcctcttatataaaccgcacaggaaaatgagccaattttcccatgcggatcgagttaccgcccacatgcaatctaaaatggtccctgtccaggaaaatcatttctgtagtagtgcttggtggtggttgaacctggattgtggacccatatacttgaattcgtgatgattcattcatcacttctgaaatgcaaattttgcccaaatatttgtagttagaattatggtattgtctattttatatattgtaaatatgggcaatatgtatcttgaattatgtatttagttatatataacacaacaattcaaacaaattgagaaaacgacatgtaactcaggagttgtgatcatttaactatctgattattatttttttattgttagctagaaaataggagaagttttcttagaaaataagagaggagaggagaggagagtcagagggtggagggagtatacgtgcatgcgtacatatggtatggtgggggtggcggcatatgggtgtttttttaatctaattgttaaaattactggatcatctatttaaaggatcatctatttattggatcatctaatagttaaaattatcatattttctatttttttcgaatttattagagcatcatgtggtaacataggagcatttgtaaagcgttgtatggtagcttaagagcatttgtgacatgtttagtaaaattttaatatataatagatgacatgagctaaccggcaggcaccttctatccaaaataatttaaatttctctcaagatttctgtctgcgtagtccaaaaggcctgtaacttttaccacgactccatcaatcctataggtgtgggaaaaaatacgttctagctgatgttacattcccacattatatagattccatggacagcagaaattcctagtgctttccattccaaggatccacaactgtttgagactagcagtagtgaaaaagcaaaattgtaattccaataatttcacaagaaaaaaatcatgtgtggtctttcattgatcaatatttctcaaatagaaacaagggcatggcatttatacaaaaaagcttagtaaccagccatatcagccataaaccgcacacgaactaggcaaccacccatcaacttcccaggtatattttagtgagcaactttatggtccttgaggaggtaccacgaggtaccattttttctattgtaaatttagtacctctttgtacctaggtactataagataccatgaagtaccaaattttacgctaaatttttggtatcttatggtaccttctcaagtaccgtagaattctctattttagtagtacgatctttcaaggttttttgtttgactgcttgctctcgtgttccagcgtgta

SEQ ID NO: 72029 - DNA, 3143 bp, Oryza sativa
acgctgcaattagaattcctaacgccccacattccaagaaatcgctagcatatgtcatctgcacagaacaagcatgcaatttctcattgatatatatcccctccaatcttcattcctagctactcttacaaggaaaacatgtgctgctgcacgcactgtccatgcataattgtttgcattctacatatgcatatatagtaccaagcagacatacctaacatctctcattgttattgaacacttctcaactacctgcagccaactgttttctatggaggacctactagtgtacatatatacgagttgctctatatattcatttttgtcgttggtatagcaattagcacagtagcaccacaatgtgtcatgacaaaggagattctcttaccgtctcaatatcaaaaacaggtgtagtaattaatatgaaacatgagaagaacttctcatagccacaatgtaataagacaacatacccaaactagcggaggcatgaacttgtagtagtgtactactacatccgtcccaaaaataaaagattttataggttgagacacattccagtactatgaatatgaaaaaggggtctatctatattcattgtactagaatatatcatatctagatctaagtttgttttttgtgtgatggagggagtaagttgtcttccctatcctcaaccatgtctttctcactacaaatattttacgtgcaaacatgctgatatgttgtgctcctcctgttcaattcacgttatttatttatgcaatatttgcgtaactcggttataaatagtactacctccattttttaatagataatgccgttgactttttctcacatgtttgactattcgtcttattcaaaaaatttacgtaattataattattttgttatgagttgttttatcatttatagtactttaagtgtgatttatatcttatatatttgcataaaatttttgaataagatgagtggtcaaatatttgagaaaaagtcaacggcgtcatctattaaaaaacggaggtagtaccatccaccgagcggcgctttttcaagagtttacatttcagtacaatgcacgcatatttaaagatagtcacttctagaatatttccttctgataataaggaacatacatattttgcaaaatgttggaagagatagtgcatctcaacaaattttttttttgcacgaaacagccaaaatcttctgatccaacttaattaaagagacgaagccaacctagattcttagacatagacatagacccaacaatcaaacaaataactaataacttcaatacaaatgcaacaagttctacagttatgtttggcacgggcatcatgcatgttttatgggccgatgtgccgcatggccagcaaacaaatggattgtgcagttgtcatcttcacagcttacttacaacagcaatcttctcgaacagatcatacgaatctatggctgtttaagctttacccattagcagctacaaagagaaaaatctgatgctctgaaccaaccctaacaagataacgatatgaacagacaggctggcttccatctaagtttcactaaagctttctctgtccacacactacaagaatcctgttaatccatgatgaaaaatttccgtcacggatcactgaaaaaccgtcaccaaacaacatctgtgatggtttcagaaatcatcacggattgagcgtcatggattgacctgtgtgacggtttgtcgaaaaccatcacagattaacagaatcggtgacggttttaaaccgtcacgatgaagcccgtggtctagttagtccagccaagcccatttcctgtgatgaaaaataaccgtcacggatagctgccacgtaggatatttctctgtcacagattagctgccacgtaggatatttttccgtcacgaaattgaatcaccacgtatgtgccatgtgttcgccaaggtggacgctgatgtgtcatcgatgccatgtaggatttagcccacgtgttttgtggcccaattcttttccaagagctttcggcccatttatgacctaatggttttttttttgttttgggctgattttttttagtgttttttcggccttttagtcatcattcagcccagctcaaattgggctacagctagattttagcccaacaaaaattcagctgctgctaaatttagcaaatacaaatatttcgtccataattttagcaaaattaattactgatcatcagttgacattctctcatcatcagtaacaaaatagttatagatcagcacataaatattataaaaacacattacaaccttcacatctcatacaacataattttttagcatatctcatacaacataattaaaacctgttcaaaagcacatgacagtacccaacagccaccaaagcattttggccactccatcaaagttcgcatatgtttgagcccagcaacctgatagtacaataccatgtgttagattatttttttatgcgctagagaaacaacaagaaacaatctacagatacgatattagtttttgaatgatagggctactttgcaacaccaatctgatgtccccataatacattgcactaacaaaactcaatgtccccatcaccaacccacctcatttcattggccaagcaagcaagcaactgatgctatagattgaaggaggaaataaatgtggtccttttgcaggacagagcaagaaatccacagtttctgaagcaaagaaacgcaacaaaacagaactatcaaagatctgtgttatgtacaattaatctttaaacatcttagttcaggaatagctctacatatcacacgtactgacaaaaacctctgtacaagaaactaaaaatcaaggcagtgcacaactagttcagagttgttctgagttcagataattcacatccaccaaactatagatagattcacaaacaactaaagtggttagagatatacacagacaaattctactgactagacctgctcatcatggaagcaaaaccaaaaatggcatttacagccataaaacgacactgctagtttggctccttttgcagcttaagaaagttattaagtatatacatcaaacaaatctacttggttcatttgcagattaagaaaatgagcaaggatatacatca

SEQ ID NO: 72030 - DNA, 4403 bp, Oryza sativa
attactagattatagtaatcgggcttatagattataataatctatcataataggctatatatatatatatatatatatatatgtgtgttcaagcttatttctaataatccggattataataatgctaaggtaaatcaaacatggccttacattagtcttgttttttgacggaagagggtagagggtgctctgttagatttaatggggtaattgatccatttaaatcaattaaatcaaataaattccaaggctcattatactaggaattcatgggtatttattcttttatgggatatcaataggatgaagagttttgagaattaatccatttgattagggaattggtaacttatatcaattagtcctaattgatggatggttgatggttgtatagtggaggatggttcatggctagttgatgacaattagttgctctattcttctttctattccattggtaacttacatcaattactcctaattgattgttggttgatggttgtgtagtggaggatggttgatggctaattgatgagaattagttactctattcctcttcctattccatgactcttactcttcatattccattcctcttataaaatgagaatgaatttgatctccagcgagagaagtgagacacactttcatccattttccaacgttgttgctgctacggtaatcccatcccgacgagtgtgtgcacacgcgttgggagagtaggcctccgaaaccacgcgctgctgtgacatttgcacggacgggcgggcgatcaggtttttggggagcgcaaggcgcgactactcactgttcgtcaacatctacttcaccttcaccaatatgtcgaacaccggagacaacggcaacactggatacaaggagaaggaggctcccgtcaacaccaacggaggcaatactgcctcaaactccagcggaggaccattcttggggtataaccttcttacattatttcaattagaatttttactgttaatgttcatcgcaatgtcaacattgtgttattatgtgattgttgatgcttattctacattaagcatgctcatgttgattacattcaccactatcactggatcaaatcccattgtaaatatcatgtttattatcttgttattttggattaaaatatgccgaattatgaccaaatttccaacatgctccaccttatagtcatttcattaatagaaatgaggtttccagcttacaagttagaggttatagttaacctagaacagaaagaagaaagaagaaaaggaagaagagaagaaacaaaaataaaaagaaaagagaaggggtggtggatttacaaagatataaacaatggttcttatactaagagagcctggtacaccaggattgaattttctgccagtttgattcattggttctcatgctccaaagatcaagggtgtctgagacttgctgtgtgatgtgctgtaggttgtcaagctgaccttcaaacactctgttgttgcgggatttccatagcgtgtaggcgcaagcagcgaaccaaattggttctattccttttgaagaccgattgctgtctatgattgcttgaaggaaagccgagcttgattctgagttgttggccagctgcagtaagtttagtttttcccatagattattggcatttttgcatcttaggagtatgtgatcagctgattctagagccgggcaaagggagcagtggggatcttcattccattttttgctgaccatattggctttggtgtttagcctgtctctgaatgctagccaaaggaaaatcttacagtttgttgggatggtgtgaatccaaataaagtctgccggtttccataaggatccatggtatgtcagcatctgataggcattttttgttgagacctgcggtgcaggataaagaaattctcttgtgtctgcttcctctgggattgggttgacatgctgtaagatctgtaacagagtgtgcagttctgtttctgcttggtaggatagatttgggtggagctgtatttgccaggagctttgtctgaactgcgactgaactgtgcactctttatgtatagcaaaggagaataaaactgggtaagcaaactctagacgttgatggaaccaattatctttccaaaacaaagttgttttgccatttccgagcttgactcgtgttatcgagcagagagtctgaaaatgtgaaaggataagtttccaggtcggtgtatcgttgcttctgggatgcagctgtataatgtattgcagatatctctctcgaaaccatttagccattggatcccctgtgcctgagagcaccttgttttctagctttaaaattaatgctgtattgtgtgctcttaggtctttgaaacctagtcctccttgctgtttttgtaggactgtcttccaggctaccaggcagtgtcctcctctgacggttttttcccctttccaaaagaaagcacgccttattttgtcaattgcctcgatagatttttctggccagatgcagcaggacatgtagtaagttggaattgctgaggttactgcatttatcatagttagtcttcctccttttgaaagtggcatccaacctgcaaggtatttgtcaatctttgatatgacaggtaacagcatattgtgtgaaattttggtggttgacaggggcagtccaagatggtctggcattgtaggatttgtgtcactgcatctttgttttcttcattcaggtgtatggggacaagagtgctcttatgaaaatttatttgcagacctgaaaatcttgtaaaggagtccagaatttctttaagagctgtagcttggtctgcttcaccctttagtaggatcagggtgtcatctgcatattgcaaggtaggtggagcaccttcgatgtctagcgggtgttgtagggttcctgtgttaaaggcctgctgaatcatattttgaagcacgtcagtaaccaaaatgaagagatagggcaagagggggtccccttgtcggacccccccttttatactgtatttgatcacccttttgcccgttgatgactatctgagctttacctgtacagacgattgattttgtccaactaatccatttgtctgggaatcctcctactttaaggatccgaaacagggcttcccagcttacaatatcgaaagctttgtggaagtcaagtttgaggactaacatcggcttcctattcttgagggctgcttgtaccatttctgaggcaaggatgaagttttcaatgattgatctgtatctgatgaatcctgattgcattgggtcaatcgacctcattatttctcgctgcaatctttttttttaacgactcacacgagatggtgcgaagttctattgatagagtaggaacaaattacaagattacaaccctagagggtcataacacggaaaaaggaaaaaatatacaacccccacacaccgacagcgccaacacacacgaccaggaggaggctagcaccggaccggccgctgctgagcgtgaccggtcgccgctagatcaacaaaggaacaaagacgagatcgcactacgctaggggatgccaaaacgacgtctccaagaagaggagcaacggaaaaccgccgccgccgtccgttggggctcaaaggagccaagactgggctttcgcccggcaaccacccttgaggggtgagacagcatgacaacgccctcaggagggggaattaaccatcgttgtcggcccggccaaggctgggctgggttttcaccagccgttcaccacctgcgaatccacggctgacgcaccgatgctccaccaccactcatcctctgccgacatgtgggacccccgcaccggcgcctcccgtcgaccagcctttgtatgccgaagaccgtgccacacccaccagcagctcctccatgcaccagggtcgcctcctccaccgccggccgcgcctctcacgccaaatcggcctcctccaccggacgcacctctcgcgccaattcggcctccctccatcggccgtgcctctcgcgccaagccggcctccatatccgccgcccgcgcctctcgcgccgagccagccttcgctgccatcggctgcgcctctctgcaccaagccggtctccgtcccctccaccgtactctcccgcgccggcgaaatgcagccgtctgccatgccctcggctagcccaccgaggccaccatgccacctcccaccaccaccgcagccactgctgccaacgaccacctcgccgccggccagccgcagccccaatgacgaacctagttcgtccaaccattccttagggagggataatgattactggggtgaaaatgtaatttacttgtaaaatgaattgtatcgggttgtaaaccttgtattcttcgattattttttcgaagctaataaagaacgggctg

SEQ ID NO: 72031 - DNA, 1459 bp, Oryza sativa
  unsure (1)..(1459): unsure at all n locations
gaggccaccatgccacctcccaccaccaccgcagccactgctgccaacgaccacctcgccgccggccagccgcagccccatcgtcgtcgtccagccgctaccgcaaaataactgtcgccacgagctccgcgccactgcctctgccgcgagaaccccaaagccaccgcagccgacagccgccaatgctgtcgaccagccatcgtgctgccgccgccgaccaagttgctgctgccaccgtcgctatgaactccacgccgttgccaccgtcaccgttgccccgtgctcccgcgccattgccgccgccgatgtcgccgcgagctccgcagtgccgccaccaccgcgagcttgccccacaccggatccgccctcgggggggccagatccgcctctgcccgccatcgtcatcctcagcggtgcccgggaagcggcctcccatccatcgcctcgcttcaaccgccgcctaccgacgcgctcgaccacgccgcccgcgcccggcctcacctgcggccagctgcgccgcccgcgcaaccgtcgccgcgaccgcctcttccccgccaccagcacgcccgcttctccgccgcacgccgtcgcccggcgtcagccccgccagttccggccaaaacggcgcggatctgagcgggtttccaccgccgccagccctgtccgccgccaccacacaccgccaccactccggcccgccgccaactgcctccccgccgttggcatagtatccgggcgggcgcggatccggatggttgccaccgtcgccgcccggctagtaacccgggccacccaagtgctgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaataagataaacggcgcagacgactccactccacaggcagcttgaccagggctacacctaatcctccacagccgccaatgctgtcgaccagccatcgtgctgccgccgccgaccaagttgctgctgccaccgtcgctatgaactccacgccggtgccaccgtcaccgtttgcccgtgctcccgcgccattgccgccggcgatgtcgccgcgagctccgcagtgcccgcaccaccgcgagcttgccccacaccggattccgccttcggggggccagatcccgctttgccngccatcggcatnctcagcggtgcccnggaaagcggnctcccatccaatcgctcgtttaaaccgccgctaccgacgcgcttgaccacgccgnccgcgcccggncttacctgcggncagttgcgcccgccgcgcaaccgtngncgngacccgcttttncccgccaccagcacgcccgctt

SEQ ID NO: 72032 - DNA, 20813 bp, Oryza sativa
gaaggagaaagaacagaatctctagtgttatccataataattgaataatcaatgatcctgatgagatagcaactgtgttcacttcttactttgaaaatctctttcaaagatccaatacagatgatgccactccttctatggatcaaaatgacaatgatgtaatttttcctccccctgaaatcccttctgaaaatgacatcctagaaattctaaagcaaatgcgaagagatgcctccccagggccagatggtctcaatgttgcattttatagagctgcctggaattggataaaagacgatgttactgccatggtaggctccttctatgaaacaggtaagcttcaatcaggtatgaatgctactaatattgttcttgttcctaaaaattctaatcctaagtcccctgctgattttagacccattagcctttgtaatgtttcttataaaatcattgctaagtccttggctaattacattcagaataaacttcctaaccttatttgtgacactcagcaggcttttgtcaaggggagacgcatctctaataatattgtgcttgctcaggaaattgctcactctattaatctcacctcttttaatcaaaaagcttttcttttaaaaatagacttgtctaaagcttttgacaggattgaatggagattcatagcggacgctatttgtcgtaaagggtttcatgctaatttcgttcgtcttgttctttcctgcatcaactccgctaatttttctgttgttataaatggtcaatcgtacgggtacttttcagctcatcgaggtattcgtcaaggttgtcctttatcgccttatctttttgtccttgcgattaatgaactttctgaccagcttgcagatgcaattcaaaggaaccacatttcagtaataaagttaggacaaaatggtccttccattcattctctgatgtttgcagatgatctaatcattgtggggcaggcccaacaagaggaagtcaggaaaacctctgaaataatcaattccttttgtctcagatcaggccagactccaaattggggcaaatcttccatcctgttcagcaaaagtactcctgaagaggtaagacaaaatattcttacaatctttcctgtttctcttatgaactccagcacaaagcatctagggcatcctcttctggtgagtgcaaaagacagaaatgctgcctacagtttcattgtcgacaagtttaaaagcaagcttactacttacaaagctaattctctttctcatgcaggtaggcttgccctcattaaatctgtctttgcttccattcctatttattacatgtccatcatgcttttctcaaaaaaattgattgctaaactaactgctattataaggaaattttggtggacaggaattcaagcagatggtggcaaaaaaggaatggctcttaggtcttggaaagacatttgcaaacctgtttctgagggaggcttgggcataagagatttgatggctgtaaataaaagtatccttgtccaatctgcctggagaattcttactaatccaaatgatcttctatcctctgtcctaaaatcaaaatattttccaaacacttccttttggaaggctagaacagatatgccaaaatctgctttctggtcttctattcttcaggtaagggatgtcttggaggaagcttcagtgtggcaactttctaaaggtgatatttctatttggagccaaccctggtgctctatttggaaaaacattcatgatcatcttaatcttgataatcttccttttcacatgcctgataaggtttctgatctttgggatgagaataagaattgggatgctcagaaaataactcaaatttttgatagtgcagctcaacattcaattatgcaggttcagattatgcagggagaggaggaagataggctttgctggaagtacacaccctcaggagtttgttcagccaagagtgcttacaagacaatttacaatgaaatgtaccccaatcaaaatcaggtcagtaatttaacaaaaaatcttttgaaattaatctggaaacacaggtacatgcctcccagagtcaaaacttttggatggaggctgctgagtaatgctctcccaactgctcaaagaatgcaccacaggatcaaaaccgttagtcccaattgtcagacctgtggtcaaagggaggatgacttgcatctcttctttctctataatttcagtcgtttatgttggttcatctctgactttaatctcaaagctgataatctttcttctctaggctctgttcaagatattattgcctatctttcagctaatggcatcaatatatacaatcttttaattatgctttggcagatttggaaagcaaggaatgatatcaacttcaaaacaaagatttgggagccacaacaagtgtgcaatgctgcgcaggcaatggcaaagacatatgaaagtgttcatcaaatggaagaagacagttgccaagacttcaatcgggctgaagagaataatataagaaattctattgttaaaattcctacaggaacaagagtttatgtggatgcctcttggaaggaagagaaaataggagtagggatcttcatccacaaccctagcaatcacaatgctattgtcatcaaagctcaaagtctcaatgcaggaactcctttgctagcagaagctgaaggattatttttagctatgcaaattgctcgtcatcttcagctgcaagaccctatttttctctcagataacagtgagatagtgaatgttgtgcagaacgaggactacatacaaaaccccggacattggtctctgagaccaattctttcaagaattaaaaattttctgcaggatcaacaagttcgaatcatttggatctctagagagctcaacaaagttgcagatggccttgcaaagtcagcaagacaagctcagactaacagctgcttagcttttgattgctctaatatttctcacatttgttccagagatgtttgtcctactaaaagagctctttccttcactcctaatggagcagttaatgtaactcatgctttgtgtttctaaaacgctttcttttaataaagtgcatgagctctcaaaaaaaaaaaacctcgatcttgattgggtcacgtggcacaacgcatacagtcccgaattcttggcatgataagcgtttcatgcatgtattcacaccccttccgcagctgttcgatgccgtatcaggggtcaaaatggtacgaaaattttccggattccagacctattttcgaaaacagaatctgtcggtcggaaatttttcggaattttttagaaacggaaatgaattcggaaatattttctcggaaacggaatcgaaaatgataagggcagttttcgacggaactcagaatcagttggaaattttctcggaatttctgaaaattttgtgactgcgataccctggattctttttttaagcactgaacagtgaataccatggtttaaaatatgtgttatgcaaatataaagttacataagaatatttttttcctgcattagaatttatcaatagcattactctcttaaatatatataatttattccatactgtgttttgtgatgaactgttaagacttaacaattggacttatatcattgtgttttatgatgaattgttgatcgttgggacttgagaattggatttgttagtttgaggggtttttgtattccgataaattttcgttaccgtattcgcgccggttcgttttcgctccgttttcggtttccgacggaactcggaatcggtcggaaattttctcggaatttctgaaaattttgtgactgcgataccctggattctttttttaagcactgaacagtgaataccatggtttaaaatatgtgttatgcaaatataaagttacataagaatatttttttcctgcattagaatttatcaatagcattactctcttaaacatatataatttattccatagactgtgttttgtgatgaactattaggacttaacaattggacttatatcattgtgttttatggtgaattgttgatcgttgggatttgagaattggatttgttagtttgaggggtttttgtattccgataaattttcgttaccgtattcacgccggttcgttttcgctccgttttcggtttcgataatatttgattccgtttttttatccgtggtttccgatttaaaaaaaagaaaatggaaatgataaaggtggttttcgtccgcctccataccgttttcacccatatgccgtatacatggtgaaaaaaatccagtggacctaaatgtaaattacaagttctaagaggttttttttgttataaaatgcaacgttccatgacatgcagacgcggaagaaagccatttttctttagtgactaacaactctgaatgtgttttttgacaggagcagctaccgctgaagctgaatttatagacggaaaactgactttgaaatgcttgtttgtaccacagagaaaactcaattcatttcatttcacaatattaatggctgagttctagttttgagaggagttcgggacctttcctcttatcacgtaaaaaaagactgatggactaaagtattgattaattaagtattagctaactaaatttaagaaataaatcaattaatttaaatataaaacaaacatattatcaaaatatattaaataataatttaaatgaaactaatttggtgttgaatatgttgctaaatttttcaataaatttgataaactaaaataagttctgatgaagataaatggggcacacaaaacgagatatctattagcgtataattaattaagttttaattattacaaacttgaaaaatagattaatatgatagtttagaataactttcatataaagaaaattcgcacaaaatacaccgtttagcagtttgaaaagcgtgccacaatattctagaatttcatcctctccttccatgagatttgaacgggaccataatatgaaacggatggagtatccaataatttactcccatccgtttcacaacgtaagtcattctagcatttcccacatttatactgatgttaatgaatctagacatatatatttatctagattcattaacatcaatatgaatgtggtaaatgctataatgacttacattgtaaaacggaggaaatatctatttatctattatatactaaaagcctatcaaacttactacaaacgctcctaagcctccacataggattttaaaaacactcctacatcgccatgcatgtggtgctctaataattatagaaattctaagaaacaaaacaccatcgattttcatttacattattttcaaccatcagatatattataaaagtactaattaaatttatctccaaaacctgcatctagattgccgtacgtgcacataagtacattagttggtatttaaaaaacgtacgtacgtacgtacgtatgcacgccgggcgaactgactgttttttcttcttttctttctcacttggacaaaaaatcaaactgcccatattaactatgctttaattacgtgtacaaatatacataattttgagtttctaattaggcgcatgtcgtcgaaacaccaatgaaaaacaaaaataaattaacaatatatattatataatagttaaattagacttgcatttttaaaaataaaaacaactccaattgtaattagcaattttcaaaagttattcactccctacgtaaaaagtaatgatatgtcaaaatgattatcactaaatttatcatgaatctatttatcatgtattatgtgttttctctattcgtataatttttaaaaattaaggatcgtatatattcttttcacaccataccggtgtcctgtatcttctacttaggcttcgtttgatatagctcgatggctgagcttattcaggacacatgaaacggcgtaagtcattagttcaagattaactaaatgatataaagctgaaaatagattaatttgatttattttaaactttatataaaatatatttttaataatacgcatgttgcatttaaatatatacgatgttgattatgattgtcaatttaattatgctgaatagaatgattcagatggattatatttagatattattattaaaagatatttcttttgtaataattcctagatcaatgggtagatcactggggtatgtgcttacaacgaacaaggagcagccaatcgaatactactttagaactaattgcttatttacttaatcgtttaatttgtagtatataatagtctttgtcaaaaaaaggcctaatatatcaatcgtatgttaccactaatccaaaagtatataagttctatccacaatttgtcaagtcatactgcttactcggcattcatgcacagtgcacctaataattagctgacatccaatgagcacttatatcatcaagcaccgaagataacatactatactaagtaaggaactattaacaaatggtaggtaagtagagcatgtcacctaaccacaacaaacaatagtcgtctacaagcagattgccggtatcaataatacatttctacacttctaccagcactcttaagatgcatgtcacataatagatcgaatgaatcagaaaaaatctgagaaaaaaatacatggccatctatttacacttaaaccgatagatccactatcttcaaccattagattagatatattctagctaaaaaccaaacaatagtcatgccatcccaccaaactttttgaaaataattttttttactaatgatgtaaaacaaaatcgtagacactcatataaacgtgtgcacaaccacctacgaatatacacactactattagccaaaaaatacatgcgcataaaaattatcacatggaaacatattatatccatttataattatgtcattttcatctaaactaggaagatagcccgcgcatatgcgcgggcatgtgcgtaaaattttattacgaatgtccatgtgtagatggttttctatccaaaatattattttacattatcataaactaaaattgaacttatttaacatgctttgaacgttggttacttgcaacatataaattgtgaactaaaattacatcaaaccgtgttgtttttaattcatgagaaaattttgtaacgaaacaattgatgtgtttcctatgaatgtccaattcttttgttagattttatttgaaattttaaatattttcattttttggtcctgctaaaatgtttgaatatttctatctagaatgggttataaacccaacaaaaagaattttaaaattagataaattttgtttaattttcatttcattttatcttcattttttttggacaaatccactatatgaagcatctttgaaatgctttgatctcaatataagtgggttgatcctacaacttggcatggtgtaaaggcatccataattctaaattatctcgctccaattatgtaaaaaaaattaatatagaggccatagtattttcttagcaaattaccgctaaactggagcgtcaggtaagaatcacacgtttgtagattgttccatgctatatgtcacaaattcacgatgtactgcagcaagttttaccaaaaagtaaatggatacggtctttaaattcctatatggaattgggttatatattgctgaggcgacatcaggttgtttcactcttaagattccttggtgcaaccaacatgcttagtacgatcagtatgttgttcaactggccacatgacttcatagatcatatatataatttagacgctacgatcatcttaagattatttatttatctcctaaaatgatcatttattgataaaagcatcaatatcaaaacgtatgggtaaatagcttttgtatacacgctgagaaaaaaataactaagttgatagaaagtcgttagatgtctaatgggatataagtaatgggtctaccagttttataaaaaaatcgactgggatattttgatttttagtgagaaattttagtattttattttatttagggtaaaatttgctagggacatctaaaaaatatgtacttaaccggggacaccgtaagaacgcgtatcagttatgggacactgaaaaaactttataaaatccaaaggaaatggacagagaaacaataacgaaagtatgattttgccccttgcctaccaagttcagctcgcaaacacctccgacactgcaaccgcacccgccgccagtgagatggctgtctagtggggggagggggtttcgagaagggcccatgcgcctgggcccgtggctccatgtcgttcttgcactcgtcgccgctgcagtgcaagggccatgttggtgtcaatgctccgccacacaccgcgcttggggttagcacaacgtggaccacctcctgattcatgtcgagcagggcgccgcaaagcacaagctattgctgtcagtctcgcagccgcaccacgccacgatgccataccctccacctcccatgtcgtgactaccacgacgtctgagctatatgcgagccacacttggcaggaagggggcaaaatcatactttcgcaattgtttctctccccctttccattggatataacaaagtaatgctgcgggtatctaacagctaattaccagttttttgcagtgtcccatagcagatatacgttactgcagtatctcttagctaattacactttttttttatatcttgtagtaaattttacctttagtaagtagaggctacaatatggatgtgggtccataatgtaattttttgttagcacttaaatacaatcaatatgggcattaagttattgttttcacttaaaataataataactggctagacctaatagatggagattcgcttgtggtcttttctttgcccataaaaataattttaattatcatagagatagaaaaacagagaaaagtaaggccgcacaccacacgggaacggggatggagggagggttgggatgtttcttttttttagaaaaaaattgattgatctgatgacctaaaatataatgtgttgaattttaagtcaaaactgatggttggatgttatttttttctcagatttattagttcttttctaatttaactttgacaagtggcagcttagcaaaacgcgtatagggatgtagaggaagggaatatggtttgggatgttttttattagaaaatatatcaataatgatgtaaaataatgtgttcatatttaagtggaagccaatggatggatgtttctataatttaagaatgtcatacaacgatttagaaatatttataagaggtttaatagactttaacgcctatttatgagattattttccataaagataattttaattttaattatgatagggataaaaaacagaaaggaacagggagcctacaaattgatacgtgcgtggtacacggatatggggacatgggaggttttggtattctaagatagatctaacgaagtccaccgatttaaatgaatatcgatggttagatttctctattttattaggatgccatgtgacggtttggaagtgtttgtaggaaatttaatagattttatttagaatttaatagattttatttagaatataatagatagatagatagtactacgtacatatggatttttgctttattttatacggtagaaaattatattttatattttttcttccgatgatacgttgtactaattttttttttgcctttatctcattttgacactggcaatttttttattccggcgaatcgaacggaagcttttcttttttttctgaatcatacgtactggtattttttgttttgtcgacggtacgtattctcacttttatacagggaaggtattatatacacacacctaatgattattctaaagtaatgggcccaccaatttaaatggaaatcaacgatacatatagatctaatctaatggtataaaatagcgggtccaccaattaaatgaaaatcgacggtgagattagatagtgccacgtgacggcataggagcgtttataggagtcccacgtggctacttgagagcgtttgtaggaagtttaatggacttttagtatataatagataatagatagatagatagataggaaaaaaatcaaatatttatatattgctaaaaatggaaataatcggggattaggggtgagtaataaaaaaaaatttcttggcaaacgacataccggtcaacagcaatacatctatgctaatttcaccaatctcaagatatgccattttttagagatactcataggaattaatgcattgtgtgtgaacgtgtttacaggggtgagtatatacgtaaatacgttttgtgagcatctggcttgtttataaaagacaaaatttttaatgtactacctaccttttggccacacaccaacaggcaacagctgacggctgaggagtgagtcataataaacaatataataggaatcttgttgtgtagtcatcgttgtgtacttgtaccattggttgatccctaaaatattccatccaatgtacctttactatcacaattgcgagcagaatttaattacgatcaggttactttcctgctcgacattcgtttccgagtctctcctaataattatttgccatcagtggacgtctacaggatttttcccagtatggagaaattactcgtcattgccctcaaaattagagaatttttacagtacaatgtactactagtatataattattcttttgggtttttttttaccatatggttttccagttacaaatatttgcatcatattcatcttaatttgtagagagattcatatatatctcaaacaagcactccctctatctacaaatataaggataattcgtcgagaatatttcaccatccattttcttatctcaatcaatcacaattgtcacttctttgaattccctaagcatgtttccaaaatccgatgggtactgcactaattactgcatatcaatctccactgcatgggtgacaactgtactataattctttaatataactaaccatgtaatccctctaacctcttaaaaaacaatatgcctccatactataatttgttacatctggtattagattagttttttatgagacgggggagtatacgtgaagtttaaggtaaggttgaaccttttttaaaaaacttaaacacatagacatacacatagaggaatcgaggtcatcgatgcatccccaagataggtgtagcagttagaagctacaactccatctgtatcagaatatatttgttttaggattttttttagcaaaaactgaggtagagaaaatatattctcttttagttattttagtgatcaaattttgaatttcttagatttatatcgaaatatatatccccactgttggctgaataatatattgatttccacgcattagaactagtaaaaaaaacttggtacaaaatttcgaatcctctaaatacttatatttggaatgagataaatataatgtgtactccctccatccataaaataactatattttagtcttgggtatttaaaatgagatagaagaaaaaaaagactaaaatgcctcctgatcaataaaataaatattatatattgatgggtggataggtaaggaaacggcaaaggtagtgaacaaatgaaacttattaacttattattttgtaaaccgagcacaggtaagggatataaaagtaaactcgttttgaaaatgggcagtatctaaagttattttgggatcgacggagttacctactaataaaatgcttaatccttctctctctctcatgattggtgcacatgcacgctacaacattttttcacaatctgtgtggatagctgttgttgaaacaatggaacagatccaaactatttgaatctgtgtactctaggagatggatgatctggtgaatgaataatgtcatgaacaaaaatgggtccatttttccgtcatatatattcggtgcaccctcttcttatcatatctcacattttactttctccggtacacatcggtcgggacattctatagatctgacaaatataatgcaaacacgaggcaaagtatagattctggaggaccatagtggtaagagcatcggttctaagatgatcatgagtttctgaaataaaacaagcaagtctgtcgaaaagtaaatgtaaaaggcatatatatatgcttaattaaaaagcaagtcttctattttgtctccaagcaaaagtcctaaccctagcaggaacggctgtggctttgtttttccagatgttattcaacaaagagtgttacttttttttttaagaataacacagtacaacacagacactcacaacgcacgcacactcacccaccaaatcccacccccaaaaattgacgccggcatgccgcatcctgcatgttactgaatttacatctgaccaagattggtgttctctcttcatgatttctttataagattgttgaattgcttgtacctgtaggagtataaatccggcatatatagtctgtcttccctgtcatcatgcattatttctacctccaacatttgttaatttgtgatgcttatggttgacgaagttgaataagatagctagctagtatgctacacacactcacggcgtttttgagaatttaaattcctaacacgagaattttagcatcggtcacacaatctccaactaaaggaaaagaagattcagagaacatatcttatgtcagtggaatggagaatctgaatttgcctataattttttagataatgaaaattgattgcattcccagcctctgccttatagcacagagccaatataattttatactaaataaaaatgacataatatgatgggacaaattgctaactacccaaagaaagactagctaaaaggtttcaaatgaccacgcagattataacaagtaagcttctatacagtacaccaaccataataaagtaagagatgcttagctaccaactctaagatgggaatatatcctatgcacaaaagccttaccgtgtatacaccatgcatactaacgaaaatatttctccaaaaattttggaaaaaaattatacatgtatttttaatagtattacatctaatctcatcttcatattctttatatgtagagagcaacaaaaaagataaaattctgatagatttgtactctcaaaactgtcagaatttttatcttttttgttacggctaaaatataataaatttgaggttaagactttacacatactgtaatagtataagaagtacttgtacattttttttccagattttttgataaaatttgttagttgatgtgcatggtgtgtatacaagacttgtatgcacagatatgttcctcttcaagacatagcatatagtagtattttggtccactattatgacatagtggaccagcagtgtgaagccactttgaagagataactagcatgggttagacaactttctattattgaaaaaattatatcattttagcaatgccaaattgtccgatgtggttatcggcactccatgatttgtacagtgcattttcgctagcacattggcactagtagttgtaggaaaaaaaaacccttagggtaccaaactctaaacaacaggtgccagtagagccaatcacattgttttcctaccaggacatattcttagacacccactcaatggagaatgacaaaaaatatatccgtgaaaactcatataccatgctcatctctacacgtcatgtaaggtatcttaactaattaaaaaattagtagttttccgttcgtcacaaatctttttcatctgtctcctcgtgatcgtgcacgcaatatgagtctttcgcccgtcactgctaagttacagccagcccaatccacacaattcatccctgttcatgctagggtgtttttcagcccagtccacgcgagcaaatatgcccgaacaaaaagaaaacaaaaataaaagaacagcaaatgaaaatcgcaggccgccagctcagcgcgagtcctcctcctgcaatccagtggcttttaatgtgctatcctgtagatcccacttaaattaatgatttgatatttggcaatcttgtttgtgcaatagatatatcttgcctgatcttgatttatggcaaagtatttctttgatctgtttctggaggcctagggttcgttcgggtgttatagattttgggactttctaggtattttcttgtggtgtttgctatgtgcctatattcttagatcttggactgattgtggattggggctatgctctaaccttagaaccttacttgtcctcccctaacgcacttcaccagtcccactccccggacagtaagattcctgctgatttgcaagggccactcgccaatgaggcataagcgccactgttgctcgtgcagcagtcatgttgttccaacttccaagtcactgtgtcagcagtcctactgattaacactccttaaaatgggtttcgattatttgagatcatggcccactttcattcacttaggtggtcccacatgtcatcctcataaatgttaattaaagcaattaggcaacaaaacaatgttaaattatcaaatttttaataagatggacatcatcatcatcatggattcgtgaagtcagaatccatgggggcagcggaagtgatctgaaaccgttcttgacatgccgcgcagcaaagcggataaatgatgacgtggggatggtctagtttgatcgtcatggaagagaaggatggtgttgtccttgctgctgtcttctttcaacctagccggtcagtttctgactgaagtaatgcaagaatatgttacatatatacaaagctcacaacagagctcttgcattagaacaaaagaattgctggaaaaagatgatgcagttatacacgtatgtggtgataatttggaggaaaatcatttgatagctggatgatcacctgggattctaaactgcatgtaaaagcatgacaaaaagattggatcttttgtgattggttttagttaagaagtcataatctttgagaagttgcagaggaggtaccaatgcaaggttgttgcgattggagaggttgaagtagcatgtaatgctgtaaaataaggatcagcatcagtttactcatatatcaacttcggcgttgatggcagcatcggcagcaacatttgaagtagcagcatcttttatatcggttgtggcactgttgatgtcaatcccgatatcagcatcgagctcttctaagtcaacggagacaatggagtgcctggcagcttgcttttgcttttgcttctgcaactcaggtgcactaatatcttctttcttttgcgctttggttgggggccttggagcaaagatgaaggaggaagagggccaactcccaagtttggattggccgatgcaggagcgtattcgatgcggcacccactttagctgatgatgggaggatcgacgtaaacaacctacaagatgatgaggcatgaaagtgttagtgaataaatattttgaaaatagggaagagtgcatataatggatacctttctgttggtcttgacaaaatcaggatcaagaatgcagcaataagtggttccaatcaggttaaacatatgttgcttccattcacaccaccatcgggaccagagctttgaactagatgtgtgggtatagaaatcctcacaatcgcctagtgaaggtctctcgatcaacatgaaacgatcgaattctatggcattggctactgggcccctcgcctggattttgtcaatgaagtagaggccaatcgggtgctaagcgaagcgaagttgataagtagaaactagtggacggtaaaactcatacgagacatgggagttacaacccgtggagaccccggttggaagaaggcaatgggtgatggttgatatgaagatatcccttctttattaatcaaattgggtttaaaactggcagggaattcaaaattatcgccatccttataggcataccaaattttagcagtcttagcgaagccatagtaaaaggctttgaactaatagctatgatcgacaggcaataatttgcctcttgggtagcacgatgcgacttcgccataaggcatgcatcagctgcgagtaggagctacaccttcagcatgatccaatgggatggttagtgtattaagagtaggccttcctaccacttttgttaaatatgtgatccgaattttgggcccacaatatattcggattagtttgctagtaggattagtttcctagtaggagttcctattaggtttcctattaggtgtctttctattatcccctatatatactcttgtaaaccgtacgggaaggggtgacgttcccattgttattcctctacgtttgtaattatctcctctatagtgatcattgccggtcggcgcccgtggttttttcccacaagggtttccacgtaaaaattcgtgtctccgttgtgcatctattttcataacaagtggtatcagagcattggggatcaatctactagttcccagccaccggcgtgtttatcggatcgaagaaatcgatctcgggcggcaccgtcgtctcgtgattccaatccgaagcaaagttgccgtcgactcggagtcgacgtcgtccttcctgccgccgacgcgtcagaggagcagcgcaggcgcagcagaagcatcggcagccagcagccctaatacagaagcgcacggttcaagaaaaaaaaatcagccgagagagatcggttgtttcgttctgtgcatgctaatttttccagtggaaaattgctacagccaccaaagcttgtgtaccaggaagtttcagatctacgctacgtgcacacgagaagtgtaccaagtttcgcgattttgctaggtttacatcaatttcttactagcaaattcagtattaattcccatggtaagtttgaagtatgatctaccgctcctagaccgagacacaagattctcactttggcaagtgaagatgcgagccgttcttgcacagcaagacctcgatgatgcgctttctggatttgacaagaggacacaggattggtccaacgatgagaagaaaagggatcgtaaggctatgtcatatattcatcttcatctatctaacaatattttgcaatctgaccagtaagatgcacctgaagcaaaagttatttttgcacaagttgcaagatgatgggtctgtgatggatcatctctccgctttcaaggaaattgttgctgaccttgagtctatggaggtaaagtatgatgaagaggatttaggccttattttattgtgttcattgcctagctcatatgcaaacttcagggatactattctttatagccgtgatactctaactttgaaagaaatttatgatactttgcatgccaaagaaaagatgaagaagatggtaccctctgaaggttcaaattcacaagcagaaggcttggttgttcggggcaggcaacaggcaacaggagaagaacacaaacagcaaatcaagagataaaagttcaagtagctaccatgggagatcaaagtctagaggcaggtataagtcatgcaaatactgcaagagagatggatatgatatctctaagtgttggaagctacaggataaagacaagagaaccggaaaatatgtaccaaaaggtaagaaagaagaggaaggtaaagccgcagttgttactgatgagaagtctgatgcaaaattgcttgttgcttatgctggttgtgcacaaactagtgaccagtggattcttgatactgcatgcacctatcacatgtgctcgaatagggattggtttgccacctatgaagctgtgcaaggtggtactgttttgatgggtgatgatacaccatgcgaggttgcaggtattggaacagttcagatcaagatgtttgatggctgtatcagaacattgtcagatgtgcggcatattccaaatttgaagagaagtctcatctttatgtactcttgatcgcaaagggtacaaatattctggtggagacggaattttgaaggtaactaaaggctctcttgttgtgatgaaagctgatattaaatctgccaacctgtaccatctgcgaggtacaactatattaggtaatgttgcagcagtttctgattcattatctaattccgatgctactaatctttggcatatgcgtcttgggcatatgagtgaaattggtttggcagaattgagcaagcgaggattgctagatggacaaagcatcaagaagctcaaattttgtgagcattgcatctttggcaagcataagagggtgaagttcaacacatctacacatactactgaaggtattcttgattatgtgcattctgatttatgggggcctgctcgtaagacatcttttggaggtgctcgttacatgatgactatcgttgatgattattcgcgaaaagtttggccttatttcttgaagcacaaatatcaagcttttgatgtgtttaaagagtggaaaactatggttgaaagacaaactgaaaggaaggtgaaaatccttcgtactgacaatgggatggatttctgttctaagatatttaaatcatattgcaagtctgaaggcattgtgcgtcactacaccgttcctcacacacctcaacaaaacggcgtagcagagcgtatgaacaggacaattatatcaaaggcccgttgtatgttgtctaatgcaggtttgcctaaacagttttgggcggaagccgtttccactgcttgttatcttatcaatcgatcacccagttatgccattgataagaagactccaattaaggtatggtctggttccccagcaaattattcagacttaagagtatttggttgtattgcttatgctcatgttgataatagtaaattggagcctagagctattaagtgtatttttcttggttatccgtctggtgtgaaaggctataagttatggtgtcctgaaaccaaaaaggttgtgattagtagaaacgttgtctttcatgaatcagttatgttacatgacaaaccttctactaatgttcctgttgagagtcaggagaaagcaagtgtgcaggtggagcacttgattagttcagggcatgcaccagaaaaagaaaatgttgctattaacctagatgcacctgttattgaagattcagattcttctattgttcagcagtctccaaaacattctattgcaaaagataagcccaaaagaaatattaaacctcctcgaagatatattgaagaagcgaacatagttgcttatgctttgagtgtggcagaagaaattgaaggtaatgtcgaaccttctacatattctgatgctattgtttctgatgattgcaatagatggataactgctatgcatgatgagatggagtcgcttgaaaagaatcatacttgggaattggtgaaattgccaaaggagaagaaacctatccgttgcaagtggatcttcaaaagaaaggaaggtatgtctccaagtgatgaggcaagatacaaagcaaggttagttgctaaaggttatagctagataccaggtattgattttaatgatgtcttttcccctgttgtgaagcatagttcaattcgcactttactcagtattgttgcaatgtatgattatgaactagagcaaatggatgttaagactgcatttttacatggggagttagaagaggacatttatatggagcaacctgaaggttttgttgttcctggaaaagagaacctagtctgtaggttgaagaaatctctttatgggttgaagcagtcacctagacagtggtataagagatttgactctttcatgctttctcagaagtttagaagatcaaactatgatagctgtgtttatctcaaagttgttgatggttcagctatatatttgcttctttatgtcaatgatatgttgattgctgcaaaagacaaattagagatagcaaagttgaaggcacaattgagtagtgaatttgagatgaaggatttgggtgcagcgaagaaaattctcggtatggaaattactagagaaagacgttctggcaagttatatcttagtcagaaaggttatattgaaaaagttcttcgtcgtttcaatatgcatgatgcaaaaccagtgagtactcctttagctgcacatttcatattatcttcagatttatgtccacagtcagattatgatattgagtacatgtctagagttccttattcaagtgcagttggttcacttatgtatgccatggtatgttctcgtcctgacttatcacatgcactgagtgttgtcagtagatacatggctaatcctggcaaagagcataggaaagctgttcaaaggattttcagatacctacgtggtacatctagtgcttgtttgcagtttgggagatctagagatggacttgttggttatgtggattcagattttgctggagatttggataggagaagatcactcacaggttatgttttcactattggaggatgtgctgttagttggaaggcaagtttgcaagcaactgttgccttatctactactaaagcagagtatatggctatttctgaagcttgtaaagaagctatttggcttagaggtttgtacactgagctttgtggagttacgtcttgcattaatatattttgtgatagtcaaagtgcaatatgccttacaaaggatcagatgttccatgagagaacaaagtacattgatgtgagatatcactttattcgaggtgtgattgctgaaggtgatgtcaaggtatgcaagataagtactcatgaaaacccagctgatatgatgacaaagccagttcctgctactaagtttgagctttg

SEQ ID NO: 72033 - DNA, 35256 bp, Oryza sativa
cgccgggccggatgtcacgccgcgcatgtcgccggcgcaggcggcgccggcgcggcatcctcggagaaaagccgagaagaggtccttcttatcaaaggcacgtaactttagttagttgattgattattatctaatttaataattcatttgcaactttagttaattaattatttaattctgtaattcatttgcttcttcgagttcatttttttttaaaaaaaattgcatgctttgtgaattgcaggtgtacaggtgcatgttcccaagggtgagggagtgatgcagaagctggatttgtattattaatccgaccttaattaattactgtaaaactcccaatcgtatacgtatttccgacaggaaatgtactgtgtaattaattaatttgttcgttcttgttctttattacagtcccctggcacaaatcaaatcacaatatgatgagattggcacatgtaacttacctgcctattcttgtgcggaaattgtaaattttgattttagacatccggaaaattttgcgtgtggtcccctttgcaatcttatcctctcgctcaaaccagatcattttgaaagtgaaacggtgaatctgaccaaacttcttatgcaattttgtgaacttttatcaccagcatcgaattgttttctgttgcagagactcgaaagattgttctcctgtacggccacattttggcccatgggcctcttcaaattctgagaaaatcaccagaccctgaatctaagcccatggttacctcgtggtcttgaccgatggaataattctattttgactcccttattacatccacggtccatcaacttggtagatgggtgcaatttagtacaataacttaaaaaataagtgctctagtgcaacaactttgacaggtatatgcaatttagtatgagaactttataagtgatcgtataaatgcaataacttgcaaggtaggtacgattttgatacaataagttaaaaggttaggtgacaacttaattatttggagcattttttatataaattcaatttttaagtactaattttgacaatatactagcacagatttgtataagtatatttattttttatcctaataactaataactgaaatccaattaaactagatgtagaaattattgtttttggttgatattttagaaggggaagaaaaccaaaaaaaaatcttaaaggtaattggatgtaaattgtactactatgtgtagtataattcttaaagattaaattcaatattataaggtaatatccgtatgattactatgtaatggcatattgacatcgtgaaaaaaaactcaccttgcacatgcttagccaagttgatacaccaaaatactaaattattaagttcttatattagaacgcactcacttattaagttgttgcactcggatgttcaattctcaagttcttgtactatatcgcacccacctgccaagttgttgtaccgtgggtgtaatttactctaatctcttgctctcgaatcaccttccttaaccacaaaaccgggtataacgtcttcacaacttttaaaaccagtgcaaatctactccttcgatggtttgggaagcggtttctactgacatggaaacttgactgtgtttgtcagcatgtgggtcccagaaaccaaaccataacttaatgcggtaaaaaatgcaatacaaatttgattcttcccattgatttgagatctaggggtttctgaccatgatgatgtgccgccatatatttatcgatttttttctctcgtcaagaatccagtacaaatcctacgcattacagataatctgatggatggatcagaggacgccttgctggtagcagacgtcgagcgtgtgctgcgccatgatccggttcaccttctccgtggggtggaaggcgtcccagaagaggtacttgctggcgtcgtcgcacgtcaatggcgactcgtcgttgcacatgaaccccatctcgaacctccccgtcgcgcagcacccctcctccacgttctccagccctacctccccaaaacattacaacatacttgggtcagtggccgagccacctaagcaaaactcactataatttttcgtgttcttatgagaatagaatgtgccttcctctcgtaattaacagtagatatcatattttctaatgtaaaatttggtacatttagctagtactagttaaaattttcagagtaaaatctagatacctcgaggtagtttttcaaataccataatttttctcgtatcgtggtgtgctaactaaaatttatttcgatacaatctactactggtgtaaagcaaatgaaacaatatatgctttatccaatgcgaaatacaatttactactccctctgtttcttattgtaagtcattttgacttttgttaaagtcaaactgcttcaatttttactaaattcatagacaaatataataatatttacaatatcaaattacttttattaaatcaataattgaatatattttcataataaatttatcttgagttaaaaatgttacttcctcgcatattacttttgtcactaagaccaaagagaaattaaattatcttggatattacaaaattaaggaatgaatgcaaacatgcaaccaatgagtgtttagatgactcattgggttataatcaaacatttaatttatctcttcatttaagtattgaatgcataaagtttacaaataggaaaaactcaaatgtgaaatatgtctaatttttgtggatggatggagtactattttgactttgaaactgacttataataaaggaggtgactcaccgtacttttccgggtgggtgatgaggtcgagcatgttgtcatagacggggatgaaggcgaccttgagtcgcgggagctcggcgcggagcgacctcaccatggcctccaccttgccgttgtactcgcgcgccacccggttgtactcctcgacgcagccgccgccgccgccgccgaggagcgcgccggcggtgcgctccagcggcaggcaccccatcggcgagagccccgcgaacgtgacgcgccgcgcgccgaggcggtggatcgcggcgaggaacgcgcgcgccgcggcgacgaggtagtcctcgtactcccccacgctgtaccgcgcgaaccgccccgtggcgagcatgtagtagttctccaggaagtcgttggtgccgatgctcacgacgtggagcgcgccgcgcacgacgtcgcgcgccgccgcggcgcccgcgtgcgcgcgcagccgccgctggtactcccggtagtactccacctccttccacagcgggatcactgactaatcggaacacgcgcgcgtcaattaatttcgcacttttgtgtagatcgatcgccatgaattcgatcgatcgaggtgagctctgattatgaacatgcatttggcagatgagatttggagcaggtgagatttggagaagagagtgtgaatgcgtcacatgcatctgcatggatgcaggagtacttctcgttgtaattagtagtagcatacgattttggttgggaccgggacaaccgaaacaaaagcaatgctgctggattctctgggtcaaaacttaagtactggttttattgcaagaatcagtcattggtaatatagttttcacctagttaattactattactatattttaactttatatgtaggagtcattgaatcaatcaacacaactagagtgttgtaaaacagtaagagtattgatccaacaacagtaagatcttgtttattttgagacaacatcaatcaacactgagattagtgctgtaaccctatatagtatacttgtcggaaaccatctagaaatgtactactccagtgagcagctctacacagcaggagacaatctcagagaaatattcctacttggattaatgatgatttaataataaattcagaactgcatacatgccctaccatgattaggcaatcaaatcaagacagttcttctctagaagacgcaatcggatgaatccagctagcctacttaatgccggcacaagtggttgcagaaaaacgaagaacaaagcagggaaacacatgcccattatgtgcgttcttcagacaagccatcgaaagataactgaatactgaaaacgtacagccatttttctttttcattgttacaggtgatgacagtggtgtgcatgcaacagtgcccgggaaagagagatttgggtcccaatgcatttaagttttaacaacgagacctaacgtcgaacgaactgccttaaattgcagacattttcagacgactccagcaaagtacaattattcagaaacggcaagtctgaatttttcttagattgcaagttgcaatgataatgctgcgattgattctttggaaaagccataacttgcaattcacaatgctgttgcatttgattctttggaaaggattttcacaacttgcatgcataatgttgtatttggttctttgaagcagtgcataatgttgtactactatttgattcttagaaatacttgcgagttgcaatgcacagtgtgtattgctacctccgtttgtcgttttgatttttatctaacccaatcatcttctttagctttggtcaaatttattgaaaaatatagtaatacttttaacatttaaactatcaaatatatccaatcttaaatttaataaaactagtttaatgctataaatattgtcaatttttctataaaattgatcaaactttaaagaagtttgacttaatttaaaaaagtcaaaatgacttgcaatatatgaaacggacggaggaaggtcagcacgcatttgattctttagaagaatttcatatagaatttgatgggcgtgtgaattttgcaagtattttgctgaggattgttgatagtgatgatggtggtgtagctttgctttaattattaccaggacgccggcggtggcgttgtcgaggccggtgccggcggaggcgaagcagacgccgcgggcgaagtcggcgatgccgtaggccgggtcgaggtacgccgggacgagcggcggcaggccgagggactccgacatgaagtccggcgcgaggcggccgttgccgaacctccccgtcgcgcgcgcgccgccgggcatgtcgcgcccgtacggcgggaagtcgctccgcagcggcgtcccgatctggttgttgttccccgtgtccaccgtcgagtccccgaacacgatcaccgccgtcacccgcgccgccttcgccttcgccgccgacgccgcgccgcggctcgccgccgcgacgacgaggaggaggaggaggagcagccgtaccagcggcgacgccattgcagctagctactacgtacgtgtgtgacgcgtcgcgcggtgtaagcagtgaagtgagtgacactgagagtgagtacgtgcgtgtttgttgtggaaataaatagatcaggcgcgaggtgagctgtggtcgccgttcagtgggagacactgtatcaactcttctacagtgcaatatgaattccagcgtaatgtgagcgtagctttactggacaggcttgttatggttgatttacacacttacagctaattaattaaaaaaaaactgattttttgaatgacttagagagagataaaaagtaatgtgtaatagtaggaccttttcgtgcattctaaattgttctattttcttccaacgaaagaatcacatttttgggtttttgatgttaaggagatgggcattttggccacctaaatagtggtaaaaaaataaaaaaaatagcagcataaattaatatgaaatatcattgttcaaatatgtaagatccaattaaaaaaacaaacttaactaaaaatgtttagcatattgcattaatatgtctactatttgatcattgtcatcatcgtgttcaatgggtatacttgttgaatagtagttcacagcacgcagaatcttgcttgtgcgctaaaaacaaacaagatttgaagggagagacatccctctaaatatttttttaagaagaaatcatgaacatattaaaaattgaacatgagactttagggttgaaatcacaccccttatcactgaactatcaagtacatctcctataaacacatggttgcgttcataggaagacgtggagggtggtgttcatcttggcgtcggcgatggcgcggtggaggcgttccgtggggtggatggcgtcccagaacgcgaacttgctcgcgtcggtgcacgtcagcgggctccgcgcgccggcgccgcacatgtaccccatctcgaacacccccgtcacgccgcagcacccggccttcacgttctccaccccgtacgccgccgggtcggcgagcaccgcggccaccgccccgtacacgtcgccgtacacgatcctcgcgccgccgccgagctcgccgttgagccgcgcgatcatgtcctggaggccggcgttgaagcgcccggcgacggcgttgtactcctcggtgcacgcgccgccggtggcgcgctccagcgggaggcagcccatgggcgggaggccgttgaggtcgaccttgcgtgcgccgagcgcgtgcagctcgcggacgaacgcctcggcgacgccgaggaggtagtcgccgtacgccgccgccgtcgagtactccgccgcgtggccgcgcgccacggcgtagtagttctcgaggaagtcgttggtgcccatgctgacgatgtacagcgcctccgacagcgtcgccgccgccgccgccgccgccgcgtcgtcgtctccccggaagctccggagcctcgccgcgtactccttgaagtagtccagctccttccacagcggcagcaccgactgcaccatggatatcagccaagaacaccatgaaagtggagctaagctagcaatccttttaggcttacgaaaagatcggaggtggcattgtcgtagccggcgccggcggaggcgaagcaggcgccggcgccgaggctgctcatgttgacggccgggtcgaggtaggccgggacgagcggcggcagcccgaacgcctcggagatgaagtcgacggcgaggcggccattggagaacctgccggtgggccggccatttccgcctccgctgacgccggcgccggcgagctggaggtcgcggccgtagggagcgaagtcgctcctgacgagcgtggagaggtagttgttgttgcccgtgtcgaccgtggagtcgccgaacacgatgatcgccgcgaccttgctcttgccggccgccgccgccggctcgccggagaggaggaggaggaggacggacagctgcaagagggcgaccgccaccacaagatcacgcggcgaacgcatcggatcgatcgttgagcgagctcgctggtggcgtgcaggttttcttggctcgccatgagtcgcttttggagaggtcggcgagctaccggagaccggccggggaagagaggtgaagcaagcttaatttaccgggttcaggccaactactgatggagactgcattggaagctttccattccatttgctcttcgtcgtatcgttcaggattacattaattaggacggttttttggaaagtaatttgactaatttcacgagaattccggaggaatttgacagcaaaatgatcaaaaggaagccgccaagcagagtactactaatgaacagaacatttttctttttttttttgaaaatttaaaattaaccatgtagcttttcatttagaatgtataaataaacattttagccatgccacaagctcgagacccgcatccaaatccttgtaaaataaaaaaatcacttaaaaactatattttaaaaaaataaatttgtaacatatcatattaatccaaatgcttgcaaaattaaaaatcactttgaaaaccatataaaaaaattaaaattttgagcatttcatcttaaaatcatattttaaaaagttcaaaaatatcaaaataatttgaacataaatcttattaataataacaaacggtctgaaacctgaaagtaatccaaggataaggagaaaggtaaacaggccgaaacaaacgcgaggcccatatacatcgaaggaccctatataccagcttagccatcctctcgaagcttccaactccggcgaaacccaaaaccctactccctcgtcctcctcgtcgacggcggcggcgatgctcccgcagagccagagcagctcgctgcagcggctcaaccacgtcgagcaggtaatcaatccatttctcccctcgagatttcccctccctttggttgttccctggaccgtcttcttgtggggggtttcactggatcttgatcttgatgcggcgagggggggatttgcgcgtgcagatgatagtccgggcggtgaatctggccgggacggtcatggaggagctggggaacgccactgggccccgcaccgagggcgtcgctggccactgccgcgagttcatgctcgccatgaaggtacatctcaatctcctcgccctaagatctgaaatgcttacctttgatcttgcctgcttggatgtttggtgatcttttgcacctacagattgtttccactggtaatttattggggccccaaaataactcttgtattacaccagaatttgtttcccttctaaacccttgtttgggtatgttatggatgctagaatcaggttacagtatgaacaaggagctaattgaatactttttcctcaacaaacattgaacatttcataaggttttgtatgtgtggaataattattagaactaccagaatgaacctgactttgtttcaagatttttgtgatgatcattctggaatttgttctgtacagaaaaacagatcttggtgaattgtttagagaaaaaaatatcaagtcttgcctccaattcatccaattactattgttaccgagaaaataaaatttacacaacatctaccgagaagttacaagagccacctaaatcatcaaaattacacaactttcctgataaaaaaatcagcatgttttcctgaaaaaaatacagcttgatgagcaattgaactcagaacagtaacatctacccagaaattacaagaaccaccaaaaaatagaaacatatttccttccaccgaatctgagcaaccaagtgaccaacacaacaatattcaccacgatgagatgtctcctgcaagaagtcgaaagttgaacagatcgttggatccaagaacataggtgaacagagcgaacatgtgaaaccgattgggtggcacaatctggtgccgactagatatccccctcccatattgaagccaagatgaggccgatgggatctggggagcaaggttgtcgctgtgggcgatggtgacggcggatccaagtggattgaaaccttggatgacggtggtgatgtggagacgtagggattcaagcatcaacgtaagggagcaccatcggaacagggaagatggagtggcggcagggcggaggtgtggatttacgaggcacatcgttcctaccttttgtttcatgaatttacgaggtgatgctcgacagggcaatacgttcaacaggaatcaacttaaatctgatttaccaggaggagaattacagacatttcacagccttttaaaaaagaggagaataatagtcatttcacagatttttggtcccagcagcttcaaaaacaaaaacaaaaaagtgtagtgccatgcaacaatcacaactgagccttagttgttaagggtgccaccataccagtgaacctttctctgggtccatccaagctctttctactcttcaccaaaatacaagtcaaatgtgtgaaatgacaattgtattgctgtacatgttcctgctcttctctttcactaactttacatttaagacacaatgtgcattgtaaatcatacatggcagactcatttgttattatgtctggagcaggaaattcaaacgacattgcgtgaggaaatcaaaagtgcttgcgaatatcgcccatttgagaagtgtgactacagtgcaaggattgctaatgagatttgttgcaaaaaggtggaatatgtacttgagaagctggatgctatgcaaaagaacattgaggaatgttctactactagttaattgataactagttatctacctacctactggtgagtgctgatgcatcaggcgacttccccattcgaattcctcattctccatctttgctgtagatgcatcatgtgttccattgttttgacagtaccagccctcaagaaatggtagtactgttgctgtatgtgtcatttatttgatgcatcagaacattatatggttatttcataccggtccaagtttgaactgtgctccatttaggttctaagtttgttatagtattggcaccattgtaattgcaactggcaaatcgttttaagaacattagttacttgcaaaggcagcttttacagttttaaactctagatctacacgacttgcgatagtgtatgctgtattgttggctatatcccttcttttgaactcccagcattgatccatatgttatgctccatatggataaactatttttgagtgtcttgatgttagatactcttccgtataagatgttttgacttttttcctaatcaaacttttttaagtttgactaagtttatagaaaaatatagcaatatttctaacacagaacaaacatactatcaaaatatattcgatttttatatttaatgaaactagtttggtgttgtagatgttcctaatttttttaatgaacttggtcaaacttaaagaagtttggctaggaaaaaaaatcgaagtgtcttataatatgaaacggagggagtactatttagaaggacaacagtcaccaaactagactatttttttaagtagaaacctaataaactattttttaaaactatgtgactgtgtagtgttataatctttgtcatttcatctacatggagatcaaccttgttatatgccccaggttgaatagagtttttttttcctcatcatatttctactagtagtattctttgtatgtactcgtatccttcaagaattgagaggtgtgtaatgtaagtttacacagctatctgtgtttctttcaggtttacagtggcacaagtgtgactgagcggtttacaaaggaacatgagtgtcggtgtagccagcttgcaaatgcacaaggcatcattgaactatgaaatgtaatttaccttcggtttacagtgctttggtttaggtggttgcacagtgataaactgcaagtaaccacttcagtcttgcagaagtttacagggcagaatctgaaatgaatgcttgctagtactcgtatgaaatgaaaggaatggttgcacatgcttgcttgctattgctagtagtacacatgagtatttgttaagatctggcatcgaatctgaatctcgtattaaagcagttcttgttgcgtgcttcgtctgtagaataaggctacgctatttatgtgtgatttgctaaactttgggcgtttattttataaaaagttattttggttggatgcatgatactacctattcatattaaaagttgttttgattttttttctaattaaatttatttaagtttgatgaaatttataaaaaaaaaattagtaatcatctacaacaccaaattagtttttttttacaactaacatttaatatattttggtagtatgtttgatttgtattcaaaatgttgctatatttttctataagtttggtcaaacttaaaataagttgattatgaaaaaagttaagtgatttataacataaagcgtaggtagtaatttgtttttgtagatttgtcgtgaaagtctttccataacattttgtggcatttttttgtgaccgcaagactcgcctctctcggtgtttctacaagcaccgtactgcagcatttacccgccgcaaataatgtatagtaatttactctcatcactgtttctttttttaaaaaagagaagcatggagacggttccgaacctttcacataaatttgtttttcttaatagaaatttggcagtacatataatataatataatataataatatagcttaaaaatcgtaaaaaggaagacaaaaagctttagtatatatcgagagaaagaaaaaaaatcacaacctgaaatgttaaaaaagaaaaaaaaatcacaacctgaaatgttaaaacagcatttacgaaaaccgtaattctggattatagaaaagaaaaagaaagagagaagaaaaatgtattaaatttattcaaagtattcccctccaaaattcacaaataaatttcctaaattataaattagagaggataagtcgccaatcctctctcttttgccttcactatccatccctcctccgcttcttcctcctcagcctctcatccaatttttccattcccagaaatcgagcgaggaagctaagctaaaccaatcgaaggccacggccatggctgccgctccagccaccacgtcactgctgagcgcgctgctgcagcttcccctggccccgttctccgggaggaggtcgccgccgccgccgtcggtggtccacgtggcgcccccgcgctcgccgacggcggcggtcgcggcgaccaaggggtacaatgtgcagatcgtggtggacgagaacgagggggaggagtccatcttccggcggttccggcgggaggtgatgagggccggcgtgctccaggagatcaagcgccgccgccgctacgagagcaagaaggacgagcgcaagcgcaaggcccgcgaggccggccgccgcaaccgccgcaggtgaaaacacctcacctccccccctttgtttgatgcatcgatattgtctatgaaatgatgtaatcctttttgtgaattgtgaattcttgaaatcgatataacctgcagataaaactgtgcttgcatagtttgcatcagctgttgatggtaggagtttctgttgataatttggttgttcagttcagagtttcagactgttcagagtcggtgtttgcaggaaaagaaaaattagcaagatagattgtgctagcactgaatcactgaaacaggagtaaaaacatctaaatggtggtagcactgatgcagaattgttgctttggttcatttcattacttccttaggatttttttaatgataacatgttgattgggtttgtccaagctttgtgtaattctatcccttagggaacacaagctgagcaaatccgatgatcttcagctttcagactgcatttgcatagctgaatacgtcattgtaatgtgaaaaaacttcaaggtcatggaatgtcttttgttaacctgacctgtgtttgtcgaaaatgttgtgcaggcgtatgatggaggagcctaggttcccagaagacgatgctgattcagaggccgcgaggagggctcgtgacgatgaaaaggataactgggagattgacggaattctgtgagtgaaacaatggagttcatagccattcagatgcaaagtttccatgttttgagttattgtttttttggtccgcaaagcacaaactatatgagttgtcggccttaatttcctcttcaattgtacggtttgaatgtactaaatcttagctaatgcagcatccttttttttttttacctctgtaccttttccagtttgtttgcaatacattttgcaaatatgagcctataattataaaagagtaaatattatacaatgttatcctatagttgagtaaaaatggagaattcataatcctacatgaccatttttcatcctgttacccagtgttaaacctgcccaaattatgcacattaaaaacatagaagttttatgccttaaaaattttcaccaaaaggagcaggaaacatgtgtatatgccttaaaataactcagccagaagatcaaaacaaactattcccacccccacaatttatgtttttgcagccaaaaaagatatccactctggaagaacaaaacatcatccaacagtacaagagtacaacaccagctgaccgtccagcttacaagcaaatgaagcaactattctttttttctttttcgcaaatcgcatgtaaacatgtctacatgtccttccaaaagtcacctggaatcaaaatgtatataaatccagccctctcaagaaagagaagcttaatgaggcaacaactgaatagatccttggacatttcagttgtacaattctcggtaaaatgcaggtaactgaaacgggatctgactccaatatttgatatcaaaccgaacagagttcatgccattgtcaacaaacaagccttccacgatcttggccaggggttcatcatcctccatgcatatgatctcaacaatcttaagatgctcacatgtaaacgatctttctgtaagctcatcaccaatgatatgttcatatggatgcggataatactgcatcagataaaaaagaacttgtaagttgtatcccgaaaagacgtactcgtgaggaaatggtttaaaataaataggatcagcatacatttgaagaaaatcatttaccttttcgagtttcagagtaagcttttccagttttggtgagctctgaaggaaaataatcaacacgtagaagtctgaatctagacaccattgtccgagagtcaggtcgacaagattgataaatttcgggcataactgaggattgttttttattgtcatctgcacgattcaaatgattattagaccatgtagaagagcatgctatagatacaaacacatgtgaaagatagaggagaggagagagaagaaaaagattttttttagaaataatacctttttaatagagaattgcaaaatagaggttaacagactaaaattacaagtttagcgcccatcaaacaagcaaagttcaacagggtatatatcgacaggggataaaaaaaagtaaataaaaaagagaacaaccactgtacgccactgtgtgcatgtaggacctatcgaacatcagagttcaataggccccctgccaatgccctttcatgtactttttattttttttagtggaccaacaaccttgcccaactgcggttgttcgacagggtattaaacttgagattgtagccgaacagcttctattttttaatttttcattaaaataatatattttcaaaacaaattcgaagaaaaatgggctacagattggactctaaaatattatatgtgtagaggtgggtcaaataataatggtgcatcatgtatttatataaaactattgtataggtaggctattaaagttgttatagatgatgtgccaatttttaaaggtagtagttgactatactattattaaacttgctcttagaaggtcacaatacacctataccaaattatatacaaaacttcctcaaagtcaggtagctcattgtgttcgttagtatatgttgggaactaacccttcaaacaagcaaaatggagcggtagattagtgcatgattaattaagtatcaactaaaaactttaaaaatggattgatatgattttttttctaaaggaacttccctaagaactttttacaaaaattgtaccgtttaatagattaggaagcatgcacatgaaaaacgagacctagaaactggaacacccatatatgcaaacttatcgccttttctagtctctatgaaagtaagataactaaatactactgagatatttaattatttgccactcttaaatgtggcatttaataattttccactgaatccacatgtcacagattatgagtagcaaattattaaataccacgtcttaaaagtggtaaatagttaaatgtcccactacactgtggatcaacaattgctgaagtaatccatcaggtggttgtgggagtgcatgttttaacaatagttgaagcattttccagaactaaaatttaaaatatacattattgttcataattttacatatatatatatatatatatatatatatatatatatatacatatttttaaaatatttgtggaactatacattctccatgggttcgggccacgctaccgcaccgtcgacgtagctcgaaggcatgaaactgatggaggggcggtccaacggattggtcacgttggaccgacatggtccaacggattggtcgcacgggaccatatgcttcagtgccggccactgcgatggcgcacgcgtgtgttggctccacgccacctcccctcccatcgttcccacgtgcctctaccacacggggaatgtatatttctttaaatatttttaaaacatatatatgtatatacacaaaattacaacaaaataatatatatttaaagatttcattcgcattttccatctctacgtcaccttttttatttctcacttatatacgctagtaacggcaacataattaaaagaaaaagaatcaccgagaagtcagagacaggttgcattttctattacaactgttaagtaccaagctaaacaagagggaatatgtaagatcaataagcattaccttacacgcatagtaatcgaggtccaaatttctaacaccagaaaggctccagagcaactggcgcatgtcataagcacaaaattcgatgagaggaaacaggtcaactgttgccgtcaccagcgacgcgacgtcgtccagtacgggcacgaagttctcaggctgatgcatgatcagagatgtcagattcggcgcagaaatgcagctctcctgcagagttgggaactgacatccatacatggtgagaacattcagggtctcagatgagatctcatcatctccaatgatgcagtcgtacaagaggagatcctgcagcagtgggcagccaatctccagctgctcgaagaagccttggtccaagaacacattcttgagagtgattctacccaagtagcatgatgtgaacaccgtgtgatcgaggtgcaattcgtgcgcatccacgatgatcttgaggaaactagcttgattctgcaacgcgtggctgatccacctgttggcgtccgccgagtcgttatcgcggttgtttgggttggaaatggtgtatctgaggttgaaggtgtggatgacggcggcggggtcgcggcgctcgagcagccggttgacgaacctcttgaacgccgcctcgttgtctggtgtgaaggcggcgatcggggacatgctgagctcgcagtagttggcgttgatgcggggcacggagcgccagaggtcgcgccaccgccacgacagcacgcacgtctgaatgacctggcgcacgttcaggaaggacatgatgtggtggaggataccctcggggagggcgctgagaaagtctgggccagcggttgcggtggcgttccgcccgcgcttgccgcgcgggaaaccgccattcatggcggtcgatgatgacgcataggcgtttcgtcgaacaggtggtgcgctgcagaaatgggaaagaataagaattagtaagagaaagtcatgattcctagcaagccatagttcgactaggaggactcgagaattgagatagcatgacaatatcaaagatagttgggatttgtttattcactgcttgcctattttattctctaccgtaatttttggacggttgagatcgctttgaggttcgtgaaatgtaaaaccctaagcaccttgccctcctcccaactagatccaccccctagcacatgcgccgccaccacttgcctcaccggcgcaatgtgcttctgccgtcggccttccccttctatcgtcaccaccaatatcttgatgtctcatcttcctcaagtccggttagtttcctccaccccgcctcaactaccaagtctccagtgcctcgcacctttcaatatataccagtcacatctgtccctgcctcctaaccactccgacaggtagccccatcgtcagggtaggtccaccaccctcctcctctaccacagctgaggcgaggtgacatcgtggccttgctaccccaaccaccgcgtagcttccacatcccaaaatttccctctaggtcccaaagccagtgagttttctttgatctccttcttttccctacccgtaccttgatttctaatcaagccacctcgccagaggaggtgttgccagagattgaagacgccttcgactgagattttccaagatcttagctaatcgattagtaaaaatgaaattcaaagagggaagaagcaacaagatgaagagcatacctcgtgcgatccatgcgtgaatctcacgtcaagcgttgagtccccagccctcaagtatctgttttaaagaggaaattacaagaaccttgatcctcctccaatttgaggacctggtttcatgatctgaacgcgtctgacacgaatctcaaagcaatcacccggtatcttaccctcaatctttctttactcttatctataattgccaaggaaatatgataagtctggcatgatgataagcccccctcgcatcagagaagggtggtttgtcctgatggcgaaattggcattttaaggctgatattatgttatactaataatggtatatgtgtaacacatttttgcgtatcgtaccacattccatatataatgagatggctaagtaaaaaaaaatcaagaagtaaataaaatactactttatgcttgacatttgactattcgtgttaggaaaaaaaactgttttgttgtgacttgttttatcaataaaataagtttatgtgtcattattttttatatttacactaaatttttaataagatggataatgaaatataatgtaatatttaaaaatggatcagggagtaataataatttcctctgtaaccttttataaaagtaaactttgtgacttcttcgatagagcgactaaagtgcaaattagcaagaaataaagaagtgcttgcttacgacattgtgacaccggcttttgcaagaatatattactcccttcaatcctaatttgatcttcgccttagattttttagtctttccaaattgatcaacatctaatcagtgcctattcatttatttataccggagtaaatggcatagtggtatgtatattcgtttatgtgtgtaggaggaagaacattcacattgtagaatatcctatgtgtattaagatggggtccacctaatatgcataaggcaatagagagatttgtgaaatgtatagggcacatgcctataatgggatccacacccatgggtattaaggtggatctatgctatgctatgctttttttttttttttttaatttgaggtacctgatatcaagggaagagctcatttgctatgcttggtgtttgagtcatgtgtttgcaatgtatagatgctttgttacagtgaaaagattctcttcatacccccttatatttcccctaaatggcatcactgtgtctgttcgtttatctgtgcaagagtaaatggtattgttgtttgcccacatacatgcctcacacgacacattgatcaatgagagctagttttgcggaagaaacacattgatcaatgagctaatttaaggaagaaggttttttttgccttggtctcggcgctatttgcaaatatgatgatcaaattaagataagggagtagtatttttgtaacaccctgaaaattcgaccaacaaaaatcaaagttccaaaaaaatatggaccttcaaaaactttttaaataaattgcatcatgccgattttgtttgattattttatttgatttcgacttcggggtttataaaacgcgaagaatgaataattaattaggaatgaaccaagcaaataattgaaattcaatttaaataaagatttggtgaggatagaaatgagtaaaatattaccgcgaccatatttatatccctcagatttaaaagcgatggaataagaaataactctagttaaattcaagtaaattacaataataataataataaaatatggaataaattaatctcgaatggatccatgggttggaatggcacaaatattgaatatattttatttatgcaaaaactgggaattaaagaatcaaatctaaataataaatgggccaaaatcgggttaatagaaaagggtcactattcatcggccgccaggtgttcgacgaggttccctagcctaaccctgccccattgccgcgccgacaccgccccgagccccgtgccgccgctgccggccgtcgccatcacgctgccccgcgcgcctgctgcccgagccccgtgccgcgccgcctgtcgccatcgccgtcgccgcgctgccatcccatcgccgtcgccgcgcggccgtcgtgtcgccgcgcccgtgctccacgcctcgcgccgcgcaccgccgctaccgccgtcgccgtcggccgtcgccgtcgccgctcgcccgtcacgtcgccctctcgcgccccgcgccccgccgcgccgtacgcccgtcgtgtcgccgtctcgcgccccgcgccccgccgcgccgcacgccgtctcgtcgccgcctcgcgccccgccgcgccgtgtcgtcgtcacatcgccacgtcgagccccgcgccgcgccaccccgctgacgccatgaggccgccgcccctctcccctcttccccttatctctcccccctcccctatataagccccactgctcccactcttccccttcatcctcacctcctctcctctacccactccaccacgccgccgcctccacgacgccgcgccgccgcctccacgccgccgcgccgtcgcatagagccgccgcgccgccgccacgaagccgccgctccgcgccgcaccttgcgccgacgtcgccaccgtcgccgtcgccgccgtcggtaagccgcgccccccttgcgtccatcgttgtcgccgcccgggagggcaagaagccgagagagagagggaggaatgagccgggagggagaggagagagagaaaaagaaggagaggagagagagaaaaagaaagagaggagagaaaaaaaaagaaagagaaagaaaataaataggcgtttgagtaaaatttagaagtttagaaaattcaaaatagttaagaatttaatcgtaggttgattatagtcgtaaaattgcgaaagttaattataggattaataaaaatatagttagatgaattcttactaattaaatacctaaagtactagcatttaaatataagattaatgaaaatataattggatgaattcctatagattatttttagtaatctccctaagaaatcaatttcgcggtaataatttacatgtgattaagaactcaataattcgatgagtcttaggacatgactataaattacaaaatatcttagggagaagaataattccacttcgcgaataaagtagcctatatagaattcacctcccgcgctcgtttttcaattcggtcattatttggattttgtttgaattctaatcgaattcaaattgttcttacgcacgtaactatagagaccgagggagccgcggatccgggtgaaggccaagacccacaagacctagagcaaggcaagtcatcactattctttgatcacgttgatcccaattgcgaaatcaatttttgtttacaaataagattgcatgcaatgatgaacatcctacttgtgattatgccatgccttgattattgtttacccttaaatctttgtaaccatgattacgtatgagtccctagtcaattatgacacttgcttagaaatgctactttagaatcttgcatactcatgtttatcaaatattatatgcttgggcaattacctttgggaagttaattgagatgcggcatgtggagacatgagcaccacattgccatgataatgatgacatgaaaggaattaaaaatatttgttttagaccggggcggacggtggatttgggtggtatccgggaaaggctagtaccgtccccggtcaattaaggaccgagccatgaagttaagcatgaaacgaccccgtacaaccacatttctcgaatggggatagacctagcagagtaaatagccgagcggaggcattatccatgcatagtggtttctcatgtgtaaggcaggggctctataatggtgtcgccattgctaggactgccgtgtgtggagttgaacctagttataacttaattacatgggtgtaaaactttccttcccgggtgcgccagaactcctctcactgctagaaactgtgtacgcctagggtgcatgaggatgaaaagttcatggagcgggtactgccaatgcgaggttatcgaaaagctttgccgtgacgcgtctcatgtgttgagacaaggctcatgtgttgggcagtcgcggagtgtgggtaaagtgtacatccactgcagggtgagtaaaccaaatctattcgaatagccgtgctcgcggttattgagcaccgggacatgtattacacttggctagtctctaaattcttaacttgtgtgggatgggttgttgcatgacgaatttttatgctgttggagccacttcctgagaagggggaaggtgggcgtactcagaaaaccataacgactcaatggcgggaagctatccttgggatcacaatggatggtggaaagaaccgtcgttgtttaaatacaaacactggtactaaaatttgatcagtcaatgctaggtcttaggtttgtgaaaagaattacaaaacttgctttgcgcaaaagagccatagccatcctttgaaatacccctttcatatgcattgttgctgtggtggcttgctgagtacggttggtactcacccttgcaaatataaaattaatcagaagcgggagatgaagcttcggaggatccctatgcctactaccaggagggagatgaagacgatggcgctcagtaggtcttagtacggtcgttgcctgtggcaatggcatgccgctgcctaaactccgctgccttatctatttctgcttttggatgtattccggaccgctcggtccgatgatttaagacaatgcctgcgggcttatgatgtaataattagcactagactctcttgtatgtgcttttggtatttcagctatgaactcgtgtgtaccagactacttgatccagggaaatggtactgtttacacgaataattcctgttatgaaaacggggatccacaattttggtgatagatattttaataccaccattatcattgtacaattgtctatcataatctaattagtactccctccgtttcaggttacaagtccgtttcaggttacaagattgacggagcgtggggctcctcaccgggagaccgcgcgggcccccctttgccggttcggccaggggcgctgggtgaggttctaagcccttgatctgtggaatggttcgcgagagagcaaatgcgcaagacacgggcgatgtagataggttcgggccgctgagaagcgtaataccctactcctgtgttctggtggatctgtgtatgaaggagttacaaagagctggagagcaagagagttcaaactctagagaccctctccctactctttttccccagtcccctctacgagctcaggtcttctccagtctttttttccgtcccctctcttggtaggcatggtcctccttttatctctcaaggggataccacatacaccatttctacctacccttcttttgggtggggacccatcctactttgaccaaaacttggctcgtacttttgcctgacaccgggataaccctgtcctccctcattaatgggcggagatttgcaatggctgttgtccgaatgaccctccgatgggatgggtcataccaacctccactccgccggaagcaggtgcaacgtggaagcacggttgtttgccgatgacgcgaccggcgtcagaccagtcacagaccggtcattcttgtccaccacgtgtcagtttagcatgctacacgtctgcccttcttcatacaatgacttccttacaatggttgcgatgaagcctggaatgtatctggccggggctgacgtgccaactccaggagttcccacgccggcttcggctagggacgagtgcctggaggctctcatcattccgacgggacggggcgaggcgtgtgtcaggccgcctgttgccccctaacccgcgatctgaccggtctgtgaccggtcacacactgcgaccgatcacggaccggatgagtgtgctgcgctacattaaatgcggcgtggggcgctcgtccaacccgcaataaacgcggttaggtgagcgccgctgtgctcacctaacccacacacgtggcgccaaaccctcagggggtcggggcgccccagccctcggggacgaaacgggagcggcccgacccctcggggagatagagggaggggcggcctcatcaccctcgggcccaacccccccaagggggtcaggccacgtgggtgaccgcggctgccccaaacctctagtcaagatatccccggtcccatgtcaccgacagtagcccccggcgttatgccagggcgatcgccctcctcgaggaaaacgctcgggtgtgacgccactcctcaggcctggtgacaggtggggccggtctctacaggcggacaggaatccagtggtcgcaaatcgcgcgcatcggcaagggaaaaaccgaccgacaataatgagcggctttcttcaagaccgttacattacttgagtagcgcgcgaattgggacgagccggttcgtttcgcctggagatgtgatgatggtgcatcggtcggcgagcgtagttaacgcgcgcacgatatgtcccatctcgactgccacggccgcacatccgccttgtgcgccgcaaacgggcgagcgggattagtggaggagtgggcgcgagaaacgagggggcgagatagtgggcgcgggaagcgaggagccgggcatagcgtttggcaagggtataaagacgccgaggaagagattcgtttccttcctctcgccattattccccttgccttcgccgcttgcgctctaacttctcgtttcctgtgccctaccctcgccgcactcactcgctctcaaacccctcctccgccggcgttatggcacggggctccgcaccgctcgacggtagcgtgctgccgccttctcgcatcgtgagcgagaggcaggccgggctgccgcgccgatttatgccggaatctgccaccggccgggaggtggtagagctgggcgagggacgcccggcgccacactacccggggcggtccgtcttcttccttcccttcgcaatggcagggctggtcccgccattctcttctttcttcatggatgttttggagctttatgatctccagatggcgcacctcacccccaacgcagtaatgacgttggccatcttcgcgcacctgtgtgagatgttcatcggggtgcgcccatctctccggttgttccggtggttcttcaccgtacagccggtgtcgccaccgtcggtagtcggtggctgctatttccagccgcgggggccggtgttgaaccgctacattccctgcgtccttcgcaagaagtgggatgagtggaagagcgactggttctacacccctctcgccgacgaaacgcgcctccgacttccgagccagcccccggcgcaggcctccagctggcgggcgccggtagatctgggagacggctacgacgctgttcttgaccgcctggctggtttgcgatcccaggggctcacgggggccatggtgttcggcgactaccttcgtcgccggatcgcgccgctccagcggcacgcccggggcgcctgggagtacaccgggcccgaggacatcatgaggacccaccaggggcgcaaatgggactgggaccctgaggacttcaggatagtggtccaacgggtgctgaatctcagctccgtggaggcatccctcatccctcaaggggtccttcccctctgctgcgatccagagcgcgccaacatcctgaccatcatgcaggaggtcggggcgtcgggggagcgggccccccgaggccacgatggcgcgggcgggagccgcaggggggaacaatctaccccgggagggggtcgtgcttctgggccccgtgacgggggcccggggggcagccgccctaccgacgcccgggggaagaggaaacaggaggataccccctccccatctcctccccgagggggcggggcggtgcgtgccagcagcaggcgcctggagggtgctgtgccgacgtcgcagcccgagggggagcgaaaaaagaagcgactccgcaagatgggggggaccgaaccatgccggggaaacctcatctcccccccaaggtggtcgtttagccgacctcctcgcaggttcgtccctgcgcccactgcggccgtattcattctcctatctcccaaggcaagttttcactcacccgtttttcgtcttctggtttttcttctgcatcagcgagatcccgtcgcgcccttcccgccattccaagttcagccggtctgaggccgaggagacggcgaccgcggaggcccggaggcgggaagctgaccggcgagaagccgcaaaccgtctccgggaagccgaggaagctgcccaggaggttgtccgggctcgccaggctgaggaaaccgcttgggaggaggccagactccaccgggccgaggagtccgtccgggagacagaggcggcgcgcgcacgccgggcgggctgccaagcccccgatccgactccgcccgaggcgacgacgacttccgaagccacccacgacgaggccgcgggcgcaccgctcgggcccgacccctcgggcgacgctcaggacgagccagcttcgggggacgtccctgagtccggcacgtcgatcggcgggccgagcagtgcggcatccttaccgaggcggctcttccccatgccttccgctgcaccactgagcgcagagccccttctgcaggccttggccaccgcgaacaccacggtgttggacgggttaagtgcccagatggagatcctgcaggcagagcgggcggagctcgacgcggcgtgggcgcgtgtcgaagaggggcgacgctcggtggaggccatggtggaggcgggccgcaaggcacaccgccggcacgcctcagagctcgaggcccgtcgtagggacctggcggagatcgccagggaggtggaggaggagcgggagactgccctcattgccaccgccgtgtttaacgcgacgcgggacgacctctgcctccaatacgggagccggggggcggagctagagaagaagctcgacgcgtcccggcagcgcgaagaggcccttgaggctcgcgccacggtgctggaggagcgcgcctgcgccctggacacgaaggagagggaactggcgggtcgcgaggccgccgtcgccatccgggaggcaacgctggcggcgcacgaggccgcctgcgccgaagaggagtccgcactccgcctccgcgaggacgcgctcactgagcgggagcgagctctcgaggaggccgaggccgcggcgcagcggctggcggacagcctgtccctccgcgaggcagcgcgggaggagcaggcgcgccgtaatctggaaggcgcccgcgccgagagggccgcactggatcagcgggccgctgagctcgaggcgcgggcgacggcgatctagccgcccgcctcgcagctgccgaacacaccatcgccgatctgcagggcgcgctggactcgtccgccggggaggtcgaggccctccgcttggcgggcgaggtagggcccggcatgcttcgggacgccgtctcccgtctagaccgcgccgggcggcaagcgggcctctggggcgagcggaccgcgaagtacgccgccaaccaggggggcctcgcccagcgcctctcagagatggccgggactctccagcggctccccgaggagctcgaggagacgatcaagtcatcctcgagagacctcgcccggggggcagtggagcttgttctggcaagctaccaggccagggacccggacttctccccgtgggcagcgctggacgagttccctcccggaaccgaggacgacgcgcgcgcgcaggtccgggacgccgccgaccacatcgtccactgcttcgagggtacggcccctcggctcgcgttcgtcctcgactccgacgaggagggcggcgacggtggtatggacgacagcgacgacgaggccggcgacccgggagcctcgaagtgagcccccaggcccccgccaatcttaaatagtttttcctttcttcttccgaggccttcgggcccccttcttgtataaactaattcaatctgcaatcaaataaagaggaaatttttgtgtcagctctgtttgttgtgtgtatgagacgaggatggtttgtgccgcggtccttctgtgtcttggcttgaacgagggctcgtgcccaggtcccagcctcaaatggcgcgggtcggggctagtgcctggggagatccgcgtgtcgagactggccaagccgggaacgtggtgaccgagggttatggattacccgattgtgggcctttgccgattcccccccccagagttcaccacgccccggggcacggctcggttctgggccccgtttggcgattttagccggcccgggccaccgagggcaggatcgagcacgagcgtgctaattcaagccaagattcttcgaaaggaaacaatgacacagacacagtccttaggaaatcgaaaatgcttttattgaaatacggaagagaaaaaatataagcttatgcatgtggtagcccccggccaaccctgcacacccgggggggtgcggggttggcccgagcccgagacctgacacccgacccctactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggttctgctggtagcgcgcggctcggagggccgcgcgccgccttcgctcttcaaagtagtcgaggtcatctctgcgaagctgatcttgatcagcctcacagtacatggtggcccgaggggacctcagggtgagctcggatgggagaaccgcctccgcgccgtagacgaggaagaaaggcgtttccccggttgctcggcttggcgtggttcggttcgcccagagtaccgctggcaactcctcgatccacgagtcgccgtgcttcttgaggatattgaaggttttggttttgaggcccttgaggatttccgcgttggcgcgctccacttggccattgcttctggggtgggcgggggaggcgaagcagagcttgatgcccatgtcttcgcagtagtcaccgaagagttcactagtgaactgggtgccgttatccgtaatgatacggttaggcaccccaaaccgagcagtaatgcccctgatgaatttaagtgcggagtgcttatcgatcttgatgaccggataagcctcgggccacttagtgaacttgtcgatagcgacatacagatactcgaacccgcccggggcccgtctaaacggacccaggatatcgagcccctagacagcaaacggccatgaaagaggtatggtctgcagggcctgggccggctgatgggtttgcttggcgtggaactggcacgccctgcaccgccggaccaggtcgaccgcatcgttgagagccgtcggccaatagaaaccctggcgaaaggccttgccaaccaaggtgcgtgaggcagagtgggctccgcactcgccttcatggatatcggcaagaagctcgacgccttgttcccgaggaatgcacttcaggaggactccgttagtcgcgcgccgatagagggtcccttccaccagcacgtagcgcttggagatgcgctggacgcgttcactcccttcgcggtcctcgggtagagtcttatctgcgaggtacgcctggatctcagcgatccaagcaatcaatctaagggagctgtgagcgcttacctcgggtcccgaggcctggactccgacgggcctcgggggccgttcaggcgcgtccgtctcccctagggggtcgggtcgcgccgatggctgggcaagcctttcttcaaaggcgcccggtggggtctgggctcgcgaggaagtgagccttgagagttcgtcggcgaccgcgttatcccgtctgggcacgtgccgaagctctatcccgtcaaaatggcgctccatacgccgcacctggcgcacgtaagcatccatctgcgggtcagagcactggtactccttggagacctggttaacgaccaactgagagtcgcctaacaccaggaggcggcggatccccagtccagtcgccactctgagtcccgcaaggagtccctcgtactctgccatattgttggttgcccgaaagtcgaggcggaccaggtatttgaggacatctccgctcggcgaggtcaacgtgacccccgcaccggcgccatgaagagacagggagccgtcgaactgcatcacccaataggcggtgtgaggcagctgcgaggggcccgagctggcctcggggacggagatgggctcaggggccggggtccactctgccacaaagtcggcgagggcctggctcttgactgcgtggcgtggttcaaagtgcaaatcgaactcagagagttcgattgcccatttcaccacccgtccagtaccctctcggttatgcaagatttggccgagggggtaagacgtaaccaccgtgacccgatgcgcctgaaaataatggcgcaacttcctcgaagccatcagaatagcgtaaagcatcttctgggcctgagggtatcgggtcttagcgtcccggagggcctcgctaacgaagtagacgggccgctgcacctttcggtggggccgatcttcttcactaggggccgcatctccagggcgctcttcgtccgagaggccgcgcggggcgcactcggcttctgtgccgacgacctcggggtcggagggcgacaggcgcggccttcccgcagtggccccggggccatcctgggggtcgggggcgcctggcaccgtcggacaagcgggcggagggccagctccggccgtcgggggccttaggccaccgttcggctcgggggcctctcctccctgctctctcccgggtcgagtcgacacagggtggggatgcgcggagcgagggtcgtcctcgtcgcgctccacgaccaacgccgtgctgaccacctgcggggttgccgccaggtagagtagcaacggctcatctggctccggggcgaccaggactgggggaaaactgaggtacgccttcacctgagtgagggcccgttcagcctccttcgtccagataaacggcacggagcgtttgaggagcttaaataggggtagcgccttctctcccagcctcgatatgaaccgacttagggcggccatacaaccaatgacgcattgcacatccctaagcttgctgggggggcgcatccgctctatagctcgtatcttctcggggttggcctcaatgcctcgggcagagaccaagaacccgagaagcttgcccgcaggcacgccgaacacgcacttgtcggggttcagctttatgcgggcggtgcggagactttcgaaagtttccgctagatccgagagtaaggtctcctggttgcgtgttttcacaaccaagtcatcaacataggcctcaacattacgtcctatttggctaaccaaagaaattcgagtagtacgttgaaaagtaggacctgcattctttaacccgaaaggcattgtcgtataacaataagttcctatgggggtaatgaatgcagttttttccttatcctccctagccatgcgaatctgatgataaccagagtatgcatctagaaaacacaaaaggtcgcaccccgcggtggagtcgacaatctgatctatgcgtggtagggggtaagggtccttaggacatgccttgttaaggtcggtgtagtcgatgcacatccgaagcttgccgttcgccttgggaacgatgaccgggttcgccagccactccggatggatgacctctcggatgaatccggcctccagaagtcgcgccacctcctcgcggatgaaggcttgacgttccggggcctgccgccgcactttctgccggaccggccttgcgccaggccgtacggcgagacggtgctcaatcacctccctggggaccccgggcatgtccgccggtctccaggcgaagacgtcggcgtttgcccgcaggaaggagacgagcgtgtcttcctatttgtcgtccagaagaccaccgattcgtgtggtcttggacgggccgtcgcccagggcaacctgcttgatcgggacctcgtcgcacgtgatcatccgctgcctcggggcggctgggacggaggtgctgagcctctcgtcgccacccgcgggcttggatgccgcggcgaggtggtccgcgtgctgctccatgcaagcaagcgcgactttgaggtcgccatggacggtgatggggccaccggggcccagcatcttcatctggagataggcgtagtggaccgccaccatgaacttcaccaacgcgggcctccccaggaccgcgttgtagggcagactgaggtccgccacatcgaagttcacccgctccgtgcggaagttggcggaaccgccgaaggtgaccgggaggtcgatatgacctagcggccaagtgtgccccggcgtcacaccgatgatcggctgggacggccggagcaccatccccggggccttgatggcatcaaaggctacgggggaaaggatgttgagggctgcacccccatctatgaggacacgccccaacttcacgttgcaaacggtgcgggaaaccaccatcgcgatctgtcctccccgggcaacgcacggcgggtggtcggtctggtcgaaggtgagggcaacctccgaccaccgcgcccgccgcatcgcctcatgggtaggggccgcggccagaagctctcgcttcatggccttgaggctccgacgagaagcgtgagcgcatgctcccccatcgacggtggcgatggtggccccaggctcctggaaccctaggtcatcgtcgccatcgtcaatatcctcggcgggggccttctgcttggcctcacttcgccggttgccggagggagccgccggggccttgctctcacggcgctcctgcctcctctcctcctcccacttccttgtccgctcagccaaacttttgaccgcacggcagtccgcgaggtcgtggagggaggtgttgtgcacggtgcaccacttgccggtcgggcgctccctactgggagcgccggcctccttctttttgtcgctcgcaggcctcccctttcgggtggcccgcgaagcgccctcgacggcgaggacgtgaccctcgtcgtcggaatgggccgatctcttcttcctcctcctgtcccgtcgccctgaccgagcagcgggcccgggggcggccggagcttccacaccggaaccggaggagttccaggtccatgcctcctccttgcgagccacacggtccgcgagctgaaaaagctccgcagtggtctggggctccttggaggcgatcttctcgagcatgcggttgtgtcgcacgccccccctgaacgcgtagatcaccgcgtgtgcagggatgcacggtatggtgttgcggacttgacaaaaccgctgaatgtacgagcgaagagactcatcgtcccctcgctgtaccgcgtgtaagtccgcttctttacctgggcgcggatatgtgccctggaagttcatggtgaactgctggcacaaatcctcgcaagagtggaccgacgcgggtggcaagttcattagccaaccccgcgcctgtcctttcagggctatggggaagaaattcgccatgaccctgtcgtcacccccggcggcctcgatcccagtcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacacggggggctggcccccgcgcccggaccgaagtggcgctccggacgaggaagcgccctccgatgcgtgggcagcacggcgatcattgcgccggcgctcgatattgaggcgggcatccggcccctcacgcacatcttcttgggtcggaggcattgacaagggaatggcggacgaacggtgggtaacggccgccgctcgccgcgccctccgcctcgacgacacggagccggcagtagcagcgctagtggccttggtggcggaggaccgcccgccggcgcctaggcgctgctgcgccgtcatgaccaagttggccacatcatctagccaacgtcgggttggagtctctggatcagggacgacgggcgggtgacgtaggagcgcgcccgcagcctggagcgcgccctggggcgtgctgccatcgccgtagacgaggaggcgacgctccccgtctcgccgtccttctccatcgctcgtgggcggcgaagtcgcggatctttcgtccccctcgagcgcctcctcccgcctaagacttcggcgagaggggggcggtggagtacgagctcgacgacgcgggttctgctcgctgtcgtcaccgctagcgctcggagagaggttgtgcgccactgcccgttcggccattgggctgagcgggagaagcttggcgcacacgaaagagaacgagggcttagaaaaacacacgcgccccctacctggcgcgccagatgacggagcgtggggctcctcaccgggagaccgcgcgggcccccctttgccggttcggccaggggcgctgggtgaggttctaagcccttgatctgtggaatggttcgcgagagagcaaatgcgcaagacacgggcgatatagacaggttcgggccgctgagaaacgtaataccctactcctgtgttctggtggatctgtgtatgaaggagttacaaagagctggagagcaagagagttcaaactctagagaccctctccctactctttttccccagtcccctctacgagctcaggtcttctccagtctttttttccgtcccctctcttggtaggcatggtcctccttttatctctcaaggggataccacatacaccatttctacctacccttcttttgggtggggacccatcctactttgaccaaaacttggctcgtacttttgcctgacaccgggataaccctgtcctccctcattaatgggcggagatttgcaatggctgttgtccgaatgaccctccgatgggatgggtcataccaacctccactccgccggaagcaggtacaacgtggaagcacggttgtttgccgatgacgcgaccggcgtcagaccagtcacagacc

SEQ ID NO: 72034 - DNA, 972 bp, Oryza sativa
tatcaactagtatcaaatttgaattttaaagcttagttttagagttaatgtggattttttatcatattcttttttaccttagtttttaatttttttataccctagataaagtagactaacaaatatttactcataaattatttttgatgcttgctcgtttttttcctgcactcataacacaactgatcactacttcgggtgcaaagttgtaaactcaactaattaccgtaagagggtcagggtttcaatcatttaggtggacgtccactcatttattgccgttctactatcttactgatggatcggctgtgggaagaggtgctcaattcacaatcagcctttccctttttcagatcagtccgcgtccaccgaagaaatcgcggcaaactcggcaaacttttgacgtttaccggacaggcaaagctaccatcacttcgttgtcgttgctgtatatccacgaccacgtcaaaactgatcccatggcgccaaactgaacaccgtgtcgatctccgacctcgtcgtcgccgcgacaaaaaccgctttgatcatcacctcgtcgtcgacgcacctccaccgcatatgtagcagtagacaagtagcatctgcatctgcgtgccatacacgattgctccagctagctgcacctgcacatcgccatggccatggccgacctggagttggagaaggttgcgagcttcttgctggcggcgctgctgccgctcgtgctcttcaagctggcggcggcgaagcgcggtggtggcgatggcggcatgaggctgccgcctgggccgtggcggctgccggtgatcggcaacctgcaccagatcatggcgggtgggcagctcgtgcaccgcaccatggccggcctggcgagggggctcggcgacgcgccgctgctgtcgctcaggctcggcgaggtccccatcgtcgtggcctcgtcggccgacgccgcgagggagatcatgagcaggc

SEQ ID NO: 72035 - DNA, 667 bp, Oryza sativa
ctgttgattgctcacacgtttgtaaaaacggtagtgtatttcgggacgtcgtatccgatgacattgcatgcttctcggcactctcttgggagaataagggcagcacgggatgtaacctaagcgtctccttgatgacaagcttcaggtactttagatttgtgagatcgtcttcggttaccgttgtcttcccttgtaggttgttccttaactctgcttgtgcctttctcatcacttttgggttcctcattagctctgacataacccactggagcgtatttgctgatgtctcactccctgcattgaagaggtcctgtggaataacaagatgcaacctgaactaatcaatagacattcttagaaaaaaaagaaataacaaacacttctagaaaaatgaaataagaagatgcaacctgaactaatcaatagacattcttagaaaaaaaaaagactagctaacacttctagaaaaatgaaataacaagatgcaacctcaactaagcaatagacattcttaaaaaaaaagactaacaaactcttctataaaaatgaattactcttctgcaaataataatgtagaaatagatgacttccatatgtaatctattttctatatgtaaactaaaacactatgaattaatgtgtgttcttcataaatcagagcagcaga

SEQ ID NO: 72036 - DNA, 10820 bp, Oryza sativa
ttcagtgcattcgtagaactgatttcaatctgaaagaaaaaaaaacaaattcagtagtagatacacgtctgggatgcggagaactgtaaagacgggaagaccgctgcaactatgacgaggaagtggatgacgacggccaggacagatgggaggcaggcaggacgtgcttctatttgcactaattcaatctattagaaataagagaaagaagggggaggaggatgggggtaccgtgggatggatctggcgccatcgctcgcctcctcctcgccgcctagcgccgctgcaccagaccaccgccgctcacctcctcctcaccgccgcacgccgtcgagccctcctcactgctgctgctgccagaggagatctctcgcggtcgctgccgaagcggttggcggccatgaggatgcccccgatggcgccgagcaccccgcacgcgaggagagcggccgcgaaggcgatctccatgacgggcgcgccctgggccctcccacggcgctgccgacaaggtcgtcctcgtcggagatggagaaggagtggtccacgtacgccacgcctggctaccctcgcctcctcctctgcctctgcctgtcggtgccggatccgatctatgaactactcttccccacctcctccttccgcgctcgcagcctcgacggcgccgcctccaccagcgataccgccggcagcgggagaaggaggcctacctccgcgtcgaacagcgcgtactcgccgccaaaccatctccgccggaggttgaggaggaagaggatgcagattcagatggggacttggcggcggctagggttggggattgcttcgtttgattttggatcggctagggttggggaacatgggtatgaagcaacaacggatgcgattttacaagaatagccttggtgcatgtactagcttctgatactatttggacaagatggacatttcacgtcaattttggcttgaccgcgcgcagtggcctgaccgcgatgcaaacctgggcggaaaattttggcgcttgccagtatgtttatttttggcaaaaaaaaaaaaaagatcttgtgctactcgtactttttaattttaattcatgagaacttcaaatttaattttaggctgatttttgtgtttcaaatgcaaaaatcataaataacaaaattgtagaacttatcgaaatctacaactattgtattggtcctttttacaaataagttcatttgaacaattccaattttgaattttcaaaatttgacaacttcgaacaaaaattggggtaaataaatgatttcaaatagaaaagtcaccacaaccaaagatgtagaactcatcaagatgcaaaatttttattttggtcatttctccatctgactctatttgtacaatttgaattttgaaattcaaagtttgagaacttcaaatagaattttttattagtgaatgacttcaactgaaaaactcatcaacaacaaagttgtataatccatctagatctacaatttttattttggtcatttattcatccggcatagtgattttaacattgttaataaattttacatatctccaaatatggtttcataaattataagagagatgtatacattttgtgaacaatgttactatcactttgtcggatgaagaaatgaccaaaataaaagttatagatattaatgagttatacaactttgttgttaatgactttttcagttgaaatcatttactatttgaaaatgttgtttgaagttgtcataatttgaaatttaatttgaaattcaaattcaaattattgaaacaaagtcatatagcaaaatgtccaaaccaaaagttgtacatcttgacaagttatacaattttgttgttgacaatgttttcatttgaaatcatttactacccgaataattattgaattgagaggagggatgtaaaatagacttctcagcgagggaggagcagaaggggccggcggcccgaagagagtggaggagagagaggctgcgggctgagggagggagagagtaatacttgggccgaaaaaggcccaagtacagagagaggaattttaattcgtttttcatttattttaataggttaaataaactttatggtattaaaattagttattgcgctccgaaaatttatggaaaatttcagaaaaaaatttagaccacgtagaatattaaaaaaaattgcggcaatgatttttaaagaaaaattttagtttcctcgttaattcacttgattaaattgtttaaacctttaatatattttttctagtaatgcaatatataaatctatgacgtttgcttcaactataataaattatagaatcctaccgtaacacaccagacaactagcgcagtggtaggatgggttatcttcaacaagaggtcatgggtaatttaccaattcgagttctcttttcatttttgaaacgccaactctcgagtgacattgggacaaataaaaatatttaagtgcacattgggacatctagaacaagtggttcaaatggtaagacacgttcctaccttccagctaagttgtgggtccaaatcccacatgctgcagattttacccatgcgcaccatatttttttagtttgccatattatgcatcatatacatgtaacaaattaacaaaattattttgttcaaatttaacaaatcgtattttgggtttgattcttcttgcaatcacattttttatttttctttgcgctaaatatgttttattttttattgctttgggctaactagagtatgacgaatttaaaatcatacattgtgacagtcttgataaaactgtcacaagttagcgggccgtgaatatccactgggctgatccgtgacgaaaaacaaaaatcgtcacgattacgtttgtcagtgacgatctgtaaatccgtcaccgagaatccgtcatggattaacaagtttcttgtagtgacaatagggccggcccggggggggggtggtcagcccgtgcgcaggcccgaggccccccaaatccaggggcccccatggctaatgggccatggcccacgttaccccatatgcatcgctacttcccaggcctaggatcctttcctattgaagacggaagacgaaacgaagaggagcgaaggaaaagcgaagcgatttgactcccgttcccgtcgcctactcgcctcgatcacgcctcctccatcgcctcgatcacgccgctggccgatcgctcatcgctacagatgctacgtcgctcggtcgctgctggctgctgcctgctggggtgagctctcgcctctcggcttctcgtgtcgcaactcgcaaggagacgaggccatcaggccaaccgcgcaacggcgacgcaccctctgccctcatcggctgatcgacgtctcggcgccacgcctgtaggctatagcctgctgcagtgctgctcgaggtaattttctccatcttttttagtttttttcctcttcatagatcaaaatttattagcactcgcactacttaataattcatgattattttttcaacacaacattaatcatgtcgttgagaaaatatgcatcgggtagcgaaaaaaggaaacagaaaaagcgtttgagatgttcaagcatattagagatgtggattgttatcctaatctctccattgcttatcagaatagttctatttgaagttttaaaatgttatatatagataaatttatcacatcgaatattaaatgttgtgtttttatgagactataaatatatatattagtttatgtgtatatatatataaatgggcctcccctggtccgcatagttctgaaaggactgcagtttttaccacgactccatcaatcctatagctgtggaaaacaaaacgttctggctgaagatacactcccacaatgcagtgacattagggaaaagaggaaattcctagtgcttcccattctaacgatgcacaactgtttgagaccggcagtacagatacggatgcagcatttgtaattccaaagaacttcacaggaaaaatatcatgtggcctttttgccttgaatatttcttacacaaaaaccggtgcctactatttatgccaatatacactagccataaactgcgcagcaagaacccataaaacttcttatgcatagtttagtactacctccatccccgaatatttgcatttcactattaaaattttgtaaaaaaatgttatttctattgagatgggacctaataaattaattagattgatatactaattccctcacccttgttattagtcaagtttgcaagtatgtaatgtgtgcgtgcagtgtggtcatttatatgtggtgctaatctgtatgtaatatcctagaaatgcaattattcttggacatagatagtataatctttcaatttcacacctaataaactataattcaaaccacatctttcaaacagaattaatagcataaaaattttgttccaccaaaaataaagaaacaattaataccaacatatttattttctcaatcttacgcgtcatatttttttccacgataaaataagattcaactttcacatctccacgatgaccttacccgtggcatggccgcccatgctcttctcccacgcctccgccgccttctcgaacggacaccgcgagtcgaccaccgtcctgagcttcccttctccgacgagctccatcagaaacctcatctcctccttccccagcgacatgagggccatcatggttatcttcttcctggcaaacatggtcagcatcgccgcgacgtagttcccggggtttggtgttatgtccaccaccctaccacggctgctcagggtcggcttcatcgccgaccagttgacgttcatggcggtgttgatgatgtagtcgtacttctcgtcggaggccgagctcgtcagggcggcgccttggggggtattgtagtcgaggacctcgtcggcgccgagggagcggacgaggtccatgttgcgggcgccgcaggtggcggtgacgcggtggttgccgagcttggcgagctggacggcgtaggtgccgacgccgccggaggcagcggtgatcagcacgttggcgccggtgccgccggtgccgtcgaatttggtcccgatggacatgagggccttgagagctgtgaggcctgcgaccggcagcccggccgcgtcgacggcggaaactccggcggggcggacgacggtgaggctctccggtgcagcgacatactcagcgaggcctcctcctttctgtattgcaattattattctggtgagaattgatcattttcttgatgagaaggttaagcaataaaattgttacaaactctatttttttaatgtacgacggcgttaacttttttataaaaattagattatttggcttattaaaaaattttgatgataaattaagtcataataaaataaatgattttataaacattagattatttggcttattaaaaaattttgatgataaattaagtcataataaaataaatgataattaaattttttagatataacggatggtcaaacatatctaaaaagttaacgacgtcatgtattaaaaaacggagggagtattaaagaagaaatgcatcagaaaattcaggtgctatacatgagatgaatcatgaacaaactggatgtttgaaattacccagaagttcagtttggacaaaactttgtcaccaactttgagctcatgtactgcagaaccagcctccacaatctccccggcaacatcagtcactgtttcatggagtaaattgagagatgaactaaataatattagattattccattggtgttatatacttcatcaccggtcaaaaactgaattatcttcataactaagagtgtgcattactgaaatagacccgttcatttgcaatcaattgcacataaatatatgtgttgtacgaagagtaccttttgaattagtacttctgtctagtttcataaacaaatggtccttactaatgggtaaacacctggaataaatggaaacttgggaagaaatgggcgtagcatccctttctgaatactccaatcaatcgggttaacgcttgcagcttcgactttaataagaacttcatgtttcttcaccgaaggaacagggatttccacgtgctgaagtgaaactaaactgtatttaaatcaataatagaataaacaaattttacatacacatatggtgtgttcaatattttcttcaaaaaatcattgctagctatatattctcactttgatgaaaatgttcagataagtcatgtcctggaagtgtcgtctatttcttggaagcaactagactcatgaattacagatgaatcggaaaattgtactagaaataaacaaagttcaatataatcgacaaatgcaatttttccaggacaaaacgaaaaagaacatgatcaaattttatgtcagagcagtagtgcagaatatcctacgaactcgatcactcgtagagcattaaatcaggaggaagaagaagatagcaaaccttgagggcaccggcgccgccgccgtagccggtgtactgcaccgcgcgcatggtggccggaatcccgccgccggcggccataatcccgagcaattcctgaatttctcctgttgtctgaacaagtcaatcgatgatgatagatgaatgcagtcatctgggcagtgtgcgttttgtactagattaattcttgtgacttaatgtcaaaataaaataaaattcttgtgacttgggcgtgaagggtttgaccgggatttgattcaataagcatttgaatatatggaagctcatcacccaggcgctgatgtcattgacaagcgtcgtgcatggataatcaaactaagaacatatatataattaattatatatgatcttttgatggtttttgacggctttcctcctctcgtatactattactagctactccctccgtttcgaaatgtttaacaccattgactttttatcatatgtttgaccgttcgtcttattcaaaaaatttaagtaattattaatttttttcctatcatttgattcattgttaaatatatttctatgtaggcatataattttacatatctcacaaaagtttttgaataagacgaacggtcaaacatgtgctaaaaagtcaacggtgtcaaacatttcgaaacggagggagtaggaagcaaatatgtaaaataaacatttgagaccaccgattgtttatgcgtgcaagtatgtcagtataatagaataacaaaatagagatattgtttctcatgtcatttgatagtttagtcctctttgaatagtgtaacaatgcccgtgctgacttgccatgctgacgacgacagacggagggagattttctatttgaaaccacacagtgattaccagtatgataaattaaacaagcatcggaactcggctagtaggctgccaacatatgcattttatttcaaaccggaaaatgcatttttttttttttggtatggatcagctacaaccacagaacctcaatttcagcctacaaacgggaacagtgcaatatccatcaagaatgcacaattcaagcccgatactatcatggagtttccgtttggcagacttattgtaatgtccatcatgtcaactaatcttcttcacgtagccggactactactgcctcagattcaactgctcaaagatttcgcgtctttagaccgcttccattcatagtgccaagtctcagcgcaatgtatcatgttatgtcattgagccacacggtcaaatctgtagacgctgcaattagaatcctaaaaatgcccctcattccaacaagcgccagtatcatttgcgcagcacaagctatttctctttaatatccttccaaaaacactatagtttttaccatggtctcgttaatcctgtagctgtcagataaaaaatgttccggctaagtttcattaacacaactcatggttagaacagaacaggcgaatttcctagtgcttcccattccaactacccacaactgtttgagacgggcgcctgtgcagttgtagacggagcatttgtacttcgttaaaaaaatttcacaacgaaaatatcgtttggccttttttctttgttcaatatcttctcaaatagaaaccagtgcccgctatttatgcaagtagctaggtatctcaggcataaaccgcgcaccaaccagccataaacttcccaggcatagttcagtacaatctatcgatttcacatctagcaaataagtactccgtccgttccaaaatatgaatgagattttggttcaatgtaacacatcatagtatgaatctaagatgtgtcacatctaactcaaatcctttatattttgggatagagggtgtacaaaaaaaacagacaaaaaaatatttttgggacgatctcgttttgttactccattttgggacaaaaattatacattcagaccaaaatataattttctcaatctttcccatcatttttttaggacaaactaatatattactttcacatctccacaatgaccttccgtgttgcatgaccaccggtgctcttctcccacggctccgccgcctcctcgaatggatgccatgagttggccaccatcttgagcttcccttctccggcgagctccatcgtaaatctcatctcctcgtttctcatggacatgcatgttatcttcttattggcaaacatggtcagcacggtcacgatgtagccaggggcgcgggccaaggactttgaacttgtgtattcgaaatgggaaggggtaaaaactttttttagcttaattatacgcctaaaagcctaattattaacttttatagtgtgtcacacactaatcattatataatatatagcgtatataacacaaaaagcataaattcacacaacttattgatagaattgatcatcacttgaaattgtttagcatatagaaatactaatttgtaaacattttaaagtgccaacatatatgaaatacatggaggatagaaaatgataaagtgagaagaaatctcacaattatttaaagatcaacttttcaatacttgatattttgaagcagctctctccaaaaaagactttaaatcaacaacagggcccttcttcctttttcatgtttcagttatgaaaattaaacaagattctatttatactattatgatacaaacaactaagatgagatctctgaattactatgaacaaatcctactatccaaggctcctaatcctagctaactgcccaacaagctaatcaagtttgcaagatagtagctactaactaggaactatgaagtatcaagaatgaattactaagtacaagtacaaactacagttctactccctccatcctataatataagcatttttaactacgaatctggatatatgtctatctagattcatagttagaagttgttatattttaggacggaggtagtaccaactaagcaaaagcaagtagtagtctagtagataccaggtaagtataagtgtagtcagtgaactttagtttgctaaccttaatgactcaacagttcaaatgttcaatccctcctcgattccatggcttgcggctgcttgggacatatgtctgtctagattcatagttagaagttgttatatttagggatggaggtaataccaactaagcaagagcaagtagtagtctagtagataccagataagtataagtgtagaacaaattatgaaatcagtgaactttagtttaatttgctaacctcaatgactcaacagtttaaatgctcaatccttccctgagtccacggcttgcggctgcttgggtgcctccctcctagtggccagaggcacaggcattatgcccacggcactgctggccgttgtcccgcaccagcgccatcgccgactcaccgtcgcgcaactgctccgcccccccgccacaccgtctcgccaagtcacgccccaccaatgcagttgcaccgggcgtctgcactgccgcctccacacaccatgctgctctcgtggcagcaccgccttgatctctcgccgatcgccgctcaccagccaccacccgccaccgctgagatagggttaggtgagggggagtcagttgagaaagggagtcggcagtgagtgagagagagagagagagagaggatgatgaaggaggctcaagaaaagtagtttgattgctttttggttgtttaaggcattttatttattttttatacatatgcgaaagacagagtatatatacctcttttttcaaaaatcgtcagtatatatctgaatacctttgagtcatagtgggcccaccttggatgtagttcccggggtttggggttatctccaccaccctaccatggctggtcagtgtcggcctcatcagtgaccacccgatgttaatggcgaagttgatgatgtagtcgtacttctcaccggaggccgagctcatcaggatggcgtcctcgggggtgttgtagttgaggacgtcatcggcgtcgagatagcatacaagctccatgctgcgggcgccgtaggtggcggtgacacggttgttgccgagcttggtgatctagatggcttatgtgccgatgccgtcggaaaccagatggagaagaaacatcataggaaattcaaacacgatgaccctatcgaggcacgatatttggtaccggagttcagctgtggcctacatctccagggcattgattacgagtgctcctttccgatccaagatattacaacgtatcagtgttacaataacactcgagtagatgccaccagcagccgcaacctcttactatgctaagtcgcctaatatggttacaacaggtccgcgtttctatttaaaatagaacctcatgctcagatttc

SEQ ID NO: 72037 - DNA, 1514 bp, Oryza sativa
tatggtctctatatttataagtgaatatacacaataataaatagaaagataagagatgatctatgtggcgcctccacctcaagatgacgtcaaataaaatgtatttttatggagactttaacaagacaactcaaacagtgctctccgtttgttttttttccttcttcaaatatatatatatatattctcgtgtaataaaaaaatattaatacattcgacttatttttaagcgaactctatttaatagacacttgcccaatcatatatatagccatcataaatacatatatatcttctcgtgtagttaataaaatacttatacactctatattaataaaatattaatacatatttatcttctccctcttcttcactagctagacacctgtccaaccatatagtggtgtattaactatgtgccaatgttctccaagagtccaggttggaagtctctgctgtcactaaccctctccagtgtataaatagccgggtgcatctcctccatggcactcacctcaccacacaccactccaccatcactcacagccaccacccgccgccatggagcaggtctcgtgcttcgccgccgccgccgccgccgtcctcgttgttctctcgctcgctcgcatgctcctcgcgccgcgcagggagtgggacgggctgaacctgccgcccagcccgtcgcggctgccgttcatcggcagcttccacctcctccgccgcagcccgctcgtccaccgcgcgctggccgacgtcgtgcggcagctcggcgcgccgccgctcatgtacatggagatcggtgaggtcccggccatcgtcgtgtcgtgcgccgacgcggcgcgcgagatcatgaagacgcacgacatcaacttcgcgtcgcggccgtggccgccgactgtccagaagctgcgcgcgcaggggaagggcatcttcttcgagccctacggcgcgctgtggcgccagctccgcaagatctgcatcgtcaagctgctcagcgtccgccgcgtcagctcgttccacggcgtccgcgaggaggaggccggccgcctcgtcgccgccgtcgccgcgacgccgccgggacaggccgtgaacctgaccgagcggatcgaggtggtcatcgcggacacgacgatgcgccccatgatcggggagaggttcgagaggcgtgaggacttcctcgagctcctcccggagatcgtcaagatcgcctccgggttcagcctcgacgacctgttcccgtcgtcgtggctcgcctgcgccatcggcggctcgcagcgccgcggcgaggcgagccaccggacatcctacgagctggtggacagcgccttccgccagcggcagcagcaaagggaggccatggccgcgtcgccgcctgacatcgccaaggaggaggaggatgatttgatggatgagctcatcaggatacacaaggaaggtagcctcgaggtgcctcttactgctggcaacttgaaagccgtcatctagtaagtatttttcttactcccctgaatgtt

SEQ ID NO: 72038 - DNA, 553 bp, Oryza sativa
gttcacttcacgtacggcgccgaacattcttccagctacatatattcaaagttgcagcgttgctttgcaggccagggcaggatttagaattaattaggcaatgcaaagttcttagaaaaaagtacgcattcagctggagccgatcgatgaaacgatccatcgatgggattccaacaaagcatatgcacgccggacaaatttgtactgaccttcctatacgggacattgtgtacatgtgttattccaagagtattctcgagcactcttgagtctaatacttgccattttgttttctctgaatacctttacgtctgatgactgacggccagctgcatatatgtacctatacagcatgcacatatcttagttcttcgatctgcaccctctgttctgtttacacacaggaaaaacgctagctacgcaacaattgcaaatatcttggttctttttccaaagactcgcacgagacggtgcgaagttttattgatagagcaggaaaaaattacaagattacaaccctagagggtcgtaaccaggcgaaaggaaaaaaata

SEQ ID NO: 72039 - DNA, 1731 bp, Oryza sativa
ttgtgttaactccactgttcgacagtcttctgtcaatgtaaagccttcattatctaccaactatgtaaaactatctcccaatcttaatgtaattagccagcctactttggccggcccgactaaaaaaagaaagaagagtagaagcaagcctactcattacactattcagaattaagaaacatccatccaatcgagatccagggactaccacatttcaaatgacttctattatgttctataatcgcatgcctcttgacattaccatatgcatattcagttgctgccccagtcagaatctttttaaaaaatgtgaaacccgctcaattacttgaaatcttaagcataaagtttttttttcattaacaacaaacaggataacatttttttccctgtcctaagaggaggtttcaaggaacagctgtctaactgttgtccatttttttccttctctaacatgagatatatgtatctattttgacaaaaatccaacaatgtcagcaaggatataataatacgtcttcaacatatacatataaatgcataaactatattcctgctttcttatgtcaatgaaatggcagagctcctacccattccctcaaaaaaaataaactatattcctgatttgttcatatgaggagagacagacttgcaaatgctttattcatgcttcgatgggtcatggaacatgatatactgatgaaaaactactgtgcaaataagaaaatcttatatggttcatgactcgtatgtaggtagtcattccctcctcaatctatccaatctgggaaatataaggttatcggtatttgttgtaacatctaaggcagtgggcaagacctagccaaacagttcaattttagctctgataagaaataagtagatcaatcatatacttgcaagaaactttccagtcccattatctccatttctgtccacttcaccaactccagcaacaagaatggtcgaaggaaaatcagatgcctttatgattgcatcaatagtctcttgcaaatcagtcaccgcaccaccctagacaacaaaaggaaaaacattgacatcacggaagaaaaaatgattattttaggaaaacatgggtttagcgttatacatactgtgactattaacagaacgaagtacttctgctgattcctggcaagtgattggtgtgctattgcagtagtagtgctaattactggacaaaatagtgttggccagccaatgatacattaatacattatgaagtgcactgatataaactgacataatcccttgtgttccctcgacctaaggaagtttgatatagtcaggcactcggccaataggcaaacagctagcatataacttcaagaagcatttcaaaagcacaaaacactaagtacataatttcttacagaagaaaaggaaatgtgctgtaaatcaaaataagaaggatcagcttcttccaactaggcactagggttgaactcactgcaagaaattcaaatgtacatgaccaaaagggggagttctttttaccttttctgtttctgtggctggtcaatgagaaccagaaatctcaggggtacctgatccccttatttggcatcaaatacaaatcccaaccaaaggtgcggcaagttcaatattagctggtatatctaagcaggcttttatattgcatcttcctgttgtgatgaacacctcgagttgcatcagtatcttaatcgacccccatgcaacagtacaatg

SEQ ID NO: 72040 - DNA, 3724 bp, Oryza sativa
attagttagacacctatttttgatattgagatggtaagagaatctcaggtgccatgatgcagtttggtgctactgcgctaattactataccaacaaacaaaatgaatatatagagcaacttgtatatatgtacactagtaggtcccccatataaaacagcagtggctgcaggtggtagagaagtgttcaataacaagagagatattaggtatgttagcttggtaccatgtatatgtagaaaacaaaacaattacgcatggacagtgcgtgcagcatctagtgttcttggagagtcggtcaaatgatttccttgttaaagtagctatgaatgaggattggaggggatatatatcaataagaaattgcttgcttgcgcttgtgctgggggcttcttggaatgtggggcgttaggaattctacttgcagcatctacagctttggctggcctgcttgatagaatcggctaagccttggcactgcgaatgcaaaggttctaaagatgtgaaagctttgagccgttgaacctgagacagaatgagtcaatgtctgtgaagaatatcagttgatacaaaggagatgacagcaagattattcaacggaacaccacgatattattgggctgcatttttcattcttgttggggtactgtacagtgcttatttgaaggctgaaagtgaggtgctgtaattgtatggctgatccattaaaaagcacatgtttatataggtttggataaacatattgacagcccaattcggtagcttgtttgattcatcctgttggtaatcaacctgtagtttcaaatataaaatctcgcttcgtcactcgtcatcagcttggcaagttggcaggggcattgtcatgctattaatgattatttctgttcgcgtttatcaatacaaagaggactaaaaatctaaaatgttgaatgaacatgaggaataacaacatttctgttttttacccgttcgtacggacaaacgattagtgggcagaaatattcattttacaaatttgcttcctgtaacacgagagcaagcagtcaaacaaataccatcaaaagatatcagtcaattatggatggaggatgcttgttaatgatatcagcgattgggtgagcttccacgcacacaaatgcttattgaatctgaccccggtcaaactaaacccttcacgcccaagtctcaagaattcagtacaaaacgcgtactgcccacttggctccattcatccagctctacggccgagtttagttccaaaatttttcttcaaacttttaactttttcatcacatcaaaactttcctacacacacaaacttctaacttttccgtcgcatcgttctaatttcaactaaaccttcaattttagtgtgaactaaacacacctgttcagccaagaggagaagctagttcagaaaattgctcgggattatggcctcgatcccccggtgggataccggccaccatatgcgagcggttcagtaaagtgcgacaacagcggcggcaccggccagtatattactaactaataggtatagtccgattcttactctatttttatacatagtacaactcaactcctaaattgtaatcgattttgtactttaacacaaactctaacttggcaaatatgccatgccaacttgaatatgttacttgttcgaaccttcgtgtagtaggatttgagttggttctcctgatgttcatgccaagcagcccaaacagtttacgccaggctcgccgccttcatgattgtgcacagcaacactagcatacctaccctccatgacttcacctgcaacttccttatggcttgtacaaacatgagctttcctctcaccatacataatattctttctgtccttcataatattcatggtctacttactacagtctgcctgacacaaccaacatatctcatgtaggcttttaagcaaaattagactactccttattgctggcacacatgtctcacatccgaaagtagcgtcccatttctatcatacatcttgaacaccaaacttgacatcacccgctcaaacaacatgacaactcatgtcatcgcccaagtaaaaaaaaacaaactcacaagataaccacacccattccctagggcactgaattggtcaaaaggccaaccaaggcttagccaatgctattaaaattttacatggaaaccctttttatgttcgagtccacatattgatatacaattgtagtaaccattaaataatattgcaaatgaaccctcaaatcattttaataaaaactgttcaattcataaatgcaccctcaaataacatgtaaagacattcaatatggagagagggaggttaatgtcgatccctcaataaacttcttttataataaagtccttctgcaccccttagggtgtgttcggatgcccctcttccgaaccctctccttcgtttttcgcgcgcacgcttttcaaacggctaaacggtgtaatttttgcaaaaagtttctatacaaaagttgcttaaaaaatcaaattaatccatttttgaaaaaaaaactaatacttaattaatcacgcgctaatagaccgctccgttttccgtgcagaggcactatgttccccacctgagcatgcgaagtttcgcgaccgaccggatttcgcgaaatttcgatgtttcgatgagactcgaaagtagaaaccgtctgagatttcgagaagtttcatccaaaattcaaatttgcattaataaaaaaaagaaaaaaactaaataaaatcttataaatactatgatatttatagaacttgttgggatataaattttcgaaaaaaatgatgtattgtgtgtatttactaaaacttacattaggaaagaaaagaagaaataattaaaaaaaaacacttacatgagccaaaactgaacggaattaaaaaaaggaaaacacttattgatcgaaattttgatgattttgatcggaatttcgccaaaaccgatcggttttcgagaacttgttggcaaacttagggaatttgatttaaattttggtttatgaaatttgttcggaatttaccggttttccaccggatttcacgaaattctgaattccgccagtgcccgaaacggaagggcttgtcggaatcgtaaaccctgatgtgaacacagccttagtgctactctttttcattttcctccctttctaacgctcgcttccacctgtgtcctcagtcctcatgcgccgcctactccctcctcttgatctccaccatctcggccttctcccccaccacgtcctctcccacctctccaccaccaccgtcgtcatgtcctccatctcgccgtctccatcgctgcctccatcctcgtcccatgggatcgatcaggcaacgatgacgcagcttgatctgagatggcgtgtagcagaatcgtcgatctgttgcggggatggggacatgagacgaggcggcggcaactacgcgtcatgaaaaatgtcagcacgccctcctccattcttactacctagcttcctagcctcgcctccacactactggagaaaccatctttgatcggtcggctaaatttcacaatagttctggttcttataaaaattgggattaaaaaacatctttagtcccagtttaaaagctcaggggtactttttgatctttagtcccggttgataacatcaaccgggactaaagatcatttttagtcccgtttcaaaaaacagcaggcagagatctattat

SEQ ID NO: 72041 - DNA, 3325 bp, Oryza sativa
agccataaagcgatgcatctatccgtcagttgatgatgacttttgaacatcatgtgctctagtcttatatgagactttcgttctccttccgttgctatgtcctagcattgttgccttccctcaatcaataactaaatggttaattggacccatgctactatcattttgatggttttaaaaaataccattactattcacctatttgaactcatgccactataattacaccgttattttgatatatgccacaaattaacctttgaacacatatacacattttctaaattttttagaccaaactgtccatcgtcttcctcctcgaccccttctctctcttctgtgttcaccttccctcctcatggacctagcagctcgtccatcagcgattcaatggacggcatactgccgggcccagcagagtgaggtcatcttgctgctgctcctcacagcacctacctgtttgcatgatagcatgagctgagctcccattctcctccacccagcagcgaccatggtcgccctcatcacaattcacaggcttggatccagcggcagcagctgaaaccggtgtcctccccccttcctccagaggccgcgacgaagcactacgcgtcagcgaggagcatgatgaacatgtcggtgggggccacgggacccagggaatcctgcgccggacacgatattgttgttcccatgcgacaggatgggtaactagtatactactcctatgaatcaaataataacaaaattggtatagcttcaaataggtgaatagtaatgtcatatatcataaccataaaagttataattgcatagatccaattgacccataactaaatgactaatattattttaaataagagaaaagagatgaacagtggacaatgatggtcttcaatgaaatggcagtgaaatttcctgtaactaggttaaaccccgtgcgtgttgttgcgggagtttagtatgatagcactaagtaaaagtaaagtgtaagatagctacacaatataaacttacgtaagttgatgtggtttctaattgaggtttacgataatttaaatttaaatagtatatagaatgatgattcaaacataaaagtgagtttttttcgcaaaacataaaagtaaattgatgtggctttctgagagaagaaaaggcgggagatagtttggatcatagattaatcatctaatagctaaaaataattgaggagatatgacttaataagagaagaaaaggatgtaggatcgaaattcaagaactaagccaaccagagggggtgaatggttggtgtacccaaaaaccaaaacttttagcggaattaaaagttaccctcaaatttgacggatcgcggtctgatcgaaagcgatacgctggtctgaccgcctggaagtcgtcggtctgaccgaggtagtaacaccaattgaaccgccgagatcaactccagaagtcgcctgatgccgtcgctggtctgaccgccacttcttcactggtctgaccgccgtcatgtcgcctgtatgaccgctgatgactcatcagttagaccgctgaaccagagaaaacacaaattgaagaagtcacaaagtagatgacaactttattacttctgtctgtatttacaaagtgcaacaatagcactcctcacgaaaatctcgactaaactcaaaaccctagttaactatcaactcaatgctctcaaaagcgataccgggaagcctcacgctccctctctatttatacatgaggtgggcagcctaaagccatgaaccaaacccatactagaagtcctaatccatctaggaaaccttctcatacaataaacaaactttacaaactccaatcataccaaatttggactccttccaaattcgactccgtttcccatacgcacacaataccttcaccgtatgccatatggaatcttcaccaaccacatgcattgaactctagcctaaatatcctgcatgatatctgaccgtcacggacgtggccttatccccaagtcgactcccgatccatcaccgacgatactctcccgaggcatcaagtgaccctacacatggatcgaataaagaaaccatattccgaggccaagctatctccaacttgactcattgttagcaaacaatagtattacatacgcatagtatccatctagaagccataaacacgaaacaatcacggatatccaaacaaacaacccgaaaccgaaaccgacacagagtcggccagtcagaccgcgggctagccggtctgaccgttcgcataactacggtctgaccggccgcaccagcccggtctgactagaccctacaaaacagtaaccctgttcatcacctgaaaaatcaatcatcttcaaaaccacttcaccaataatctccaaatatcaaaaccaataatcacagatgccaattgttcatcacagaataagaatcaaaaacactttgattttacaaaggaggggaataatttggacaatagataatcatctaaggacaagacaattgttgtgatatggcttaatgaaagaagataaagagcacattaactaagttaggagttaggatgaactatataggtacataagatattatgaaaagagatgatgagacatattaaaatattatgtgaattatatgagataatgatttaacatgcttgcatttgaaaagctataaaatttaataagtataaaattatagataacataatatgcttgcatgatgtttaaatgtcctagttgttatagtagatgatgtgacatctttgcatgttaagctttaggatttagtgggttctaactttatagtaatagaggattaacgaaaaatcagactcatgtgtcacctctgttggcgaatacggaggcgaaggcgcgtctcgcctgcctcgcctccaacggaaatgcggccccctgtggtggtggccaacggtggtggtgcctccctccctcccccctctccggcaagatccaggcatctctccaacgtgagaggccaaatcccctattgcggtggtggctggcgatggtcatgatggtagcaagagggacgaccagatttggccccttctagtcatatctggcgcgtcccagttggggtcgggcaaggccaaaactccggtgcgaggtcgttcggcagagcttggaagtccaatgatgccaacggtatggcttcacaactcggtgcagctctgctagtccggctaggtggcagagctggtcgtcaatggtgtctacccggtctttgtgcaggtcgtggtgtgaatagtacaggtaccttcggtgtgcagctagcatttggtggcttctgctggtgctacatgg

SEQ ID NO: 72042 - DNA, 944 bp, Oryza sativa
tccttccccttctccatctccttctccttccccttccccttcccagcttggccgccaccgccaccccctcccttgacctccctcttctccaccacggcggccaccgccgccggcttcttggcggcctcctcgactcgctccggctgcggctccatctccagctgcagcttcgtctcgggctccgggggaggcgtgggcgggggcggggcgagcgccggcgcggcgtggagcttggtgcggcggatgagcgagctgaggtagcggctgcgctgctcgagctcctcggacgccggatccatggcgggcgtgggcgtcggagtcgtcttctgctgctcttccttccagggtgcggggacgcgcgcggggcgtcgtgctcacctgaggcggcggcggcggcgagcgttggtcaccatcgctgcctgcgccgctgcgcggtggtggggggaatggaaatggaagtggccaaatgagaggtcgtggtcaaagcacaggagaagtagtagcgccggttcacgagacgaggcggtgtggggtccgtttcccctggccttttcccgatggtgattggtgacccggcgaatgtggtgagcgagaccggtttgaaactttgaactcctaacgaacgtggtgattcgttgaggccttgaggggattgtcgcagaaatagttacattttgtaactgagagtactccctctatttttcaatagataatattgttgacttttaaataaatatttaatcatttatcttatttaaaaattttgtgtaaatatataagatataattcgaacttaaagtattttaagtgataaaacaactcacaacaaaataaattataattacataattttttagataaaatgaatggtctaacatagaaaaaaagtcaatagtatcatctattagtatgtcattgtgacctgtggagttgtttgggtaccg

SEQ ID NO: 72043 - DNA, 9350 bp, Oryza sativa
caccaaaaattttggcatctctggtgttcttcgttcttctccatatggctaactctgtccccttgattttcttcagcttctacaaagaggagttcgcacaagtggtcggtcccttgcggtggaagcggcggcggcggcggcggcggcagcggtagcgtccctagagacacctcacagatccagcggccgtcctcacggccgatctctccagcgtccagctcttccaccggacctgcaaggaagaagctggtttgtgtcacatatctcctcgcctctttggattttactgatttttctctcgatttttagctgattttctctattggtttttcgccgcgtcggccgccgccactgtactccgggacatggatccggtcgccgttgccgccttccctgcctcccaactgatggccacccgcggatctggcctccgggatgcagatccggccgccaccgcctcttcctccaaggccacccgaccgctggccgctggatccggcctccacgaggtttagagacgtggatccggcgaccaccgcctccatcccccaaccgttggcatccgtggcctcttccccgactcctccaacgccacccgaccgccggcgtccgcggcctccaccgtctccttcacccaccagagccgccgccattttgactcttgcttgattttttgttatcttgcaaatgttcattgccaaattttagattaggccatattctgtgttgtttgtgtggatgtctagtttgttaagatgcagatcattaactgtgtgatgtatattgttactcaagttgtgtgatgttggcttgcatcttgggataaatcttgcatcttttgcttcatgttgagagctggtggctgagggcttttgaattttttttttatgatttttcacacctgtgacgggtgataaattaaacctgtcagtggtatatgtcacctttgacgggctggaaagagtcatccgttacaagtgattctcacctgtgacgggctatttctatgcggccgtcagaggtgttaatcaccattgacgggctttcacccgtcagaggtgaggtgcagttatcagtaaccactaatctctgacgagggccaaacccgtcagaggtgatgatatgggcccgtcaatggtgagaggatccagcgtagtggttgttcaccttattgaaggcattgatattggagcccttattcaattctacatcaagatatttctccggatgaaaaccttaagattcgtttggatcgggtgatgtgttgtcgttccctcggtgtatccttcttgaaggcttcgttttaggagttttttctcttgttggactgttgttattaggttcagtatgccaatgccagggttttcgtcggttttacataaattaaccatgtttacgtaaggtttttgttcggttttccttataaaatgaatcaactcactctggtttttgggtccggttttccatatcctttttgcgcctacaggttgtaggatagtagaaggtcttcccacccccaaacgctagccaattaggtgaggggctccccgggccacttatatatcagtttctttgtccttacacaaccaatgttacatcatgcatttggtggaacaacataaacctgctacccttatttgtggtttaatttatcacgtggctgttccaccaatatcacgttgtcctagctctgccaacgacttcatcttcattatctgtcgttggctgtggaaaccaatggtagcccatctgatctgtcctttcgtcaattctcaagtgatattgttcttactccaatagcttgattggtatgggttcgaggagtgatgtggtgatgggcaaacccatcattcaatttctttaatcaaacagatcatcaagaattaaattgtttaaaaaaatctagatattttttttatattagcatgagcatacttgattttatttaaagaggtgtgccatcacgctagctggttccacacacgtagcctatcgtctgtaaactgcatttcgccatatagctttgtttacctgatacatttcgttcttgatcatgtctgaagacatggtgagctcaccctcgctctggcgccctcctgttcccatcaaagacgcgatcgagcaagatgccatcaccccgttccccaagcctgaggctccagaggaggaggaggaggagtcacaaggcgactgctaccgccgcctcatgtcatccctaccggtgaaggtctacggcgagcgccgttacctcgagtaccaggcgacgtggtggcctgagtccgccgtccaagccgtgatcgccatccaacgccggttccggccgaggccatcggatgtgctcctggcctcctaccccaagtcgggtaccacatggatgaaagcactcgtgttcgcgatcatgtcgcgcaaggtttaccccctgcgggatcacccgctgctgcgtctcaacccgcacgactgcgtggtgcacctgtctggcgcctacgcaacgggcaaggaggcggtggtggaggcgctcccttctccgcggataatggccgtccacatgccattctccaccctcccggcctccgtcgtcgtcgactccagctctggctgcaagatcgtctacgtgtggcgcgaccccaaggacgtgctcgtctccctgtggcactactaccgcaagctacgccccgaggaagcccatgtgtccgagttccacgacctctacgagtcgttctgccagggggacaccgtgtttggcccttggtgggacaatgttcttggctacttcagggccagtgtggagatgcccaccagagtgctcttcttgaggtacgaggacatgctggaggatactgccagcgccgtcgtcgccattgccaacttcgtgggatgcccattctcggcagaagaggagagagccggggttgtcgatgccatcgtcaagctttgcagcttcgaggagctcaagaatctggacaccaatatgtccgggagcaatgggcatctcatcaagctcccaagctcctcctacttcaggaaaggagtcgctggagactgggtgggtcacatgacccgggagatggccgaccgtattgattcaattattcaaggcaagttccaaggttcaggtcttgagattaaacgagcctctacctgatcaatctttttatgtaattatatatcatatatggagtgttgatcattatgcattataatcactactcctatcttccgtcccaaaaataaaaactcaatcctagatttaaacctgaataagaattgagtttttcctgtagggagtgcttgtgatgcttgtcaggacgaacgcagtaataaatatataatagggagtgcttgcgatatttgtcagtacgtatgcagtaataaatattattgatcaggcacagctttctgtacgattgtaaatttatgggaaagtcgatttacgatatgtgaacaacactattagaactaaatttatgtgtaattaaccaacacgctactggtgcagtatgtctatatatagctctccttttatagtttttcgatggttgtatattcttcgagcaagctagtatgtcctttcagatgggcccgccactcagcagattccgaagatagcattcgttttaatcggatgtgattttgcaattcgcagtcgttcgatgtgtaaataattgatagtaattttcttgaagcaaatatatcctgaaaaatatacactactgcacaaacgatttttactccataatttttacaaacggaccataacttgccatgtctgaaaaaatcgagtagtattttcgcgtacagctccttaagagcccgtatggaaaaatcgatttttccatatgggcgtatgcgaaaataaaatttgaaaataaaatttaaaaataaaattttcaaaatttgaaaataaaatttgaaaatttaaaactagtttatctcattcatatacacttcaaattggatgattcttttttctaaatgtttataaaaccatgcttctatcatgttattatgttcttactgctattattttggcattttttcttctgactttgttttataaattgaaattttgaatttcaaaacttcaaataatattttgaagcaataaacaatttccgctgaaaaagtcatgaaaatataagttgtagaactcatttattttggtcattttttcatccgacaaagtgatagtaacagtacacaaaattagcatatctctcttatactttataaaaccaaatttacaatgttacgatcagtttgtagattttttgtagattttgaagagttatataactttgttgttgatgtctttttcagttaaaatcatttagtatttgaaaatattgtctcaagttgttatattttgaaattcaaattcaaattgttcaaacaaagtcatatagaaaaatgaccaaaacaaaagttatagatattgatgcattatacaactactacccgaaaaattatttcaattttttgtattttaaaattcaaattttatatagttcaataatactcggatggagaaataacaaaaaaaaaggatatattcaatgagttctacaactttgtttttgataactttttcatatgagttgatctagtgccataaaatttgatttgaagtttaaagagcggcatgaaaaaaaacgatatttgcatacggacgcttaaggattcctccttccctctccaccagttcaaaatttttcactcccaaccttaccattctatcattcctcaccttgacgaccgagagcagagcggcgcggcacgcgcacttgaagtactaatgcagttggatctagtggttcttggtatctggatgaaccttaaggaagcaaggcagaagacatagggagtggtagaagggaagacatcagaggtggcatgccaactgaattacagagggtttggcatgaggggtcagtgtgctaggctgctagcctgacagagagaagagaggaggatgaattggaaggagctaggccggatactaaagctgtgtttggaatcctgagtttctaacccctctccatcgtattccgtacgcatgcttttcaaaccgtctttttgcaaaaaattttattaatataatagtaatcatatatagtatttttttaaccagcgcagatgaggggtacggattgattgttgtgtaccgatggcatgatcaaatatggtaatagcacatacatttaaatgacagcaaagcttagagccatcgctgaatcttaatctcacatctccacgatgacctttccagtggcatggccgctgaggctcctcgcccatgcgtccgccgccttctcgaacggatgccgcgagtcgaccaccgtcctgagcttcccttcccgcatcagctcgagcagcaaccccaggtcctccttgctcatcttcaggctcaccagcgacagcttcttcctccgggagaacagcgtcaccaccgacgccacgaagttgccgaagttgggggcgacgtcgacgaccctgccatggctgctcaggcgcggcttgaacaccgaccacttgttcttgttactgatgttgacgatgtagtcgtacttcttgccggaggggctcgacagcgcggccccctccggggtcttgtagtcgaggacctcgtcggcgccgaggccagcgacgaggccgaggttgcgcgcgccgcatgtggcggtgacgcggtggttgccgagcttggcgagctggacggcgtacgtgcccacgccgctggaggccgcggtgatcagaacgtcggcgccgccgctggtgcccgagccgtcgaacttggtgccgatggccttgagcgcctggagcgctgtcaggccggcgacgggcacacccgccgcgtcagcggcggagattccggcagggcgagcgacggtgagcttgtccgatgtggccacgtactcagcaaggccccctgctgtctacattgcagatttgcagaaagtaaattggtcaagttatattttttttaacgactcgcactacacagagcgaagttctagtgatatataaaaagagaaaaatataagattacaaccatggaaggttatatataggaagaagaaaaaaatataccatcatccacacactgacaacgccaaacacagacctagtagaaagttagcaccggaccagctgccgctaagtggtatcgaccgccgctaagccagcaacggaaaacatccgagattgcccaaaacccaacccttacaactaatacaaaaccacgctctatccaaatttttgggattcagggagagagggtgagagagaagaatcgaaccgctctccgcctagaccattcgacgtggccaacttgcggaagataggacgccgacataagaggataagaatctagagcgagattgcaccaattgcttgggaggttttgatagaggggtgcctagacgacgtctccaaggagagtagcaacggaagaactgccgccgacgtctgtcaaggtcctaaagagaaccgagactgggcttttaccaggcaaccacactagagggagtgagacggcacgacaacaccctcaggaggggagtggcgctcgaacgccactgttgccagcccggccaaggccgtgctgggttttcacccgccgtagaccccctgttgctcaaaagctgtcctccattgctccaactaccaacccttcaccatcagcgtgtggacatcactgaaccaacgccccgcattggccagccttcacatgcctccacatcagcctcccactctccgctaccggacagccgacaagccgctgccaccacccgccgtgcctccttgcgtcgtactggcttctaccgttgccaaccgcacctccttgtgtcgtgcagatcctcagggccgctgtgccatggcctgcagcctccactgctgccttgttggcctccaccgccgcctgcacgtgccagtcgtgcctcgccggcttccgcctccccttgcatgcgccggccgctcctccccgacctctgtcgccacctagacacgccggccacgcctcgccggtctccatcgccgcttgcacgctcccgtcggcctcctccaccatctggacgaccgcccctaccacgagaagctgccgtctaccactccggtgcccacgcctcctaccctgccgccacttgctgcctccgacgaagacgtgccgtcccacctcatccgtgacggcctgccgccgaaacctcgccaccctgaccgccaccgtcgcccgtcaccgccgccaccactcatccccgccgccagccaccacccggccagatatggccggggtggcgtggatatggacagggctccgccgccgtcgccgccgccaccaccgtcagcccccgccgccaaccaccccctggttagatctggccggactcggccctgatctggcctcctccgccctggacagcctcccccagccgtcgagcgtggggtgggtgagacgaggccccgccgccgccgtccttgcggccgcgtggctttgccagcgcccgctcaggcggcggtgaggcaggaggagtaggaaacggtgggaggaaggtggcagcaaggtgtcgtctctcatgccgcccaggggagggcgacgtgagagagaaagttttggtcaagttatattggcgtccaagctggtgaaaaattcggtgcattttgaatcgaaaaatgatttgctgagacgaatttggagccagatcattggaagtacgtacccagaagtctagtttggagacaactttatcaccaactttgaactcgcgtactgcagagccaacctcaacgatctctccggacacattatttactgctcaaaagaattatacaagagtgagtacatcaatttcatcatcgtttcatggtaagaaaaaaaaaatgatctgaaacgaatgctacctggaataaatggaaatttcgggtgaaaggggcgcatcatccctttctgagtcatcaaatcggattgattgatgcttgcagcttctacttttacgagaacttcgtccttcttcacagaaggaacagggatttccacaaactgaaatcaaattaccccgaaacgtatatggaattcaaataaatcaccacggtaatttgttgaccaattcctctcttagacaaacagggctcttcacatataaattaaacagcacaactcacgcagaaatccaggcagaagttccccattgcgaatatgaaaaagtaagaacttttgaagcagatagaactcaccttaagggcagcggcgccgccgccgtagccactgtactggacggcgcgcatggtcgccggcctctcgccggcggccatgttcttggtgagatcaggtgatgtctgctcacgccgttgtcagaactggtgagctatttgtgagactggaggaagaagaaagctccccactacttcatacaacagctccatttggtagttgagctatctgcgtctgtaaagcttgcgttggtgcacaaagaatttcggaataattatataaattttatagtgatattaaattacacagtctcaaagcatctcctgcttagtgggcgggcaatcattgtaggcaatcagcttttgatgtaccgactagattattaaacatcaccataaccactgatgcttagaccttgcgtgctttaatttcttttcagcaacttgaaatattttatatggaagtcctttaaccataaataatcatgcgccattgatttttttttcatttttcgtgccatcaatgagctaccgccaattaataacctatcccccggattcccccccccccgcatcgcccacgcgctggcgacacggggggcgaaaccctagcggcgccgccgcctttcctctcccccctccccccacctcgccgccggaaagccggcgggcgagccatgatggcggcggcggggcctccttcatggcggtgacccttcccagcgcgcgagaggcggcgaacggcggcagttggggagcaacagcggcggccgatcccggcgaggagacggcagatccggcgtcaccttcgccggatctggccatcccctggccggatccggccggagtgggtgctggtggcggaggaggccgcggcgcggcgacgcgacaagggcggcggcgacggcacggtgtccgcagcggaggcggcagtgacggcgcggggacgcggcagcggtgacggcgtggcatctggtggcggccgccacgatggcgagatgcacgcgggcggcggtgctcgcgccgcccggggtgagcgacggttgcggtgccgccggccctggtggcagcgggccgagcaacaacgtcaacggccgcgcgaggctcgcacacagcggctaccgacagtgctggttgtgatgggcaac

SEQ ID NO: 72044 - DNA, 4587 bp, Oryza sativa
caactccactccagactcaactcctagagttaaatttaggggttggagctgtaccaatcaggccctacttgtacaacttcatatgatctttggggaaacactactgagacaactagccatctactaccgtcgtaaaatatagctatttaggatgggatttgactcatcttagaatatagaatttgaagagacctctgctcagattcgttattataggatgagtcaaatttcattctaaatagcaatattttaatattttagaacgagaacgcggtagcatcccagtatgatgcagcatgtaaccgaaaatgctgccattgatgacaaagacaacctggaagattactgttgcactttgtaactgaactaccgaagctgatggcagcggtagtagaattcttgaattgtctgttcatgatgccctgcaagctaatgcattcagttggagtgattaaagtaggcaataataccatgagtaatgtcattatttgtatcggacaaaaaaaatgtactacctctgttctaaaatctatacataatataactaaaatataaagatagaatcgaatagaaacaaatctgagcacgtctgttcaaatttatcgtattaggacgtgtctaatataataattataataatgtatcttatgttttgggacggataaagtaaattacttgatcagcacactctggtgacatgacagctgtaaagttgactactgaattcagtggaaagaccgtgagcattattgttcacggctgaacacaaatctgtgggccacatcgtgaccttctccggggcccacagaacgcaaccgggcccttctttgggcccaaggaaaaatgggctgctcttttgggcccacgtgggccattttgcctccgttttgggccggccgtgaaatggctagagctgaaattgcaggtgttgatgacgatcgaaagctggatgctaattcaaaaaaaaagaaaagaaaaagaaaagcttggatgctgcacttgtaactgaagctggtgacagcaatagtacaaccttgaattgtctcttctgatctgctgatgcatttctagataatgcatatccagcagatttgggtgattaatccaagtaatgatctcactccactgatagtggaaattgctggcttcagcatcaaaaactgcattgtatgtttgttttttcgttcttttttttggcattgtttcagcttctttatatgaagtacaaattctacactccagcttggccttaaagtgatcgaacacctagcttgcacggccatggcgcccatggcgcaagatgtcgccgagtacctgagcatcttcttggctctcgtcgtggcccctctcctgctgctcagggtggcgaggcgggcgcgcggcaatggcgccggccggccgaggcttccgccggggccgtggcggctgccggtcatcgggagcctgcaccacctgatgggcaagccccacgtgcaccgcgccatggccgacctcgcgcgccggcacggcgcgccgctcatgtacctcaggctcggcgaggtccctttcgtggtggcctcgtcgcccgacgccgcgcgcgaggtcctcagggcgcaggacgccaacttcgcgtcgcggccgtggagccccaccctgcgcgtcatgatggccgacggcgagggcctcgcgttcgcgcgccacggcgcgcactggcgcctgcgcaagatctgcgtcctcgagctgctcggcccgcggcgcgtgcggtcgttccgccgcgtcagggaggaggaggtggcgcgcctcctcgccgccgtcgccgccgcggccgcggccggggccgacgccgtcgtgaacgtgagcgagcgcgccgccgtgctggtcacggacacgacgtgcgcgccatgatcggcgacaggttcgagatgcgggacgagtacctggagggcgtggccgaggtggggaagctcctgctcgggctcagcctcggcgacctgttcccgtcgtcgaggctggccagcctcgtcagcggcacggcgcgccgcgccgcagcgagccaccggaagatgttcgagctcatggactgcgccatcaggcatcaccaggagaggaaggccgccatggacgccgacgaggacatcttggacgtgctgcttcggatacagaaggaaggaggtcacgatgccccgctcaccatgggagatgtcaaggacaccatacttgtaagcaccatggtttctctcttcactctacttattaattaattgtctttcatttcatcattgtgatacttcattgttactgctacatatatgtaatgttgattaatttatctgacatctcttattaggatctttttgctgctgggacggagacatcaacagcaacactccaatgggctatgtccgaggtggtgaggaacccaagaataatgcaaaaggcacaagccgagctacgtaacaagcttcaagggaagccaagtgtgaccgaagatgacctagttggcctaacctacttaaagctcgtcatcaaggaaaccctaagactgcaccccgccgcaccaatgcttgtcccaagggagtgtggggagtcgtgcaaggtgctagggtacgacgtgcccaggggcactaacgtgctcatcaacgcgtgggcgattggcagagaccccaattactgggatgacacggagacgttcaaaccagataggtgtgagaataacaagtataactttagaggcaccgatttcgagtacataccgtttggatctagacgaaagatctgccctggtccggcgttcacacatgccatcttggagctcgcgctcgccgctttgctgtaccactttgactgggagctcccctgcggagttgctccaggggaggtggatatggccgaggagacaggcgtcgtcgttcgcccgaagaacgacctctacctgcgtccggtcgtccgtgtgccgccgggagctgcctcgagcggcaatggtggcacctagccgtgcaccgcatctactacctagccttaattatgtgaaaatgtaacctggttggatcgaatggattaagtgctaaataaaatggtttatgtgttcatgtttgtttgtgttcgtcacatgtcacatgcataagagagagaatcagactatcagagaaggcgaggtccagaagcaggatcaatgttatgcaccttgcaatgtcgatagcaattggcattagtcctaaactgctcagtcatcgtgcaggatattggtgcaggtatcccatagagtcatactctggttctgtaatcaccaggcattcagaaatcaaaaccgtgaaaactaaagacaggcatattcatgctccacataattctccaagaagaaatttggataaaaatattgatataaatttttaaaagtacggaacaatggaaactttcatctgataagcattcttttatcggaataaatatatcagtggatacgtacgatacaatgaacagatcctctcatgctttgtataaattgtattacatgctactacaatacagtgaacaggtcctttcatactttgaattacatgctacaatacatctcaccatactttacatacaatcaatggtctgagagaagggtcaagcactcaagcttcctggtgcacacattaatctacacctcaattgatgcttcaccgttgcttgcctttctccattttgaggatcgttgcttgtttatgatttggacgtaagggtgaatagtctaagtgtctaaccacaccatgagcaataggtcaaccccttgcatcatatgatatcttggtatgattgagtataagactatgagagggaatattgccctcaagatctgttaaaagacatcaggagggaaacgcccaggcatagaattgttctgctgagcttgcttcagatgcactctaagtgcataattatttatctgcaatgttaaatatacttatgtaagaacaatcaaaatcaccgggagtagtgttcgggacaaaagaatcaccaggagtaaggagtagtacctcaagagtttttatctgttcctgatactgcaaaaccagttgtttcaggctatgaacctcctgagtcctctcgtcaaactctttttgacgttcatgttggatagcaaccgccctcttcagaacagcgttctctctcagatatattgccagttgctccttcagcatcacattttcctgcaggaaagcaaagcataactgcttaatttgcctaggagtacaagtactatggatgaaacgtgcatatgctgttggttgcaccttgtgcaaattatgcactgcttcagttcctgctcgctccattatggatttctccaatgcctccagggctcttgaggcacgagcccgcgcatcatctatgtctgatgcactcatcatctctctaacaaatagctcaacccactcagaaccatgatgatttgtctgaaagttttctgtagcatgtgggtttcagtgagcacatccaaatgtccattattaacaacacctgtccaagattgcaagctgacatttagcaggcattttttggagaaatttattcacgaaagaggcatagttcatgaagacatggcaaacataagttggcaat

SEQ ID NO: 72045 - DNA, 2385 bp, Oryza sativa
taagcctttaactacagcaccgtcagccatggagaaattacctgcaattcagcggtaggcctcgcaccacgcgctcgctcacacgatactgcatgcattacattatactccctccatttcagattataaaatattttgactttagttaaagttaaactgtttcaagtttgactaagtttatagacaaatataatgatatttataataataaattagtttcatcgaatcaataattgaatatattttcataataaacttgtcttgattgaaaatgttactatctttttctacaaacttggtcaaaattaaaacattttgattttgaccaaagttaaaacgtcttgtaaccttaaacagagggaatagtattctcttcctaaaactcaacctaaatactccctccgtttcgttttatttgacaccgttgactttttagcacatgtttgacctctcgtctaattcaaaaaaattaaataattattaattcttttcctatcatttgatttgttgttaaatatacttttatatatacatatagttttacatatttcacaaaagtttttgaataagacgaatagtcaaatatatttaaaaaagtcaacggcatcaaatatttagggacagatggagtaatattattgttgagcggtgttcgcctggtatgtgggcgcaggagttgcaaaccagcatcagtgtgtcacttaccttgtttgccgttgagcaaaatttgctaagatgaaaatcatatctgaaaaacccgtaattagctaccaaaatcttcagctcaatttccatttgtattatacagcatcaggatatattatgccggcggcggctagatgatgtctacaccgtagggttgcatgtgccggccgcaaccacccacaggttttatctgatgcggtgaaggtcagtgtgaggcaggcgccattgcaccgaccgaaacacacgaacagcgacaacagcaaacagatactagagcaaagcccccacaaatttaactagattggatatttagttatgctgtgtgttcaccaacaagcgcgggccgagcgacagagacatatgctatcctccaacagtagcatagctatgtactcgctccatttcagtttaaaagaggtttttgacttggctcacaatcaaactactttaagtttaactaaatttatagcaaaaagtagtaacattttaaacccaagataaatttattataaaaatatattcaattattgatttgatgaaactaagttagtatcgtaaatattactatatttatctataaacttagccaaacttaaaacagtttgactttgactaaagttaaaacgtcttataacctgaaacgaagagagtatttttaaaaccacaggaggggaaaagagaagattgagaaaatacgcaaaatgaggtgagccattagcacatgattaattgagtattaattattttaaactttaaaaataggttaataagattttttaaagcaaaattcattttttttaaaaaaacacaccgtttagtagttcaggaaacgtgtgtgcggaaaacgaaacaaactctctctctccggctgccgaaggcagcctaacaagtttgaatgtttattatccattttcagtttttttttaaacattaaggttttactacaccagcgaataatctttttataggtcgtataaattgataacctcatacataagtggatttgcgggttagccacttatgttcatcagtgaataatctttttatacatcgaataaattgataatccgatatataagtgaatttgtgggttagtcgttgggtgagccaccacccggctctgccactataaaatctcccgaggaagatgacgaggagtcagtcaacagttgactagctgttcgattcggccatggccaccgagctcactgagtacttgctgctcctgccgcttctcgtcgtaccgctcctctacctcgcggcgtcgtcgtcgcggaggtcggggaggctgcggctgccgccggggccgtgggcgctgccggtgatcggccacctgcaccacctcgccctcgccggcgcgcccacgcaccgcgccatgcgcgacatggcgcggcgccacggcccgctcatgctgctccgcttctgcgagctccccgtggtggtggcctcctcgccggacgccgcccgcgagatcatgaggacgcacgacgtcgcgttcgcgtcgcggccgatcgggccgatgctgcggctcgtgttccagggcgccgagggcgtgatcttcgcgccctacggcgacgggtggaggcagctccgcaagatctgcaccgtcgagcttctcagccaccgccgcgtccactccttccgccccgtccgcgcggacgagctcggccgcctcctccg

SEQ ID NO: 72046 - DNA, 11603 bp, Oryza sativa
caactctagtacattttgtgagagagctccacctaactctactcccaattttagtggagctgaaactgtttggctgagctccagctccaggagaggtggagctggagctggagctgtgccaaacaggcccgtagtatatcacaatgtgaactatatagtaggagcataatttatctcaaattatcaatcaaagattcatctgcgaacatgtttttcttagataatggaaggaacaatattcctttatctcaatgttccataacatatttgtgtgcgaaaaaacaactacatactagggtgtcgtcgcatggagtggcacacgaacgacggcatgtaggtataggtcattcttcctcctaacagtgatgcccatctcctcggtcatatctagctcacttggcttcaccccagcagggaggctccaatcgaagtggtagagaagggtggcgagcgcgagttctatgttcggctgcgcgaacattataccaggacacattctccgtccagacccaaatggcaagaactcaaagtccaaacccttaaagtcaatcttgctatcctcaaatcgctcaggcttgaactcttcggggtcatcccaatacttaggatctctaccaattgcccaagcgttaacaagcacagtggtaccttttggcacatcatatccaaagatcttgcatgactccctcgactccctaggaaggagcaaaggcgctggcagatgcaacctcagcgtctctttgataatgagctttaggtaatttaggtcggtcaagtcttcctcggtcacctttggcttcccttggagattgtcgcgtaactcagcttgcgctctcttcatcactcttgggttcctcatgagctccgacatggcccattggattgtagtcgctgatgtctcacttccggcgctaaaaaggtcctatgaaatttcaaaattattaacttaaattgaacatgccagaaattaaatgaattagaacgtacgaaaaggatttggaaagaaaattagaaaaaaacatttggttggaatttggaaatgatgttgtgcttgcttacaaggattactgctttgatgatccccatggtgagaggcacgtcgaggccacctcccttctgaatcctcaagaggacgtccaccagatcgtcgtcttccacgacgtcgccgctcgccgccgctgccgccgcgcgccgctcctggtgctgctcgatggcgcggtccatgagctcgaagttcttgcggtggttctcctgcgcccgccgcgccgcgccggtgacgaagctggcgagccacgacgacgggaacaggtcggcgaggctgaacccggagacgagcttgagcccctcggcgagggcctccaagaactcgtcccgcttcttgaacctgtccccgatcatggcgcgcaccgccgagtcggcgatgagcacggcgatccgctcgctgacgttgacggccgcctcgccgtggggcgccgccgccgcgacggcggcggcgaggcgcgcggcctcctcctccctgacgcggcggaacgactggacgcggcgcgcggagaggagctccaggatggcgatgcggcggagctgtcgccacagcgcgccgtagggcgcgaacacgaggccctccccgtcggccgtcatgatcctcacggtggggctcaccggccgcgtcgcgaacgcgacgtcgtgcgtccgcatcacctcgcgcgcggcgcccggcgacgtggccaccaccacggggacctcgccgagccggaggtacatgagcggcgcgtccatccgccgcgcgaggtccgccagcgcgcggtgcaccagcggcttcccggcgaggtggtgcaggctgccgatcaccggcagccgccacggccccggcggcagcctgacgccatcgctgccgccgccgcgcgtcctcgtgacccggacgagcaccagcacggccacggcgagggcgaggtagtggtagtaaccgtagcagctggttggttcttccatctcttcgctttgcttcgctgactatacgcagccaaagcagtatatttatacactacctgcgtatgtatacagctgtatgtatttatatctataccatagatagagatatggtatttctattcatatcttaattaccttatatctaacatctatattcatagcactctgaggaagcttctacactaacttggaaaaaatctgaccattaatttagcagatcacattgttatgatacagattgagaatacatttacactaaattaattagacactataaaagagttctttacattaactaaaaaaatctcactattaattgagcggatcttattattatgatactaccaagaatcgttgtgtactaactagggacttcgagagagcttctacattaaaaaaagatttcatcgttagttaaaacaaattgttcttaagtctattttctcaacttcacctctcttctttttcacgcacattctttccaaactactaaataaaaatttctatagtaaaattgttttaaaaattataagaatccattctaaatccttttctaatagttaatcaattatatgctaatacgtgcttcattttacgtgttggagaggagatgtcccctctcctcccgaacacattctaatgatctttactttaagtatgagggagttgctatatctctactacttaaatcatccttctccacctccacctccacctctacgtaaaaacctactaccataaaaaccatccatctaaaaagcagacttcttaaaaaaaaagctaaataaccccactaagtctaaattctctcggtaaatttaataaaaaatcgttgaaatgcatgagcctataactactactccctctatttcagattataagatgttttaaagtcaaaatgtttcaagtttaaccaattttatagaaaaaaatagtaatatttttcgacccaagataaatttattataaaactatatttaattattaatttaataaaactaatttggtaatgtaaatattactatatttgtctataaaatgagtaaaacttgaagtagtttgactttgaccaaagccaaaacatcttataacctaaaatggagagagtactaattaactaaattctgatcatctattaggcgaaacatgttactctctccatattttaatgtatgacgccgttgacttttcgactaacgtttgaccattcgttttattcaaaatttttgtacgaatataaaaatatttaaatcatgcttaaagaacatttgatgataaatcaagtcacattaaaataaataataattacatattttttttttgaataagacgaatggtcaaacgttacataaaaagtcaatgttgtcatacattaaaatacggatgtagtatttcgatatagattttattgagaattcatattaaataaagaatgaagttgaaaatagtttaattaggctcttttttttgaactcaaaattaattattacaaatataaggctgtactatatttgcactaccaacttattacattaccattttatcctaaaataaaaaaaacaaaatattaattttctttagtgggagatatagtttttcattccacacacccctctcgttccttacctgccatcttaaactacgtatatatatagccggcagggcaggtccctaattaaggagtagtacaaacttagtcattgttaatctcgacggaggacaagatccttcctgtagcatagagtagcaacgcacgcgcgtacagccaaaaccggccggccgccaggtcgccgtccacacgtcctcgcgtcgccggccggccggttgctggtcgggtggctgtcgatcgatgcatcgatctagccgtaaactgcccaatgcgtcgcatgtactccccctctttaaaaaaaaaaaaaaacaaaccctaggtgttttcgtgtccaactttgattgtccgtcttatataattttttttataattcgtatttttattgttgttagatgataaaacacgattaatattttatgcgtgacttgtctttttaatttttttcataatttttcaaataagacgaacggttaaaagttggacacggaaaccagggtttgtcttttttttttttttgacggagggagtagatgcacgcgtcgcatcatatccgccgcggtagcgtgcgatgcctccaacctgcacacgtcccgtacgtctcgatctgcatctacctgattcttcggatgattctctacagtagttcagaacaattcttgtaacgatgaggaatatggtaagagcctgaggtgagactggagtcggaggggttaggagtaaagacgaaaagaagattgagcaggaagtgattgatcagacggtgcgcaaacgcagaaactttctgtactatatattggttgtgttgtctctatttgtttatgtggctacaactagatatggtggaagagatgtcctttaaatatttttaaaaagaaattataaatttgttagagattaaaaacgatacattggggttgaaaccatacgtcctttactattgtgctatcaattacatctctttattttttagctgttgcttgtaatttcatctggttttgcactgtcatgtatcaatctaattgggcatacaatctattatatattaaaagtccatcaaacattttcaggaatgctcttaaatcatcacattatgctaataaattagagaaaatcttaagaattttaagaaaaaaaaattcaaccgttaattttcacttagggctcattcgaaaggtagaattggaaaaaaaagtaggaacaaaaaatacatataaatgggataagattgtttgtgtaaaatagatgattgaaaatcataaaaaagtgatgttcggaacaaaggaattgctaataagcataaaaatctttctaagcaatcacattagttgcttgcattgttctcaaattataaatcgttagattagattgatcctaagaatagaacgcccaactaaacccagctacagatcggttggctgtgcacggctgcgatggaggcctggagaaggcgcccgatcgaggcacggaagagactccgggatactatcactctctccgtttctataatataagagattttggataaatgtaacacatcttagtacaatgaatctaaatatacggtacgtctaaatttattgtattagaatgtgtgacatccatctaaaatactttatattatgggatggggaatagtagctagctgtacgttgcctatatgcaaatccaaagactcgtccttccagtgaaacatgccactctatacatcaactgccctacagctttgcaaagtgcatgcaaacagtgtcctacagcttaatttgcgaagcgtaagaacagtcagcgacgatcatctggcctgccatacaaagctcgatcacccgtaaaccacggcctaatataaccacatcctggtaaaacaaaccacacaaacacaatgatcgatgaacaatgcgggcacatgatctcacctaacaactactgagattaaaaacgaataaattgatgaggaatagatatctaaggctcatgttgactacggtttttttttaaaaaaacattatagatcacatatatcatacaaaatgaggtctagaatatgtatatctcctccatctttactgattggtatgaaagtatacgacaaaccgcgtcaatgtaaaccaatttgaaggaaactagtttgattatacaaataaaatatatttattagcaacagtagtaaatccgtatatgtggattagtaaggacggtgaagacgtacatgggaaaaaattgtatggcaccccatgccacaaagcatgcatggcacctctatcaagatcttgtcacctagcgtgcacaaatcttgaagcactgatctaccttcaaaaccatactagggcaaaaactaattaacagactatcactaatctcgcgcgcgcggaaggatggcggcggcgatgcgcgtgacggcgatgcacgtgcaggaaacggacggcggcggtgacgacacgatgacgtgcgtgcaagaaagggcggccgccgccggcaacggcgacgcggacgcacgcagcaacacggcggaaatcgacggagctagcgctgcccagattgatcgcgcggcagaggtgcgtgggctgatcggtcataactcgaggtcaaacttcgctgacgatgccatgaaagacccaagccatgcacatcatcggttcagttcagatgatgagaatcttgaagattgcatgaatgaagaaaatgattcaggcctggtttagttctcaactttttcttcaaacttttaacttttccatcatatcgaaatttttctacacacataaacttttaacttttctatcacatcgttccaatttcaatcaaacttttaattttggtgtgaactaagcacaccctcagtgtgtgagtaattttgattgatgtactttgttgtgctcagtagatacggaatgcatacaaatttgtgtgcactgtacgtgcacgcgaccgccggaatccttccgcgcgcgagattagcgatagccagttaattagtttcatgcggttttgaaggtagaagtgctccaagatttgtgcacgccaggtgacagaatctcaataggtgtgccatacaatttttttttccgacgtacatatcctactagtctatcttctttttatatgatgacacagattttagataattaattgtttcttgaaatttactaaataatatactgcatagagctaacaaatagactgagaaaaaaatatctaaacctttataagtttcttaagtacatggcctatgttgtatgcctgcgtatttgtagggactacctttctagtttagtctaaaaattttgaacggttttttgaaagtagagatgaactccgaatctccgatggaaacaaatgcaaaccacgtgaaagttgacatgtcaagctgggaacatatcctatacacacaagtttctcgtgcacaatttaataatattattgaaaatatgtgtttaatttttctagaattttctgtgaaatttactagttggtgtgcacgagaagcttgtgtgcataggatatgttcccgtcaagctggtcagtcatttatgattctgagacccggtttgaaccaaacgaagtccttatactgaagcaattgactttgttgttctgagacccggttatgattctatttctacccatcgtattgtttcgtttgttgtgaaaggtaatttactcattaaagaaactgatagaatcataacgactagttcagtagttcgctttggatttaagcttctgaagtgctcgacagcttaccaacctcgacgccatggccatggtgaaacctgcactcgccgacgattatcgggtgaaagaaatctctgagcttgaaagaagagatgcggttcggttgggtcggtgattcttcaccgaccccaagaggcatttgggccgtatatgccacagcaattgggccgtcgcccaccggcccaccccatcaaaacagtactcggagaccgaaccgcagcaccaacatataacacactaataaatgggattttttttccatccttcgaagtacagtaacatataatgcggtagtggtaaaaggtaaagaacaatagcgattgcagaattggatgaacagattagttcatgaaaggtggaagcggaacgaccttggatcggagttgggacaggataattaactgacagcgaatctgcagttggacagtaaacaagtcttcagaatgatttgatttctgtctgtttctaccaaagagtttctgatgaatgagtagtcaattaacttaactacttttaattaaccatcatctgaagccatgagggtagctagctcagattctttactggacaattatgtaatgtattgctctctcgtttccttcttgattaatgatcaatcagttcatctcctctcttgaaatcggcctgtgctctcctgatgctccatgccattgttgaaggcgaacattcaggccctgccgccgccgctgccgaagctctccaccgccgacgaacggtcgatctgcaggcacgccggcgagtcaggtttcagagtagactgttcatttcacttcctacaagtgtttgtgttcatcgtgcagatgcagaatcactgattcatcactcaccagagttctcaaggagattctttttctcatttgcaaaggtcatattcaaagaagcctccatatatgctggtgtgtgtacagtcctggtctcaagtctcaacgatgatctgcacaaataaaaaaaggatgaacaatgttagacaattatactgtcacttttcacatttcagatatcttccttcttttatcagtgtttactgtcaaaggttagattgctacaaataacaccatttcacttttatcagtgcaatggaaatagggagttctcaagcatcaagaaaccggcgtgccatattagctacagtttctgtataaaaacgcatgaatactttgttgaggtaaaacgtaaaagtcgtttttaagtaagcatgtttcacaaaatggtgcactaagcactagtctgagttttgaactgctatttggtggtggctactttctcctgctccgttagtatgttttccaattgctactcccttgctaaatggtgcgttacgtacacaagttttactatatagaagttttttttttgaaaaaaatgaaataattgtactcaattaatcatgtctaatagtttgtcttgttttacacgttgccaaaaatcctagctgaatatctggttcgaactcagcgactgttctcatctaggacactatggaacaggtgaatcataaaacacaagaataagaaaaactaattagtttcatatatatgaatgcacctaaaaaacagagaagtgtaatatatatggaaaaaaatataggagtgatcgttaaaatcagaatacacacagaagtcaatgattttctagaatcaaattgccgccaatattagaagctatagtaaaattgctcatagtaaaagagacgtctgttgcctacgtcaagacagagtgattaatccacgtaatgaccttcttgttgccttgcattgacttactgccagagagattggaaaaaaatgcccccaagtgttatcagattattgtatgttgcgtaacacaaagaaactgagatgtacttgacagtgcaaggacaaaagatatgaggtttaagtgttatcaaattattgtatgttgcgtaacacaaagacactaagatatacttgatagtgcaagggacaaaacatgtgaggttttaaccttgtgatccattttcaaacctcaacaccctcacaattttcttttaaaaaaaaaactaccgctaacaaaaatactaggtgctgattggaacgcgcgtgctaccaaatagcctataattagttatatcaacaaaacaccgtaatggcctgacataattgataacgacaacggcgaagttatgaacgtactcacggtgaaaattggccaatttctggttaaattaattagtgcccgttggagagccgtccaaatcgcgctgacacttcccttttgtaattatccgcagtactatatgactagacaaaatctgctgccgatctatgctcctttaaagaatggaatggcttgtcaccagcatcaactccccaaaattctgacatgtgagactattgtccattccctcttaaaattaaatgtacggtaaaaacagaattaattgaaacaaatcaaaattgtttattgttggcgaggagaagcagaggagtggatggatggtgcggatcgatactcgatcataagctcgttgcggtcacaggctcgtctcggtagacgtcgctacgctacggcaccgctaatctcgactccgtgctattaagttaatcacatcgctaatctcaggagttgggtggggcccctataatcagaggcacggtccgacaaaaccgacatgccaagagcaagtataatagtaagctataagcctactataaacttatgtagaggagagaagtaaataaaagagaaagatgttggttctcatgtaagagctggcttaacacaagctccaaaacaacattaaatgtataagtgagagatagagatagaagaagaaaatcatagctaaccttatagttaatctattatatgtgttaactttagtataggctaatagtaggaaatgtgctatattattatccttgctctaaaacaacgaatctaaacaagtattgactatttagattgttgtttcaagaggatgtttgggagggaggacaccccctaaaattttataggtagtaatattttggatgaagttagtattctgcaggcacacctatatactcctgtcaagtcaacaccaagtagtcgaagctctcacgagttgccatgaaaaaaaagaagataatactcgaacaaccctcaccatgtgccattccaggtgacagcatggggcacatatttcgaacatcaggtatggcaccttaaataatactatctttatattttaatatatgacgccgttgactttttatttaatgtttgaccattcgtcttattcatcgtcaaatgttttttaagcacggcataaatattttcatatttgcacaaaaaaatttgaataaaataaatagtcaaacgttgattaaaaagtcaacgacgtcatacattaaaatacggatggagtaaaaatattagttcaacagtttcccttttgtcttgcaccgaaaaatagggagtagatttaacttaaaaaataggtagtttcccttttgtctcgagaacggtgatcgatatcccatcaatatatcagaattgttttctcaagaaatatattgctaaaaagaaaacttaatctgctcctactgaggcacaactacaagtctacaacttcaaatgggggtaatgcattgtggatggcaaggattggtttattaatttacacaaagttaagttttattttctttacaaaagaacttaattgatgttagagctataatagaaatagactgttttgaataaattaactgtcttatctatctgaataaattaaacaccttgtctactcgtccaatgtttgtcataattttttatttttcctgttgcaacgcacggtcacctctgacagattaacaataccaatttattcctagtaaaatcctaaataaaatatttttaaagcacataaaaatcaactagtagatatatatttgtaccattataataccaccaataatagaaggggtcgtagatgcaccccctacataaatagtagtaagacgtagtactgattaattcaagtaatgatattttcttctttgactataccagatattagagcttaatcagatgttgcgtgtgtttgggaaacacaacaatatatgaacttgaaaccttgataccgctgacattttttttgtgttcattgcaacacgtgtatgcatggtaagcacagcaatatactaattccccgagatagctgataacaactgcaaagttgacaattgaactcactgcgaaaattggcaattcaattttctagctgaaatagcgcctgcgttgcaggttggag

SEQ ID NO: 72047 - DNA, 1100 bp, Oryza sativa
tgagacaaaatgtggatacccacgatactatcatggtaatgtacaacaccaccagaagagtcaagtgaaatgcagcacaagtagcatgaagtatttcctgcatgcaacaaaggctaacatggtaacaacccataaggccgcatctagcagtattttaccaacggcagttaacacaatcttcatgccaaggccagagtgcacagagttgacactccccccagtcaaaccagcagtgctatacaatgtaactgtggtagaaatgtttattaaaggcgcagtatgctgtgcaaaatatttactccctccgtcccaaaaaaagacaaaccctgagtttccatgtccaacgtttgaccgtccgtcttatttgaaaaaattagaaaaaaaattaaaaagacaagtcacgcataaaatattaatcatgttttattatctaacaacaatgaaaatatgaattataaaaaaaattcatataagatagatagtcaaagttggacacagaaatctaaagtttgcctttttttttttttcgagacggagagagtaatgcagaagcagcagaacgacatgtttactgggacgatgggacgatcgccagaacgacgcgtttcctgggacagaggaagtactacaaacctcagcaaaagtctcacccacaggcccaggaatcttcctttggtcaaacgtagccatcccaccaacagccgagggccccaccccttcaagctgccaggtcatcatcgcccccggtggtggcccccgcacgtcagccactccagtaccccaccccgaccccgacccctcacccgccgcgtgacgttaccgcccacaccccaaacccgaccgttacctcaccgggttcaaaacggcccactcgccgcccgccacgtgtccgacccgcaccccgcccggtcggtccccacgtgggtgagctgaccgcgcccccgagcttgcctttgcgtgcgccgcgcggtgacgagacgacgcgagtagtgcgaggtggagaagacgagccgacaccaccaccaccaccaccaccacgagaggaggaagccgcgggtctcctcgtcttctcctctctctctctcctcaaccagctgtct

SEQ ID NO: 72048 - DNA, 609 bp, Oryza sativa
aggaagaaggagtcgatcttgtcgatgtcggcggcgagggcggcgacgaaggcggcctcgtcggccggcgagccggagatggaggcgacgatgcgcttcagctccttgtagctcacgaacttgtccctccactccgggaggctctgctcgatctgcctcttgagcagcttcccaaacttcatctctgcaactgatcactgatcaatacctacagataactgattaatcttgtagcaagaacagcattggttagctaaatctgtgtttggtggatttgtgcgtggtgagtgctcgtgatataagagcagagtttcgtggaatatttaccagcatatgccaagcgtggtgactggcgtgattgcccaaaacgtgctatggacaccccgtggatctatttgcgcgtcgggtgtcacgttttaagtttgtggttttattatacatgcgtatgatttgtagcatggatttgagatagagtaatattattacaatatagatcgagttctctctctctttccttttttttttgaaaataccgagggttatttgtcatcacgtaatcttataatttataatttcaggtaacatattgttccatcatgaaatttcata

SEQ ID NO: 72049 - DNA, 1199 bp, Oryza sativa
gcatccggtccaaaaccaagggagaataatatataggacaaaaaacatttttacccattgcaacgcatgggcattttttctagtgtaagagtaaattcactgtgtacccctgaaaactcactcaatcccttttctacccctgaaattaacccgatcgcttctatatactcctgaaatttcaacttgatcccttccatgcctctaccattacattttccatcgcttcactgttatttttgtccttgatactttaggtttgaatataaccttcaaaaaaattaaaatttttgtttaagtgcgcaatatatgtattttatgaaactaatgagactaaataattagtgcagaaaattttgacataaattttagaaataaaacaaatgttataaattaaatttttatttgaaattttaataggacaatggatttttttatcaggagcattcataaaaacattattgtgaacattggtcctatctttgtatgaatgctccttattttttataatttttttaaaactaaatacatattttttatttcattatataaaaataatttttgggataaataatgcttcgcacaacaaactcataactataatagtctcatacgagaagcttttacatttttaatattgtaattcataaatttatatgtttaaccaaagggtaaaatggacatttttatagaaattagacggtcaactgacgggagacgtatcgaaggtgtcaaaatcaaatattgggtgtatacaagtaagtaaaattcacgggtgggtatataagggattagctaaattttcaggggtataaggggattttctcatattttatatatggcccgcatgatcaagtaggtcatgcaacacaagcacgtacgagtgttccttataaccagcaatgctccatgcgtgaagactgtcactgggccatgtgccggcgtgtagatcagcgcaaagcgtgatcaaatttatgtcggtaggattcgcgaggtcgctgactgcttcctcgcaatctcagttggcatataaaaaggcaaaaaatatcagaagatcaaataatgattgaaaattactctactaaaagtttatttggaacgacaaacccgattgaagattagagcggtcgaaataagtgagattgatctcggtgtttcttcagaagttaaacccatcacacttttcgacgagtaattcgacg

SEQ ID NO: 72050 - DNA, 1260 bp, Oryza sativa
ccgtctgttaatgttataaataagtcatacccaataatcttgggttagtctctgcgggacccaccatatacccagttctatacggaatcatacattatatacggaagatattttggataaggaaggggaagtaaagttctactcgggcactataaggactactcggatcatattcatactttgtctctctagttctatttggacaagggggcacctgagggtataaatacatgaccccctagaaggagatgagagatggcaagccagaagatagatctagaacaaatctacacaagccaatacagatttagagaatccaagacaagccaacatatatacaccaaaacaagcctagacaaatccaatctgaagctacaaaggcaaacatgagggatctagagctacctccaatctcaccgagttcacattcgaagaaaaagactacactagctgttggctgcatgtaaaggtgcaaagccgctatgctaacaaagattggattaagtcatccaattattgcactaatgaaatattgatatataaaggtaactctggatttggctaatatgagtagggctattacttgtcagttaagggggcccaacctatatataaattcttgcctattgtctcttttaccctaatatcgcgtacaccctgataccgacgaacaccataccctacaaataccgtagtcacgatatagcctatcgacatcgtcaaaattgttacttccttcatcttaaaatataaacttttagttatctaaacaactatatatctaaatttataactaaaagttgcttataatattataggacggcagtaatactaccaacaaaagcacccatgcgctagtctatgactagggatcatcggttggcctaataagccaaagccaaatttaaattttttatcttaattttgaagctaattttaagatatttttaattttttatattggtatttaaattttatatataaattaatttttattttttaataaaccgttttgatttattagaaaatgtggacaaccggccgtagaaccccgtggtatgtcgcttcgtccagaactatccagacctcccatatgcatgatcatggagctagttaaacgcatacacagaatacaaaaagaagcgacacacactacgtacataattaaattggatttacgaatccaccaggggccgcaaaacggaaggttcgaagctaggcagcgcgcctaactatttatgggtaccgagctcgaattcg

SEQ ID NO: 72051 - DNA, 509 bp, Oryza sativa
tataaatttgcaatttgcagtgaataaagatgtactaattattggacgaggcattaccatcaatctatccagtctgcaaggtgctctaccattgttagactctcgtagtctcgttcccgctgtcctgcacacacgcaaataacaaagaaaaaaaatcagagaatggggattagactcaaggaatggagatcagaaaggaaggaggcggcggtcagtggcggatggcgtgggcggagagggctgcgaggacggcggcgcggtggaaagaagggggacggcggtcaatggcggatgaggaggcgtggttgtcgtcgacggagtgtgaggcggagtcgggcgaagacgaacatggcaagggagtcgcgtatgagatcggggcggcggccagtggcggatcggagaccgcgggatccagaggatctcaccgtggatgtttgcggtgcgacgaatggagggcacgacgaggaggcgagatggatggcgacctgacggtgatgaatcgacgtatg

SEQ ID NO: 72052 - DNA, 1086 bp, Oryza sativa
cacctgacttggaccagggtgcaccttttggctgactcagactaggttgcggcacttgaagatggggcttcagttccagaacttcgcatagttcatatctttggagtcaacctcatacaagttaccacttcatgtcaggcgtcaacactagcttgtcattactaggataccatgcttgtcatcataaggatatcaggcttggcgtttccttccagcttaccaccatacgctttagactatgatatcccgcttactaaggataccatgattgacaacttgccattaactgtctcatattggctttcctggtctccagtgctaggtacttctgctattcgatgccagggtcaaccattctaactataagttatgcttcccaagagaaccaatttatcccgcttgacatgctttgacgtcttcccgaatgactttgctgctggacttgttattgtctgatcgtgatcctgccagatctgaagcttcgttgttagaggtgattttaatctgacctctgtagactatcttcgaacatatcactggttctataactgggaatggctctcacgaacaagcagctcggattcactttctttacattcagtttacttcccattattatcttcaggttgtcctcagttagcattcaacgtattcctttacacctttaaccttgatgtgttctttcccattggatcatctcccaagacatggcattacctggtaaccggtgcttgcacttttcactccgtgtagcatctgataccgagttgaagatttcactccttgccttcatagaaacacttttacctaggtcatcttgcttacttaatgacaaggtgactgttgcggggcaatttacaatcaggggtcttccttgagcgatgcagagcatgtttctgtttatcaatcacctttcggcctacttcttttatgctagagaacatctttgccaatctcttttatcaatcatctttcggcttatctctaacaggtggtattctgaatgtggattgcggacgcttctggggatgatgaggtcctttggcttcctgcctttcagtggaaccttgatgtggtgcgtcaaaa

SEQ ID NO: 72053 - DNA, 39046 bp, Oryza sativa
ggaacagattttaccggtgcactgtaccactgtgcacagcacagtcacacaacctgtgacctgcccagcagcagccagtactactaggggtctaggaggacgcatatcggcatatggggaggtaggctagctaggcctaggagtggtttggcccaacttggtaggcaccagaccaccagtcaagtcaggggaatccagatgcctgcctgcccgttatcatcatggggcgcgcgcccccgagagcgcgcgcacacggcgagtgcgcgccacggaatatgctgcctccgcgcgcaacgcgacttggtccatccatcctttgcttccccaccgagtcatcggtcgcccaccaacgctgcgcccacccaccaaacctttccctgcgctgatcggacggtccccagccgatccgatccccggatcaccgatccggcgacatgcctcccctccatcatccgccgatcgatacacgcgccaccgaacggcaggtgaaagatttacgcacgccgcccgcccaacagccaaacggtagcagtacacgatcatcccgtctgatgcgcgcgttcgccccaccacctcctcctcctcgatagatcgatcggtcgtccgtgtccccactccgctcatcaccgagaggcgactgcattgatgatcgatcgtagccagcgacgagacgacggggctagcgcggcgctgtgtcgatccagccaggctgggtcgcgccgcgccacgtacgtacgggctctctcgtcaaacgcgtttgatcgatccgtccccccgctaagccgccgtaccccccctgttgctttcgggcaaggcaggcgggcgcgagcggcggcagccgggcaccacctgccaacctgtgtgcatgcatgcgccccagctgcacgggggcttgaaaccgaatcgcgtcgcgtcttcttctcactcgcattacctcatcagccgcgcgctctgcaggcgtcaatccggcacgccacatcgtccgtcagcgcggttcagctagcaaaccaatggcgcgtacgtgcacgcacgcacgcacgcgcacggagagagaggatccttggtgcatgcacgggctaattcgctccagtagctgacgcttttgttaggccggtgatgacctgatgacgaggagaagaagatcgatcgaactaattttgagattgattattgcggggtaattcgatctcgcgcgccacacgttttccgttttgtttatgcgcagttgatactgtccttttgctccacctcttttggtcattttattagtgccctcttgacgctaaacaatgattaggggttgctttctcacctctgtttcgtttttaagctcatagggcttgtggccggtccaaacgactcgaccaataaacaacatcctatacaagcccaaataaagaatggaagggtcctaagcacgtgttagcacgcccgtgttgcggaataagtagtgattaactttagtgagttgttctctaatctcgtcatcaaacttaaaaattgtctatataaaatgtctttttaggttaattatagagtttaagcttttgggggcaattttaggtcaacaataagctattaatggattgatttttcaaggtcgttacaattgaactttgaccatcattctcttccatttcgaatatgctatgaacgacaactatgaaactagaatcttgtacatggaagtattttcaaacatgtcaatactattttaacggcagtaaatatggatgcttccagactgactattctaaaatcacaaagtttaaatttagaacacatcacgcacttctcatatttatccacagatcaggatgcctcaagaatgccccaaaggcaaattgaccatttcaagtcacattagccatttccttttcttatattatcttgcatggaactctttgcataaaactattataaggggttacttagggcagattaagcagatctcgagaaggatttgtagccgacagagccctgatttggtggcctcacaaggcctaatccttactacctttcaactgactcaactgttcacctttccctagagtttctccatccccaaactccccaacgtttttcaccccaagtcaccccaagatttgtcttccaagggagaagaagagaagaaaatggtcccagtagatgaggcttttcttgtggccaagcgactgtggatccgttgccacgttaactcggcaagtgctgtcgactaagctgtccctgtccctgatctctatctctctatctatctatccccatgatagggggcgtccctgttagcatgtgaggaggggtcacaagtgacaagtcccaccaccttcacaggctaagggataagatgaggacggatgataagtgccaccttgcaagcaataaagggccatgggagatatggagatggaggagagatggggttctttggagttgtgatcaaacaagggaccatccatcaatccatccgaaattcatcttcttccctttttaagataagccatcaagggaagcttagctttggactgcctaacttttcttagggttgcagctttgcattgacccggctttacgaaaagctgagactatcaaatcctagctttccaagcatctttgatgtgaaagacattgagatcattgacgggaaacaagagaagcaactcgaacaggatatgtcttttttaccaccaatgagggaatggagatgggatcttgggttagtgccactggcaaagtggcaacatcaatatcgaagtgaattggagtccaggtaaattgaacatttcttctgatgaactggcagaaacaaaagtatacctgtctagttaccatcttgacaaaatttccaggcatgaaagatacagcgggaggaaaattttccacaggttaggttgatatttaaccccaactggaaattgacatctatagaggaagacggccaaatgtaccgcagcaatcaaacatgaaacatgtataggcaaaacatgaacatcagtagaaggcttaccaggtagaagtagagccgtagagttactcaagagagcacttcatacattcaccggatgataaagatacaaaccacatacccaaacaagcacaggtgacttaacaaccagacatatgaacagcatttaactaacaaattaaactagaaataacattaagtttccataggaggtttactggctggacggacatacatgtataaaccagttccaagttccagccattttgcaactaatgcaaaacctatatgagaaagacctatagaattaccgggttcacaggagacgcttccaccatggaagcagagggatgaccatggtgaactttaaaagcttaaggtgctctttctttaaacgctacaagtttattcttcagtactctcagtagtaccaattcgagccgtcattcttctgctggccctgcattgcgccggggtattcgacggcacctgacatgttgaaaccagagccgaacctgaactccgatgcgccattgatgtcgcccatctggttaccgaatggagtatcgtcgcggatgaagaactgctgctgtgccggggtggtctgctgcggttgctgcatcatgccattgacatcttcgaacacacctccgttgctgccgccgatgccacttccctgtccaaaaaagccttcttcaatctgtatccttgggttgactgcattaggcctctccatgatcgtggcattgtcgttgctaaggttcttgttggccacgaagttgttgtcgtacatgttcatcagctctgtaattgacctctggccatccatgggcaggccgaaatccagattgttcagagcctggttcggcgtgttgtaggttgccgggaagatggccggtggcgatggcttgttctccgtgctctgctggagtggatcattgtacttgcaagtgtattggtggctgttgcgcgcgttccggtcaaggaacccgtatccatagtcgctatgcgggcactggacattgtggcaggtgtagacacggttgttcagcatcagctcaggctccgcgccagacgcgctcctcttctggatgaactcgacatcggtggcctcctccttcatggacgccggcatgaggaacttgtcgttcagcatagccgcgccgaggttgaacgcggtcgggtcggcgacaacaacagccttctggttgccggcctcgtcgcccttgcagtcgtcgacgacgtcgacgtcgtactcacttgagctggcgttgaacgatatggcgctggtgatgccgccggtaggtgccggagggcgggcaccggggttcagcttcaggtacagctcctcttcctgcttgacgacggccagccaggtggagatctccttggcggtcatcttgtcctggaggcacttggactgccggaccagccggcggatcttctcgatgtccggcgacatgtgcttgatgacagcggtgagcacgctgaccttccaggccttcttgaggtcatggggcttcttgtacggaggcgggccctggtccttggggatgccgagctccggccaccactcctcgtcgccggtgggccaccacggcggagggacgcccttctcgagcgggtaccgccgctgcggagggtcgcagtgctgcatgagcgccgagagcagcgacccgagggtggtgtcctgcagctcctgcagcgagtgcgggctcccggtgccggaggcgagctcgctctcgaagcccgggacggcgttgtcggcctggtacttggcgatggcggcggggccgttgcggtcgaagcggaccttctccttccaccagccgcggaggttgtcggaggcgccgctcaccggcttgcccttctccgggatgatcccgtacacgaacccctgcgcgcggcacacctccatcatcttgagcatgtacttgaggatgccgtcctgcgcgcgcgacatcttcttccgccgcgcctgctcctgcgactgccgcggcttggacgggtcgcccacgacgccgcccgcggggtccttgccccggctcagctgcagctccttgagccgcttcagcttcatgcggtcgcgccacatgcggcgctccagctcctcgatgtcctccacgtcgtcgtcgctgtcgtcctcaccggcgtccgggaagctctccggcggcgggtccacgaggtcgccctcccccatcacgcactgctcccccgacgacgtctgcggcacgagcgcgccgaagccgaggttcttgtcgccgccgttctgctgcaggagatccacgaagttgtgcacgccggggaacatcatgccctggtccatcaccagaccacctcccatcatcgcaacgcacaacctcgaaataattcgctcacaggtagacgacgactcttcttgtaccacttctactcaagtagtaattcacctgcacacaagcaagagaagaagctgatgttaattacagaaatcaaaaccaagtttaagcaactgattacttcgtctaaacgcaataagtgttactactacctccttaactgagaatacatgcgcaacacgactacggttaccgcagcatcctaatgcggcaattacgccattaccaaaaataaagaggcagtactggtttgtttcccttcagaaaacattctaagatctagaaagccaggagaccaggagattatcgcgcgagtaaaattaggtttgcctattgaagcaagggccagagcctaattttgcatgtgtttggtgaaacagagagatctttatctgatcagacatatctcctgcaatcctctcacagagttaagagcacgcaattaacagtcatataggacatggttatcttttgttgtgacataatcatactacacagcataaaggtatcatgattcagacatgatcataaataaagtactaacggaagaattagtcaaagccgaagcatgaaaacattttgtgatgcacgggattagctgaaacggtattttcatgctgctttgaaacaagtagggatcaaaagaaacttaaacatgtgaaatttctccttttcttatcctttccgtgaagtattttgaaacacatgaaacaacaagccttgatcagatcaaagtgggagatgaaaaaggaatagaaaagcacgggaaaaacatttcagaaaaaggatatatttttatggattattttttcggtctaccacgaccggcatggactgttggaaacaagaacatgtacccatgtgcttatcaaaaggaatcggaggccatctaaaagaacagaagaaaacaagagacgaaaatggatcaagaacacatcaaatggagaacagaggaaaacatacaccgccttagaggaagcatcaatgattgtttttggccataaactcgatgcaaaacaagatgcttccttacacccaaccacttaacatttccagagcaggatttacaacatgtattccttaaattaggttaatctctgagatctaatgaacacaacaagagaaaactagtagaaaatttctaagtttttttccctttctcctttggctggcagcaaatcgtataatctgaaaaaagctaagctttgacctctgccatggatttactcaagcttggcagaaacaattctacgcacaagaacagaaaatcacggaataaaattggaagggaataaagggcaacgaagaagtagccaaacaggaattggctaccgcaggcagctctagcatccacgaaatatctgaaaaagaggacaaaagatctacccaaacagatcacagaccaccaacctatcatgaacacaaccacatcctctccaagaaaaaaaaagaaaaaaaaagaaaaaaactcgaacacaagcaaccatcaacaggaggacatggagaacagcaagcccacaacagaaagagaaggggatagcagcaagcaagcaaaggcgagatcgagctccctacctctccctgccgatctcccacttgctgttttcccttccccaagcccgctagctgttatttctcctttgccatgaccttggaggagaggagaaagggagagagagagagccaggcacgagtggggaagataagaacagcggagccaaagccagggccaaagccaaggcgcccagcgcgccggggggcaaaaaagtaatcggcaagtggagggaagggtgtgccgaaatgggtggtggcttgggtgcaacagcgacagggaccttctcctccccctcccccttttataatcccgccctaaaactagtcttcctcccacgaacgaaccgccctgcgccgctgcgctgcggcggcggcggcggctcgctccggtaagccggtaactgcgttgctttgggagggtgaaaaggtgaaacacaggcatctgtccgtgacatgtggggtcccaggatcagagagctaatagctaggtgtactgtgtccaggccctccaggggctgcagggaggccggtttaccgttttgccctcggtagggttctgtttagtactgtatgtagtacagtatcagattggttctccctcccggaggctacatgggggagagactgattttctgcgcgcttttcaagtttttttatgggagcacgtacatcggtaggcatgcaaaaatagggcaaaacgtgtgagtacacgtacgtgtttggcgggagttttttttaatgagttctctaaactgttattgaatttaaaatatgattaattagtttttggctggaagcatacaaactaggataaaatatctaatgaacgttgtctagtttgaatgtgtaggaaaatgtgattatccacgttaattttatatgtggctatctatttagatttagttgttatgtaaatattaagaagtttaagagataatatgtaaaaattgtaatgggagtatgtgttgatggcagcttcaataccaccaccattgaattctttttagaggagtatagataatatcttattgggagtatattaatcgatgtttcaactcacatacatcttgtttctaaaattgtccatttcaatcaaagtaaaaaaataagtttgctatacatttattattgaaacgctcagttaggaaaaaaccaaactagacataaatgagtaaaacattacgacaagttttttcttttaatggtatgcaaacttaaatgtaagctagattttgttaatttgtagaatatactacaaactataattgtttggccagcaaacactaagtttagtgatcaatttactcagacaatttaatatcctactgtcattgtaacatactataccatttacaaagagagtaaagtactcaaatgttgtttaattcactgccaaacatttcctacttttttcacatcacaaaaaatcaccttttggtttatagccatatttgtgctccactcaatctacaaaatagagcatccttcatattgctagctaaggtgtgctccatttttatataccataggcaacttaaacatagcaaacttatatatacttaaggctaagttcgggagagcggttgggctaagctttttagtgacacctgaaatgagataaacctttgatgcatggttaatcgagtattaattattacagatttgaaaaatagataacttttatttttttacatgaaacacagtttagctgttcgggatgtgtccttacaaagaacgagaaagtagtcaatcataaaatcagtttagaactcaccactagagcaagtactatagacctcaatgctcttgcccccaagatgcccgatcacatgagatggagaagagaggagtcacctcttatgtatggggtaacatatatacatacttcttagtgcaagtttaataataaagccaattactagtagttccaaaaattaaaacatcatctatatccaacctaaaaacactcatacagtagtaagctgtaaacatatattgcattattaatatctaatccacccaatagtttatcggagctcgtggtgcagttggctacaaatctatagcccgcttttttttctatctcctctcctttttcttccgcataaatacaaatatgatgttgcaacttatatagcttgcttacatcatcttgttgtactcgctcttaaagagatgagaaatagaccaataaattgaatgaaaataaataaagtaaaattattataatatattaggacaaatgtattaaagataatatgttgtatgtgttacctcttaattaatgagcattaggcagagttttcttagggtgttggaacccttctctttggtacacaaaacaaaccgatgtattagcacgtgattacatatgtactagctaaagagattttttaaaccaactttcctataaaattttttttgaaaaaaatatatcactcgacttatgagctggaaagtttaagagtaaacaaatatgcagatttttcgtttggtatttttttaaaaccataagtcactattgcactgttaagccaaagttaggttggagggtttttttttttttgcttaattgaggtgaggaataactcaaccattaagtttaggttttcaaagttatcggtctataaaacatataagaaaaagatgaattaaaagactaaaccaataaacccaagtctaaaaaagaggaccttagcacttcaagaaaaaaatatattaacatacatgtaaaaaatgagagagtaaattgcgaaagtgtagttaaaaacgcacagacttgctcctagtccatcaaacgaacagaaccaaataggtgcatgcgagtcctaattctttcggttactgctgagctcagtagcacctactacagctagacaatccgcacaagatccagcggctacagcacagcaaggacagcgctagcgctagcagcagcagtgcgagcgctcacagctgctacggagggcaaaacggtcatcggcgaagccacactttcctcatcaaatccggttaactttgacggccttcgattccgcagccgccgccgcagcagcgcgatcctgaagcaccaccacgtgctgccatatgggcttgggccacgtgtcctgaacaaacccgggcccactccctcggccctgtgtggctttacacgcacgcccacctcactcgggccccacacaaactcgggttcacacctccccgggaacgcgcgtactacgcctcggtagattttctaccgcagtaaaaagatccaacattaaccacgctagtgtggagacagagagtacggtattaatcgcactgcaggtaaattattagagcaagtttaatagtatagtccactactagctccaattcatttataactaatataatagataatttatacaataattgcttactatactattagtatatgatcacacctgttctacacacattgtgtcttgaagtccgtgctgcagctggctacagatctgtagcctgctgctcttctctcttatcttttatcttattaaaatatgtttgtagccagctaatagtctattattgtatcagctcttaatcgatcgagtttgtgcaacagtgcaagttaacacggaccttaatcagagccagatgctgttgcattgtactcctggtacatttgtgtgcttttaacttggagtactgctggttcttgttttcctcggaacaacttgcattagtactgctactgcttcagataccgttggccacagcaatacagggctacaggaatctgatagtttgatcttgttcaggcaccgggaaataattgggggcgacggatttaattacggtttccgcaacgatcttgtatttttttttcctcttcgccatttaagttgtactactcccccaatcatgtcctggttagatatcaattttttccttttgcaggtaatacttcttccgtcccacaatataaaaagttctagagttggatacggttgttaagggggtctccaaaaataagtctctaaggtagggacttattttttagagatagtggtagaagtgagtggtagatgattgtgattggctgagtagtggagataggtgggaaaattgaatgttggagggttgtgattggttaggaagagaatgttggtggagaagttatattttgggacaaatactaagggctaaaagttgctatattttgaaacggaggaggaagtagtttttttggggttagatatgttttttctttggccattctgatgtgcccatttgcttgtacatatgctccatttttctaggtcatgtggatcgatacagtagggtgtagtacggtgtccactgtcttagacatgaatagaaaatgaccggacatacgtatgcctcctatttggagtagtagacgtggttgacgtattttgtgtactgcttcatgaaaactaccacatccagaatttccttcctagaactgtatagctataactcaatggtacacttccagctagcagagtacagtaaaaaggttactagtagaatagcgtactccaactttttctctacaaatggcactactactggagtgctactctaactccacgtggactatactgtagtagtaagctcgagttttttttttacttgctttcgtcagacgagcaaccacgcgcagtactagtcgagatgcgggggggatataccgccggtgaaatggtcgccggggcctatccaggccgtacacgtaaaggcgtggggtgggtcgtggtcacatctcgggccgtccgtcgtgaccaccaatccgatctaccgcacgtgctcatcgtgcttcttgggcggtgaacacgtgtggccgtctcggtagcatcacctggtcccgtggaacgcacttcagatcggctttggagtggtccgcggttgaaatgcatgatgccagcgcgtgtacagttttgtactgcacacgagtttgggcacacacggtcggtaactttgctggagcacgcagtaactaacctggagaaatattgctgctggtcgtgaggtgtttttttttggacataggctgatgagacgtggtgaatgaaaagggaaaactaaatgactttggagtaagatttttttttccatttctgttcttagtggtgtccaatagtttgagtgacaaaagcgacggaaaattaatggaaaaatttaagtttcaaatttagagcttagctatggcttataatccgtagctcaaacaggcatgacgacaatatatgctctattcaggacagctaaaatttttgacaattaactggtgactgagtgataatttagagaacctagcttccgataaccaatttattttctagaaattataactattactctatacgtcttaaaaactggttggtttagcctaaaagtttatcccatgaaaactatagttttaggttcgggtttggagtgacaacttcctcgttttctggaacggtttgctttttagaaaaccttttttatagaagtattttttttaaaaaaataaatctatttgtttaaactttgtaattatgaacattcaatgaattattcgttctaaaaacattcagttaattatttgctaatggcttatctcgttttatataccacggagttactgcggccaacactcgaaatgaactacaccttaatactacttcatcttgtttttagctatctaaccaatagtacccatctcctcctaatttccttcctctactcgttctctccacatggacaaaagggtatgttagtcatttatttatttattttatatgtttttgaatttctaaaataaaataatagtctttgagggacggatggagtaaagtattagaattcaggtgagaatttaaactatttgggagagatcaaattctaggagtagttgtagacatgtagttgtcagaaactctctgaaactgacccatggttttacttgagtgaaaacagcgtgtacaatctttgatgagatgcagaggaggttgtatttttgactaggaaaaaattccaccatttttccatgtttgaataaagaatgctcttactttaattcaaagagtactactcttagcatatggagtacaatcagttgacctatagatataaacatgtgtagtcaaccgcggccattgtatcgatataaattgatatgtcgcattgtcaatttgaaaaagtaccaagttgatgaaaaagaaaaaaaaactggaaaaagaaacaggcagccgacaacctgaaagaaatttcagtcgatgtgctggctagctcttaatttcatagtttgtccgagcacgattcttagcccttgtttagttccaaactttttctttaaacttccaacttttccatcacatcaaaacttttatacacacataaactttcaaatttttcatcacatcgtttcaattttaaccaaactttcaattttgacgtgaactaaacacacccttaattatccagctactagtaattctgactgaaatactcctacgctccatttatttatattttctatttttcagaccgagggattaatatgtattttacatatatagatgggaggagtggagtttgctcagcctcactactattttttttattcgccactgactagctgcacgtacatgctgcataattacgcttctaggtacgtcaagacactcaagacgtgaacagaaaagtcaaatcgtatgagtcaaaactattgaattacaagcgggtataatcttctcacgcaaaaaaccccgatattttcttcactgacgacaatatttttttatcgttttacttgtagatgcacgatcaaacctgacctattattcaactttatgacctgataaacctgtaatattatgaaagaaattttatactgatctatggataatattttcagtgtacagtctagtaacaaatgtcacttagttcgtcgaaaaatataagagactttaaggatttatatgagcattacttatccagatgtatcctaaaattcctttattagaacaaaattagtaaatgtattaatattttaagttttaattttatatacataagaaaaatgattagctacccaacatggccgacatctacatataggatgcacaacaaccataaagtttgactttaaaaaatctgagcaagggacaaaactttgcatgagatgaaataagcaaaagcttggtaggggatatatacaaaaccctctctgagagtgcctcgtcttttcgcttgcgcttatacttatcagccacattttaaatttttgaccttaaatttaaagttaatttcagggttttttcatcgaagtttattttttagcatttgcttttagatcgctaagaacacatatataaaatttttatttacaaattatttttcaattgaaaatatgtcgtttcgcgtatccggagggtctggaaatcggcaaatcatgtactatgtaaaaacatacttggtataaaacataacacaataaaaataaatcacatattaagtggttaaaaaatatcttgtcgatcgactccaataaccacaatatcttggacagacactgcactaaggataaaaaaaaggtaaattgaatccatatgtaaatgtgtttattcaaataaatatcgttacaataaatgtgtttatccatgtaactgaaactgtacaaaattaggaccatactactgtcatcatattttccatccatctcttttttttcccgttttattccttctttctcccgtctaatacccctaaacattggtttagggacccatataacagttccatcttcctttatcctcccatattttctcttcctccatctctgtcctctctccagctgataccgcaggcggtgaggagggcgccagcaagggaggcggcccaagaaaaagatgccaattgcagccgctcccgccgccgcgcaggtgcacaatgttgtgctgcggcatgcctccccgacgtcgcaaccccgcgcggcgacatggtgagagcagtcgccgttaaacccgagctatgtaggcgatccagtcggtctccggcaccggtgcatatgtgagtgggtgcttcaaaacccaccgtaggtgccaaggccgacaagccacggttagacctaatttatagaataacatagcaatatttataccaccaaattaattttattaaatccacaattgaatatattttttttggtgctataaaaatattgctatgttttttctataaatattcccaacctttatgaagtttaagataggataaaaccgaaattctgaaacggatgggattggagaagggctacatttcagcgtccgcacggacgcacacaacctgactattgttcttagctaggctagctagcaaaagcattaacccacaattaggggcgcattaaccattggttggatatgattgaatctaggccgtcaaattgctggtatataaaattcagatggctaaattttggcgcatggctcatgagcacaaataccgtgtggagaatatagagaatctatcgcttaattggtccatgatatgagaatacatagaaaaaattaactataatatactcttgagttctacacaatctagatttattaatatcagtatgaatgttgaaaatgatagacattataaaacagagaaaatatgtcacattctattctaatttttttttacggaggaagtattacaataccatctcagcatgatctgaaattcactaggccagtaggcagtagctagttgcggcgtcttgtttatttatgatttggttggtgacagtggaagcaatcattcatccttatctcagtttcggatctcgccctgaacctgtcgccccctggccattcagacaacacgaagcgctggagccatcatctcaactggtagattcacctcaaaatctactagcagtagcagattgcatggattttggagcagtgatttactaccacaatctagaactcgggacgatgaaattccgtcttcaataggagtaggaaatcaaatgagtggcaatcgggtccccatgtgctgtacgccagtttcaattccttcttgatcggatttctgacacgtgctcattactcctccattcgtctcgatcggtttccagtctgtccgtgccacctcaccgaaggaagaggacacagatccgagctggtgctttcgcgcaaccctaccaacgtggtaactcaaccctttcattgcactgagtacggagtatcttttcaattttacatcggaccacccacttaactctaacgaacttgtcaatcctagtatctgatataccagctgaaataaatgattagtatttgatttttttaatatctatttaatttacgtatataaacaaataaattaactcatacgaaattaaaaagctattttagaaaagtattccaagaaaattttacatatatatttttttcacgaaacacattgattacaatttgactatatcgagtagcagtatttgttcctctctaacctcctctcatcttctcaagtattgatattgggtaacgtaatttcgccaacctttctcttaacaagtggcatgtgttagtagcattttgtccgtgagtccatccatacaaaatggaaagccggatgttataattttccacctaaaatatacaaataaaatggaagataaattaggtgtacgctgctcatttattttctttttgggagctgtagtagtctcgacagttggctggacaactgtacattgccgttaaaacccaagcataaattaactgattattgtgacctcacatctcactgacttttttccagtaatcgtgacgcgccacctttttgcggcaaacattttcctagtacgcaaggctcgaaatcaactttctagtgtaagcaagataacatagttttataccgggtgattgcgatagaaagtaattcttcttgtcaagtgcatgccttccacccttggtaaattcctcgaccacttaaacaaattatgcttaacgcacaaggcggctgatagattatgctatggggcacccctagtgtcttccatcatcatattagtagtagctaaaatgatttatcgccatcaccatcacgtgggaaatagcaaatgccaaatgcattgtcaatctatactcctaagaaagaggaaagagcgcgcggctgtttgatcctatctgaacccctgatagcgtagtttaatcagtaatctctggcattgtgggtgctctctttttttcctttttatgtatactctgttttaagaactttcagctattctgacttgctgagcaaatatgataactgatatgcaacatccacccaaactctctccaagttgtgccgccatttttttttctttttgtcctacagaaattcttgtgagatcaaacttccaagcagtccaaatgtgcccatttacttactttggggctttctatatactagcaggtaggagtactcatcacgcagggagcaaagcaaagcttgccactcactgccatggcaccgccccaccgagagactccgcgactgcaaaaaccccaagacggcgagctcccggcggaccggtcgggccttttagccggccaccgcccacgcggggtgcgtggaccagttcgccgctgttcgacgatgcgaggtctcgagaccagagatgcggtttggtgtcggcaggtgatattgttgggcctttttcacgcggtttcgatccgtcaaagtttcctcacacatgctacatccacaacaaaaaagaaaggccaccttttgttgttgtagtagtagaagtattttctgaagaacctttcctgtcctgtaaaaatattgcagaaaggagaaaggttaagctgtggcaagcagggagacaaaatgtatttggggatgaggaatagttctacagactacagtcgtcatccagaatatgctgaacggcaagtcttcgaattgaatacgtatagttgaagttgttcttttctccaatagagcatggggtcaattccctgcgtgttctctgatagagtagaaaagaagtggttacgttactgcttaatcagggttttaacaaagctgatggaaaccgctcggttttgcacaaatcggttaagtaaaaaaaaaactcaattttgacaaaatttagtcgaatttcacaagtattaattcagctatttcgtgaaaactaagaaaactgctctggagtttttgaaggcgttttttttagagtcaatccattttatgacatcgacaaaacgcgggttctacaatatgccactgacaaaactcagttccacactataccatcgaatgactcattttcttccttatatgccatcgacgttagtcaaccgccgttaaaagatgaaaaatgaccattttacccctagcataaaattgagattttgcataatgccatatcgcggtaaaaaaatcttggatgataaaaagacaagcaatttcaatttttcatcaatgagaataaatagtgaatcatgatcagtgaaatcgatgaggatgcatcgtaccctaggggtaaaatagacatttttttgctcttaacagaatttgactaactgttgactggcggcgatggcatgtaaggaagaaaagtagttgttcgatggtatattatagaactgagctttatcaatggtatattgttgaatccatgctttgtcaatggcatagaatggattatctctttttttttaaccctgctgcttactccctccatcctataaaaaaccaacctaatactggatgtgatacatcctagtactactaatctggacatacctctgtccagattcattgtactagaatgcgtcacatccaattctagattcgtttttttggacggagggagtacatctttgttaacataatctgatgtgagactggtcaccaaatatatatatttgcacttcctgaattttgtgtgctctctttgtgggtagtgttacgtgctatttattgagcggatatttgtaataagtggttgtaacttctttgaagtaaaggtcgagctttattctatctaaaaatatatttggtcactaaataattgtacgaacatatacaggagaaagtcaacactagcaactttataattgccacgagtgtcaactgtacgtacacaatgacagtaatgattgtggcagtctattgtttataacgcactactgtgctagctgtatagaatacgtatctatatacctcgagtttacgtattatacacctcaaatacttgatttggtgacatatactgtaccagtttgatccactctctttctgaagggagacgggcaatttttcgttagacgatgacggcgacggagaggtggtctctatacgcacgcacatacataagcgtgtgtatattcacggatttagtcgagttttttctatgtcttcttttgattcaccaaacgaagcattggtccttttgaaattagcaagggggtaatcatttaggtgagccattagggcgcttgaagggtcacttatgaatatagtacaatcatgctcctaatacacacgctactcttgatttgcaggaacactgtcggaaactgcacagtatttcttgatttgcgaatggtagagtttactacacatgtggcaacaccagggattaatctacctctatcactgtcctgactgaatactcgagacacctcctcttgaaacattcagaactcgaggtaattaagctgaatgagtactattatatcgataaaacaatggattgccatggcttgaagatgagttgccggcaattgagggacctgatcctgcgcgacgcgacgccccagaagggatttctctttgttatccactgccccctctcgagtcgagataaaaaaccacatgccgcttgccgtcttcctgcccaattgaactccggagagcgcgcgcgccggccatggcggcaagccaatacatggacaggttcactgaacaactgcctgccactggcagagacagcagcgagtcacacggagcgggcaaagcgaagcccggcgcgcgcgagcgatgatttgtcaatggccaattggcaggcgccgtgctccctcccgctcgggcagcggctgcgcctgaggggatcgttacacgtgtagccgagatcctgagtagatttcactgttccatcttcgagaggtaaggtagcccgcacgcgtagggattcggattccgtgtctcggtcgcgcctacctgtccatgttcactgttcaggacttcagagaaatactactcctagcgttggtttccgtcgcggacgatctagtagagatctcgtgttcgaccatctctgcatctttgctgagtaaatttaccctgatctcgtgatcgaagtaattaaaccggactctaaagttccacctttcatctgctccgctacccgtatcttgtcagaatacttgtgtggcatagtagtccccacactttcactaggttcctgtacacatccatgagagataatgatctgaacatcgagttaaaccggcgcataaatttcacaagggtgtacgtcaaaaaaatatcacaatgaagaggcattaggttcagagattccatccacggggatgcgttgtggaactggagccgtccgtaaagagaaataattaatccccacgagtttgggccttgcgactaaaccacctaaatgctaaacggcctatgaaaaagttcactttagatccctcactgggtataacacattcttcatctcttaaaacaggtgtaaatatagtcccaaggtggtttggacaacggtattggctgacgtgataccacatgacactattgacttgatcttcatctaacgtggcatctacgtgatataagaatcagaaaatataaataaaaatagtcccacatgctaggcacaaaggaaaataatatagaaaccctaagcccacatgtcatcccaaccattccttctttctttcctctttattttctctctccatcgtcctctctatcctctctctggttgacccctccccttgacggcctcagttggtcggccaagatagcggcgccgacggcagagagaagtgggcacccagatgacagcaatagtcggccatcccaaccgtttcgttgtcaatactagcatccagtgtggctgccggcctccgctcctccttaatccctctccaccctggtgtcggcgtcaagctccctttccgccttcctctccggtgggacgtgtgggtcgaggaaattgagaaggcggcggttgatggtgctagagcggcaggtggggggaggttgggggagcggtgttctggtggagggcaaggcattgggggcttgagctccagtgtcagccagctccagcggaggcccacgcgcatggagatgggtggatttggcggcatagtcgctggaggagcgagcatggttggggagagcaaatctggcagtggggcgaggcgctgggggctcgagctccggcccgttgtcgatggggatgcaatggcgctcaccagggcaaaacctccttgggtagccatgttccctttctccatcgctaccgacaggtacatgcgaccgctgaggttgcggtcgacgttgtacatggcatccttccacttgatgcaacaacgcggggtggatgatcaggacggagctcttgttgtcgtagctcctgcggcaggccttgagagagggcgagcgacgcggcggccaacatcgagctcctctgcctagctagtagaaggcctccacccgttgctgcactcctccgccgtgcgtccataggtccacacacacacacacagagggagagtgagagagagagagagaatggaggagtagagatgggtccctctgatatatgggtcctatatatttttaatttttttcatgctgattaggattccacgtcagccaaaccatcaaaaaaacgactaagagactcgattcatactggttttgatagttgagagatgctctatacctagtattgcggttggatgacatgaattaaaacttgacccataactgtaaggtggactttttccaacgatctataatggctgtctcaggaaagggtccaatacgcagaacacggccacagaatctcgacccctttgctataggaataagttcactttgggtcttaatatatcacgaagtatgaaattcgtccataaaccgaaataccatatacaacacctccctcccttgcctctcaataccactgcaaataatgtcctatggtggtacctacgtggatggtttgacttgatccttatctcacgtggcactctctatctcatccttccttcgctatcaatgaggagtcaacgccatgtgggacgatgaccaaagtcaaaccatccacgtaggcgccatgtcagctgaaaccaccatccagatcgccttgtggccttatccacaatagttttgagagttgaggaacacgttgtttctggtatttcggtttagggacgaacatctgacttggtgacaaattgagggaagtaaattgaacttatttatttgttgtacttcactacatgggctcagaggatcagcttgttaagttgggccttccttcccttttcccaggcctatcggcgctgccagcgctatcttaacccagcccattcatattggattttccttttttttgacaactatccatattggatactgtactagtttcctggcaggtaggagaagaagcagacaaaactggagagaccaaccaaacggtcgccctgttggccacctcgcgtcgacaacgacggtccaccagccgccggcgcagccccaccgtacctgagccagccaggcaacgcaggcacggccgaaacgcacaaaaccaggtcacatactcacacgaatacacgatcgacggcgtgcacgcaaggcccccttgcccccgtaccacgctgttccccgcgaggccgtgtgtgtattgtacacgcatcgctggctgccgatggcatggcacacgcgcaccgcagcaaccgatcgctggcgatccacacagcgagcagagtagcagcagcggccacagctcgcaggctcacatgccgcccgtgcccgcgcgcgcgcgatgcaccaaccacctagcctgctagccgaggcggcgttaaccatgtcacgcgtcttgctgccccggtcggttgctcccccgcgccgaagctgctcggctcggctccgctagctcgctcgggcgtcgccatcacgcgccacccaccggacgagggtggcatcgggcatggcggacgctgctcgcggcgatgacgcgatctaagccgtgggcaatgtcacggaagaattctgagaggaattgaatcgacgaacggtgtacatgcatgtacaggtcagatgtgtgctgcttgccggtgtgacggggtagttttacaggagcagcagcgaagcggggaacaccaggagcagcagaagaagaatcaggtggcgtcttgtgggtcggtgcgtcgccggaccgccgccgccgctgctgccggtggccgccgttgacggtgcgttggccggcatgccgccggacaaccctgccggatgtttgagacattgtcagtacagtcaaatctcgccgtgtgaaacaagtatacatgagaaatttgatcagacattttcttgccgtgctgctttaattttggcagtgccgacattcggctacccaaaaagggtggtggttcggtcgaatattttgattccttgaaagttctagccactgaatatatcactaacagtacaaacataatcacattatctgatacacctacttgattacgtagattcactttgctcttcactacttcagaaaactcgatttttacatacagtggagtaaaattctgctgtatcgcgtgctagtgctagatgacagttgatttgacaatggaataggtggaggtggagccaggagtactgattcctaacgggagtttgtcaaattaaagatgcaaatgatttgatagttttgagctactagtaacaacgtcctctctccgttccaaaaaaaacaaatattaagattatataggatacattatgctattaatgaatttagatagtgtcacatccagtactaacttagttttttacgggaggagtatgtgtagtataagaatctagtaaactacaggtctttgattagcatgcaattttcaacaaattaaaggttgtgcatttaaactccacattgcaaaaagaaacggaaaaggtgtagcaaaggcggtcaatttacgacagctccgtttaattgattgcacgcggcagagggcggccgtgtcgtacctgactcctccggcacggcgccgcccggcggctcggcgacgggcacaccgagcgcggcgcagagcctgggcgggggcgcgtcgacgcggcagatggtgggcagcgcgagggcgcggacggcgtcgacgcggaccccgtacgcgccgtacccgccgacgagtccgcacaggcaggcggcctcgccgtcgacgacgcccgcgagcgcgccgcagcagcccttgtccggccgggtcagcgtgctccggtactccacgtaggtgaggcacgaggagaggttcagcagcgcgcccgtgcagtcgagctcgccgggccagggcgccggcgccgcccacggcgaggacgctacctgcgcccgcgccgcgcgcggctgcagcgaggtgagcacgaggagcgccaaaacggaggcagcggcggcggccgaggccgcgggcagcataatcatagccatggcgccgattcttgtgcttcttgatatgtgtttgacatgtggagatggggagcgcggcgagcgtgcgtgtgcggctgtgtgtttttgtgttcgtgtgcgtgcgccgagtgacgggggtatgtgtggtactacatatactccatctacaacagcttgggggccatcaacgctagttcgggtacatctcgtcaagccatacttcactggaaaatataaacggataataattgttgaataacagagggagagagagagagaggggaatactgtaaatattggacacgttgtattgagtctcaggggtatatatatatatatatatatatatatatggattgtatcttaagtaaactcagaaagatagagatgaaaactaatcctatcatatcacaacaaatcggatacaatacgatcttatccatgtattctaacatcccccacagtccaagcgtgagcaacgtgaacacttagactagagaagaaagacgagagtgctcaatacggatgataaccctttgtgccatactcgacataaccaaagcgaaggacatgagggacccatgatcgatgaagccatgtgtaaagtagttgtggtcgatgtagtcgaaatcggggagccaatgatgtcgagatagccgagccgcagggtgtgcatggggcaccgtagagtggtcgtgagcgaggacgtgttgaagacgatgacgatgacgtgatgctgcagttgttaaggaagatgacgccgaagagtcgatgttgtcgaaccatgaaggacgagacgtcacatcgggtttgccagacctagagacaactcaggatgaacgcgtgcaacggggttgccaataccgcacaggcgaatgtaggggaccaccatgaattgacaccaatgtcggaggagcctagtagagagggcttccaagatggttgcagcgtgagaacgatgtagagaaagaattgccggagcagcacatggcctctatccacggaatataatggctccttttaaacgtggtattgacaaacaaacaaatagaaaaatataggattttgacaggaatttaagttcaaaacagatgattgtaaaactcatggaaaaacacataaacaatcgtttcaagtaggaaaaatgcagaaatcgcatgagagagatactcagaaaattttccaaaaggtttgaactcttgctaacttttctccaaaatctctatagaattgtccatccgtagaaatttcaaatgatatgataggattcaatccatcatttcaaaggatttgataggaaatttcctatacgatagaaatcctctaaaatttttatgtttttctacaaatcaaagaggacctaggtatttctaaggagctttagtagatacaaagattaacgtgaaattattttgatgtccctaagattttatcttatcacttcatggatataaagaaaggagaatgctaggggatggaatcccatcccaagcacccgcgatgatatcgtctccgtgattgtgtgccttgtcccctatagcacaggcatcaagcatgcaaaaaaagagcagtgcggcattgggaatgtggcagcggagaacgccttgcctcgttgctccgtcaaggagcatatcactggagaagtggaagggactcgccggagaagagacccatgcccacctcgctcggtcaccagggagcacgtcatcggacgttgctgcagaatgggagttcatttgagaagggcctaaccgccttgtcgtgccaccaaagtacgttttctaagaagaggcccgcaccgccttgttgcgttgccggggagctcattgccagagaggagggtgggggaatagggtcttgcaggagaatggttctgtatcgctggggagcacatcgacctcgccggagaggagagaggcatcggtgaggagaatgtcgtcatcgcccgaaaagggatcaagggagagggaaaggatatcggcctagtattgattgggtattagtaggtaccaatagatatcggttgatacgatagagtaccagatctgatacggacaagtatcagctggtacagataagtattggttgataccaatagggtatccgatttaataccgataagtatcagctagtactaacaagtatcaactgataccggtagggtatcagatttgatattgataccggcagggtatcatatttgatattgacaagtattagtaggtactaatagggtatcagaattcgatacatgcatgatatcatactgtctaatcggaatcctgtaatataacagctcccataaaataatataacgtgtccatatttttcgtaaagtcaatattcgtaacttttgaataattgttaaactaacaatatttagtgtcacacatattcatattttaaagttctttaataatgctagctccaggctagaataccaacaaggactcacaacgagccctattagaactaatattattcttgcttcggtgaactttgttgagcactatttccctatgtcccgtcatgagctcctttgcctctttgactatataagctagtcccgacttatcgctggttttggcctgaagaagttgtaccaccgtactgcagtccgtctctacgacaattagcaggcgcatccattggatccttagggataaaccttctttggatgctaaaaactcagcttccagcacctcggtgcaataatccagagagtgccatgatgtaaaaataacttggccagcactatctcttaggatcattccaattcctccccgatcatcctgagcttcaaaagacccatcaatttcagcttcatccaccttgttcttggtttctcccacttctgaaccggtcctatgtcaggcagcatcaatctcgtagcacgttgtatgacatattgacatagctcaccacatgcttcgccttctccatatctgcttgagggtgttgcttgatttggagtagagtgtcgatgtagctcttgataaacctctgcgagacagccaccggtggtgccgatttgccgtgagtgatttcatttcatacatgctagattcgccaaaacaccattagagacatcatttgtttagggattgaatttgggatgaattgaagagtatcaaagagccacgccatacctgtgtttgcagaattggcttcctgtgaaatatgtcctgcctccctcattgacatccaaagcgcttttgcatgtgggcaacgacacaaagcatgtgaaatatcttccttctctaccccgcagatgacacaatggtttatcacactagattctgctaaaaattgccctgatatgaagtataggtatataaatatttactactccatacaatgttttatcatattagtttgtgctagaaattgccatgcttctagatcccaaatttatgaacttcatctatggacgaattgctgccttcgtggcgtcttccacgggtgacatgttattttcactccttgctgtttatggcatggcagtataacttgtcatgtttgtaagtaataaggagtattatataattgcattcttgttgattttttttctcatatttcgggtttgcaacgcatgtggcctaaacccgactacattattgcataatcatgccattggttggtgagtagagcgaagctgttgtccgtcctcgctgtattgccttcgctgatatatttgttccttggatacctataaatgatgttaatgcaatcataattatatttgtccggtttagaagttcattgagtaacacagccgattaaaattaaaaatggatgttgtaaagtgttgaggtgccaaaaatatctttggcgataaaacgttgtctacagtcgttagtcatattttttctcgaactccagttgtgaccaataagtttctcttgtagaaatattacttgctaggctattgtcagggttagctcaatagctcgtccttcttgataggtcaagtaaattagcgtatagattagcagaacatcatcatatgtttaggattgatcatgcacataaggcgggtacgcaattttaataccttttatgcactaacaaacaaaaaatgtatattacactaacaaaaataggtgcatcagtcggtagcaataacttgttcagcagaccgcaaatggcttacaatttatgaacataggatgcgcgtgaggacatcaaacatgagatgactttaaatgctatcttctgcagctcgtgcaaggtgttactattacacaaaaaggacgagcgtcggacactcggggtaaaattttgccagacagtacaacattattaacactattcagcttgctccatccaagattgaacaaagaatcatgtactaccctcccctaatgccctttttatctagcaaccaaaatgagacaacctccatcacgccaaaaaaagactgtaaaagtagcaacagcgttcctatattcccattcacaactcagaagggcaagaacctggtcactcgtaacacgaagcttgaagtatgtgaacatccttccaaggggcatacagccaaccgcagaagtaccacatgtcctctcacaagtcacgaccattccagttaacatattttactctcctacggtcattccaaaaccaaacttgtagttcttctttgaatggtcaatctgcaccacataacataagttcacaaaagtcactaatctgaaaaactcacttcttgttaacaaaaaatatatacttcatctggtcatgagaacatttgttttggtcatgggggactatgtagacttattcctataaaattatttagattggatgtataaaaactatatgttagatttatctcaagcgttacttaggctgcctttgagccagggacaaagagagaagatttctcttgttctccgcgtgcacgcttcctgaactattaaacggtgtatttttttaaaaaaaaaatctataggaaagttattttaaaaaatcatattaatccatttttgaagtttaaaataattaatacttaactaatcatacgctaatgactcatctcgttttacgtatcttctcaatcttctcctttctcctctcaaacactcccttaatatagtattataagtttatctggtttttcgaacattttgtaatagaaattatagttcaaagttgcgaatatgatacttttatgatcagagggagtataaatacagtggtaagaatagagcaggttagcctgaactgtaatacaactaatacctctgcagaaagaagaaaattaactcccatgttcaatctctcttccaaatatgcagcaacaacaccatttgagtcaaattttccccttagtcggcactgcagtaaaattcattgataaattcaaaactactaaacggaaatatcagaaaacaaggaactgcaggagcaagagtacacagctttgtactattcacagatacccatatacacaaacaggtccatgaagagatgcaaaactggataagctcaagaaagaatacattgctacttgctatttgatagaaacactaacctgcctaagcatatagtcataaccaaagctggaagtaacgtcccttgacatgtgattatacatgaagtcagacgcaagggaaacctgcataccatatccttacaatcagattaaaataaagtgtgaaacttctgttgaaaataatggtggtcttggtggggccctaccttctcggaaactttctggacatagctcaaggcaactataccagtactggcaacctgtagagtacccacctgcaatggcagtaaacagaaaaatcttgctcagtttacaccctcaaggtagctcaattctctttgtacaaaacaagaggttgtgttaattgttaacaatgtcactaaatctgacaactgagcaatgacgaataacagtgcttttacagtgattggtgaaaggaaaggaccagatcttgctaaggattgttttaccgggaatggtgagtttcattcttaagggcctgctttgataggagtggatttgacccagctcccatcggattggagggaaaacactaaagcatacacaaacctgaaggattggatatattcccccattcttctaatcaagccagcattgttttcagtgacattaggggtactgaacaagtaacttgggggaaagtgcaatccaaaatggaagaatctcagtctgaaaagaggacatcaagtacacatgcaaacaggtatacaggattacagggaatgaaaagctacacagttaaacctcaatcaacttgactatcttacagcccaaaacagttctcaatccaaagatgaattgtggaatcgactactgacaaggtctataagctccttaccattttatctgaattatatcgagaagcaaaaccaattcctgacttcctttggtggccaagccagaatatttcagttcccattgacaagttcggcgtaacactctgaaatgcaaaagttcattgtttcactgtcaagaatagacaagatttaacagtgaagattttaatttcacaactgtacttgtgctagataaagaaaattttaactccacaaccatatttgtgcaggtaatttaccataaatataaaccagaaattggtttagtcaggattaacatgtatctgcccactaaactacaaggcaactcaatatgaaccgtgaagcctatatgatccaaatcccaaacaaggtgtacaagaggcaattgtaaattgtgaaccataattgcatagcagcatattgaatgcacaaatgtcagttctgacatgatatttccaaattgatatcaaacgtaatacctcaacttttgtctgtaaccaaatggtatagtttatttccagtcgtaatataaaaggcagaggaaggcgcaaatgaatcaatacagaaaataaacaggccaataagcataaccacaatatcacaaattcaagacaacgagatattaaaccatctttcctgcagaatctaaacaatcaatgaataaacgaacaactaaggagaagcttacatatcatcatttttcttttcagtttacctaaagtcctgaagatgacaatgtgaggcttttaaagataaatgcacgtctgcaagtaaaggtgcttacctgaatataatttgccccatagaacgcattatttccaatttgaaattgagctcggtagtctgtcccctacacagatttgtgaattgtaagaggactacagatatcagatggaagcaatcaaaattaaaaagtagttttctaataagtaattctcacagattattgaaattcacttattggtcaaagaagtgtagtctgaaatactgaccttgtagtcaaagttaaacattccttgggagtaatgcggctcatgagtaagctggggaatgagatttcaaaagccaaataaagaaaaatatcagtcatcacacataagattaaccacaacattcaaattcaggtacctgtgcatttattttcagagtaagatcatctgtcagatcacatttcacacgagcattcagtcttccatctgtcatcacccttcctacaagaattaactgtagacaattccatttcaaaatcacaagttacaaaatacactatgcaaaaaattcataatattcaattccatacagacaaacctttggatctataaaattggcaccgaattcgtaatgtgatgttggaacttttatagtttcagttgactgagatggaacttctaaggaacccataaaaacactgttgatgttgtcagaataaattgcccaaaagaaagtgaaacacatatcaacattatctgtttcccttacctgtggctgagtgagaacttctgatttaatcctttagtgaagtcaaacctcaatccttcaaaaagttcaggtttcaacgacactgaaaatggagaatgtcagcaaactcacaaaagaaatgttcaagagccaaaattcagatagaaaatagcatgtatgcaacaacagatcaaatcgcacaatcagtcctttcaagtttaacactgcaatgagggtagggtaactcatgcagaatgttaaggtgtaactaagattggtgaaaggtattacaaggatggagctatgtttgcagaagctaatgtttatatggtatacatactaagcaatcaaactttagaaggaaactgtgcacgtgagtgtggccacagtgcaatttcttctgtgattgttcgtcattatttaggttcaaatgtaaggagttgaaggcattttcagacaaatatatgtgcacgattatggtggtctgaatgtaagaaactgtagatacattaaaggttttttaccttacactacgctaactatgtttaatcacctaattataaatttgtaatatcctcctttattattcattagacacacaggtttgataaactcataaacattaggaacagccatacagtacttaataagtcattggccattaggtcacttgaaaaaacaggaaagactcaacagcaagaattaaaaaaaaaaagttaaccctgcccctttctaaagcctgaattgcacattgtagcatgacaaggttgctccactcagaagtcggaacaatattgggactagggtagtggcacatggctctgagttctggtagtatgggaggatactaccatagtaccatgtgcaaaaagatattactgcaacactagaaagtgtagtttgcacaaatatcgcatggactaggatttgttgagtgcaatgcaccagtagttaatgtaatctacgtatattacaaatgaatagagaacagtgattccaaatgcctcgagattccagagtaaaacatgctattcacaaattttagacgacaaatgaatcgccaaacaaattctaggactcacaactgaaacaaccaacaaagcactgaagaactacacatttcagattcaacagcaatttggaccaatggaccaccgaacagcatcaagcaaatcagttcgcgaccgagcaacctactataccaccactctatcactaaccacgagataatacgcatcattatgaaacaattcgccaatgccgcagcaattcacacgcggtagcagtcaaaaaatagctaaacaagcgaaggagcggcaaggatgggggcacgaactgagggcctcgcgctggatctcctcgaagggcacggggcaggggaggttgaggtagtccaccttctccacctccttcttcttcccctcctcctcgccgtccggcttcggcgggaggatccccgcgaggccggccccgtacggcggcgcggccatgtggggctgcgctgtgggcggcgggggaggcgcggcggcggaggcggccgaacccatggcggcgaaaaccctagatgtcgggggaggttctggatgggcttttgggtgagggggagcgagcgaggcgtgggctctcgtctcccacctcgcgacgcggcggaggtggaatttttcaccgacccccttttgattttcttttttttcttttcctctctcgcttcagaccttcagtcgcttctcctgccgctgcggcgagtgacgctcttttcatgagttctgggagggttcctttcaatgggagaaatgaaaagaaaccctcccaaaactataattaattaattataatgtataatcactgtgtaattagaacagtacaccataattacactatataattatattggatgtgtgcatagcaaaataagattggtatgtactagctcattatggctgcatggccttaaccataagattgtgggttcgtttctcatctcttgtgttagcatttcttttttctccgccagattgcatacatttcaaggtgaatagtatgatcaagaaaatcaagtgaaaggctaagtaaatattcggaatgagacatagcaaaagcgttctctattttcatggtttgttctctatttccatggtttgatttttggcagaattgcgtaaaccaccttaattatcattataattttaagtttcttacccataacctgttttattgtaaaagcccgcccacccacccaatattagcgcgcctgggtagttcatttagcatatttcttccaatgtagatccgttgccaattgtcttttgtgcttagcgctctcgctgttctcagttgtcttctcgcttcaaactagcctgagaacaagctcgagtcgagttcacctcatagtcacgctaaacgagcctgacctgattattatgatctgctgtgaattcatgtcaaaaaaaaaatataattattatttattttattttgagttattttatcactataagtactttaaacatgatttatatattatatatttacagaaaattttcaaataagatggatgatagttaacgacgttatctattaagcaacggtgggagcatgcactagctctttccttcgagtaactaataaagtataaaggggtggtgccaaaacttggaggctagacccacactatagatggccaaatgggccgcccggcctggcacggcccaggcacgactgggcctaggccgaggctacttgggccgtgcctacccatgggctgcacccccccagcccaggcacggcccaacaagactcgggccatgccggaccagcccaaaggcacgataacgcgccgtgcttctctattaaataagtctattttttccctcatctctttgggctatgtcttatatggttggaataagtctatttttcgtccctcatatctttgggttgggtcttatatggctagaataagtctattttataaacctcgtgtctttgggctatacctcaaatagccgaattaagtctatgatgggtccctcaactattttctttggtcgtgtcgggctgtgtcggcccacggtgccaagggagcagcccaggcacagccccgctgtcagcgaaattgctaatcagcgaatggtcgcgcgccctccccccgcgcggcgcagccacgtggcgcgcgtggagagggggaggggcggcaggagggcacgggaggactcgtgagcgtggttttttttttttttggttttttcgtttctctttcggttttctttggttaattcccggttttgtcgtttccttcgttttttaagtatatacttaacttttgatttttgacctacatacttatacaaagtttgtatacgtgtgtatatattacaaactttgtatatgttgtatacaaagtttatatacgtcatatacaaatacaaactttgcatacgatatatacaaagtagacgtatacaaactttatatacgatgtatacaaactttgtatatgtgtgtatacgcacatatataaagtttgtatacgtgagtatacgtacgtatatatttgtatacacacgtatataaactttgtatatgtcgtatataaagtttgtatacgtcatatagaaatacaaactttatatactatatatacaaagttatacaaagtttgcatatgcacttatacaaagagagaattcactcagtgccactgagttttcaccacttctacaatataccattgactttgtcaagttgaataatatgccatcatgttttcccgaacgtctactgcataccatcacagtccagaagttgttagttgggcatctgttagagctgtaaaaaaacctatttgcccctaactcattgtacatggttttttttttttttgccgatggacatatgaatacatatagataaactgattgaatcatataacagcctatgattgctagcttcacgcgttggtagagacgtagtgatctgttgactttgaaatgggacatatcggaaaaaaataaatgtacataatgaaaaaatatcaaccccatacagttagatataaaacaagtttgaacatggtgcatggcactgagctcatatagatatagaaatgaataccaaaatattttactaaaattagccaaatccatacagtttagtaagacagcataaatatttaattacattagccaaccccatacagtttagagatgaatcacaagggtccatggatcataaggatcagtacatgttcagccatatgcataccaaaatagaagttcaacacatgatctgcaccgcaaaagttacaagcatatagatggggatgacatagatggccacaaatataaaagagaacatcagcgcagttggcggctggttgcggcgacaactgcggaggtggttgcatcagagatggggccggaagcaccaggacgccggcggtggatgcgaggttggcggcttgtcgcggttgcggcagagttggggacggaagcgccaggacgccggtggtggaggcaaggtcagcgggtggtcgccgtgatgctgggggaggtggtcacgtcggaggggatggtagcgccaagatgctgcccgcggggtcgtagtcggcggccggttgcgcccacgatgccgcatagtcggccggccacggcgatggggagcccggcgactggcagcggccgagcgtcgatggggatcccggcgaccggccgccgccgcgcatcgacggggatgctggggaccggccgcgcccgcgcgtcgatggggatcccagcgaccggccgccgccgcgcgtggatggggagccctgcgctcggccacgcgtcgatggggagcccggcgaccggccgccgccgcgcatcgatggagagcccggcgacctgccgccacagcgcgtcgatggggatcactacacttggcggcgcgtagatggggagctaggtggccggcggcgcgtcggggacttgggcggctggccttccatcgagtcgtcgcctcgctgtgggcagatcgatttgggtgtgcagggttagggttttctgtcaacaggtgctagggtttattagtcaagggcattttagtcattaagaaaaaaaatcaatacaccaaacggatgcaccctaacgacttgtggacggcgatggcacgcagtagacgttcggaaaaacacgatggcatattattcaacttgacaaagtcagtggtatgttgtagaagtggtgaaaactcagtggcactgagtggattctctcttatacaaatgtatacgtatgtatacaaagtttgtataagtgtatatattttatacatcaaaagtgagtatgtatatattcaaagtatacatatgtgtatatttatatgtataaatatatatacatagtatagtagtataaggggtagtatagtatactagtactgtagtatataggggaaggctgaaacttaccgtgtggccgcaggcgcgcgcggtcagtcgccgatcagcagtcccctactgtcgggccaggccggcacgggcacgaccgtgtcaggccgtgcagtgcttgggctgggccaaattaccgtgccttgggccaagctgtcgggcctcgggccatatggccatctataacccacacaactggttgccttaccaactgataagtcttcctttgccgtccttgaacatgtaacgagaaagtcacaaatttgacattggcaaatgacatccctttctggacacaaattttggcgaaagttttagattcatcagttctttctagacacatatccatctcaaattctcaactggagcatcaacctcagtctctccttgcgggatacccagtccttcatagcttgtggatgcacacatgcgtcatgaccacgatcctggggccatcatgcttgtgctacactagcaatctacggcttgggtgttgaagagaacaagtcatacatggcgcatcaaacgcacaagagtacaaaccgcggcctccttttcacccgcggcgagttgcagatttgcagtgcccacttgggcttcttctggtcggcacggtttaattttctcccaagaagacaacgacgcctcgagatgcatggcatggcacgatctgatcttactactactcccgggccttcatggaggaagaaattttcaccggcttgatgatttgattttctcaggctgtatacgtgcagaatcagagtcaattaacaccgtgtttagatcccagttttttctttaaacttccaacttttttcatcacattaaactttcctactcacgtaaacttctaactttttcattatattgttccaatttcaaccaaacttctaatttcaacgtgaacaacatagcagcaggtaaatgttccgataaacacaggagtactattgatagtacttttatcgatcggtgcttggtgaatgaaatggctgtgattctttgaatttgtgatgtcgctttccaagggaaccaatggatatgtcagtcatgatccattctacggagtacgtacttggtttaattgcagccatacaagtgcagcagttactgtacattgtacacatcaagaattaaaattgaggcctgacagagtagaaaatggacagcagcgagtcctatttgcgtgatcgatcgaacctttcagccgaataatttgtggctctgaggtagtgtttggg

SEQ ID NO: 72054 - DNA, 2593 bp, Oryza sativa
taagactttctaacattgtgcacattcatataaatgctaatgaatctagacacacatatatacctaaattcattagcatagacatgaatgtaggtaatactagaaagttttactccctctatttcacaatgtaagtcattctagcatttcccacattcaaattgatgtatatgcctagattcattaacatcaatatgaatatgagaaatggtagaatgacttacatcgtgaaacggagaaagtacattataaaacggagggagtaactttgaaagcatgccattgctgcattacttactgacaagttttgggacagtgcttgctttactctgttttgatgttgctgcaaagaatgtttacaccttcatgaatgggtgatttagagcacgatgaatctagcatgcaagattatattactggctgtaaccattggttgatttgctgaatttgttctttcagaatatcatcctagtcgaaggcctgaagctagacgatgtcaaggctggaatctacatgctgcattgcttacctctgaggctggttggatccgagggctcaccaatcaggtgcatcctgatcaagtgattgcttcatcactgctcctgataatggcgacactgcagatcatgccatctgatgctgctacatcctggctgaggccttgagagtgccaaggccagctcagtagaaaaacaataataagtgtaaacgtatatatatcgtttgtttgatcagtaataattcaataaagcacttaaagtaatttttcatgtaaaaatgcagcagatattaggaatgtggtgaaagaaactgacagactagtaatccctttgttctcaaatacgaggcgtattagctttttacatggtctacaatttgaccgtttatttatatcataatatattatcaactaatgcggaattaacatcatataaaaatattttttaaatacggatctaataacgctacatgtatgacgtcaaacctatgttactaatttaattattagtaaaaaaattcaatgttaaactttccaaaaaataagagtattttataactgatggtgtaacagttattgagctggtttagtacctatctctactattataaaaattgaagatgtttccgcggtccgtcatcatgtttgagtcggttttaattttatgttttagttttaatctatatttcttctctactattataaaaattgaaaatgtttttaccggtattttggtacgtcatccgtatatgagttggtttttaagttcgtttgcttttggaaatacatatccgtatttgagtcggtttctaagatcgttcacttttggtaatacagaaggaatcatataataaatctgtttaaaaaactcgcatgctaacttgagatgatcggattcctaaccacagctcatgattttctatatatatatatatatatatatatatatatatatatatatatatatatatatatatatatccaaacgaactcctacagtaaatttcgtcttaactaaaccatataataataataagattaaaatagttttcacccgttgcaacgcacgggtatttttttctagttaagtataagagtcaaagattagtgttatcattggttacggcatggtacgggacttattgtcgaggtctagtaatgaaaactgcttgatatatcaaacaactttactactgtatttctcttttcaatacagctcgaatcttaataaaaacatacaaaatgactcaggatgtaagtgcacatgcatttgcagcgtcaaattcctcttcaactctacaaatacacacacattattactgacgagagtggaacatacagattaatattaataagaggaattgcacaatggactaggctttttttttctttaccacagttgaataatgggccatatatttacttcatgttttcacttaggactaggttttctcacactttattctcattggactagtttagacttggatctttttttctcatcgatgctgtccatccacaactcgaagcttgaccatgaccatatgcaattgagtctcttggtggcatcctacaggactttgcgtaacaccacattcaccttaggagaatgggcataaggtatagggctgacggataggccggccgacaacgatcatctcgagccacgggttcaaagtgtcaagtttggtaacaaaccatgattcaacgcaaatggttttctaaaaactagtctaatatgctacttagataataaaacatgacccagagtgaaatttggtcataataatatactccctccatcctaaaatataagcatttttactatagtgacgagtcaaacgtttttaactttatctattaatagaaaaaaaatattaatcacgtaaaattgatattattagatttatcattagacaaactataataatatgtaactctttttatttaaaacatcttacttttatagatattgttggtcaaagtagtatcacaaaaaccgtgtcacagtccaaaatgcttatattgtgggacggatggagtaaatgtaaacttatatatgttgtcggtcagcaaaattccaataaagcaaaa

SEQ ID NO: 72055 - DNA, 1162 bp, Oryza sativa
catcaggtggtgcaggctcccaatgaccggcagccgccacggccccggcggaagcctcggccggccggcgccattgccgcgcgcccgccttgccaccctgagcagcaggagaggggccacgacgagagccaagaagatgctcaggtactcggcgacatcttgcgccatgggcgccatggccgtgcaagctaggtgttcgatcactttaaggccaagctggagtgtagaatttgtacttcatataaagaagctgaaacaatgccaaaaaaaagaacgaaaaaacaaacatacaatgcagtttttgatgctgaagccagcaatttccactatcagtggagtgagatcattacttggattaatcacccaaatctgctggatatgcattatctagaaatgcatcagcagatcagaagagacaattcaaggttgtactattgctgtcaccagcttcagttacaagtgcagcatccaagcttttctttttcttttctttttttttgaattagcatccagctttcgatcgtcatcaacacctgcaatttcagctctagccatttcacggccggcccaaaacggaggcaaaatggcccacgtgggcccaaaagaacagcccatttttccctgggcccaaagaagggcccggttgcgttctgtgggccccgaagaaggtcacgatgtggcccacagatttgtgttcagccgtgaacaataatgctcacggtctttccactgaattcagtagtcaactttacagctgtcatgtcaccagagtgtgctgatcaagtaatttactttatccgtcccaaaacataagatacattattataattattatattagacacgtcctaatacgataaatttgaacagacgtgctcagatttgtttctattcgattctatctttatattttagttatattatgtatagattttagaacagaggtagtacattttttttgtccgatacaaataatgacattactcatggtattattgcctactttaatcactccaactgaatgcattagcttgcagggcatcatgaacagacaattcaagaattctactaccgctgccatcagcttcggtagttcagttacaaagtgcaacagtaatcttccaggttgtctttgtcatcaatggcagcattttcggttacat

SEQ ID NO: 72056 - DNA, 28883 bp, Oryza sativa
  unsure (1)..(28883): unsure at all n locations
ccatattttggaactaaacacgtgcgtgtttagattccaacttttttcttcaaacttccaatttttcagttacatcgaactttcctacacacataaacttttaatttttccgtcacatcgtttcaatttcttcaaactttcaattttagcgtggaactaaacacagccatacacaaccgagatcggtaagctacagtataactcaatcaaacactaatttcgttttttttcttctcttgcgtggagttggattggatggggggtacagcgcagtacagtaccggcccggtgtcggtgcggtgggaggccgttaaagccatcgccagcctgtccctgcctcccagatccacgtcccctttcgccctgccatgattccccctcctcctctgacttcctttctccacactcacacactctcgctttccttgcgccttcgtcgttttcctctccccgcatacgcgtcgacgcacagcagcagtagcagtatgagtgcctgggtgtggggcccacaggtggttgtgtacgatagcagtacactacaccctctcttccaaaatacgtaggtttatttgtgggctcgatcattaatatcgataattactatttatgttttatcatctggtactaatcatataaaagttttacataatatcgataattaaatattgaatacagacgattataaataaatttattttgggaaggagcaatagagaacgtatagatcgacggggagacacctgcgctgcgggtagtgctgagctgtgcccataaactgccgcgccatgcgtccctcccctccccacgaaatcgcgccggtttttatctaccagccacgattttgcgctccagcctggcgcccctgtcgttttccgcacgggctaacgatacacccttctcctatcgctgccaggtggggtcggtgtcgtgctggggcccacgcgtcagtggcgttgggtcttcccgtcggcgcggggggtgtgtgggcgagcaaactgccggtcgtacagtccggcttgtacacacacggtacgggcggggcccggcggcgggttggacggttgcgattgaattcggcggggtgatggggggatgggctccggcgcgggctacgccttcggctttcgcgattgcaaccaaacaaaccccaacccccgtcgccttcccaaatgcccacttccaacaccaagggggatggatggatggatggatgcactcatgcacgcttgcatgcatggctggatagatggatgataggtcgatctatcatccacccgagttttctccttcccaacctagcggatggataagctcgtcgtcgttgtcgccaccgccgctctcttttcacattctctttgcaaaatatctatactgtttttattttaaaatacaataatttagtatgagatgtaatacatttagtgctgtgaatctaaagacagtgatgaaaaagaaaattagcataacgaaaatataaatatgaagtactttctccgtttcagattataagactttctaacattgataacattcactttctgtgaatgttatcaatgttagaaagtcttataatatgaaacggaggaagtatgtacgaaatccggttttaaaatgtaaactagtatgatggcccgcgcagattgcgcggctagcatcattatattttctctcatataatagcatatatgttttctcattatattattcaaatatattaaaatgataacataattttaatttttgcaataactttacaaaactactaatgtgtaatattcatattatattttatatacctgttagttattaattatttttaatatcaaattttagttatttgtaaattatatattcctatatagactttagactcgtcttttaatatttcatttttttaatttcgcattttctgtaaattgtatttctatatagactctatgcttttcttccagtattatttaattttatttctgaatttttattatttctaattgtatttatatgtggactctaaactcatctttcaatattctttaatttttagtttcgaatttcagttacttctaaattgtattcctatattgactttaaactcttcttcccatgtttttcttaatttcgaattttagttatttgtaaattgtatttttatacggactctaaactctacttttaattttattatgttcattccaaattttagttagttttaaattcctatacgtactctatactctatttctaatattccttatttttaattccgaatttcagttattttctaattgtatttctatatggactctatactctacttctaatattccttatttttaattccgaatttcagttatttcctaattatatttctatatggacttagtctcctcttctaatattccttattttttttaattccgaatttgagctatttctaaattgtatttctatatggactctagttttctcttctaatgttacttattttttaattccgaattttaactatttctaaattgtatttctatatggactctgttttttctttttctccgattaatgtaagaatttctaggccatgagaacgaacgtgggagctactttttctattactttaataatataatagattttgttggcagctcatgagtagtaaaattattttggcactataaactgaaaaataaaatggatggagacaccgttctcgtcttgggttaaccgctccaacactttcataattgagttttcaacggattttattttttttcctctctgtgtgtgtttgactgtacggaatgagaaggattattcaaatttcaaacggcacagggacccgccggcccccgtgtaacaaaccaaaccaaaacggccttcgtccacactactccagctcgaggaggaccgcgtggagctccctgacacgtgggacccaccaaacctcttgtccccacccgccatccaggtaccgaaaatgacgcgcctcgccagctgtatgccaccgtctccttccccccaccgcctatataatcccctctccctcttcctctcgccatcgagtccgacacgtccacatcgccattagagcagctcgaggaaggaggaggaggaggttgattcgatggggatggaggcggagtgcgataggataaaggggccatggagccctgaggaggacgaggcgctgcggcggctggtggagcggcacggggcgaggaactggacggcgatcgggagggggatcccggggaggtcggggaagtcgtgcaggctgcggtggtgcaaccagctgtcgccgcaggtggagcgccgcccgttcacggcggaggaggacgccgcgatactccgggcgcacgcccgcctcggcaaccgctgggccgccatcgcgcgcctcctccccggccgcaccgacaacgccgtcaagaaccactggaactcctccctcaagcgcaagctcgccaccgccacggacggcggcgagatcgaccggccgtgtaagcgcgtgagccccgggccggggagcccgacgggatcggagcgcagcgagctcagccacggcggctgcggaagcggaagcggcggcgggcaggtgttccgccccgtgccgcgccccggcggcttcgacgccatcagcgcggcggacgtcgtgcggccgccgcggcggcgggacgacaacgacgacgacggcgacgacgacccgctcacctcgctgtccctctccctctccctcccggggttccaccacgacagcgcgcggagccacttccaggagctcccctccccctcccgctccccttcgccgccgccgtcgccgccggcagcatctccatccgcatacccgttcaacgccgatctcgtctccgcgatgcaggagatgatccgcacggaagtccgcaactacatggccggcgtcgggctccgcgccggctgcggcccgggcgccgtggccgagtccttcatgccgcagctcgtcgacggcgtcatgcgcgccgccgccgagagggtcggcgtcgtgacccgccaataaaaccccccaaaaataaaaaaaaaatcaaccatcccggttcaaattcaccacaaatgcacggtgaaaaaccacctgttaattatgagatctgtgtagtattattagcactagaattttcctggttcatctttgtattttactttgagtaaaattcttctgctgctctgaaacagagcagcggtgaaggggaggtaaaaaaaaaatcagaagcgaaatgctagtgcattgctactaccagcacagcagcagcatcacggacaggttggccgttttctgtacaggaacgaggtgatggtgagatgtagcgacaggtttctccttccctttgaaccgtccgtgcaacgaagagtcgaagactacttgggcatcgatcagatgtgcgagttgaaagtgatagtagtagcagcatgctgtactagcagtacgcatattggacatttcagagcatctaacttttaaatgtggcaattaaggatttaccaaccacaatctataacatatgggtaatctttaattgccactttaaatagttaaatatttttattttggagctatatggccgtactcgagctgtaaataaccgatgatcttttctttttggaaaaaaaaaagcctttgtttcgaatgtataggaattttctgagaatctgaaagtacttatattcctcagaaccgtaagaacttgtttcttattggccgctttgcgtcgtttaaccgttgggcatttgtctctatcaactctatgtgcgtatagaatggatggattccgatctcattgtctctttccatcagtctatgtgtcacgtgtgtagagaatgatgaattgatttatactccgagtagaactcttttgctaagctaattcattcctattcccaaagaaaatgggcgtatgagtctcatagtaatacgagacaattcaatgcccaaaggaaattgatttctactgtagtgagctgtactgtccagcaaaacggttgtgtactgttgaccattcgaatcgatcgttggtgcagcgcacggtacaacgaagtaattcggccgcagcggccagaggagcagggagccaatatgagctggctcgtagtaaatcgagtgcaggacgagtagtagtaggagtgagctgtgacagttcacggttggcggtatttataccagcaagtgatgaagctagctgtacacagctgacctgaccagctgctccccccaaacatccctttcctgtgcagaacagtagcttaaaggattcctgacactgttgctgcagcagcagcagcagcactactagtagtagtactactagcaagttaattgcaaatctgcaatttgttcagcagcttgaaagcagatgcttgtttgttgaggccgtttttgccggtgatggttggtagtctggtgtctctgcaggaggcaacataggcctcggtaattctcacccatcgacagttcaggcccggcccaaattggccagatgagcccactgatcttaagcccaatgcaagtgaaacgcaagcatgattttgatcggaaatgcaaaatggtccatatattgcgaggccgaatttataccggaaaggcacacggacgttacatggacaagtcgtcagagtctcacacaaacaagttcaagaacggatcatacggatgctgccatgagggtgcacggcggcgatcaggcgggcggcgcgtcggcgtcgtcgatgttgctgccggcgacgtcgacgacgaagcggtagcggacgtcgttgcgctcgaggcgctcgagggcctggttgacgtagtccatcttgacgacctcgatctgggaggtgagccccttgtcgacgcagaagttgagcacctcctccgtctcggccatgctcccgatgaagctgccggtgatggccttccggccgagcatcaccatgggcgagatgaagctcagcggctggttgatcacccccatcaggatcagcttcccgtccagcttcagcagcgccaggtacggctccagcgggtggtgcaccggcacggtgtcgatgatgtagtccagcgagtcgccggcggccgccatcgccgccgcgtcggagctgacgaggtaggcgtcggcgcccaggtcgtccatggcctcgccgcgcttcctcgccgacgagctgatcaccgtcacgtggtgccccatcgacttggccaccttcacgcccatgtgccccacgccgccgagccccaggacgccgccgcggagacctggcgacatcagcccgaagtgcttcagtgggctgtacaccgtcagcccggcgcacagcagcggcgccgcctgctccggcgctagccccgccgggatcttcaccacaaacctgcacacaaattcattactttttttactagtttcttaccatctcactaaccaaatattttaatctttttaagacgtgacaactttcagattaggcaggtggatcaaaaatcacgggatgttttggtttgatgccagaatttgccctatcaaatagttggcactttaaatagtaccatgtatatgtttgtaatgatgtcaaaatttaccaaaggtaatacaactcttagagcaggtacaatagcaggctaatagcctgcttacctaatattttaacatatatgatagagagagggaaagcagagagagcaaagcggacgacaatccagtcaccggctcaagcacgagcgcctaggcgctctggccccctgcagctcgggacaaccaatcgaaaattagaacttgaacatgcagaagttaccaacacctgacaggatgccttggttaaagcatgggtgtagccaattactgtatctaccattgtttagttatctcttaaataatgtggtgaattttggagccggcagttaactttactattgaacttgctcttataaaccaactatactaaaatattggtagtgccaaatcttgaccatgatttgacgctaccaatgatttggtagcgcaccaaacaaaatgagcccaacatttcactgtctctgctagtttaccaactgactacaacgacgctatgcaacaatccaacttttgctctgttcaagaagcaattcttccaacaacaaatggactaatggaccggggtaggtgaggacttatcagttaatcaacactttatacctaactttggtgacttctcactttacactcaacacagtaccgacttctcgacatctctttcagtctcagatgacattttctccacaaaattttctaacagactggactttactttggatgttcggaaaagtccagtctagttttctctacctagaacactgacaatatgataatatgataatgatatcgtgatcagttggttggtgattacttgttggagtaaagctgtgtttagcactcacttctggtcgacgaccatggcggaggcgaagccgccctgggttggccggccgtcggtgtagacgtcgttgtaggaccaaatcctcttgttgcagtactgctccacattggccttgcacggatggcactcgcggcagcagccgacgatgacgccgacgccgacgacgtcgccggcgctgtacttggtcacctccggcccgacctccaccacctcgccgaccacctcatggctgcagacgagaagaggagagaattttcttggtcaccgacaaaatccaacacatgactgaatattggtacgacaatggaagtgtactggaaaaaggaattcttggtcaccaactaattaatccaaccaattattgttgcatacttagtacgacatgcagatggtgtagtagtactaaattactactaattaggcatcatttttcagcctggtgttggggatctatcgtgtgcttatttaaagcccatcagatcagggaaggttctcgctgaggttttctttacacgtgtctctgaaactgatggtgcatctaatctgtactatacctgtcatgaaaggtgttgatcaaaaaagaaaaatgctaaaagcgatgcactaacttatctttctgttccaaaggagtgtgatatagtggtgcatgtgcatctatgccttttgtaaatctgaaaaaagcactgaccagatttgctagttactagtgcctactcttttctgatatgtttgttatcccaatcagttaataagtttatcttcagtctactatagaatacaccatcaaatcaattgctagtagaagatctccattgacatgagccatgatccatctagataactgtgaataatcttacccagggaccatggggtacttggaagcaccaaggtggttcttggcctggtggatgtcagtatggcagataccacaatacaaaaccttcaccaccacatcttcaggcccagtcttcctggtaccaccacatacaggaaaaaaaaagaacattagttgatctgttgcataagatgcttcttcagttattccattctacaagaagacaactcaaggaaattattgatatatatataatcctccttttctttaaggaggcatggcacgagaattgcatagcaaatatatatattagaaaattataaagaatgcttctgaaaatatatatatgtggagccaggcaactagccaaaaagaactccatgcattctgtctgtttgccacaactgctccggattcagggattctgttcctttcacccaacaaaaccaagacgtgacgatgattgcaatagccaattggcggtaggtgaagcagttttggtagtacactagtactacaccactatactcttcatgttggacttatactaggagaggagcaggaatacaaaatagagtcaaactcacgtgggaagtgtggaatggatcgaatggaggagcccaaaaaagaaaaaagaaatccaattgctctcttcacctcttcacactttggccaagaggcagaaacaatctgagttgtactcgaggcagatgacatgaacacaaacaaattaaaacacgggggcatctaaacaactaaagcactggaacgccatcagttttcagaaattcagaaacgaaccatctgaacaactaaactgtagtagaacgcatgtaccagagtttcagaattgagacaaaagagaaactaaaacctaatccctccgtttctaccgaccttaagcaaaacttgcaagaacaagatcgagaaggagagggtgatcgatcatatcatatcatacctgagggtgtagttgtagggggtgaggtggccggaggcgtccctggcggcccacccggtgacggtcttctcggcggcgaggctgcccatcgtctctggacacgaacacgcgacgcacgaggcggcggcggcggcggcggccaatggatggatcggattcgggaggaggaagagaacaagaacaagaagtgcagtggctgattcgctctctctcgctgaattctggagagggggtggtgcgtcccgcagcgagtatatataattaaaggaaaacatcgcgttggacgggtcgtgactgagagggggaagaggggttggtgaaggctggctgcctcggagatcgtgccaggatcttctgtggccacacggcctcaatttgattcgtttttgtttttttttttgttttcgtgcaagacagtttttaaattgaaggggaaagtgccaaagtgggtatcgaaatgggaacaaaaatgttagtagtaggacaagtagtggaaatgtttggtcgcgtaggttttcctaccaaggttgggaagtggttaattagctggtgcgtacgagtatggatggagtagctatatcagctccttcataatgttttattccctcattattaatgttaaaatgattaattacctattcaactactttatccgtatcaaaatatagtaagctatcatactgggttagataccatttagtaccataaattcgtaattcgtagtactgaaacatgtcctggttcgtagtctattaagtggtgtctaattgactttatctagattcgtagtactgaataagatttaatcgagtactcggttattacgttcactatccttttcatatttggattctgtcgacatttgatgtcgcgattccggtatttgcatagtatggggatctttgatactaggatatacgcgagacttaggtaaaagagacggaaacagatttttatacaggttcgggcccctgaattgtcaggtaatagccctacaacctgttggccgaagccggtcgttgctcttattcaccataatcacaccagtacaaatattggggtagcctatctaactgttgtcgacatggcggtctgaagttcttactcatagtcgacaacagggtagccttcctcctcgaatccgcatccaacgagatcagagacagcgctatatctctcctaacagtagccataggtacctaggggactagctatgcctatctctgaagtcgatatctggcatcttgtcttggcgtatattggcttgtatgttgatcttctgtcttgatctattgttccgtgtcccctctcctcctaggaggccttgtatttatacccataggtgtccccttgtccaagtagaactagggaaaccaatatggatacaatccgagtagttcttgtcgtttccatgtagaactttggttgttttttcttatccggaactcccttcatatccgaagtcagttcccgtataagacatggtatgtggtgggtcatgccgagatttagtcaactactattaggtatgtggtatccataaccctaacagattccctttatacaaaagcatggatatactctatatagaggtgcaatttaatttagattttttgagcagattatcaatttgactacaaaataaactatattttgtaaaagtaactttacaaatagcttaaacaagttgtatacaaagcatatttttcagaacacggagcaaataattcgatttaataatctgattaataagcagaaaagaacataaccttgttaccatagggtaaactcctataaaataaaaacaatatcatatttattaatagggtgtaaccaaataagtcgccctacaccatttgtatgcttgactattactcctgatattatctccgtgctattagtctcaaccttatatagtgagctacaggacaaaaataaaatacagattgagtcacaaatctctctcttgctcacacctacaaatcgaaaattcaaaatgctcgaaagtcagaacaaacataaccatgaaaaagcgactttagttagtagcttgactacttcccctctaaactgtcacacctatcgtggattagtcgtggatttatggatgattttgcagtgattaattttacctcacaaacagtagccatcatgtccttgtagaagatctcgtttggagaaaaggaggaggcacgcaaggcacgcgtgcttcgcatgcgaagcgaggtgacgtggcactgtgccagtggctgagtggactaaccgggaggggagaaaagttgcagagaacgactccggggttggtggccgggcccatcgcggtaggtgggtggggcccacttgccatgtctggtgacgtcacggatacgtcatctgaacggctgtctgtgaagagagagactgggacatgccaaccttcaacagcacgagtggttcatggtcaactgaggatgatagaaaaagagaggataaaattaagctttgatttttattattatagtactagtacttatcatttgcgtatgttcccaaaaaataaatgttaaaatttcctcttgaatgaatgctaaggggttgttcagatgataatattgctaaaattttggcatgatttcttatgtattaaccaaatttgacaacaatttaaacgtatgtttttttttgacaactttgctaaaaaatagtatggttgaaaatggcatcaaagtaaatatgccctaaattttcatatgaatgacgagtgatttttttaaaaatattttgaaacgaggcgagtgaattggtttataggcacaaattgtggcacttggtgacgaaacaatttactaaaccaagcatttttgttttaatttgttgccgcgtgtatagcagttttcgtagtgatacaatcatacaaaagttgccttttgtgagggactatcagttgtgacagcaaatacgatatgatttcaacttcatatagtgttccacatttgatattaaaacatcaatttcggtttctggttttcagtggtgacacgttgtttgtatgcttgtggttgctacttgtgtacttacaagaaaaaaatttagacttacaaatttgcaagttgcaaccacaccaaaatctcaaaaaataaagaatcataagcacccaaaactgatagctacacatatgtgccggtatggattaattgtcgatgcttgggatcgttggatgcaacatacaactctgttctggtgaaaggtcaatttcagatcgtaacatatatcatatcgccaactaattcggccattctttgcacaccacagctagtttaatcgatcaatttgagtcgcacagctagctgcatacgagccatttcgctcttatccaagtagatatggaagaagatgcttatcttaggtagttcatggttcatggagatttgttgctagctaagtcaaggatgtgatcactatcataatcatatcaagtaggagtaacgataaatatattaagaaatccgctctaattatacctccgagcccatatatgccaccaactcgacattgctaataatgagaaggggtaggagatgccgatggacggtggcctaggcgcaaatagagagagggcgagccaaaggataacaataaaagcctattgggagtttagtggggcttctccccctccctcggtttaggagagtttttttcatagcaatcattttttacttttgtttttcctttttctttgttccctatccccggcaatggccttcggctgttgcgttgtaaaaatcaattttttcttcttctaatatagtagcgtgcaattcttttacgcgttcgtgaaaaaggacaacggcagcgtgagcctcctcccaactataccctcatcacataacctatcattattggcatcgttgtgccacctcctcgatcgagctctagcatcagttcgagttgtgatgaacaaaaactttcatgactccatcccccaatccctgcgtcctcatctacaaaggatgtactccatacattcaaaaaaaaccaatcctagatttaaatctggatatacatgtgtatatgtgtccaggtttaattttagaattaagtattttttttagcggacggagtagttgacgagcccacgaaggacactagtggatcggcgagcttgttggagagcttgataatggccttgagcactcatggtcgtggaggtccatcccttctcttaagcagtgccacatggcaggtcgcatgctggggagggaggagatggtaaatgaagcatgacaagtaagaagcatgtatgttttttgaaaatttattttctcaacttgttaactggattagcatgaggccaaaccaccgtcaaatgtgcgtatataggactgataccgccttaagataggtttgagtggggagggactagggtaaattcatccggtttgaagagtttccgtatataaaatgtttttgtctttcatttgtggggcatcaattggactagggcaaaagttaacgaagttatggaacctcttttaccatataaaaaagtattcacttggtaagcacggaagaaaaaaagtttgtcttaccttggtacggttattgaatgctaggtatatatgactccatccattaacattacgatatccatatgtattatagtctcttttattttcttttttttttcagaatgacaagtgcgtcggatcgcaggccaatagctcaatagcaaatttagatcataataacaaggattaagttcacttcagatccctcaatttgtcgcctagtccgatattcatccctgaattgcaataccatatatgatgtgtctctcaactcctaaaactagtgaaaataaaatcccaacaactcctaaaactagtgaaaataaaatcccaagacggtttggacaacggtctcgactgacgtggcacatacatggtgttgatgtggcacttaaaacagaaaaaaaagagattcacatgttaatgagtgtttggttaaaaataacaaaaattgcaatggactcatgccatcactccctccttttcccctattctctccctttcctcctcatcgtcggtgacaacattagtggcagggccggtgaggcgaaggtgcgcgtgagcacgggcgggggcggccgagggcatggagggagttgctcgatgcgacaatgttcttgcgcctggagagctacggcgaggccaaggcatgggtgtggcagaatctctcctacttttgcgccaactacgcgggaggagggtgtcatcacgacaattgggtgtccacggcgcgtgaggccacagagtgcaagcggtggcgactggcggtagcatggagaaggttgtcggcgttgacgcgggaggagggtgtcggtagcgtagtcatgcccttgacgaactcgcggaggtcttcgatgatgccatagtgctcgagctttgcggcgtctggcttcggcgtgacggcggaggggatatgtgggatcgcagggatggaggggacggggaggtcggtagtgaggtgcttgatttggttgactaggaggtcagcctgcttgttggcctccgctgtgatctcctgtgagttggttgtggtctctgagaagatctccttgaacttcttcgccgtctccaacatcattgccaacgagtgcgtggctgcctccgccgtctcccttctcccttactactgctacggctacttggtaccacatggcatgaccgtgccattgacgcccagtcgccacaccagcgccttgctcccatctgtgctaccaagaaaaaaagattgagagaaaaagagagaggggaaggagatgacctgtcactcacaggtgaggtcccccaatatttatatttttatttagaccgagttgtcctgtcatgtgggcctcatgcttgactcaagtcaccgtgtcaactaaaaccgaccactatgctgccgagagaccaaagttaacacggtattaagttgggagacggattatacctgctatttcggttcaggtatgaatttcagactccgcgacaaattgagagacctaaagtgaacttattcctaataacaacccataaacgcctcgttcgagagcgcatgatttaaggtccattcgctgccaaaccaggctaaaccctaaaccctaaaccatacaaatgcccataagcaaggcccatttagaaccatacaaagagaagcccagttacagcatttctaggtccatggaaatagctttgcacctgtgctgattcggttcatgtagcccacaatcttcgatatatgggctgcatgtattgtcaacgttttgcatatgcgcacgatatttttttccctctctctaactctcttccattccccagtcaagacaacaatcacgcctgtcttttgtttcgcaagtaaacgtacggtcctaattaacgattacgatgtgtggtgttcgcttatgcgtcttaattgcgaaaaacctttattttgacgaccttcatggtaatgccattttgttctcttttttttttaaaaaaagaaagtctagcagtgtcactccatatatgcattgaatcatagtagtcatattctgttgcatcatttatatacaaaattccaaatttagaccatatatataactacaaacatgtccaaactaaaatgagagtacagcaagtactaccactatactaaatgttgcgttctgacgtgttgttttttttggcggtttgtctaccgtgaaaaccttttatatcaaagtttctttgaaaattcaaactaaccccctcttaactttataataattaatattcgattaatcatatcataatcatttttcttattttgcatgcaaaacataagctcatcataaactccatatcgaatgcagtctaacacctgtagcagcgtgtagaatttggacattgcaatccaatgaaaacagagcaaaatccgaacgaaattatgaactctgatcgggcccatacatggccgggcgaaacgaaggcagcatggccctccacgagcaaccaagatctggtcactgatgcaacagtagtagtagtagagtaggagagacaatagtacatgtgtttggttacgagtactccgtagtagtccgtactaacacacacatgggtccaattctactgttactgaactggaatactccagctagtggttcaatactgatcacctagcgacagagtaaggtatgggtttatttgtgaggcacatgtaatcagtggcgcccataaggccagcatcatctatatggatccggatccgctacagtcgctactgtgactacaacttattctctccgataaaaaaaaacaaatgtaggactgaatgtgatatatcctaatatgacaaatctagataggtgactgtccacattcgttgttttatgatacatcacattcagaatttgtatttttttatggagggagtaagcgatagcagtgcacatcattggatgtaaatcggaaggtctacattacacattgtactgttcataacactgaagcaaaactactgtttgcaccattactgtaacgtggaatcttgaccgttgataggaaaaacgaacggccaaaattatatgcggtggttaacttgcagttccaactataactgcacttgatatggattcaatcgagatgttccaattataactgcacctgatatgaatccgatctatatgtagctcgtcagtgccaatgttaatatcaactcaactatgatgagtgaatattcatgtgggtagaaagatacatgtatgagttaatgagtagtcgagtatgccatttttaaataaatgacaccggaacccttcaccatcaaacattgtattctcatccttttttcaagagagttataaatagatgaaaagatgttgtaattagcagtcaaaacacgtgtagtaatccacactgtcaaatattttaaaatagagggagtaccatatgcatcaaacaattcaataagccatataatatgaacatgttcatttgacaacccttgaactcttcactttgtttgaaacacatccgaattcaaaagccaggtatttgacaccctccaactttcaaaattattcaatcgaccctctttggtccaaataagttgcatattttttgttgatatggtggttcaataagccaaaacataagataaaaaaggttggccctgcatgttaggtaccacctcatctctcttctccctctctttctttcttgtctcctccccgagcaaatgagattggcaccaatgagcttgagctccaccccccttctcggcgcgttgagtactggcaagcttaacctccaactctgtctcctcaagagccttctcgatcctccataagatcatgatagtgagctcgagcttaagctctccattcctaggcgcctacatctccattagattgcaccgacgtcatttcaagctcctactccctaccgcctctctccaagcttcctttcacattgcctatgtgcacctattctccacacgctgcctcctcctcaagctatgtcgcaccgcaatccacatcgacgccatctcaatgagctccaccgactcgttgtcacacaagctcggtgcaatgattgctcaagcttgagctctaccaccttcgttcttcataagctcgctgtagcagagtttgatctcaagggaggcagagcttgatggactggagtgctcgaggggcttggaagagtcaacatggaggcagttcatcgcctccttccatcgttgcctactcgcactgccttgagcactagatctagaagaagataatctattgcagaggtggatgagaaggagaggtgatcaacaatagtggaggagctatagctcaagctcacctccactgagatcatggggccacaccatgtagattagagggagtaaggtgagagaggaataggaagagaaaatagctaaagtgcactacaagataattgacctaacgtcaccaaattattacaacgaaaaataattcatggcaatatattatactattgcaatgataatttttcagtggcaaataactatattttattgcaacgatttacattcattgttttattcaatatttttgttgcaatagaaaagagctatcgccacaaataacattactgttgcaaaggtatgttctatcgccacaattttaatttttgtgacaatttgcataatacattgttgtgaagttacgtttcactattttttgttgccacgaacaacaaatttgttgtaatgacatgagattcttctctatctctcccccgcttatgtgacatctttgtacaagtgacccaatataccaaaactaggttaaaaccaacgtggtgctagggttgggtggagggggggggggttaatttgtcaattcaacggtagaaagttgcatgatattagatatccggtttcagagttcggagtgcattttaaacaaaccttgatgggtgaaatcttctactcagaactctacaacatcactgattcaccaatgcccccctttaataaaatatggagagaaccaagggaatttttataaagcggatgtgccaaattttcatgtgcagaataatgatttgcatggaaatatccagggatccgatctccacccctagcccagcgttcgactatgttcattgtattttacatgttcataattatagtggggactcactttttaagtacattttgcaatcaatgtgattaattgcagggtcggacatagaataaaaattgactgggggcatgcataactcatattacaagttaattagaaagctaagtgaaactcacaggcatgcataactcatataacaagttagctagaaagctaagtgaaacttcacctcataacaacttataaaaactttgagatattacatgataaaaatcgtccactaactcccctatcagatcatgacaaggatgattagatagagcattgaacctagagagtcatcctcatcacttattgactacacgagagggagatatcattatgtaccgagggagatagagagcagcaggcccgacgtgccacaacttcttcatgggatggagtgcgctgtgcgcaacaacgacgatgatgagcgatcaaggaagtggcgaaggtgaagtgcggcctgtggaagcactacaggtggggcgagatgatgggctcccttgtcttcctgttttctaatccctagtttgtggatttgctagttgggggatcgatagaaggggaacggacgttcgaagcttaaacgcgcacacatttgcgtcacggaaggagcgaaaaaaagggagtggggtccttctttccaattagagtggggcccataggtcatacaattagggacatatctaatgagtgtaactttttactggggtctaaggccccaattggtttgtacgttaaatccgcccctgattaattgtgtcattttctcaagacaaaaaaataaaatggctagtgccgtcttgagcaatagtactcataaaatggaccaccctttgtacagcttaaacctagagtacatgtatatgtatatactactccctccatcccaaaatataacaatttttagccctcaagatttgtctcaaaatataacatcttctccaccaacattttcttcccaatcaatacaactctccaccattcacttttccaacctacctccactactcaaccaatcacaatcctccaccattcacttctacctactttcttaataaccgtgtctaactctaaaaatgtttatattctaggaaggagggagtagtatatgtagattatgcgatctattgacatgagtgctaagcctaacatgatcaccctaatgcggaattcttaggttactgaccgttgtttgaagccattgatgcggttctccctgttcttgtcggtgtagaggtagtagtggtagcagtagcagcgtgagcactggcttgatcccgaaggggtcgccggcgatcacttgcgaggtagtggtggccttccggtcgccacctacactgtccctgaaccaccacacgttctccctccagcgctcaattgatcggatagggttttttttgggattttcggggagaagaaggtcgtgaagagatcgtcatctcaccacgacatcggcctcccctattagtatggcactgagggagatcgggggcaatccaaaatatgaaaagatttggcgctaccgatcaatgcgcgtaatcacgtaattatggaaattgaatcgcattaatcccgtaggcactgggtggaaaacggccatccgagatttcctctcgatttccatgccgagagataaactttcctaacagtatgtagggcttgtttggattagcttctagcaactacaacttctcacaaaatctttaactcctacaaatcatcactcagattttaagaatttgtggttgtaaaatttagaaaataaactagaatcaaaagctaaaaatctcaagttctttggatttttagactaccaactaacaattcaaacttaaactcccaagcagggtcatatactactatatagtatgcatttgagagtagcagcacgccgtaggacccagcagcaactacccatacattgacattagagtattcgacagcttcctaattagtatttaataacgtacgatgaaacaacgacctgattgtttcttggaaataatcgctctttttcttggttggcttggctagctgtttaccgctctctccgtcctattttaaatgtaattataagttaccgtgttcaattttaatcgtttattttatttaatttttttataattagtatttttgttattatgagatgataaaatatgaatagtaatttatacatgacttatgtttttaattttttttagaaaattttaattaagacagacggttaaagttgtgtacggaaaatcataactgtacttaattaaaataggacggaggaagtaaaattaatatatacatgaggtcgtccaagctagcgaccgctaccttgtgattgattgacatgtaataccaatttataggttatttaactaacttataattaatgtttatattgaacatgtatattacaactttacaactcgtatcaacttggtctcgctgtttccactaaaaaaatttgagcagcaccgataagatggttgtgaatcttttctctaattatctgtgagctaagcttgatagctagatagctagataggacaactcgtgattatataaaatttccatatgttagcgtggacctataaccgttcaataagccacttgttttacgtaataaaaaacaaaagccacttgttcgatcctcttgtcgtgaatgcgtgcacaaaactcgccggctgcctggcacattttcacccagttatagttattattgaggactaattgaatgattgtattttgctatggataaaataaatattataatattatataaaataaataaaacatatttttatgaaatgtattgtctataagtttgtataagtttatcgtagtgaatgttcacattaatttgattttatatgccactaatttaattgctttaataataagaagtttaaaggaataatttataaaactataacaggagtgatcgagttgacaaattcactaataacactactaccttcttctaaaacagtatagatatttattttcaaactatgtactaatctgtagctatagagagagtgcatgcctttgatatataaaaagaccatttcttcctcgtgtgtcttacgaagtgcagcagttgagtactgtgaaggtcgaggcaaagttgatgtcccgttgtcctgaagattgtccctttagcaaaatagcaatccaatcagcgttgtcttgttgtcaagcagacaaatttaatcatgtggacaagaagaagagatggtgatgaacaatacggtaggcagccatcaggaaaattaatttattcgtcttatatcagaaaaaaaaagtgagaaagatatctgtggaacaacgatggtgaagatagctctcggactgatcggttaattgatcgttcaggctttattattggtatctctattcctaaaaagataggatatatacttaggctgcgttccttacattgggttgggaacattacccccaagcacgaaaaacggagcagttcattagcacgtgattaattaagtatttgttaatttattttcaaaaatggattaatataattttttaagcaactttcgtatagaaactttttataaaaaacgcatcgtttagccgtttaaaaaacatgcgcgcggaaaacgaggacatgggttggtaaccccttgagccgaacacagccttactaaggaatttagtattaattatgtaaagagaaaaaaggttaatcgttcaggctttattgttggtatctctatttctaaacctaaaaagataggatatatactcgggaaggaatttagtgtcgtttatattaaaaaaaagatatacacttaggaaggaatttaatatcaattattaaaagaggaaaaatggtgagaaaattagtgctaaaggaaatagaagattggccaactggagcaccttgtagttccccaccatcagaccacgatgtcattaccggtatttatggcgaaagtgtatgtaaaacatggctaatgaataagaaataattcctccgattcacgatgtaatactttatagcattgcccagattcattaacatctatatgaatatagacaatgctagaaaatcttataaattacaatatgaaacggagggagtgctacttattgtgcttgctcggcggcgtcgccaggtagggtttacattaccggttgatcactaaatttcgagccccattagtatcacggttttcaataaatttcgatcggttttcgataaatttcaactgaatctactgtttaaccttcgaaattccaatcgaaagttaattccgagccgtgtcgaaacgttgaaatttcacggaattcgaccggttttcgtcggaattgacgctaggtccgttaatatagaagaatttgcatgaatcaaatagttaagaaaaaaaggttattaattttgaatttgcaaaaagaaaagttcatgtacatgatcttgaggacacgcatcccaaaattcatgcggtttgaatctagtctcacatttccgtgtttcttccaaaactgaattcttgtgtgctgggtaggttttgaaatggactgaattgtctatacacgtagcacgtagccatcaaaccttcgtggcccgtacgtctagtatgcaatgaaaatggtaacacgtatatatttttaactcgtggttgaaatttgcaaaccacggcggacaccatcaatctttttctcttttaccattttgcttacgtgtcagcgtgcattgtgtatgcctaactacaaaacgacgaattaaatcaaacaaaatttggacgaaaatgacagcgccactatttttatttactacgacgcttaggtaaaatcaaaccggtggcaaaatacttgtagcaattaattacgccaatggcacagtttgcatataaattgcgagacgaatcttttgagcctaattacgtcattatttgacaataagatgctacagtaaccatttgctaataacggattaattaggtctaatagatttatctcgcagtttacaggcgaaatctgtaatttgttttgttattagtttacgtttaatactttaaatgtgtgtccgtatacgttaaattttattttgccaaaacagctacacaaatcaaacaaaattttgacgaaaatgacagcgccactatttttatttaccacgacgcttgggtaaaatcaaaccggtggcaaaatacttgtacgaagtagcaattaattaaatctgtccctgccgcttacttaataactaaacgctgcgatttatgattccatgcgtgacgtcacgccttagccgctcgcgccttcacctcctccacgaacgcctccacgtggcggtccgacgagccgccggccgccacggccgcccgcgcggcggcgctccacgctgcggcgctggaccgcatcgcgccggcgtcgggccccgccacggcggcgtcgacggcgtcgcgcacggcgccgcgccgcacggcgcgcggaggcggacgcccatcccgagctcgtcgacgaggaacatggcgtcggtgcactggtccccccactgcgggaacgccaccaccggcacccccgcggcgaccgtttccgcgtcgaagttcaaccccagtgcgtgaagaagcacgccacggcggggtggacgagcacttgctcctgggggctccatggcaccaccatgccgcggccggcgacggcgtcgaggaacccctccggcagcagcgcgcggctgtccggccgcaccacccagaggaacggccggccggtggaggcgagcccgtgcgccatctccgccacctcgccggcggacagcaccacgacgctgccgagcgacgcgtacacgacggagcgcggagggtgttcgtccagccacccgacgcagtcgtccgctgccctgatcatgtcgccgcgcaccgcggcgtcgccctccagctcgatcagcgggccgacggggatgagcggcgggcggngcggcgacgtggccacgcgcgtgagcgcgtccgccacgtgccgctccagctcggtgaaggagttgacacacacccacgtccccttgtcgatggtgcggatctgctgctgtatcgcctccgtgaggctcatgtaggggttcgacgggaggaggaaggacggcacgtcggcgaccgacatcgccgggagccccggcagcgtgagccgcgcgtcgaggtcgtcctcgggggggaactcgacgaggccgtggacgcggtggtagtagagcgagaacacggcgcacgactgcacccacagcacggccgacaggatgccggcggnngcggngacnnnnaccgnnnccacgggggattggaaacgggttcccgacgacgcacgccaccggccgccccgccgcctcctgccgcgcgagcagctcggcgaacgccgccggcccggccgtcccgaggtgccgcatcagctcgtcgaggtcgctcccgtcgaagccatcctccaagaactcgaacctgatccggccgccgccgagcggcacgccgtcgccgccgaccgacacgccggacgactccacgagcttggcgccgatggcggacgtcgacgagaacgtcacgacgaggcccttcgccgcgatgcgcttggcgagccggagcatcgggttgacgtggccctgcccggggaagcagatgaggagcaggtgcggcgcgccgccgctcgccgccgccgccgccgccgccgtcaccgtggccgccgcggcttcctcgcccatggctaagcaagctaacttagctagctgcgagctcactattttcttctcgccttttctccgagcagctggcgtgcagtgatcgatctctcgatagctttggtctttgatactgtggcaagtgagatgaggcaaccaaatttataccaaaaatttgtgacttgcagatgaacacgatgacgtctgacgtggcgtcacacatgtaaatacaaggcagcggtttatgggctacctattttattttctttacatttaaaattgaatactatctggtcccgctgtatccaaagataaacgtgagtgtaggggaaaaaaagataattgttaattatcatacaattaaagcttaggccattttgtgtatcaatagtcatgaccctattaaaaacaaatagttcaaattaaagaagatattgtgggtttttttttttggttgtgtatcaatttgtcattaatgtgtgcaatgttagattattgtagttgcaggaatagactacgagtggctagtcactgtctcattgttttggtaaagggacatggcaccaaaaaaataatctactactatagctaagggcccatttgaatcgtaggaatgaaaaaacggaggaataagaaaaatataggattatgataggaatgtaagtgtaaaacagaggattgcaaaacacaggaatgatcgtttgattggaccacaggaaaaacacaggaatcggataagagagatagactcaaaggatttttaccaagaggttggacctcttgctaagtttcctccaaaacctatatgcaacaagccattccataggaattttgtaggatttggaaaacttcaatcctttaaatcaaagagctatataggaaaattttctttagaatttcaatcctatgaaatgtcttcataattcctttgattcaaacgggccctaattaattagatgcacaactgcagcaactgtcaggacatccatgctgttttgctgatattactgtcacattgagctgggtgtttatgatagacattttagaatggatccttaaaattttatcgggttttaaaattaatttgtttaatagaaaaacattttcaccatccaaaataaatatactgccagatacacgcatctgctttcttcacaaaaactgaatttagttttaataaccgtcctaactattccctatgtaaaaaatactctatatatatatatatatatatatatatatatatatatcttatacatattaataaaaataaaaaatatatcttcaactttcttaaactccaatacatttgtcctctaccttctcagatcaacctccaaaatattatctcctactatctcaaacttaatgtattaattgcttttaaaaaaagatcttcatagaacaaatggaggacagaaaaaaataaagtttttttttagggaccaaggaagtactactctataattaagtaactgtcagaagtaaatgcaagccgttcttcttttcactcgaaggagactgcagactattggagtataagggggtgtttacatgcaggggcgaaaagttttaccatgtcacatcagatatacgaacacatatttgaagtattaaatatggtctaataacaaaataaattatagatttcacttgtaacctgcgagacaaaattattaagcctaattaatctatcattagcaaatgtttactgtagcacatcattatcaaatcatagagcaattagacttaaaagattcatctcgcaaattagtcgtaatctatgcaattagttattttttagtctatatttaatacttcatgcaggtgttcaaacgttcgatgtaacagggtgaaaaatttcgagatgggatctaaacaggcctaagtacagcggaaagaagcatgtgcttgtttcccaacttgaaggacctcattaaattcaaatcaagtggtacttcggcggtcatgctatctcggtcaagcgaaagggcacatagttagattgacctgagtaactcctttaaatcctaaatcctaagtttaaatccttatagaaacgaatgtcagctgattagattgtttgatagctaaattatcaattcaaaaggctgtatatatatagttggatatagaaacctatccttctgttaaaaaaaaatctcgttcaaaaaagacttgattttttcttcacatctgacgcataccaaataaaaacaaaaaaaaaattactcatcacactgttagattccaaatttccaatagatttgtcacacactttcttaaactctaatatttttatatttatcccctactatttcaaacttactagtacgtattaattgctttaaaaattaagtaactgtcagaagtaaatataaccctttttttacatgcagactgcaggcatgtgtgagggaatcctttggggaaccggtttctagaagggcgatggagaagctagcaaagttgctattggatccactagtttcggcatgaagagcgacctcacgagctgactgaaaatttgggccgactcgattggctgtggaagaggataaaggatacgtggatgcgagacgccctcttttgtgttctttttagagttaattttagtttgggccaccttttattaccgatgtttcgctttagatcatcttaggactaatgtttttattttggaccgggtatttttacctttgtttcacattggaccaccctcactcttttatccatctacatccaacttgtaatatgtcgaagaaatagtcttacatatagctgtggtagttcattgacgagtagaagacggcgtaatcgagatcgttcatatgcttgagaagagagttgggtggtccaaagtgaaacaaaggtaagtttatccagtacaaagtgaaaatattgcttaaagggtagtccaaagtgaaacataggtaacaaaaggtggctcgaagtgaaatttactcttctttttattttttttcctgtacacagggagtacaccctagaccttaaaaaaagaaccttgctatacgtccgatttatttgttcgaccagtgtacgactaaacggaacagctcggcgcgtgatggcgtgaggcaagagcatgggttggtcatacggacatcgacgccatgcacttgcgtgcgttacagtcgtacaagagtcggacaaagtagtcttgtgtatagcatttttctaaaaaaaattacttcatccatttcaaagtataaaaagtctggacataaatgagatatttcgtaggacttcgaatttggacataaatgttccatccgattgtagatccttatattttaaaatggtggtagtaaatcttagctataaatttaaacatgtgatc

SEQ ID NO: 72057 - DNA, 4978 bp, Oryza sativa
tccgttttgctatttgctcagccagtgcccaatagccagttgctattaattgtactgttcaaaaccataaatttaactaacataatttttttggaaaatgattttttttttctaaagtaggggaacgacaccctagagtgagcttgttttttagtgcttttaatgttctatgtatgacatcactcaccacagtcatcttatatgattatgagttaatcacgatatcttttttatagatcaggagaacatattcttatcatctctgtggctaatctgtatatttatagagaatagagggtttgtccaaattctacatataggaagttatttttattttcagaattacttcttaggattagctgaaatattaatttatttggctgcttcaaagtacgagtctgcctggtgtgtacaaatttacataaaactgaatatgaaggagcacaagtggactaggactgagcatgctaattcaaacaggcatccagggtgaattgtgtggggctgtgggcaaattcagtacataacctgctcgtggcaaattgaggactaagattttgattttgaggtatacgatctgatctcttcacaccttcaattcttaggtgtgtcatgtaagtaccagattaatacgtgatagatggaggtatagtcattgacagtttgccactgaaatggagtcttttgggtgatggcttgcatttgaaaatgcactggtatattataaaaattgcacagaacaagcattgacgtttttcatgtacaaacaagtttaaaaatgttatgcagcttatgttgttttcaagtttagcatatatgtatctaagaaagctatgttgttacttattgtagattgtggagataacatgtaatgttttgatttatgcagcaccatcggtgcctttttggtgtgggctatcaagaccatcgacagcttcctcccttgtccccaccggccatccgctttgcaacgtgatagatattttccttgtattatgacgttcatgaataatgtagtcatgccatatgaagcagttgtgtagtatgtgacctttttggcggttgattgaaaagtaaactgattggatctgggtgactgaataaagtgctttagtattcagcttgatttcatgaagcagactcatcatgaattactatatgttctcccaattgccaaattcagttctatttttcagtgcaaaatttagatttccaaaccttttctcattttcttttcatgccagatcaaagaagtcatatgagatatagattataaacttgaatttagcagatggtgatggatggtctggacatgtaaacgagataaactaccttaccacatcaatcactccgacattagataatgtatactattatagacattagataatgtatactataataaacgagatatagatcaaacattagatggtgatatccgggttagattcttttttatgtctatgcattaattgtgaagttgtacattacgaaatagatttttacgaaagatagaggtcgtgatgttattttactcatgcggctaaagattaacaatataataactcgctgtgtcattcagtttttaaattttaacttgtctcatttaatgcttgattggaaaacaaatatatattctttgaattatttattttgcatttctaaatgctaccgtagcgttagcacggatcaattactagtgtataagatagcaaaacaccatcaaatatttttcaatactggtagtaatttttttaatataccttaagtacaattaaaagctcatatttttacgtgaagaactttgcaagttttgagttctcttaagattggtcttactattgaaattgtacttcttacacatttttttaccaccgtataaagtacactcgatctacggttttgtttagcacacaaattaaccatcttaagttctttttggcgatggatacatcttctaaactggatattatgattttagtttaactaaaattttaataaaataaaacaaaccgtactaaacatgctcatgccattgccacttaccaaaatttaatgacgccgtaatgtacgcaccaccaggggatcagtgatcagggtccattcctgtccctactgctcggagcatctaacaagagtaatagaaatcggagagagacgcgtcagcaagaaatatatatgtgtgtgaggcagatgaatcatgggcaagtaagaaatctctgagatgactgaggccatgtttaaatcccacctcaaaatttttcaccttctcacatagaacgtttaacacctatctgaagtattaaatataggctaaaaaataactaattacacatattacgatgaatttgcgagacgaatcttaagcctaattgctccatgatttgccaaagtggtgttatagtaaacatttgctaatgacagattaattaggcttaataaattcgtctcgcggtttacttatggattctgtaattaattttttattagtatccgaacatcacatgcgacaccctatataatacctgatatgacacgctcaaactttaccaccctggatctcaacacccatgagtggacattgtatcagcgctagcgtgtacctttaaaaacttatttacaaatggagccttgctcaccttatataacttatttacaaaaggctaaaatttggcatggcattggcagtagttgatccaaaaatattttgaaacccggataaacttcactcactactacatatacgattattccatgcgaccaaaattgatttttacatacggaagggtggcccgcatgtgtcaaaaggtatgtgaaaaatccaattttcgcatgcagttaacgcagtcgcatgtgaaaatccgtttcttgcgtacgggcgcttaagtcgaccgcacatgaaaaggaaaaatcgcgaaaaaaaatccgaaaattaaaaactacaccgaaaccctaaccctagaatccactcgccgccaccgccaccatcgtccttgtcctcctcctccagatgctgccgtcgtcgtcctcctcccatatcgctgccgatggatccacacgggagggggcaaccaccagattggggcgggggaggacggctgccaccggatcggggtgggccgggggagggccacggctaacgaattggggcactggaggacggtggaaacctaacaaatccctataacacattatttaaaattgtcttttacatatatcactatatcgattaatctataccgttactataatttagacacacttcgatctaacatgttaaatctccttctttgtcatccacttagaatgtggaggacacattggttgtttgcatgccaaaactgcacacatattaacccaaattaataaaacaggtttgaccttgaaaaatggtttgattagttgcagatggattttttttcttttgagaggatgtccacttgtttgcatatgttgtctaaaaaattatatatttttttaaaaaatggtaagatatatcaatatgtgatatgcatggagttcccattatggtaggacagtttggaagagaaatttggtgcattcacaaattcagatttgaatttggatttgacatatggaaaggtttcaaattaagaagagatttggaaactttttgaatttggggaggagaagatttagggtttgcgggtgattaaaaggatttcgggtaggatttgaaattaaggcactcatttcataatttgaaccacggaatttggaacggaatttaggaataaggggttttggaggattcaaggtaagggattttggagtaccttttggcacttagtcctcctcaatccacgccaaaaatgcaaaccaaaatttggaatatttttatttaaaactagctgggtggcccgtgcaactgcgcggctaacaccgataccaaattatatatttttaatacgattttacttaaaatttattaaatagttatctcattgttttaagactttgaaagaccaaaccttatcatcctcttgtttctaattttatagtttttaaaagtcacaccagttgctatcccttacttctgtcatatccttctttatttgcttgctcgatctatcgctgtttctattcattctctttggaacccttaaaaattggatctaatagtttttagagtttattatcctgttgggtttcgtttttatagaagtcccgtcaaacgctgccattatactccccttcggtcgtccactgtctattctctttattggcattggtattttaaaaatcaaacataattattgtttaggtttattttttactataattattgtttaggtttattttttactttctagaatttccgttaaaacgtcaacgactttgtcactgtactcctctatggctcgttcgctgcctccattctttattgccatcgagattttaaaatcaaacataattataattggtgattatttttttattttttagaagcccgaacctttaaaaatttgaccttatagtctttagagtttattgtctcgttgggttttattttttataaattttaaaataccgttaaacattgccactatacttctctacgacccgtccgccgcctattctttattgtcattgggattctaaaaatcgaacataactatcgttgaaattcaaaatttactttctaaaagtcccaccaaccatcgacggctctgccattgtactcctgtacgatccgcccgtgcctctcatttttattatcattgagattttaaaaattaaatatgattaccattagggtttatttttttacgtttttgaagtcccgccaatcgccttgaccgattgcttcatgacatgcctgtcgtcatttcttttaatccttattagtattctatttggtgttttattaatagtttttagatgtcccatcaaccgccaccactctactcctttataggcatgttacttaattaatctcgtcatgtgttttagatgg

SEQ ID NO: 72058 - DNA, 1936 bp, Oryza sativa
  unsure (1)..(1936): unsure at all n locations
gtttctattgcgccataggtgaaacggactattattttccaaaaacttttgtgtggactcatactaaatctcagccattaaaatttagacttatcacgatcctaaggttaaaatttagacttatcacgatctaaaggttaatatttttcttttttcnnnnnnnnnnnnnnnnnnnnnnnnnnnnnnnnnnnaacgtgatgcttttttttagctgtcttaataatataataatagatagatagatattttttgcgagccgaaaaaatcagggcgttaaaatggcggcgctgcccgaacaccagcaagctgccccaacccaacgctgaggtctggtggtgacgcgcgcggcctggcggaggcggcggcagtgacgatggcccgacggagatcaaagagcattttcgttcgttcactatatatgcacaaaccattctgtggcgtacgtgtttgagaattcatgtttgcaaaaaaccattctatgcatatatagcgtgttctctctctctatatatgcatttctgtatatttgagaatggaatttcagtgaaacccacagattaggacaatattttggccaagccgcgttaatttggaggatgtggcacaacctcaattttgtcaagaatacacacatgtaaccaaattctcgcaccgttacgctaaatttttaagttgtcatatactcaaatgcacccagttgataaagttgtcgtacttaattactccctctatctcacaatgtaagtcattctagcatttctcatatttatattgatattagtgaatctagacatatgtatctatctagattcattaacaacaatataaatgtggaaaatgttagaatgacttacattgtgaaacggagaaagtatatgaagtaatttttacataaatgtatgcatgcacccactagttcttgtgcccagccgtggcataaatttcatgtgcacgtggctcaattttcgctattaattttttcccaatgccagtatatatatagaacaaatgggctgcttatatcatactcatatgtttaattgcgccagtgttattatttcgttacattggaaagattttgttttaataatggataatccggcctcgactatttgaaagctgcaactacatgtacctttcaaggtagcatcaaatgcaaagtacataaggatggtgagaaaataaacttaaatcacaccaactcaacacaggagatacaacttaattactacctccgttccaaaatgttctacctagtatgcgatgtgactaagatggaggaagtatttatttaggaagaaatcatattactaaatctccattaaaactagcttggcgaagatttacatggtcgttacattgtctccacattctggcacgcattatgaatcaatttttatcgtcatcgcatatttgtagctaggcccaaaacattagctagttgttacccataaaaacctgcatataagatttagttgaagttttgtcaaaagccatatcatttttagtaatccatagaacccaacataaagcaaattcttctactaaaatatgtttcttggttgagtcaataccaataagccaatttccaaataaatgtaagaagttatttgatggattcatatagaaagaaatatgaacaattctcaaaagaaatttagcaaagtgactatcaaagaacaattgttcaatagttccgccgtacatacaaaagaaacattctctcccatttcaattccttcgtgctaaattattcctagttaaaatcaccctttaaataaatatcacataaatatatttattttaaggggtatcttctgttggaaatatagtcattaatcggcatattttaatccaaaatgttaaagcaataatcatggcataagcagtgtaggacgatcttaacataaccagtagcatactatgcgcatcatga

SEQ ID NO: 72059 - DNA, 1057 bp, Oryza sativa
aagacttaatccgtgcatggcaatccacatgaagcacattaactcaacctgacaatgtgtatcgagtcatattgttggaatcggcttaatcggctaaccttgtctgactcgaactctgccgactctgattgcagccgattcttgctctgttcccagaacgatctccatcttggattccgcttcggttttatcttcatctccgatacttgaattatcaaatttggttgttaacaaatatgtcggtgatttattgcaaaagaatgtttcaattcactgcaacattagatctatacatagtgaaacattatgagtacactaggtgaaatattttttgtggaacaaaaaatgaaacgataaaacgaattcccttaatagagagtttccaaaatacgtgggtgatttgttgcaatggagtatgtggtgtacacatagcagggtgggggcagagacacgtgggtggggccagcggacgcgtccatcgtttgggtgggagcgcccgatcccccccccccccccaccgagcgaccgacggggaggattcccggtttgcaatcctaatgctatattaatcaaggtatgcagattggatagtaaaatctataaggcgtgcgaattgagtgctatattctctaaattctcgtcgtcttcctgtctcacgcggaggcagcgatattccccttctcccacgactttcttcgtcttcttcgtctctctccccttctcccacggcttgctgctgctgcccatatcagcaggaccccatctccggcgacatccctccccaggcggcaggcggcggtgtgtgctgatcagctgatgcccccacgtcggcggcatcctggcggtcggctcccatggcggcggcgtcctatcctgtcgggcagcgtgctgacaacagaaacacttataggatttggcgctgaaaattgtttatgccctttgaacaacaaagcatgttcattatattgataaacaaaaatttctgctatcagatgtgctgcaaaaatcgagatgttgaggttatataatttagtgctgaaaagttaatgttctattt

SEQ ID NO: 72060 - DNA, 24385 bp, Oryza sativa
ctcccatcccaaacacccacttaatctgattaggcaatcaggcacgtcgtccactcgatcaatcaaatcgcatctttcagctaacttaaggcattctcaaggtctgtttagttggcgaaagaaaatttttgggtgtcacatcagatgtttgactcgatgtcggaagaggttttcagacacgaatagaaaagctaatttcataacttgcctggaaagcgcgagacgaatcttttgagcctaattaatccgtcattagcacatgtagatagcactttatggctaatcatagactaattagactcaaaagattcgtctcgtggtttccccctaactgtgcaattagttttttaatctatatttaatgctccatgcacgtgtccaaagatttgatacgatgttttaaggaaaaaaaatttgggaactaaaccaaacctcagtgtatccaacccaacttggtattagtgtgggcccaagcaacaagaggtagtagtgcatgacagagggcacaatgtttcttgcctgctatggagaataagatggggtccaccaagaaaaaaaatgttatttcctatgtagtagaattgctaccttcctcatctaccatgtaaagctattttttttatttgcttgctacccggtagtagcactacaaccaggtagttgttgttacctccttccataatacgtacaacctggtaataagagtgtattcattgcttactacatgcttctgaaccacattgtggttgccttatgctgagttctttgcttggtggtaggaactcatccctctcgcacgtaaaacgggtggcttattagcgcatgattaattaagtattagcttttaaaaaatgaattaatataaattttaaagcaacttttgcatagaactttttttaaaaaaacacctcgtttagtagtttgaaaagcatgtacaccggtggtgtgcgctcaacccaaacatagttctcaaattggatactattgcaagagaaattggaagatagtgccaaaccccagcccaccttaaatacaaaaggattaggatggcgtcgactgaacttctgccttggaacgattaggtggaaacaaaacacggtagcagcgattcgatcaagcctcaccaccacgcattccattctaacccagtgacaacaaatcaccagatgaccactaccacgaagagcaactgtgcctcacaagcgacgccccatgaaacccatacattgtgtcagccatcaagcaagaaggccgtcgaagatttaccacaaaaatcgatgaacttgttggggccaccttgcttggcatccataaccacgagtacccgaggctagagaataaagcaagctgcaccaacttcgcctatcgagaccaacaagcaggagctaggcgcactcggtttgccacctccagccgtcgtcaccatggagaatggcccgaccacccagatccgccacctctagcttcgtccgctaggccgatcaacgagcaggagccgattgtgctggatccagcgcctctcgtcaccgtgcaaatcgtgtcgactatcccaaatccatccgccttcattgcggggaccgtcgatagagagggtgagctacacgggaacccatttcctagagcacacggacacccacacctacagccaccgctgttgacatcatcttctccaatcgccatggcaattttaccggtgagaaaaaaaaaacaaaatgaatctgagctacacgacaaactactctatactagtactagtatagggaggaggcctgacccttcttccagccctgaccggtgaagaaccgtcggaattggagggagaagaggggtcgagatgtttggaattactgtagagatggtccagacaagttggtagtgatcaccgatcgatcaacatgtccagaagttgctacaccgataatcaaccgatcgatcgatcggaacgttcgttttctagaagttgctgtagccacgtgtccgcacatacacctcctagaagccctccatattcataaaggaagtcgtttagaataatatttaagtcaaatcttaaaaatataaatcataaataactctcaagttgttgagtttgaaaatataaaaattatatgaatatatttgtcttgaaaaatatttttataaaagtatacatatatcacttttcaataaatatttttatagaaataagaagtcaaagaagttgtgttttggagaccgtgccgctgtcttaaacgactttctttacgagtacggaggaagtatgtgttctcctatcagtagtattccatccgtcttataaaaaaccaaactagtatcgaatatgacacatcctaatactattaatttgaatatacatatatcgaggttcatactagaatatattacatccggtattcgttttttatgggacggaggaagcacgtaccaacaaacagatcttcctcccgtaagttggctagctaaaccaccattaccgtacgcgccactgaaagaggagtaagcttacccggcaccgccaggttgtccacgagatctggacaacgacgccgaccggtgcgcgcgtcttcttttgcatctagaaacccaaaaatcgattggctgcccaccgatcgcgtcacgtcagagcgatcatctagaagctagcgagagcgaaatagcgaattccaatcatataggctaagatctctccatttattataggccctgttaccacacttgttcttaattagcttctgttaattaagtttatttcttataccaacatttatttatcccccacaataaaatagataatatgtgacaataacatggtcagtccaccttcaaaatttgtaagaaaaatatagaaaacttgaaaactttcaatcctatcagaaagtttctagaaaaatatttgaaacaaacattcaaccctagcctttcatttgaatttcctatagaatggacaattctatatagattttagagaaaagttagtaagaactttaacttcttaatcttttttctttaaagttctatctatatgatctgattcatgtatttttcatacggtcaactcaaattaataattattttttgtatattttctgtgatttacagtcctttattttatacttatatttctatcaaattaagtttaatgtttttttataactaaattctatgttttttattcctctatctttcaatccccgccttttactgaaaccgtcgctaatctatcttaaacaaagcctgaagtgaacacgtactaaaagtactagtgtactactttgaatctctagatgggagaggaaaacaggagcacgctagaaaactacgggcaattttagatggtttaggcgaaaagggtcggtccagtcatccatctctctggctgctgacagatatagagatctcacagtgtgagtagagagcaagtcaatgagtactccagtatactccatatgcttgagatattcacgtcgacaaagttttgaaacgacagttggccccattggcttttggccgcatggattttgaccgcttcctacaggtcatcatcttacaagtccggctagaggttgcagcagtcacagggccagaaaaccggagcataaaaccagcatagaaattaaattgtccaaaataacatattataaaaacacttaaataacagattataatattttatatattatattcatcacagaatataagaaagtaagatagtataagacacatcatacattcctattgttacaaatctgagcctcttatctcaagttcttatatttttgggatagagtgaatatatgtttagtgacttaaaaatacgatgtaaaaatcaacttaaaattaagtttaaatttttaactaggttgataaccaaaagagcatcgatcaagctgttagtattaggtagctgaaatagatcgtccgatggacctttaaaaataatatgtcattctcatatgtatctcaatcttattaaacaaattgtgctacaagtggtttttgaggattgaatttgatgtcatgaatatgctaattgttttgcttattatgttgacaatcatggatctgacttattaatgttgttctgttgtcttaatgtcagcagtcgatatcgttaggtttataaatggacaatatatatgcatcataagttgccacgttgttagttttcttactataatacatgtacacttaatattctacttactctctatccatcgttatctcactcccacttgtaaaacaacaactatgatcatgtgtatattaaactccaaaaaaagagcgaccgatgtagcaaaaatcatcatcgcgtctggtgtaaattaccattaattaatttatttattaagaaatatagtaccgcagacgctcacaatgcacgcacactcactcttatgaacacacccacaatttagagaagcaccaaacatgtgtcatgataggatgtgaacgtataactccacctagcatgttttaaatttgcacttacatattacacatatatagttgcatatgtgaatacattttactcctacgtaataagagtttagtgagattaaagatatattattggtctcgtgtcagaacgtaatagcaattacctacataggatgtgtgtgcatgtcttttgtttggttgaagaacttatctttttcaagcttagtatgaaatatgtaaacagctctgtaagtattaggagcctactattgtagcagagactattcgtcgctcctttctactctctccgtttcacaatgtaagttattctagaattttctatatttatattgatgttagattcattaacatcaatataaatgtaaaaaatactaaaataacttacattgtgaaacggaggtagtatctccgaccaagacacaccggccgggtccttagctgttgtgtacttcaagttttcaagcaggtgtcagaaggataattgtcgaggagagtaaccttcatcgggaacattttgagtgggcataaggtatttgagctaatcacgagaagaaagccaaactacatgcgaaggatgtggatgaagctcggccatgatacctggaaggaatattctactagaagaaaccaaggaccattccaactgctcttacaagctagcacaagcataaatgggccagatagccaattgattataccatgatacccttagggttcctagtccaatgagggcaccgttgtaacttcacatgtattttttctagctataaaggctgacttaatcatgcgggggcgtatcatatcatatgtacacaagccctcacgtgtatatatcgtggacatgaactaaaatatataaaaaaatatagaaaaattatacatgtactttcattagtattgcatctacgtgcaaaatcacatcttcaaattcatcttacatagagtaacaaattctgatagaactataaccttaaaactatcattttttgttatgatagattaaaatataataaatttgatattaagattttacctgtatgtgtaatactatacatgtataaatttttaaattttttgataatatttgttatttggtgtgtacgatatgtacacatgatagcttatgtacacaaaacatgttcatgacgcagattacatctttactggaactgtgacagtgaaagccttttttccaacaccagcactttttcgaatgttttcagaaaaaaaaattccgaatgcatttatataaaatagaaaacaataaaaagcctaaaagagttgtccaagtcaggcagaatgggataggcgcttcccgtgggcgatgacgcctttcgcgcttatctttcccgctgctccgcgtcttccagagaagcgagacgaccttggcacccagcttccgtcactcgctcgccgcgctatataaaccccacatccttgcagcggttttgccgcaatcaacaagaacaaacagctatcaccccgcgatccatttgcccaatcagatcaaggcgtgtagatttgattttggttttattactcgcaacctgcacgttgccctcagtcacctggcggcggagagagagatcggagatgagctcggtgtgcgcgaggcccgtcggcgtggggtaccttgtcggcggggcggcgagcagctggtcccagcggcgggggcgtggggtggcggcgccgcgggcgagagtgagggtgtcggcctcggcctcgaccgtggcgccggagaggcgggcggcgacgatgtacgaggtgctggcggtggaggagaccgcgggcgccgaggagatcaaggcggcgtacaggcgcgcggcgcggcggtggcacccggacgcgtgcccggggggagccgagcgcttcatgctggcgcgcgaggcgtacgaggtgctctccgacccggagcggaggcgcggctacgacatccagctccgctgctgcggcgccggcgccggggcccaggcggcgcggcgggccgggttcgccgactgggaggcgcagctcgccgggctccagtggcgggccgcgtcgcgggagacgtgggggagcaggatgcgccaccgtcagccgtctccgtcctgagccgagaatcgcagaattcgcagtggcttttttgaattttgaatttgtgttgagttttctctttttctttcactttttttttcctcttctgtagccttccttgggatgtgtatataccatacggagtattaggatatgatctataggtggtacatggtagtagtatagaagaatgtacaaatttcaaacattttgaattctgatacctactttttgggaggaaaagatctttctaaaagaacttaagaggaaaacagataatgacatttacttaaagaaaacggtggttaattgaccagttttcacgcattctagagaagcaaagtaaagattagagaagttgtgtaccgtcatatggcagccttcaaataatgggaagcgtcacattcacctcagctctagaacatcagaaataaacaaagagaattgtgcagtaataaaaaaatgagtacaactcagaaattatgaagtttggagtgaatccttcttagatttttgttaaaaaaaacgaattctcagatctattgtggaaatgaagacaatctataatgttagtttagtccaaaaaaaaactgaaaataggattctgggactgatccatataccgaggaatctaaataatcacttccacaaaaaaaaaaaaatctttccagtgaactccgcagctaacatgctgcactatagctccaaggagcaatggtatccgtacacatttgcctaaagaaaatacactaaaactgattttcagttgttgataagatttgtgagaaagtctaccatttcccacatccgagcttgtcatttgccacaaccaacgagtcgcatcctatcctatccgtatagtccccttcatgatgttcctccttggtttgtaccatatgtgtgcaaaatttctccgcacagtccccttcacgatgttcctccttgtttgtacatatgcatagtttcactaaccaaaggacggaatcacacaccaattggtaatttggtggtgactggtgagctgctttttggaaaaggattttaccgagcctttagcttttctagtttgtaaactgaaggctgaggccattttctatgcaaaaggatttccagttgatacagcgctcaatgttatgttcctgaaataaacaaggctgatttcagcgtatggatgaatagcaagtgatgccatattggacagaagcaggtcaaagcagcttacctgagtgcagagttggggatttgctcgacaaggcatggaggtccacctgaagatgcatgggccgttaaaacctcccacaagctctatatgtttgcaggaacaagctatgcgaaggtagatagatggttgccagagactcagagttaagcttaccatgtgaccccggtggaacataagcggacgcattgttggagaaccatgtttccggcaaaccatcaacgaaagaagttgataggtcagcattaggcaaaaccgcttgcaacgctgtcacatccataaactgcaaaatggagtgctgttcagataactgatgggcaaaatgccatgctgaccagcactacatacaacagactgtccattttgaagaatgtgttatgctgactctaggtaaatcaataattattcatttattattaaagaatcagattacacggttttcagtatgaaaataagtacttcctctgtcccaaaatataaaaatcaaagcctcaaagcctcttttagctcagcagggagagggccagtgccctatctcctggtcttcggatccttaccctagccaatccacaacaaatgctactctggaaactgtattttgcatctatattggatcatgtgggtgccatgtccgtctccatgagaattatgaaagggttatctactgtttcatcatcaatacgtctattccacatcgtcaaattctaaacatatattcagtccacagtattcaccgtagataggtaagtgacagtagcacaaaacgatattaacagcttccaatcatgtcaacagtaccatccataaaatgcttgatactcaaatgcattgaaagcagggaatgaagaaataactctgtaacatagtggaaattgcaaatgaaccaagccacgggtgtttgcttccagtttctatctcttccattttaaatgtcatttttccctttacatatttaaatatttaaagttgccaatatgatttctggggtgccaaaaaacaggactcggtggtttgactggtttgccatttttggatcctattggctactatgtgcaaaaaagaatagcataccatatctggagaatccgagtcagcatcaaatggaagatcaaatggattcaacggcatctgctgtacagaggcttctccctgtaaacggtggcattatattccagatccagaatcacttcaaggaacagcagaagtgtacagatatgctaaatatctaaattaccacggaagtagtagcaaacagtgatggctcagggaatggagcaaagggttcgctaggagctaatccacccatgaaaatttcttgggaatcattaccacgagattcctacatgacggaaaaatatattaggttgttatggagcaaaggggtacctttgacgttatggagcaagtaaatggattgcttgttgttagggaattgttatcaacattcttgtgctcattagtttgcagctgagcattggacagattgagagtcatagtctcacttgcatcatcgaatgaatgccagagctgcaaaaacacaacaagggacactactaagttctggggaaacggttgacacttaacaggataggtcaaataccagaatagcattgcagcaacaggaaataacttgcttattcacaagtttcataatttactcacctgcaatttattttcatcaattggttctttaggttctatagaactcattagtgaaagatctggcgaggcttgttgggtgctaacacttttggcctcaaaagcactccaagcctgaagaaatgtgaaaaatactatttataagtttaaatgcaaaagtggaatatcatagtagtgtggcacaatcagatttttttttttaaaaaatgaaaaaataattctcgtgcatttgcaaatgatacatgcaaaaacacaatgaccatttttttgaagaatggactgcattttgttgcatgtatgtcctaacatgagagcatatgaaaaaagttttttctagagcaatgcaaatattcctcacctgagaattacttgcatcagaggatgtatatttacaaggtacatcagactgatcagtcacagaagcattattttttgatgtctttgagctctggagccacgttggttgatcattatttggttcaaacgaaaacaaatcaccactcaaagcatgtttatccattacggaaatgccagaaagcccaatcactccaggttgcttttcttctggtggtgtgtcaaatgtagcccacccagcattgtccattgatggagctgctgtgagcattctatcagtggatggagttgccggaggcatgctagcaaaaaaatctactggttgatccaaaccagttacaggttgttgctgcgcaacaggctcattaaggagatctttctgtgcaatgttggcaacatcagagaaagctgtgaaacttggagtaatgcaatccttcgtttgctgagttctatgagcaatatcagattcaaaaaacatatcagctaagcttgatttgcttgattttgtagatgacgaatctatgtttcctgttgatatagttctctgcagaaagcaatcaaaattaatacatgtcttgtttggtatgaaaagaaaggaaaaccaattatttgtttagagtggaatatttaccacctcagattgagtgattccactagaagcctgtatgtttgattgattttgttgcatagaggggctggaacaccctttatcaaggaaattcggtgagtgtggtgtcgttctaaatgtattactgatgcttgaccctgagcagtcagaaattcttggtccagaattctcattggcaaatcggtcttctgacatcctctcatgcaggctctgtggactgtaagcaaatccagacatcttcccatcatgccccctatctgaaccaggtttcctagttagcatcacggattgcttgccattgcgtctttcttcgtattggtaatcataaggtgggctctgagaaaatgaatggtacgaactagcccttctatgctcttgttcattggtcttttgattctgcattgatggaacatgaattagttaagagagaagcattttggcagaatatacgttgagaaaatgaaaacttaaaatttccaaagaatcacaggaaaaaaaacatgaatgaacttctatgaaagtattcattgtcatctacgcatactgaagcagaaattcaaaagctttgtgataacaaatggacaggtaaagaacagttctcatgcagactaactagatgttgtaaattaagctaaacatacctgtttatctcttggaggcctttcagaaaaccttccaccagcataccttctctccacataaacagcttttatgaattccctaagactgtcgacattgctgcaaaaatagtttagcgtaagcatgtactgtgcccactatatatgtattcacaagacaaagtatgtattggtaactttaaaagagaaggatagaaggatgcccttgaaataataaagaagtagcgattaacaaagcataaaaggtgaaaaacaaaaaggacaacaaaatggaggtgttctcagtggctaacgccatactggtaacactatagtgacaaagctttttacctgctatcaggtagcctcattttctgagcatcaaattcctttaagaacgattctctggctctctgcgtcattcagtttaagagtcatgacatgaaccaaaagggggatttccaagctcaaaccaacccaatggatcgccttacttgattcccaccgttctggagggcctcgacctcttgcgtggtgaacgtcgacatagatactgacttcacacggtgcgtgaactcacggctaaaaattccatgaatgtgtcagaataacagaagagaacatataaagctccttcacaaggagaccagaacttgacgactctgagcctctgacacggtaaaaattttcactacaataataaatgaaatgctatgtatgctaagcacgctaatcccacaagactgaaataaataaactgaactgatgaacaggtcaactgaactctcgtcgcatcgacaagcatgaactagaaaataactacgaatactatgtccgctggcacatggatgcaatacactacacaaaattagtccaaaattaacagaggcgagagcccagcactcactggatgccgctgcaggagatgcagacgaatgtccagaagctcgtgcacacgtactgcggcccctggatcagagttccagcacacacggagagggttcagtacaacaaggaaaaaaaaacaaatcactccggatcagaagcacacacacgagaggagatcggcgagcagctgcgagtgtggcggaagggaaaaatccttacgaggccgttgcagttgatgcatctgcggttgggcggcagcttgaggagccccctcacgacccgctcgttcctctcctcctccttcctggacgccgccgccgccatcgaccactcccccccgcacccgcagccacacagatcgaacgacgaatcccgcgatcccgcagccgccgccgcctcctcggaggattggatcgctccctcctccgtggaaaccggcgaggaagtgagagggcgtgaaacggatgcgccggagaagaaggcgctggtagatggcggcgacggcgacggcgagaggcgccggtgcgtttgcttgagccggcgacgcgacgcgatgcggttgggaataacgggtgtggaaatgactagtagtaatagcgtggaattgcaacggcttctttaatttttaaaaaccacgtttagccagacagcctatcgctaatccgcccgcacatctcgttaagagcaggataatagcaaactataagccaagctataaatataatttaaaacaataaaagagcaaaaataaaagtacgggctacagatttataaccagttacagcacgaactataacagtatgggctacaaatttataaccagttgcaacacggactttaagatacgcgtgtgtattacaggtgaggaccagacattaattatacagtatatatttatagatagctattgtataaattggctattaaattgactatagataatttagaatactaaagttgctctaagtactcctctcaatttcgaaacggaaggatttttttaaaaaaagttaaacaaaattccgtgaaaaccctctaaagttttagcgttttgagtaagccattagagcaaggataatagtagagcttacttcttactattagcccattttaaagccaacatatataatagattagttataaggttggctacaactttcttcttctctctatttctcacctatgcatttaatgtatttacctaggagcttgtgttaatctagctcttgcatgagagccaacatccttgattttttgttatatctctcctccatctaagtttatagtaggtttatagctagctattatacttgctcttagcctgattcctcttccaggaaactaaaaacggtgctagccttaagggcattcccaactcaatgactaggatggtgtccatagcattaaataagctgccacctagattgaaaaatgatgtgacaagtgaataaatgaggaaagagaagtaaacaatatcttgcatgagacatggtttctacacaacatccaagacattatgtgagataagtagcattaaatttaagtatggaatagtagtgtttgcattggaagagtagtatctgatgtggagtttatggaaagtgaataaatgaggaaagagaagtaaacaatatcttgcatgagacatggtttctacacaacatccaagacattatgtgagataagtagcattaaatttaagtatggaatagtagtgtttgcattggaagagtagtatctgatgtggagtttatggaaagtgaataaatgaggaaagagaagtaaacaatatcttgcatgagacatggtttctacacaacatccaagacattatgtgagataagtagtattaaatttaagtatataatagtagtgtttgtattggaagagtagtatctagtactagtttgttgatgatgtggagtttatggaaactatgttagtgtcttgggttgggaatgccctaacattagatcatgtagtagtaataaggtcattagcgaagataccgaggaaacggacccaagcaaacagagtacagacagagagcttaatcccatattccccttgtcccaagggtggatctcgctttaacgcttttgccgcttgaattaagcgacacggataacatgtgccttaacatctcgctttgccaagccaaccatgcccggttggcttggcttggctactccgctggagaacgctggtgggcacgagatttggccaaagattaggttgttgagcagctctaccgatgccggtagcctccgcctgttgggtaggagtgtgtggtcaccggctaggcacacacacatgggagagagacgccgtttgctgttgggtttgattgtttgaactgccactccagctacaaataccgtccgcaaccaccaatattaatttaagtaggaaggtataataatcacacatttcaaagaggttgcggaggaccgcgtggtcactcctcggtgaatcatttttattttggtaaaaattgtaataaagaggtagaaattaacaaagtataaaaggtgaaaaacaaaaaggacaaaaaaaaggcgttctcagtggctaatgcatattggtaacactatagtgacaaaactttttacctgctatcaggtagtctcattttctgcgcatcaaattcctttaagaacgattcttctcaattccgaaacgggggaactaaaaaaacctgggctcccatcgaacggcctaataagcccaaaaaaagccaaattttaaattttcaaacttaattttgagattgattttgagatattttcaacgtaatttttttttcagtattggcttttaagtcactaagaacacacacacacacacacatatatatatatatatatatatatatatatatatatatatatatatatatatatatatatatatatatatataagttttacctacaaattcatttttattccctaataagccgttttggcttattaggaaaaaaagccaaacgatggggcctctgaaaactaaactaaatttccgtgaaaatcctgtaaagttctagtgtttcgaacgagccattagcctgattcctcttccaggaaactaaaaatggtgctagtcttaacatgttgtgtcctgtaaggtcattaccgaagactagctggtgcaggcaccaactgaaagtctgaaattaccttcttttggatctaaaaactgactttatgatccttaaaggttccttgaccccattatccatagtcggtacccgtacacgaagcccggaatcgtcaagggcaggatgccgatcttcggtagtgtttggttgctggaatgagatgagatgggatgggacgaacccacttttaggggtgtttggttgaggggtgggtgggatggattggtcctaggagaggaatattcctctcagatccgggaccaatcgatccgggaaaaagagccggacgaactcgtctgcgaccgacgccgcctcatccgcgcccgccgccgccttgcccccgtgaccgccgccgcctccaggaccagccgccgcttcgtccgcgaccgcctccgtctccgcgaccggccgccgcctcgtctgcaaccgcctccgcctccacgaccgactgccgccgctcgtccgcgcctctcctcacctccgcctccgtgcgcggcctccgcctcatccgagaccgccgccgcctcctcgtccggccgccgcctcgtccgcgaccgcctccgcctccgcggccgactgccgccgctcgtccgcgcctctcctcgcctccgcctccgtgcgcggctgccgcctattccgcgaccgccgccacctccgcgtccggcagccgcctcgtcctcaaccgcctccgcctccgcctccgcgaccgaccgccgccgctcgtccgggcctcgcctcgcctccgcgaccgcctccgcctccgtgcgcaaccgccgcctcgtccgcgaccgccgccgtgcgcgcctccgcgtccggccgccgcctcgtctgcacctcctccgcctccgtgaacgaccgccgccgctcgtctgcgagctagccgctgggagccagacggccctaacggtccgtgaaagttctccatcccatcccacctcaatcccttctaccaaacaaaaaactataaccatcccttaccacaaaccaaacagacaactggaaccatcccatcctaaaaaactgggataggtctaacccatcccactttgtccccaaaccaaacacacgcttcagtgatgaggaaggatgccgatcatcagtgatgaggagtccaggatggtgaaggactccatccatagattgtgttggcatcaaccactacacctctttctacatgaaggatcccgggccatggaacctgacgccggtcagttatcaggatgattggcatgttgggtttgtctgtgagttccaaagattccaccccgataattctgaatttctgatacataattcagtatgttgtactactcacctgttaactggatcagttgctcatgcactcacctgtcttctccagatgaacgaaatggcgtgcccattggagctcaagtaagtggcagtcaatgtattgtacagtagtacgttaaacagttaggacaagttgaatttcaagctaaaccatcgcacttcaatagttgaattaattgaattcacacaggaaaactcctactggctttacattgtgccatggggaatcaacaaggctgtgacctatgtaaaggaaacatatggaaaccctatgatgatcctttctgaaaatgttactaattcggcaattctattagaattatccctgtttctcctaataataatcttgttgacaatgaaaagtagtattaaacaagggttactttatgatcaatgttatgctcttgcaggaatggaccaacctggcaacttcaatatcacccagggtgagcatgatactgcaagaatcagatattacagagattacataactgagctcaagaaggtgatagacgatggtgccaaagtgattggatactttgcttggtcactgctcgacaacttcgagtggaggctcgggtacacatcccgtttcggtatcgtctatgtggagttgtggactatagtctataagacgttaaagagttacccccaaggactcaagcgttctggttcaagaacatgctctccagaaagaagaggaactaaagtatgcagactaattatcaaagcctcaaaggcttccagccttccactgtcagaattcagaacaaagctcactctagcgtatgctcatcttagcacgttagtagctataattaaatgtgaaaaataaccaatgtggagattggtagcttcattagcttccgcaatacaaggggaaataaatggagtggacttcattacaaatttgttcatcaggaccaaaggctgactaaagggactattcaaattatccaataattcagtttcaaaaaaaagatccccataattccaattcaacaaacagatttcattcccacagagaagttcagataacatttcactgcaaaagaagtgtctgaaaatggaactcattatactttgagggttccagttcgacatacattaatataaagcattaaaacgtgatgacataaaatccctgagtgtacgattgtttgtctatatttctatccagtaacctatctttacaaatatctatgcacgctctttctaacatgggaactatgatttctcctatggctatacttcttatatgcaagaaggcaatattaaacagtaattaagacaaacaggtagtagaaattacagacatcattcacaaatttcagacatcattttgtggtgtatgcctgtgcaatggccgtcaggttcccaagttcctaacagccactgttgctgtgaactttccctgtgcagagctcgcaacacaataaatagaactaaagagtgatcagtgagcactaatgcaaacttaggtcaggtttaagcactgcttcaaatctgtatgtccaactgggccactggaaattactaagttcactatctcgattcaaaaaatttgcacactataaaagggtaatactactccattctgaatatctcttaagatacaatacaatgagccaccatcattcaacaacacagaacatgcatcgaatttggtattcccgtctcaattcaaacagttagcataagtttcacataccatgtaaacatacggatcactgcggccaccagtgtcattacacctcaagcaccccccatgcttcagcaacctgcagattccacacaaacaatttagcaacatggcaaccatttcaaaaccgcttcaaattggaattaacatgacaaaccatttcaaaaccgcttcatattgaaattaacatgaacaaccattccaaaaccgcttcaaattggaattggaggcggtgtggtactcacaagcgcagggccttgctggtcccagcattgtcgccgacggccgcccggatggccgtctccgttgccgactcgtcgcgccgaacacctaatggagaaacgggagtgttgcgcggaagtagtacctaacagtgggaggaggtggaggcggggacggcgctggcgacgagtcggcgaggaagaggagcacgacggcgccggcgacatcggtgaagttggggaacgccattttcattcattcaagtacttctacccatgctccattttcattcacagccaccctctttgttaaaacacggtatcctcgtgtatgtcatgttacaactttttataaattatacaaagtgtacaagtctcaactctagattcagtgagacagaaggatttctcctccttggttgaatgcaggatctgatagatcaaataaatttaccggtcaattccttcaatcttgtcttcaacctcagagtagagctccctgagcttttccaagttttcctctgatgtctcccagtagcctctgccactggcttctaggaaggtctgaactagcttcctgaatgaattggggttggtgtccatgagcctcttcctcatagcctcatcttcaataaatgtggcatttgcctcctcataaacccagttgtcaacctgtccagatgttgcactccatccaacagtatttgtcagccgcttctcaatctctctaactccctcgtagccacttttcatcatcccctcgtaccacttagggttcagtagctttgtccttgcatcaaggcgcactgtctctgacaatgtcctcacctgtgcatttgctgtggttgtatctgctatgtatgaggaaggtgcccgcccatccttgcgcagtccttgcaccagctttgtcgggtctgagtcaaagtagtggctcacatctgttagtgaaatctctgatgagtctaggttctggaatgtggcatctgctgttgctagagcaagctcaaatgtcttgcgttgctctcgcatgcctgcccctggagcatcacaatcaaatgcaaaagacttgcgactcaggtacatgtcctggagctgcttctcatcagtccatgatgcattctccactgccaagttcacattcgatgagtaagagcctgatgcatttgagaacacccttgttgccgcctctcttaatgaaacgccaagttcccgtgcctgctcttgtgcatgcttacgcacgtagttcatctcttctggctcatccagttcggcaaccatcttcactgcccggtccagtagattcatctgcatcagtgtgttccataagtacattatttcagcaatgatttttccttatatatgcacaaaatctattatattattaaaggaatagaaaaagaagcctccacgttcgctctcatggtctagaaattctcacattaatcggagaaaaaaaaaacagagtccatatagaaatacaatttagaaatagctgaaattcggaattgaaaaataaggaatattaaaagaggagactagagtccatatagaaatacaattaggaaatagctgaaattcggaattaaaaataaggaatattagaacaagagactagagtccatatagaaatacaatttagaaatagctgaaattcggaattaaaaaaataaggaatattagaagaggagactagagtccatatagaaaacaatttagaaatagctgaaattcggaattaaaaaaataaggaatattagaagaggagactagagtccatatagaaatacaattaggaaatagctgaaattcggaattaaaaaaataaggaatattagaagaggagactagagtccatgtagaaatacaattaggaaataactgaaattcagaattaaaaataaggaatattagaagtagaatatagagtcaatatagaaatacaattaggaaataataaaaattcggaattaaaaataagtaatattagaagtagagtatagagtccatataggaatttaaaactaactaaaattcggaataaacataataaaaatgaaaagtagtgtttagagtccgtataaaaatacaatttacaaataactaaaattcgaaattaagaaaaacatgggaagaagagtttaaagtcaatataggaatacagtttagaagtaactgaaatttaaaattaaaaaataaagaatattgaaagatgagtttagagtccacgtagaaatacaattagaaataataaaaattcagaattgaaaaaaatatattaaaagacgagtctagagtccatataggaatatatataatttacaagtaactaaaatttgatattaaaaataattaataactaacacgtatataaaatacaatatgaatattacacattagtagtttcgtaaagttattgcaaaatttaaaattatgttgtcattgtaatatattttaataatataatgagaaaacacatatgctattatagccaccatgctagttctacatatgtaaggctggggcagaattcatacctggttgatgaaaagatctctgaagacacccgagcagttgataacaacgtcaatcctgggacgtccaagctcctcaaggctgacaggttccacacggttgacacggccaaaggtgtcagcaaccgggcgcacaccaatcatccacagcacctgggccaatgactcaccataggtcttgatgttatcggtgccccacaagacaagtgcaattgtctcaggatacttgccaccattgtcaaccttttgccgctccagcagacggtctacaataattttggcgctcttcaaggcagctgtagttgggattgcctgagggtcaagagcatggatgttcttccctgtcgggagaaccttcgggttacggattggatcaccaccagggccaggttcaacatagcttccctcgagggcaagtttcaagcttcccagctcattatctgccacaattagcttcaagcattctcccaagaaagtaaacaaggttctcaatttctctctgtctgctctgatgaacttggtcttggacaagtgttgtacccatggttctgataaaccaaaaccaagcatggtactaagtttgtttgtaacatcaacaacttgccctttgttgtttgtagtcctctcaacaaaggtagtgatggcaccacgtgaagcttctgttatctgcctcaacagttcaacatccgccagtattcccttgtcacttcctctgtacacatcttcaatgttcctgcccactgtctgagcaagtatgttaggcagtgagtatatttcatcctctgggcgatcaagggaagctatgttcaccaaggtggccacagcctcgatggcacttggtggctcacctatcacatgcagaccgcatggtaggaggcgtgattctatttccatgatcttggcatacacctttccaacaataaggtcacgctcatttggtggaagctccacaccttcctcaggcaagggaacatccttgtcaagattacactgttttgcagtgctaatgattgagctcacaatctgcggaccacgtcctgtgtccttgagagattggtaagaagagatgagctctgaaagctgcttgagccccttgtagagaccagcattttcagctggtggtgtcaggtagcttatggtgtttgcatagcttctgcgcttggcaacagttgcttctgatggattgtttgctgcatagtagtagatattggggatgttgccaatgagactgtcaggatagcatgcatcactcatcccaacctgcttccctggcatgaactcaagagacccatgggtaccaaagtgaagaacagcatcagcctggaagatcttctcaacaaaggtgtagtatgctgcaaagccatggtgagggctagcagattttgagaacagaagccgcatcggatctccttcatagccaaaagtgggctgaactccaatgaatacattgccgtactgtttcccatagacaaggaggttttcaccatcagaattaaggttcccaggtggcttgccccagttctcctccagcaaggaggcataggaagtgagtgactggtactcccgcacgttcatgcggtaagcaacattgaggttggggctattgaattgggcctccttatcatgaataacctcctcgatgagggcctcagctgtgtctggaagaccctcaacattgtagccatccttcttcagatcttggaggacggagtagatggagttgaaaacattcaggtatgctgctgtgccaacattgcctttgtctggtgggaagctgaaaacagtgattgccagtttcttctcctcctgcagcagacaaacaaataaggttattgtttctgtgtgctttgcaaacctagtcaccatacaatacttggaatgagtatttcaacttaggaacttttcacgaaactgcaaactagataacataattggattatgggatcatacacataaacttttgactttatgtttacgaatgattgtattgtttcatgatttgaaacttcagtcagtaggcagttttagcatatatgtaatgctacaatatattcatcactgagcttcatgttaaggtatgcatcacagggattatgtggcaagcttgtggcaccgttatgtacatgagttcttcagaggatggaagagttgattgatcgattatacgagtagttctagttctcagttgaacatactttatgcaccttaagtattgagccttttgttctcacatgatgtattgtttcatttgaaggataactttcagttggcagctaatgattgcataacacgtggcttttcattgaacttaatatcatgtgatggtatgcattactggaattttcacatcaggattgcggcatcaaatgtacaagagctcttcatgggatgaatggcgcatgtgcaataccagttttgagcatgacagtgaagttgttaagctaatatgtttgtttagcatgcaatcttaaatccctcaaaaacctcaagaagatatgaaagtgaattcagaactatccagatgtgacgtttgtggttgcctttgctctcaggcagaaacaatgcaattctatacgggtactacaatttatacaggaactgtgtggaattgcgtaccttagttttcctcttcagctctgcccatctgattgctctagtgcagagctgctccaccctcttgtgcaacgcatgtgacttccctgcatcaaacagaggaaaaaacagtttcaggctcagctacaagtacaggattacctgcgaagtaggtgagtgagaccaaaaggaatctggaaatgtccttgcctgttctggggtcacggccggcgaacacaatgggctccatgccaccgtcaagctccgggagcgcaacctgcagcgccacctgaatcgggtgcaggcccaatgtgctgttcagccactcctctgtcgtctggaacacgagcggcagtgccacgatgtacggcacgtcgagcttctgcagcgcggcgatcgccttgggatggtcctgcctcgctggccctccgacgagcgcgaacccggtgagcgacaccaccgcgttcacgaacggctttccggtgatcgggtcgacgaggtaccgctgcgtgggtcccgagaagtccagcccgccggcgaagatcggtatgaccttggcacccttggcctccagctccatgatcacggcgacgtagtgaccgtcgtctccggtgacaatgtggctcctctgcaaaacgaggccgatcaccggcgcgttggggtccttgagcttgtcgttggtgtcgcggcgggtgccgtaccagttgaggtactccttgacgtcgtcgtacatggtgggcgccagcgggtgccagataccagcgtcgaggaagaggacggggtcgtcgtacttgatgtcggcgcccttgagcgccggcacgtaggagacggcgatcatcttgaggaaattctggaggttgtccggcgagcctccgagccagaactggaggctgaggatgtacagccgggcgtcctgcgccttgtcggagggcaagtacttgagcaccttgggcagcgtgcgcaccagcttga

SEQ ID NO: 72061 - DNA, 7288 bp, Oryza sativa
acaaagatttcgagggaaatatcattctctaaatcaagtaagaatacacatagttatgatattatcggactaaggagaaaaaagaaccatgaccaaaacgcctattgttttaaaacgattttctaacctaaaaccgaagtggtaatataggttgtagctcaacattacaagggttatgtgggcaaatgtttggtaccttgagcagataaacatcgctcctgggtggagaagacctaggggtttgagaagagcagtgatattgtgacaagtttccttaattcctcttgctttgtttagtggcagttttacttgtggactaagggatgaccgtgagcttgtaatgccagagctgaagttgaggttttagtgacgtgccactggggttttagcggtttgaaagccacgtgtgtgtcctctcctgattacacttacaccatcactttcttggtcatgtcaagtcaacgacgatgttaattaccgcaataagaacaaatctaatactcctccgtcccaaaatataaacattcttagcatagtgacgagtcaaatgtttttaattttaactattaacagcaaaaaaataaaaaaaaatcaatcatgtaaaattgatattagtagatttatcattagaaaaactatcataatatttaactttttttatttaaaacatcttacttttatagatattgttggttaaaatagcatctcagagaccgtgttagagtaaaaaaaaatgcttatattttaggatggagggagtagttatctacattcactctaatagcttagtcatataataaatttataaatatatattttactatcaatatttgatcacctcgcatacacacgtaaatacatgatatattgaaatccgtgtgtcacagctgactatatctatagctcgtttttctcctctctacgcttatctcttcttgacatttacttgtagctaacatatagcctgttgtcttaaaaaaaacatatagcctgtatttgctacgcgttgttatatttctaccggtaccactgccctgagttcttgatttgtagcataaggtacaatatttttttcccataaacgtgatcattgaagaagaaaaaaaagggatattgcagatgtgctgactgagctaattaagaataagatattcaggcataaaccaagttagctagtgacttttgcatgcatttgacatgcataagtccactagcaaatatctgcagccaaaaatcatcctaatcctaataatcaaccaaaaaagtccaaaacaaaaggaaaaggtcaaaaggtactcatcgcaagcctgcaacaagtcgcacagcaagacagaaactcacaccagttgggcaggaaaccacatgaccgtgtgtactgcatgccccgtttggctcacaacctaaccaccagcacacgcctaattagtttaatcaataattaccttaccttgtttttgctttcagaattaagtgatcgtctcgtctaagcttcatgacctttacgcatccgatcgagtgacaagagatcaattggagtagttataaataagcgtgagtattataattaggagaagttttactggtgtttttatttcaaaaataaaaaaaaatcaacggtctaaaatagaagtattatataagggtatttaagtatcgatctaacagatgacatggtgaagggtgtcgacaaataaccatattttactgttgattaccctgttgtcattatttactgtaattttattttaaaaatggaggattttcccatataactatataaaccgatgttcaatgaccgaacgaaaatgggaaaagtttcaaaaaggaaaaaaacttttcgccttcaaccgggcctaattcaaaacagcccaactattttgcctctgtttttttacgtgatttttcaaatgttcaatttcaaaaaaaaaaggtcaagttcaagcttgacatgaattttgaccttgtttttacatgcattttaaaatggaaactgaagttcaaaacataggggagaaagcaatagcctagcaaacaaaaccattttccccctccaattggacctaatttgaaacaacacccaattgaaaatggaatatgtctactttgactcccttaactagtgtcttaacctaatttgtatctttaaaccgtaatagcggatattttgacccccaactattaaaactggtgtaatttgtctccctcaacggttttggaggactgttcactatcatggagcatacgtggcggtgttgtaagcgtctgtcgaggagtgatcctctctagcaggagatcgtgagacccccctttcgtgagttcggccggggaagaagctcgcctctagaaatcgcgtatccgtccccaaggctcctagctagctcgcacacaaccaaattatacaggttcgggccgctatgaagcgtaataccctactcctgtgtatgggatttagactgagagttacaatggttcctaaactcgggagaacactcttacttccctcctccacaagctcaggttttctgagagtcgtcctctttctcggtgggtaaggtcctccttttatacctcaaggggataccacatgcaccgcttctacctactcttttttcgggaggggacccaccatatcttgactggaactcgacccgtgccttcgcctggaagctaaaccatagcttgtccttgagcggggcccagcaccgtccctcgcctgacacgggggacagccctgtcattccctcattaataggtgaagacttgtggtggccgccgtccgaatgaccccccgacgggacgggccatacctacctccactccaccggaagcagatgtgacgtgggagcacggttgtccatccagtcagacgtgaccggcgtcaggccggtcacagaccggtcattcttgaccatcgcgcgtcagtttagcacgccgcacgtctgccccactgcattaaatgtgacatggggcagttgaggcgctgtgcggattaaaggaagttcagcctggggcccctcctcgcttgctccccccgccaaacggcggctgggcgagggcctcggggcaaagcagtgcaagggcccgaggggcatgacgtggcaccccgaggccccgacaccccggccgctcctgcggttcgtggaatgcggggacaggaccatgctgtagggacacgtggtaggatggaaaggtagattcccctcacttcgcatacccccgggcccatatctccgacagtttagggcttagggtttaatagttggagagtcgagatatccggtactgcgattcaagcatacgaatcagattcggcccaataatccagatgccaataggacggcccatcaatccagatgcaatacgacggcccatcagatcccgtccccgagaaggaatccccctcaccgttggatccgatccgacggctgagaccagccacacaaaccctcaatatatattcgctcgccccccgctgcgtctcgccgctcctacaccgcgccgtcgccagcagccgccgccgctgcctctcctcctcctcccctcgccgccgatccaatccggtaagcctcgccgccgcaagctccccctcgtccctcccccggatagttcgtcgcctcgtcaggcatctcgccgatttggcgccgttctgttgttctgtttggtggagccgtgcgcgagatttccggtgtttgttgacctgtttagctctgatggattcaccttgtgttagttagttttccgtcgaatggtgtggcgattaggtttggggggattggttcgtctgtgattttgtagctagattttttgaaatctagggtagtgtgagtggggaagctgctggccttagtggatacatgctgttcgtggtctcctggttcttgaaatcatgatgagttagtgctgtttgaaccttgaagcaaagttttaagttattggagttcctgtgcttagatttgtatactattagtgaagagatgcatagctgtactgctgtagtggatataggagtgttgtttttgatttgctggtgctcttccatagcatccggatgcggtgttcaattgtgtagttgtttatgtagttcaatgcactagaagcttttatttctgaatgcctagttattagttgggtatgaagtccaatgtgtgaaatgctgtcatgtttcaacttttagttaagatatgaaacttgagaaacaaatgaaaggtttagattcagtactgatgtacaacttaagtaacatctatggttgtaaattgtaccatgcattggttattgtgaattagctcttttggttgattgaaacaattctctatgtgccaacaggtcactttcagtcttttttcttgagggggagatggcggtttctttcaccaacgttagctcagaggcaggcctcaaaaagctcgatgagtaccttctcactcgcagctacatctctgggtatatgatcagtgtccactgtccaccttattttctgaattgccatttatgttcactggacttaaacccttcaattatctgtttccaggtaccaagcctccaacgatgacttggctgtgtactctgcattttcaactgcgccctcttcaagctataccaatgttgctaggtggtttactcacattgatgcactcctacgtctgaggtatgcatttttcccctttttttattctcttacattttatgttcagtgttgtgaattttctgaatgttgtatttcagtggagttactgctgatggtcaaggcgtaaaggtcgagtcgacagctgttccttcagcttcaacccctgatgttgctgatgcaaaggtcatacaaccctagccttgtcttgtttgcctgaaatctgtgaagtgttctagcatagtactgtgaattgtgatttgatgctgtttgcaaattacgtttttgtggttcaatggtgctggttaccatctctaatatatcatcatatcttctaatttcaggctcctgcagctgatgatgacgatgatgacgatgttgacctttttggtgaggagactgaagaggagaagaaggcagctgaggagcgtgctgctgctgtcaaggcttctggcaagaagaaggaatgtatgccatcctgcattatactataccatttttatgcaatgaataatacaattattcattttattttattctcatctgtagctgtaaattaagaccaaatcatcactattcattataatgcaaagtgctacttctaacttgtcaacacctttttattcagctgggaagtcctcagtgttgcttgatgtcaaaccatgggacgatgagactgacatgaccaaattggaagaagctgtgaggaatgttaagatggaaggcctcctttggggcgcatgtatgttactacattaaatttcttcctacgaatgtactgtcttttgcttttgctagtttggttagattgtgacatgaatatataccactgtttgcagccaagcttgtcccggttggttacggtatcaagaaattgcaaatcatgatgaccattgtcgatgatcttgtgtcggttgatagtctgattgaggactacttctacaccgaaccagcgaatgagtacatccagagctgcgacattgttgcgttcaacaagatctgtaagttattccataagtatcagagcccgtcgttttatttgctagcgttgttcttgttattatactgaagcaatcggatgaccagctgtcttattttaaggaatcgatcctatattattctttaaatgatgatgcatgccatatatattattctgtaaatgataatgtcctgatgtttcatatctagatacctcatttgctgcacattactctctttattcagtaggcttagatacctgatttgctgcatattactctctttattcagcaagttgctcatatctagatatctcatttgcagcacatcaatttgatttcatatggtcatgtaaatttcatctgccttgagccatccttgttcagaactaatgttttgattatgttttattgcagagatcttccttgagtcaggtgatggcgatcggtgcacaaagataaaaagaaaaatccggaagtttgaattaccgttgatacttcaatctagaagtttgaattaccattgatgtgtcgttcgtggtgtcaactagtacttgagcccgttttgtgttgagattgtagcactctacttctactgagatcgttttctcctcctttaatgtttaaagaccaatcaggttattattactgtgtctgcctgtgtcaccatagcggcattgttggtcgatccagttttgatgcggtcttcaattctcccgtctttcgctttgcttgattgcttcatcgcttttgcggctaaagtttttctgctcctaccaaaactgtaggggaaactttggttgtgctgtttgttctatctcttatgcattgcacagcctggttttttcgctcttctgaagtatagccctgtgcgctctcatcaggcctgtcctgaaatacgtgatttccgttcggtatcgatgttcggtttgtcacacatatcttctactttcttttctgtaatgaagagcattgtctactgttatcacttatcaggttcgaattggtgaattcacagctgagtgttggtgcatatatcacgatcaaagtaacaattatcatggcaaaataggtggtttcacctctcggtatcggttttcttccattggcatccctgactcgtggctcgtgggctggcattgctgaagcagcacttaggcaacatgcgataaataaagtttctcttcacaatcctcttgaaagctgctcaaggaatattcagcttacgataagcacatccgatctttgacctacataggcagcatatgatcctgagcagtaaaatttcctgcttcacctagtaaccttcactctttccattaattctttgtcagtctaccctggaaatcctcgactagtgtctactaggcactagctagtcaactgctagttcccagagggatacagcaatatctgagtgattcaccgcagatatgtcacccatcagaagttgaccatcatcagttactaagagcacccgcaatggtaaagtaaggtgctatctataaaacatgtacatctcagcaatagactcgattaatagtaaaccaccttaatagtatgtctacattggtatctatagctctctcatgcattgtctcgtttttctctatagactatctctaagttagtagatagctttgctctctctcttcatttaatacattccaagtaggaaaatatgctg

SEQ ID NO: 72062 - DNA, 9347 bp, Oryza sativa
aacatgcaaagatgccacatcatcatccactaattaacaagatgccacatcatcatccactaccaatcatcacatttaaatatcatgcaaacatgttatatctttatagtttttataatttaagagctttcaaatacaaacatgttaaattatcatccaacataatttacataatgtttcaatatatatctttattatgttttatgatatcctatatagttttatagttcatcctcatttagttagtgcttaaatgattaatctatggtccaaattatctttatcattttttcctctaattaagtcatatcacatcaattgtttttagcctttagatgattaatctactttccaaaccatctccttatttttcttcttccaaaaagtcataccaccttactctttacgtttgaatcaccattgtacatactatttaaatttaaattatcataaaccacattaacttacttaatctgatgttatctagctatcttacaacaggttatttttttttattgttatcatactaaatttcccgcagcaatgcgcgaggtttcacctatttttttaccacttctttaccactgcaccccattgtccaaatcagtgccacgagatacgatatcaggaaggcagtaacaatgattgaacacatttttcgttgatagttaagaaattcgtaggaagtgccagtaataatgatctagaaagcattaagcatcactgccataaaattcacaagtttgtaagataacatagcatgtcaaacatcacacaggaaacagtaccagtaaatttcatagagctccccagcattaatcgatatttagaacaacaattcagtatacggcaggagtcatgattttacatgcccgtgcttcgaactgtccaacattcgctctctttcctgcatcccagcctttgaagaccttcatctagaccccattgagagtgatcacaattttccgggaggaagcattgtcacgatgttcacagagccatataccctacacaaaataagtccatgaaataagtgctcaaaatttaagaagtgtgctctatgatctagacgggttttataattagttattttgctaggttacagctttgcaccggatattatcactgaaactatgcctgaatatgggatacaaagcaccgcattgccttaaaagataagtttaaactcgcgtgcaacataatcaacacaaatttcacatgcacgattgcatggtctcctaaaacttcatgacaactttttatctcctgtatatagattcgagaacttcatgatgaacttaaggtcgctatataaaacaacgaaacatttagtacttcaggtttaacctagtggctaaagtggtacttgttaggctctcaaaccatagagacaagtttatttggaaagttaacaaaaccagaatattttcggttagctccatgtataaatgattatgtatgaggatgtagtgccaaggaaggatttaatttggaagcttagaattcatttgaaaaacaaaatcttcctctggtatttaaagaagggagtgattctcacgaaggacaatctaacaaaaagaaattggaagggcagcactaagtgttgtttttgtaaccacaatgagacgatacaacatctcttctttgattttcatgtggctagatttgtttggagtaccctttttataacatttgggataaatccgtctaacaatgtttctaatatgtttgggatttggctaaagggtttacaatctaggctaaagcaccaaatctttatagggattgcggcgttgttgtgggcaatgtggatttgcagaaatgatgtggtcttcgacggctccaattttaactcttacttgcaggttattttcagggggacatactgggctcgacaatggttcttattgtgtaaagaagatgagcgtgatgtgatgaatgaaggatgcaaactgttagagacatctgtcatgcatttctttggtaaagatggatggaacatgagaaagcggttaaaggagttatgtggtcgttggtttgtttgggaagtcttttcactttgaaaggctttggagtctttgtgctcttttagttttataaattcccattatctaaaaatttagtactgcaggttgacaacaaaataaccagaaaataaaggatagtcaattgtgaaaatgatatcctatatgtttctattacctgccaagtgcccatattgagatgcccatcagttatagggatcctgaagcaatgcaaaagaagaatctaatttaatattttgttggctcacttgggagaaaattgacatggggaaaagaatgtagggattagggaacacatacgtcagggcacaaccaaacattgatgatttaatatgtgctggcatgtcatcaggtcctgcaatttgaacagcacagttatgactattgactaatatggcctgatctgaagaatagtacagtcttgactcttaacaaatcaaaaaaccgtatgctagagcaatttaataccatctgctactagttcagtacagcctaactggataccaaaagtaacctcttgtttctcaaaaaaaaaaaaaggaagtaaccacttaaataaccttctagagtgtgcttccaaggagcagatcggccctgaaaatagtgaacacacaatgaagtggctcttacatgatcccttgtttgatcatgatcaaagacaagacaaattgcaaccactgacctctggtacaattcggttaaggaaagtttcggtgtcagcttgtacatcggagtcatagttctcattgatggttagggaagcgcttgtgtgctgcactgtatagtgaaaaaaaaatcaatactacaatcgtacattcgtacattgaaaacatgtgtttacttggacatgcttatcagcttacgaacatgcatataattgacattgtcattactttaaagaaaatgaggatggtctattttcttatgatgccattaattgatgttgaacttatattacttccttgtataaattggttcacacggattcaaaacgattccagtcaaccacaaatttattctctcaagtcaatcccatgcacaagataaaaacaagtttttaacatatcatcatatcagaatagtttgctaaaaccctcgcaataattaaatcccacttaggccatattcggttaatccctaagagagagggagggattggaggggaataacttcacaccccctcaatccccttcaaaccgaacaaggcctgacggatctgaacaagcacgcatcacatcagcatcagcatgttcaggggaatttacctacaccgtatgcggttatccataaagtactttcagaaaattgcctagcacagcaatcgatcaacaacaaaatcgagctatctaagcaagagcgatgatgaatgaatgaaccgatcatgagttgagttgagtgtgtgcatctacatacagaacagatgcgccaagccgcacttgaacccggacaggtcgccctcaatctccctcagaatctgcaaaaggtctcagtcaagcaaagcgctggagcaaagagatgtacggacatggcgacggggagggagggagagaccttgggggtgatgaggtggcatccccggcgctgggcggggatgacgattgtcttctgcgcccacttggcggccatggaggagtgcgccgcgggcgggccggcgacggccaggccaggggatgcgaccggacggcgcgcaacggcggcggcgggttgtttcgcagtcgccggcggggagcagcgagcgagcggtaatggactggtggtggtggtggtgggccccgcgctctggaagcttcggatgggtgaatgccaacgcactagcattcgaggccgtcggatggatgatcaacgcttcacagaattcctggagaaaggtgcggaaaaagaaaaatactaaaatgagtaaatttcacgggattcctgtatgtttaaatccttagctctaattttatatttgagttataaatgttcacattttgtgattaggatcccgtttgtttctactgaaaaagtggatgaaaatttgagtactcatgacacgttttttaaactactaaacgatgtgtttcatacaaaaagttgctctaaaatattatattaatctattataaagtttataataattaaaacttaattaatcacttatttacagaagaaaagaacaccacctaaattgatatcatttactatatttcattttaaattcgttgttctatgataaatttaattttatgatacatcctattaaatacgtagttctataataatttaaccaaagtacacgtagtttttatggaatttacctttctcaaaagaaataatgtccgagcacgatgggccgcaatcttggcccagtcacagtaaaaaaaaatctcgtaaaattgagggggttttacgcattttttggaaaaaaatagcagtagccgcagcggaagcggacagcagcatcacaatcagcgagatgcaggcggcgctcctactcccagcgcggccgtcggcggcggcgccgcctacgctcttgcggcggggggcggcttctgcgtcctccgcgcgcgctcccactcccctccctgcggggcgcctcagcggcggcgtgctgagcgctgtgcggcgccttaccgtggcggcggcggggtcgtcgtcgtcgtcgtcgggccctctctacccgacgcctccccccaccgagcaggacatcgagcgggccaagttcgagcaggtgcttcgctaatgccgcacccccctttgatctgtctgtgcctggtagaggtgcctctgcttgaagtagggttaatcgtgtgttcgctgatattctcgagaaaactcatgttgctgtaccacttggggattggggatgtatctagtgttggattatgtagtggtcgcgtgttttccgatgtgcatttgggtatcatgaggtttagggttcaggcatcgagcgattagtaatctgatgtctctaagacagggaattgttacaattaagcgaaggtaatgatttttttagagatatcgtctgtaagcgactcgttctcttttctgtatattgtgatgacgttaatcgcgcataattgttggattcacttctgttagtttatcaaccttgctgcattaagttttccttatcgtgtgtcctgtcacatctattgctttctgattgaagtctttgtgaagcatctggttaaacaatataaatatataatgtgtcattcttcgctaggatatgatttataccttttggttactctattatcctaaagacacggcatcattggcatacttcgaattttgataccagcataccaccacttcttcctacttgtataacagaataccttcctgattatgaagctacgccaaggccatctttttgccttttagtttgatatgccatactcaatttggtttgtaaagatatttaatattcttgatggaccttgttggttaaccttcatgatatttttttttaagattgggaatttgctatttcttcatgcttgagaattttacataataatgtatacgccacaccttttaacttctgtatatgcttgttttagcctaattgacatttttttttgcccatttccgtggagtaaatggcaggttgtcaagagactggggaaaacagcgaggtatttcaagaatttgggtactcttgggttctggtcccagttggtgtccacagttgtttccgctggaattttgtcattttctacagttattactgggaaggtgacagcaccttttacattctatgcaactgctgctggtattgccgcgggttttatttcagtcttctggtcatttggttacatccgcctttctgaaagacttagaaaaacagcaagtgaacctgctaaggtactctctttctcaaccccattccctgttttataatgtctcaacactgcccttaactcattttcgtacttgtctgacttctattggacggctgaactggtgctttcacataagtgtgttatatgtctgcttttggagttatatattttaggtggttattttgtacggcaagtttgatattcttcttatttgcctttttggtaataaaataaaactgtgaattgctttccaggctcctccacgtgctgatgtaattagaagtctgaaaaatggcattgtgctcaatatgctcgggatgggtgctgcagttctcggcatgcaagcaactgttggggctttggtagcgaaggctcttactacctctgcagtaccttactatcaagcaacttcccctggtcaaagtcctgttttggctctagatgttttcctagttcaggtatttgatttgcacatatcctttctccccttgaaccattttctctccaaattttcagttgaaaataagcaccatggttcactctcatttttctgcattcaacattctggtgctggttttcaagtacttaactcatttctactaggaagtaatacgtttgtacacttgcagtttttttaagggcccctttgaaatggaggattggcaaagattcatttgcctaacgaattttcctatagagccctttgatccataggaaaacttccataagataggaaaacttccatagaatagctttcctatggtcaattccataggaaaataagcaagaggttagacctcttgtaaaactttcctttggttgagttttttctgtggtgcaatcaaagggcttcttgtgctctcaattcctgtaggattgaaaaaacatactaattcaattcctgcgtttgccctattcctacaattttcctatcttgcctttcaagggggaacctaaacgacatatatttgtttatcttggtaaagaacgctcactgagaggttcatgtttacatgatattctatactatcatctactttaaatgatttgtctgattctatatatttttattaacgttaaggatcatgtatgtgtaatagcaacgagataaatccagcgtactatgcctcactctgaataacaacaaaatataactaccctaaatatttccaaactttccctgcttttaatcatataatccttcttccatgttgagtagaaacttatattataaccatgttatcatttgctatgatggaaaatgaactactgaattgttgtttttggtcatcattgcacactccagtttatgatctgacccgttgtagtgccattaatcatgttgaacaatcatgatacgcaggcttcagcgaacatcatcctgtcgcatttccttggcctggcgagctccctggagttgctgcgctccgtggccatccctccagcagaagctgctgcggcgtgagcatatcagcgcatatgccaaaggcaagggctcccgttgatcatcttgctcttcatttgctgcttcgggctttggtattcgctaggagtagcaccgctcgtccgcctgtatgtttcttgtccagacaaaatttaaaaaaaatctagctttcactgcgtaaatttcatcttgcttgatgctgagtagcagcaggttcacatgaacagcagtacaccggggagctggtggtggtacacgtacggtaagcacacaggctttacgagttgaatttgtgagcgtacaatcgctaaggttgggccgagttgttgggtggtggcactgctcaccaggctgcaggctacggcacgggtggaccatggaatgggctgggccctgctcccgcccgtgcgactgtgtcctccccagcgcagcacgagcggcggttgcgctcacgccctagagtagaaatcaatgaaacccatgatgcccccccccccccccccccaaagcgaaagaaaattagtaccactacagtactaggagtatgtgttgaggaatcaggaaacttgacatgttgctaaatgacccagtttatctaggagtacttaattttgaagagtccgtcgtgtcaaaaataattggaagagtccgtacacatactagtggttgtgggtttgctctttgtacacataaatgtgttgcactgttgcttgtttggtgcctccaacgattttgcagtggttatatagtagtagcactactccgtctattgttagcatgcacttccaattatgcaccttgacaatccaaacagttgtttaaattaaaattcaaaatttcattgtactacacgtactactcttaaatataaggtgttagagaaaggtacataaggagattatcgccctcattggatggcaaatgctttggctgataagccatttaagcaaaataagctaaccaatttgtattgaagtttggctgaattggaggtagctttggctgatcagccaaagtatttggccaaccgatgaggccgtataagaggatgttataattagttgagaaaataaaataaataaagaattaatatagtaaaagattatgattgattgagaaagatgagtgctagtccctttaaatttgactaagtttatagaaaaatatactaatattttcaatacaaaacaaacatattatcaaaatatattcgatactaaattcaataaaactaatttgatgttgtagatgctgctaatttttctataaacctagttaaacctaaaaactttaacccagaaaaatgttaaacaaatatattactaactgcactctactgtgtccgtttgtccgctcgcgggggcgccggaatctctccgctctccaccacaggcagacacacacacggcacccctccctccgcccgaccacgcccaacacgtccgctcccgcagactccacaaccgcagttcagttcagttcagttcacgcacgcacgcgctgacgcgcccgtacaccaccagcccggccggggagagagagaaatcccgagagaaaacgagaatatcccgcggcgtcggcagatcggcagcgggtggttgagctggtactagtacgactagtcgtcagtggagtgccggcacgtacggattggaggcagacagaccgggtcgactcacctcataatcatttctttcaaaaaatctgcagagatcgtggctgtccgtcttgtagtgagaagcaaaaaaacggtgagattcgattcgcggctttggttggttggttggttggttggttagctactgcaaaaatcacaaaacaaaccggtctccggaagttgcaaggaagctgcgaaacgggtggctgctctggttgtatagtactcccctggatctcacgcacaaatttatgggcgtgtttagttcacactaaaattgaaaatttatttgaaattgaaacgatttgacggaaaagttgaaagtttatgtgtgtatgaaagtttggatgtgatggaaaagttggaag

SEQ ID NO: 72063 - DNA, 11006 bp, Oryza sativa
aaatttaactagattggatatttagttatgctgtgtgttcaccaacaagcgcgggccgagcgacagagacatatgctatcctccaacagtagcatagctatgtactcgctccatttcagtttaaaagaggtttttgacttggctcacaatcaaactactttaagtttaactaaatttatagcaaaaagtagtaacattttaaacccaagataaatttattataaaaatatattcaattattgatttgatgaaactaagttagtatcgtaaatattactatatttatctataaacttagccaaacttaaaacagtttgactttgactaaagttaaaacgtcttataacctgaaacgaagagagtatttttaaaaccacaggaggggaaaagagaagattgagaaaatacgcaaaatgaggtgagccattagcacatgattaattgagtattaattattttaaactttaaaaataggttaataagattttttaaagcaaaattcattttttttaaaaaaacacaccgtttagtagttcaggaaacgtgtgtgcggaaaacgaaacaaactctctctctccggctgccgaaggcagcctaacaagtttgaatgtttattatccattttcagtttttttttaaacattaaggttttactacaccagcgaataatctttttataggtcgtataaattgataacctcatacataagtggatttgcgggttagccacttatgttcatcagtgaataatctttttatacatcgaataaattgataatccgatatataagtgaatttgtgggttagtcgttgggtgagccaccacccggctctgccactataaaatctcccgaggaagatgacgaggagtcagtcaacagttgactagctgttcgattcggccatggccaccgagctcactgagtacttgctgctcctgccgcttctcgtcgtaccgctcctctacctcgcggcgtcgtcgtcgcggaggtcggggaggctgcggctgccgccggggccgtgggcgctgccggtgatcggccacctgcaccacctcgccctcgccggcgcgcccacgcaccgcgccatgcgcgacatggcgcggcgccacggcccgctcatgctgctccgcttctgcgagctccccgtggtggtggcctcctcgccggacgccgcccgcgagatcatgaggacgcacgacgtcgcgttcgcgtcgcggccgatcgggccgatgctgcggctcgtgttccagggcgccgagggcgtgatcttcgcgccctacggcgacgggtggaggcagctccgcaagatctgcaccgtcgagctcctcagccaccgccgcgtccactccttccgccccgtccgcgcggacgagctcggccgcctcctccgcgccgtggcggatcaggccgcgtcgtcgtcgtcctcgccggtgaacctcaccgggatgatctccgccttcgtcgcggactccacggtgcgcgccatcatcggcagccggagcaggcaccgcgacacgttcctgcggctagtggaggacgggctcaagatcatgccggggatgagcttgccggacctgttcccctcgtcgcgcctcgccatgctcctcagccgcgtgcccgccaagatcgagcgccgccgccgcggcatgatgggcttcatcgacaccatcatccaggaacaccaggagagcagagccgccgccgaagacgaggaccttctcgacgtgctcttgaggctccagaaagacatggactcccagtatcccctcaccaccatgaacatcaaatccatcttgatcgtaagctctcctccccgaactccggctacttccccctcgtcaaaaacgaaatcctcttcatgtaattcgctcgaatccaggacatgttcggcgcgggcagcgagacgtcagcgacgacgctgcagtgggcgatggcggagctgatgcgtaacccggcggtgatgcgccgggcgcaggacgaggtgcggcgagagctcgccgtcgccggcaacgacagggtaaccgaggacaccctcccgagcctccactacctccggctggtcatcaaggagacgctccggctccacccgccggcgccgctgctcctgccgcgggagtgcggcggcgcgtgcaaggtgttcggctacgacgtgccggccggcacgatggtgctcgtgaacgcgtgggcgatcggccgggacgcggcggcgtggggcgccgcggcggaggagttctcgccggagaggttcgagcggtgcgagagggacttcaggggggcggacttcgagctcatcccgttcggcgccgggaggaggatctgccccggcatggcgttcgggctggcgcacgtcgagctcgcgctcgccgcgctgctgttccacttcgactggaggctgccgggagggatggccgccggcgagatggacatgacggaggcggccgggatcacggtgcgccgccgttcggacctactggtgttcgccgtgccccgtgtccccgtgccagcgcagtagacagctggtgttatcttatctaagccaatatgagtaatcgcaattaatggcagaatttaccgataatggccgtctttagattattttttttctaaaaaggtcacatcgaatgttggacacatgtatggagcattaaacatagaagaaaaaaatcaattgcatagtttgcatgtaaattgtgagacgaatcttttgagcctaaatataccatgatttgacaatgtgatgatacagtaaacatttaataataacagattaattaaacttaataaattcgtcctgcagtttacaagcgaaatctgtattttgttttgttattaaactatatttaatattttaaatgtgtgtacgaatacttaaaaagatttggcccagcaactaaacacagccaatttcatgtgagcagtagtcaaatggtctccttgattaccgtcattagtcaaaatcgcagttcacatcatcacatattcacatggcgcgaaagattacgacacgctaccaattaccaaacccccaaacactttcccccctcaaagccaaacaatgattgaggcagccatggccggcggcgccatgccgctggtcgtgctgctccttgccaccatcccgctcctgttcttcaccatcaagcgctcggcgcagcgtcgtggcggcggcggcggcggcgaggggaggctcccgccggggccgtgggcgctgcctgtcatcggccacctgcaccacctcgccggcgacctcccgcaccgcgccctgagcgccctggcgcggcgccacggcgcgctcatgctgctccgcctcggcgaggtccaggccgtggtcgcctcctccccggacgccgcccgcgatatcatgaggacccacgacgccgcgttcgcgtcgcggccgctgagcccgatgcagcagctcgcgtacggccgggacgccgagggcgtcatcttcgcgccctacggcgacgggtggcgccacctccgcaagatctgcaccgccgagctcctcagcgcccgccgcgtccagtccttccgccccgtccgcgaggccgagctcggccgcctcctccgctccgtggccgaagccacctcgtcttcctcctccgcctcgctggtcaacctcaccgagctgatctccgccttcgtcgccgactccacggtgcgcgccatcatcggcagccggttcgagcaccgcgacgcatacctgcggatgctccaggacgggctcaagatcgtccccgggatgacgctgccggacctcttcccgtcctcccgcctcgcgctgttcctcagccgcgttcccggccggatcgagcaccaccgccaagggatgcaacggttcatcgacgccatcatcgtcgagcaccaggagaagcgcgccgccgccgccgccaacgacgacgacgacgaagacgaagacttcctcgacgtgctcttgaagctccaaaaggagatgggctcccaacacccgctcaccacggctaacatcaaaaccgtcatgctggtaatcaagctctccctctctctatctcaaaaaccttcgtgttacttgcagagtccctgatcatggatcacttcccatgtttcatgatcctaggacatgttcggcgccggcagcgagtcgtcggcgacggtgctgcagtggacgatggcggagctgatgcgaaacccaagggtcatgcagaaggcacaagatgaggtccggcgagcactcgccgggcatgacaaggtgacagagccaaacttgaccaacctaccctacctacgactagtcatcaaggagacactccggctacacccacccgcgccattgctactgccacgcaaatgcggaagcacgtgcaagatacttggatttgacgtacctgagggggtcatggtgatcgtgaacgcgtgggcgattggtagggacctgacgtattgggataagcctgaggagttcgtgcctgagaggtttgaacacaacgggagggatttcaagggaatggacttcgagttcataccgtttggagctggacgaaggatatgccctggcatcacattcgggatggcgcatgttgagcttgttctctctgcacttctgtaccactttgactgggagcttccacaagggatggcggcaaaggatctagacatgacagaggattttggagtcacaacacaacggcggtctaacctcttggtgcgtccaatccatcgtgtatcggttccagtagagtaaacatacttgtaagatatatttataataaatgtaattgccaatgtacgtatattagtttcagtttaattttgtttttttataattggtaaaagtcgagtttgacattatatgtttgtggagtgatatatatatcatattaatttatttttattttttttataattatttaggtgacatgaaaaaagatataagaagatgtatcctcaagtgatgaaaatctctctccagatatacaatttctatgtatgtcattacttgttcaatcttctataactagggggcagataacttggttcatttgggctcattatcctctaattttcctcttgggtggtgcatcagtatattctccaatgttaatgttctctctgaaacctataaaacgttttgcactaatcagtaatcaagtataatcagttcggtttccgcattttgaaagaggcatgaataagttgtgtccagtgtggttttgacgtgagatgcacggacacagcgcacgcagaacatgtgcacatccgtgcagggcttcgtacttgtagaacgcaaacctgttcgtccatgtcgcgttctcccagacatccgagccgtgtcgatcgcgtgagctgccatggccggcgaactcgcgttctatctgctcctcgtaggtctcgttgccgtgccattgctcatcttgctcggctccgagcggcgcacggcggcgaggacgcggctgccgccggggccgtgggcgctgccggtggtcggccacctgcaccacctcgccggcgggctcccgccgcaccgcgccatgcgcgacctggcgcggcggcacggcccgctcatgctgctccggctcggcgaggtggaggccgtcgtggcgtcgtcgccggacgcggcgcgggagatcatgaggacgcacgacgttgcgttcgcgtcgcggccggtcgggcccatgtcgcggctctggttccagggcgccgacggcctcgtgttcgcgccctacggcgaggcgtggcgccggctgcggcgcgtctgcacccaggagctcctcagccaccgccgcgtccagtcgttccgccccgtccgcgaggacgagctcggccgcctcctccgcgccgtcgacgcggcggcggcggccgggacggcggtgaacctcacggcgatgatgtccacctacgtcgccgactccacggtgcgcgccatcatcggcagccgccggctcaaggaccgcgacgcgttcctccggatgctcgacgagctgttcaccatcatgcccgggatgagcctcccggacctcttcccgtcgtcgcgcctcgccatgctcgtcagccgcgctcccggccggatcatgcgctaccgccgccgcatgcgccggatcatggacagcatcatccacgagcaccaggagaggagagccgccgccgacgccgccggtgacgacgacgacgacgacgacgaggacttggtcgacgtcctcctcaggctgcagaaggaagtgggcgcgcagtatcctctcaccaccgagaacatcaaaaccgtcatgatggtaagctcgacgccgccatggccgaacaccgaaagctcgacgcgcgcgccaaagatgtctccaccatttttctccctcgcttctttcacaggacatatttggcgccgccagcgagacgtcgtcgactacgctggagtgggtgatggcggagctgatgcggagcccgagcgccatgcgtaaggcgcaggacgaggtccggcgagccctcgccgccggcgccgccggccacgacacggtgaccgaggacatcctacccaacctcagctacctcaagctcgtcgtcaaggagacgctccggctgcacccgccggcgccgctgctggcgccgcgccggtgcgacagcccgcgcgaggtgctggtgctcggccacgacgtgccggcgggcgccacggtgctcgtgaacgcgtgggcgatcggccgggacacggcggcgtggggcggcgcggcggaggagttctcgccggagaggttcgagcggtgcgagagggacttcaggggggcggacttcgagctcatcccgttcggcgccggccggcggatgtgccccggcatggcgttcgggctggtgcacgtcgagctcgcgctcgccgcgctgctgttccacttcgactggagcctccccggcggcatggccgccgacgagctcgacatggcggagagctccgggctcaccacgcgacgccggcttcccctcctcgtggttgcacggcctcatgccgctctccccactaagtactgtaattaattatcaccaccatcaaatcatcagaatctaaaccaaaatatcttaagagttaagatgaaagcaaaccttaaccaaaagattaatttatcatcatgcccatgaacattggcatcagtaactgtaagttgatgaatggttcatatttgatacatatttccttttgttgactacttggatgagattctgaatctttttgtagacattttttgctgttgaaataactacacttttgacttgttgttcatggatggcatcgatattttctatctgaagaagactaaacctgatgctttacagtaagctgcactggacggcgaatactaatcccttatctcaacaatggtagagcaggtacaatagcaggctataaaccagctataaacatattttaaaaagataaagaaaaatagagaaaagtagcgggctatagatctgtagccagctgcagcacggactccaagacgtaatgtgtgtatgacaggtaagattaggtattaatagtatagtaaacaattgtatgaattggttattacattagctataaatgatttggagttagtattgggctatattattaaacttgctcttaatagcttatctactgcttgaccatggagtacgtcacagttgctgtcacatgaatacttttaacttttcttgcttgaaatttccaagctgaaagaaactcttacaaatagaaaccctagtgttttttttttaaaaaaacagattgctcaagtgagttcttacatttttttatttaaaaaaattcacttataaatagattggtagccaagttaagaccaaacagtagtagcaactagcaaaggcagctcagctcaagtttagagtgagaggtgagagctcagcggcgcgccatggcggcatctcggcttgcgctcctcctcctcgtcctcgccgtcgccgcggcgcgccacgcgctcccggcggcggggagcgacgcgcacccggggtacgacggcgcggaggacacctgcggggtcccggcggcggcggcggcggcggggaggatggaggagtacggcggcgggcggatcctggacatcacccacgcgtaccgggcggacctgccggcgttcgcgccgggggcggtgacggggccggtggtgcggctcagggactccatggcgaacgggacgctctacaacctgtcggagctcaagatggagtgccacatgggcacccacgtcgacgcgccgggccacatgaaccagggccacttcgccgccggcctcgacgtcgacaagctcgacctcgacctcctcaacggtacgccctcgccgccgccgccgccgccgccactttacttgttccccttcctgctcgcgcggcgacatggtcgaggttttgtgtggtgcacgtgatgccaccgatgccggctgcggtatccgtaaaggagattagtacagggggaatttgggataaatttggagatgaactcgaagacgagatggggaactatagataactattttgttctgctacctgcagcgctagatcagatcctctaccttaagtcacatgaatttattactaacatagtgacatgtgtgtccaataggtaattgttagtgacaaaggcacggtgacgactttaaaggtagatgatctcagtccgtacccaatacgtaatttgcacttacatatatatgtttttttttaaaaaagagaggcaaacttgctaaaatatgtttccacaaaaggtgtggagaaatactacgatttgtatagttcacaaataggataaatggtacttatagtacatatatcgctcaaaatatcaaatacttcctccgtttcacaatctaagtcattctagcatttccctgtctagattcattaacatcaatataaatgtgggaaatgctagaatgacttacattgtgaaacagagggagtacttctcaactttagtatgtgctaatacattaacatgttttacgtatctacgtgtacatttttctcagaattttgtaaagttcacacattataaaatttttaaatgggtgtagctattcctagatccagaaagaaaaaggctatgggtacagaactcatacagatgctgatgtggcatgccacgagtaaaccaagatttcttgtaactcccatatagtaaaatcaaacagttgagagctttgtttataagagttatgtaagatgtttttagttacaaacttacaatagtgaattgtccagtttgggagcagttctttacttttttttttgacgcaagttctttacatcgatatgaatctaagttaattgtctcctgtgcttctcctgtatacgtctatcgctctctgattacagttttgcctgagtggaaaaccaattctgtttggtttggcgtctagacgtttgtttggaattggaccccacctaactacatcaaaagttctcatcacaccctactcatttagtcattttgttattgcaaccaaatcgggtgtgtgctacatgcctacaattttttaaaataatttgaaacctagttggtgctctgtgtctgtcctttctcctaccaatcattaagatgagcatagaagccaaacctgtctttctgattttgcacgatctccctttgcatactgacagctgacaggatcaagtgaattagacagctccatttcagtgttaggtgctagtattagtctgccattgttccagttgcttctctcatgcagagttgcagagcacagcttcttgtcctgctgcttgcaaagatcaatttttcgttggctttgttccagcattgaagattcacctgatatgatttgatcaacaaaattaacagtttagctgaagaaatgttgtgaaatacttaatagtagctgtgaaatgcctattcaacaattctttcgaagtgcactctctgtaatgtaatgcattcctaaggaaattgcaaatgaaacttgagtgaaaatttgtcaggtagttatagatatttgaagttccccgcaaaaaaaaaaagaagttgatcgatttcctctttgctggacaggtcctacattattggttgatactccaagaaacacaaatataacaggtactattatgtatacttttcttttttccaaggagctacctgctctatcacgaatataattaataattatatgatatatctgatgaatttaccacattcagcagtgctgcccatgcccccatggtcccacagatatgacaaaaacatgaatatcacttctatgtcttgtatataaaatgcatcactgtttgcatgcactttctttatacagctaaagcaatggagtcgttaaatataccaaaaggtgttcgtcgagttcttttcaggacattgaacacagataggtatgtactcttttctggacatatattcatgcataatattcacaccttttcccatagtgcaggctcagtttttagaacaagtggtccgttgtccatatgctcattttcagcatttctcttttgcatctttacaatacagatatcattagttcatctatataaccaattaaactgtaagcaaatgatttgcaggaagctcatgtggaagaagggaggtgatctgagttatgtcggattcacagaagatggcgcacagtggttagttgacaacactgacatcaagctagttggtatgtaattctgagatatcttacacttaacagtggtattgataacttctttttccttgatcaagctagtattaagttacatttatggcctttttgtcggtgataaagatatgtatgcatttatcatttttttttgtttgatgagaatttaatgctatgctattggccgattggctactctgcaggtattgactatctatcagttgcagcatatgatcacttgatcactgcccatgtggtctttttcaaattcccggtacgacgctatccttgttctatttcagtacatctgtaaattggtcattctcacttctttaatctacttcaaaacaaatccttgacaaacattacagagctgagtactgactaa

SEQ ID NO: 72064 - DNA, 13586 bp, Oryza sativa
ttcagccatgaattaaaaaattgccaattttcaccgtgagttcagtagtcaactttgcagttatcgtgaaccatgcattaatgtgtttgaattgcaatttgcaatttgcaaaggtcagctttgtcatagatagccagaaattccggctgcctctgctgcatcacaattactacttcatccgtactaaaataaaatataagtaattttgaaccgatgagatacttttcagactatgaatctagacatagagtatatattgtatttctagaaagtgtctcatctgttcaaaatcttttatattttaagataaaggaagtatattgctgtgccagcatcatcagcatgggtgttgtgcttgttggagtgatcatacaggagttgcaaattgcaactcaaatcgttaacaatagtacagaaccattgcttaactgttctaaataacagcacatttactagctagtggatgcattccaatggattagtaaggacagacgcaatgtatcttgctggggtcaacagtagtgtaggccccaaatcaaatggtagttatcataaattgcatgatatgctatttttagagaaacaaattaaaccgtatctagttaatataaactcatttttatgtttgatatatttgttataacatgtagaagtggaaaacttgcatgttaatttgcatagtgatatatctcatatcaacttatcttatcatttttttatttacaactatttaggtgacatgaaaaaaacgagaagataaaaacacttttctgtagaattaagtcatcgaatatacgaatatgtttgagatagctaaatagataatatgttatgtatgggtggtctctgtatgttataagttgtaattaaaatgattatacagataatattcgtctaaatcacagtatttatgctctgaactcaactgcgaaaatttcatacaatcactattcatgctctgaactccacaacattcctaattaaaaggttgcatgtgcttgaatactaaaaaatcggcacccgatttttttacaactaagcacatataactaacggtagcgctaatccacgcgctgcacacggaatattagatcgagcgccacacagcgctccctccttccagttttttcgttttttaccacccacctttactccgcatcccacctttcatcagtttatttttttcgtttttttaccaccctatcttccgtggttcttttttctcttttccatcttatccgtgcttcatcaaagggcccggtaaaatattaaacatccagattttttttgtttttggttccttctctccagttattttgtttcgcgttttagtaaaatatttatcatctagtttttcttttccagttttctgtttttctagtgtctccccacgtttcaaaagtaacgaatttactccgtggagttttccatttactcctagccttccacatctgctccttctaaaataacaaatttactcgcatgaatgcccttactttttacttgcatgaatgtccccatatcgtgcgacaccattcctagatggtcgtaaaagaactactacctgcttaaaacactagtaattcttttactagtgttataaatattgtttagatttcgtggtctgcgagtaaaacaattaccaccttcctctcgatatagcccatgatctcgtagctactatgtagtaatatgtttactgatatgttcagtacactgtataagagtaaaagctgagacttcgtggtctgcgagtaaaacaattactacttttctctcgatatagctcatgatctcgtagcaaccatatagtaatatgtttactgatgtattcaatacacggtataagagtaaaaaatgatactaaaagtattgttaatctatatcacaaaatgaccgtacgaataaaaaaaattacaggctcaatcacatacaaatgataaaaattactcacaagtgaatcaaactagaaaagaaaaaaaatgattcaaccaaaaatccatcgtgaaactaggattctggtggctttcttggatcttgctataaggatggagatgccggtctgtgtcttgtgacaggtagtggagagggcaaccagatggcgagcggtagtcgatgatggaataatagaagggtgtagcggcatggtatagagatgggctcgacattgcgcagtagcagccatccatcatctagcaagcacgaaaaaaatgcaagaacattctcgttcatgttatagagacgacgagcaaaagaaaaatagcaaaaaacctccatcatcggcaaactccaccctatcctctgcggcgaaccacatggagcatgatgtgcaaatgtaggacctatgcagcccatcaattcagatcaagtaatattggagattgcacgttaatctgatttgcaaaaaaaaattggggcttcatgcgtgaaggtaaactagagtatgcagatgcaaatcggagtgctatttccttacgtgcttgttctgtcaatgtcgccgacgtggagcagccgccgattgttgctcttgacctaggtgaacgcctctttactagttaaggtgttgctcgacgtacggcagcgaggcccgaagcagcgccttcgcatcaaccgccaccggccaccgctcgccggccatcgcctgtcgtcgtcctcctccatggtgcgtcaccgatctgtgggctgggatgatggatcgatgcatatcccaaaaaaaaagaggaaaaaataaagtgggggcgagagtggttggttgggtacgggaaaaatagaatatatactggaatctgggaagttgtttttatcgaagtaaatcatttactccgataatagtgggagcaggatgatgggacgtggggtgggatcggaagtaggaaagttgtttttattatcgaagtaaatcatttactccgataacgatgggagcgatgggagcgggatgacaggacgtggagtgaggtaggcttagactaatacatgtttggtgctcgaaatgctaaggaacgtgctgcgctcctaacagcagtactacatatttaacaccgtatttcaaaatgcaagcacgccaaacacatgtttaactttgttggcaggatgctccttgagtggtgattctattgaactgttgtgaacaaactaattattggatgctgaattgatgagtacatacgtatacgtatacgtatataccaacaacctacctcagtacctctaattggcccgttggcttttgtttcagaaatcagaacaacattttctctacatttcaaatctaattcatcagtaaggatcatcaaaatcataatttgtgctaattagtaattttcatttgttttgcatagtagtgccgcatatcgatcagcttttacaaatcattgtgacatatacatttttcagtgtagtataaatatagtaaggcaactacacgattgctattggccagcaaataagagagttttttctcttttttttaataatggtatgaaacatcccggcctttgctcacaagagctatagtccattattacaaaagtagcacactaaaaagcttagtccaaagagttataaggctgatgattcctgcacgttaatgctaataagaaggcagcggaaatcacaccacagccaagctgtattaatgtccaaacctccaaatcgctttgcgcctttcaatttgcaattatttctcttgcctatgttttcattttgcaattatttttgtgctagacaacaaataataaatgaatcaacttctgtctatttataccatttccatgaagtgctcgacaactcacacccatggccatggtgcaatacgtcaccggctacctgtgcctctccttggctctcctcttgctcactctcgtcctccacaaggtggcgaggaaggcgaccggtaatggcgccggcaagccgaggcttccgccggggccgtggcggctgccggtcatcggcaacctccaccaggtcgcgatgggcggcccgctcgtccaccgcaccatggccgacctggcgcgccggcacgacgcgccgctcatgtcgctcaggctcggcgagcttcgcgtcgtcgtcgcctcgtccgccgacgctgccagggagatcaccaagacgcacgacgtcgcgttcgcgacgcggccgtggagctccaccatccgcgtcatgatgagcgacggcgtcgggctggtgttcgcgccctacggcgcgctgtggcggcagctccgcaagatcgccgtggtggagctcctcagcgcgcgccgcgtccagtcgttccgccgcatccgggaggacgaggtctgccgcctcgtcgccgccgtcgccgcggcgcagcccggcgaggccgtgaacgtcagcgagcggatcacggcgctcatctccgactcggcggtgcgcaccatcatgggcgacaggttcgagaagcgggacgaattcctggagggtctcgccgagggggacaggatagcctccgggttcagcctcggcgacctgttcccgtcgtcgaggctggccagcttcgtcggcggcacgacgcggcgggcggaggcgaaccaccgcaagaacttcgggctgatagagtgcgctctcaggcagcacgaggagcggagggccgccggcgccgtggacgacgacgaggacctcgtcgatgtgcttctcagggttcagaaggaagggagcctccaagtgcccctcaccatgggcaatatcaaagccgttatccttgtaagttgacaagtacttgttcttcacctcttccccttttcccctgcgaaatcactaatacgcgatcggtcgctgaaatctcggcgaggccatcggttttttttcttgccgttacctttccatttttgccagactcctgtgctcgagatctttgttttttccgtcgcttttttggctgttttttttctgttaccgaatggtgacgcgcggcgatcagcccgttccccatgatcctttttttttttcactcgcattacttttctgtttttagtaagtttatataactaaaggtggtacacatcaaatttacacaactaaaatttatatacccaaagtttatacattccaaagtttataggttaaaagtttatatacccggttcaaatttgaattcaaatttggattcaaatatatttatatatatatatatatataatatttctatacataaagtctatatgtacggaatttcatcaagtttatacatctaaagtttgtatacccaaagtttataagttaaaagtttaaatagcctgttcaaattaatttggattcaaatatttttttatatagaatatttctatacataaagtttatatgtatgaaatttcatcaggtttacacatctaaagtttgtatacccaaagtttataggttaaaagtttatatacccggttcaaattcgaattcgaatttgtaagtataaagtttattcacatgaatatatttttcaagtgtattagatttctttttatattttttaaatggtttaaaattgatagtgtggtagaaaggggagacgtgtgcggggagggacgcgggtgctgatagtttttttttatcgcttaaccctccctccagcgagcgatcgcgtactaggaccatccttttccctatggataatgataatagtattatctcccttaattttgataggacttattttattcaattttaacatcttcgacaccaaagctttaacttttaattggttgcaaaatagtacaaccttaataactactccatctgttcacaaatacagataattttaagcccttttgacttgtccaaaaatattaatgagtttaaagtactttttgtcttatcaatcatttatttttcaatcgtatcaccaatcactttctggatctataatccctatattcgtgaacggatggaatataagacatattttaccaaaccccttttacctgagtgcacttaaaattttactactgttaatgtaaaaatctataaagttttacctttaataataaaattaaataaccttaactgatgaatgggggagcatatgaaaataaaaaaaaaggtatgcacactgaacaaagaaagtaattgataagatattgttttttacgtatatgggaaatcatgttttttccatgcatataggaactttttggtgctgggagcgagacatcagcaagtacacttcattgggcgatgactgagctcataatgaatccaaaagtgatgctgaaggcacaagatgagttaagtaacgtcatcaaaggaaagcaaacaatatctgaagatgacttagttgaactgaggtacttaaaacttgttatcaaagagaccttaaggttacatcctgtggtgccactacttctccctagggaatgtcgggagacatgtgaggtcatggggtacgatatccccataggtactactatgcttgttaacgtgtgggcaatcggtagagaccctaagtattgggaggacgctgagacatttagacccgagcgatttgaggatggacatatagacttcaaaggaacagattttgaatttataccgtttggagctgggcgaaggatgtgccctggtatggcatttgcagaagcaatcatggagctcgttctagcctcgcttctctatcactttgattgggagcttcctgatgggatctcgccgaccaaggtggacatgatggaggagttgggtgcaactattcgaaaaaagaatgatctttatctcgttccaactgttcgtgtgcctatgtcgactgccctatagctgtttacacttaagagacaaaatatttgtctcatctgtacgcgcctatatgataaactatataacttttgatggattgatgtactcctactttgcatcctactcgttctacattattactttaaatttagttattaaactatttaatttatatatatgatcaagagtttaactcgtgacaataatttgataaataatatgttttaaatgctaaagtcctcctagcttgtcaattttgatggcggtcacctcattacacatatacatgtacttgcacgcacaatatctggtgtagactctgggatgccataaccatgaacaatatggagaaaggaggataatagtcgtgcctcctattgctggcagtagctctgctaacacacaatggcgttgtgtgaagagaagaggataagaggcgggttggagcctgagagttggaagggatgaggtggagaggggtgggacaaacatgagaaaagaggacttataattttgttttaaatttggtcaaatttaagaattttgactaaaaaaagttgaatgccttgtaatataaaacggagggagtaactattattaacagataaaattgtgtatagttgtattagtgccggtacgaaagtagtcgcgctgtccctctcattttgcaataatttctcttgcctatcttttcaaaatagggatagccgcactgtacctgactttttttttcacttacatgaatgaatgaacttctctatggaaactagtattttgatatctcgagcggatgtccacttgtctatttataaaccatccaaacaacaaagaaaaattctcaaatcgtctacactaacagcgtaaattttttaaatcattattcacacccaaatttattttttattctaaatgtgtaggtcgaatttaaacttagatttccgtcgctgatatatatccctatactaacattgttaatgtttttcagatttttcactaccatttacattggatttggaagaaaaaaaagtaacgaggggacatcccttaaagaagttagaatccactccattctttctctatatataacatttcttgttggcctccatatataacactcatagatcgccatggccgtggtgcaaatgcaagacgtcaccggctacgtttgcctctccctggctctcgtcctgctcactctcgtgctccacaaggtggtggcgatcgaggaaggcgagcggttgtagtggcgccggccagccgaggcttccgccggggccgtggcggctgccggtcaacgatcggcaacttccaccagctcatgatgggcacctgtggaccctcgtttttataacaggaatcaatcgtgtaaacagtaccatttctctgaatcaagtagtctggtacacatgagctcatagctgaaataccaaatactcatacacgagagtctagtgtgaattattacaacataagcccgcaggcattgtcttaaatcatcggaccgagcggtccggaatacaaccaaaagcagaattagataagacagcggattttaggcagcggcatgccattgccacaggcaacgaccgtactaagacctactgggcgacatcgtcttcatctccctcctggtagtaggcatagggatcctccggagcttcgtctcccgcttctgattaattttatattcgcaagggtgagtaccaaccgtactcagcaagccaccacagcaacaatgcatatgaaagggtatttcaaaggatagctatggttcttttgcgcaaagcaagttttgtaattctttttacaagcctcagacctagcattgactgatcaaattttagtaccagtgtttgtatttaaacaacgatggttctgtccaccatccattgtgatcccaaggatagcttcccgccattgagttgttatggttttctgaggatgcccaccttcccccttctcaggaagtggctccaacagcataaaaattcgtcatgcaacaacccatcccacacaagttaagaatttagagactagccaagtgtaatacatgtcccgatgctcaataaccgcgagcacgactattcgaatagatttggtttactcacacttcagtggatgtacactttacccgcactccgcgactgcccaacacatgagcctcgtcccaacacatgagacgtgtcacggcaaagcttttcgataacctcgcattggcagtacccgctccatgaactttatatcctcatgcactctaggcgtacacgatttctagcagtgagaggagttctggcgcacccgggaaaggaaaaacacatgcactcctacgttgcttcctgtcgttgtacccagtccatcatgattgttctcttatgggtatcctcatgtagtattgccaagccagtctctgaccatccggaacgggcatccaccatccacctggccatctgaaccgggcatccgccagcagactgcttgccgcatcacacacctaaaagaagaccactacgcatggatactgcctccgctcagctatctactccgctaggtctatacccatatgagaagtgcggttgtacgggggatcgtttcattcttaacttcatggctcggtccttaactgaccagggacggcactagccttttccggacatcacccaaatcctccatccgccccagtcgaaaacatttgtttagttttattttcctttcacaaattatgtcatcaatatcatggcaatgtggcgctcatgtctccacatgccgcatctcaattaccttcccaaaggtaattgcccaagcatatagcatttgataaatatgagtatgcataaatctagagtagcatttctaagcatttgtcatagttgactaaggacttatacgtaaatcatagttacaaggatttaagggtaaacaataatcaaggcatggcataatcacaagtaggatgttcataactgcatgcaattttatttgtaaacaaaacaatttcgcaattgggattaatatgttcaaggaatagtgatgacttgccttgctctaggtcttgtgggccttggccttcacccggatccgcggctccctcggtctctatagttacatgcgtaagaacaatttgaattcgatcagaattcaaacaaaatccacataatgaccgtattgaaaaacgagcgcgggaggtgaattttatataggctactttattcgcgaagtggaattgttcttcttcctaagatattttgtaagttatagtcatgtcctaagactcatcgaattattgagttcttaatcatatgtaaattattatcgcgaacttgatttcttagggagattactaaaaataatctatagattataatctataggagttcatccaattatattttcattaatcctataattaaatgctagtattttaggtatttaattagtaagaattcatctaactatattttcattaatcctataattaactttcgcaattttacgactataattaacctacgattaaattcttaactattttgaattttctaaacttctaaattttactcaaaccctatttattttctttctcttcctttccttttctttttccccttttttttcttctttcccttctcttttcttttctctctttttcctctcctctctttctttttctctctcttctctcctcccggctcctttctttcttttccttctcttcctctcttctctttcggctccttctccctctctctctcgccctgcctaccgagaccggctgaggaaaaggaaaaaggcggcggcggcacggcttaccggcggcaacggcaatggtggcggcgcacggtggctgcgacggcggtggcgcacggcggctgcgacggcggcggggaacgcggcacggccaaggcgcggcgcggcgcggcggcttcgtggcggcggcgtggcggctctatgcgacgacgcggcggcgtggaggcggcggcgcggcggcgtggaggcggcggcgtggtggagtgggtagaggagaggaggtgaggatggagggaaagagtgggaatagtggagtttatataggagaggggaagagataagggggagaggggagaggggagacgcgacggcggcgcggggcgcgaggtgggggcgcgcggcgcgaggcgacgcgacggctgcgtggcgcgagcgacgcgacgggcgagcggcagcggcggcgcgcggcgcggcgcggggcgcatggcgacgcgacagcgacggcgacgtgcgagcgatggcgacggcgcgcggcgatgcgacggcgatggcgacggcgcgcggcgcggggcgcgagacgacgggacggcgcggcaggcgtacggcgcggcggggcgcgagatggcgacgtgacgggcgagcggcgacggcgacggccgacggcgacagcggtagcggcggtgcgcggcgtgaggtgtggggcgcgggcgcggcgtcggcgcggcagcggggcagggttaggctagggaacctcgtcgaacacctggctggctaccgaatagtgccgttttctatttaacccgatttaagcctattcatttatttaaaattgattctataaacctaaattttgtacaaatgaagttcactcaatatttgtgttattccaaccaatgggtccatccttgattaattttacctatattttatttttatataattttcttgaatttaattagagttaattcttattccgacacttttaaatttaattgatacaaatatagtcgtaataatattttactcatttctatcctcaccaaatattattttaaattgcactttaattatttacttagtcaatttactttttagggtttattcctaactaattatccattattcgcgatttataaactctgaaatcaaaatctaataaaataatcgaacaaaatcggcatgatgcaattttatttaaaaagtttttgaaggcccatatttttgaaactttgatttttgttcgtcgaattttcagggtgttacagcaccatggccgacctggcacgccggctggacatacgcgccgctgatgtcactcaggctcaatcggcgaactccgcgtcgcgcgtcgtcgcctcgtccaccgacgccgcctgcagggagttcaccaagacgcacgacgtcaagttcgcgacgcggccgtggagctccaccgtccgggtcttgatggccgacgggttgggggctgattggggctagtgttcgcgccctacggcgcgctgtggcggcagctccgcaagatcgccatggtggagctgctcagcgcgcgccgcgtccagtctcatcgtcgctatcgccggcgcggcgacgcagcccgtgaacgtcgtcagcgagcggatcgcggtgttcatctcagactgcgcaccatcatgggtgacccggttcaatgcaagctagggccaaggatcacataagattgtgatatgacaccaaaacatactaatttttcacatgaatgtagattaaattatcatttacctactatcttgttatatagaacataaaaataaaacgtacatctatactcgtgagaagctcgagctcggctcgacaaatctcacgagtttggggctggacttaggctcggctcgttaagagctcgagctgagctcgaatcgagtctgagacgagccgagctcgaatcgagtctgagtcgagccgaactcgagcttttttgaaagctctaccaaagcctggaggtaagaagggatgaaggaaggggaggagagggaacaggagaaaagaggctcgctattcagcaatcatagtgaaatttgatcgattttatgaatatgaacttggaacatggaatttggaattttggcttggttctaggttttagtgtagtgtggacaattcagctctggaccatgctagtttggcagttttgacaccgaaaaatttatgtttcaagcatgactaacagaatttggagttttttttttttgaagtgagtatattggcaaaactcccatactcttgaagacttatttctccacctcgtgcaataattcaaaagcaagtgaatatgtagtgtaaatcacttatgtctgaaaatctccacacacatacagttatactatatatgtttccaagctcatatctttctacggatcactctcaatgggtcaaatcggcttacaattacgtacttggcctagtttagcccaatgtatttagaattatcctttttatgtgcttctcgctggtgaagacacgtcctgctgcaatttgttcttcatcagcgacaccgtacgtccaggttgttgtgagatatttaactatttatcactctaactggcaatctggcactaattcagccatgaattaaaaaattgccaattttcaccgtgagttcagtagtcagctttgcagttaaagcgagccatacattaagtattgcattaatggtttgacttgaagtttgcaattttcaaaggtcagctttgtcatagatagccaaaaattccagctgcctctgctgcataataattactactacgaccgtactaaaatataagtatttttgaacggatgagatactttctagactatgaatctagatagatagtatattgatgtcctgaaagttgtctcatctgtttaaaatcttttatattttgagacaaagaaggtatattgctgtgctatcgtcatcagcatgggtgttgtgcttgttggagtgatcatacgggagttgcaaattgcaactcaaatcgctaacaatagtacataaccattggttaactgttctaaataacagcacatttactagctagcggatgcattcactggtgaagaaaccgtctttggtcggtcgcccgaaa

SEQ ID NO: 72065 - DNA, 3685 bp, Oryza sativa
tcagcaaatcctcttggtcgcgcgaagtacgaaccactattctgcattccggacatctcctgtttggctgtctccatggcattagcggttcttcctcctcaccttgctgcgattatctccgtcccagcctctgaatgattgttaatccaaaccgataggtttaaatggcagaagcaatgctttgtcttcaactgttatcgtcgcctattgacgcttctggagcatgttctgtagttctaggatattaaggtcaccttaaatactaaaaaatggtttgcaaaattaaatgtgccaatgaatcgtagaacaaacaattaaaactgctacatgactgtggagtaccattgtttttaaggtggttttagaagatacaattatagctaatttgcgaacagaagcaaaaaagacgctttggccgagtggttaaggcgtgtgcctgctaagtacatggggtctccccgcgagagttcgaatctctcaggcgtcgttaattttttttcctttttttattttctcctgtttatatttttgtgttagccttttcctgtttgcattttttttggggtgagatttcagaggttaatgctcgtctagacgtctactctgtcgatgtgagactgacttgtgatcatctgttaaattgttgatccttgtgggatgtcaatgtgacgattttttgtgatcatctattaaactgtcaatccttgtgggatgtctgctatttctgtgaagtgctcccgaccccaatagatgattgatcggtgttcggtggtgggggttgggaatcatcacccacgcacgaaaaatggagtgatttattagcgcgtggttaattaagtattagctattttttttttaaaaaaattgatcaatatactccatccattccaaattaatctacatatttcataggtataccaagaccaagaaaagctaataactctctcatactatatttactctagcaacaaactcaatgcatgcaccatccccaatatttcctagccaataataaatcaaggtattgtatatgtgttataaatacttgtgtgcatggaatgcatgcatcaatgtccatttactccaatgcacaaataacgaatagactctaataaataaacacaaatgtgtagatcatttaggaataacctcaaaaaaaactatatgtagatcgatggaatggagggagtaatattttaagcaactttcgtatataattttttttgcaaaacacacgacatttagtagtttgaaaagcgtgcgcacgaaaaacgagaggggagttgggaacggctggtatcgaaaacagcgagtcatttatcgtaactcacgaacttaaatcaaacggttaagattttcctttaaaacatctctagcacttctcacttcatatggttctcacagaagaagaaacaaagagtagaaaataaaagagtcatttatcgtaactcccacgaacttaaatcaaacggttaagattttcctttaaagcatctctagcacttctcacttcatatggttctcacagaagaagaaacaaagagtagaaaataaaaaaagaaaacaaaaattaacgacgcctgagagattcgaactctcgcggggaaaccccatgtacttagcaggcacacgccttaaccactcggccaaagcgtcgcttgtgaatgcggaaagcaacaaattttacttgtttccatccaaccatgcatatacccgagcctcgaatttcatttttacctctcccgctcaaggggacgggagtttgatccgtcactctagatcctgacctaatggacaccggcgccgaccaggcaccacctcctcctcctcctccccctgtggcggccgcctccgccgccgccgacgagccgcgggacctgcgcgtggtgcgggagatcctccactcgctggggctccgggagggggactacgaggaggcggccgtgcacaagctcctgcttttcgcccaccgctacgccggcgacgtgctcggcgaggcgaaggggtacgccggccccgcccggagggagtcgctccaggcagacgacgtccgcctcgccatgcagggcaggggcatgtcttccgccgcgccgccgagccgtgaggtaattgatttgagcccgaagcccctcttcgcttttgtggaattttttttcgccggtgttgtttgctgcggaggacatcgaattttccatcgtcggttgcgaaatcgtcaggactgcgtggtttttggggttggatcttgcggttttgtgtccaaatcggagccttttagtcttaggaataggtgaatttctgcaaaaacggaatccttttgccttcggatcaggggatttgtgctatcaaggcagctcactaaccctttagcctttggatcagtgtatgttatacagatacgccatttgtagactaagacccctttaattctaaggatttattgagaaacttcataacatttgaaaaaaaaaacatgttacaaaagcagacactcattcacccctatgaacacaaaacctatccttatgaacaccccctaaaagactgaaccggcatgtgttgtgattcatgaagtcaccacaaagatgtctcgctatcaatggatatgttgcctatcaatgaaagaataattaatcataaatgcaagcacatgtaagtctagaacttgaacctgggtaggctgattccaccacaagaacctaaccagttgagctacgctcactttgctcctatttggccctttgatataaaggattggagctttttaaatcctataaaattcctatggaatgacttattacatatagattttgaaaaaaattagcaagatctcatatctcttggaaaattttcttcgagtctatttctctcttctgatacatgcatttttttcttgtggtttataaatcaaatgactattcctgtctgttttcctgtgctttatactttcattcctatcaaatttcgtgcttttcctattctccgttttttaatccaatgtttcaaaggagctttaataggtgtggatggtatacttttttggcaagaagatgatataactaaattaatgctgacaagattttttctttaaaatacttgagcttctaaccctacttaattgtcgagtgctctccaaaattcacaaagccgcaataccaaattggaaaccgctctttagcagttttcttggtttttgtgaaaaattgataaagaaatgatgaaattcagatatatttcatttaaaattggaaattcacttggttttctatttgactggttaacaaagctgttttgttaactcaagccagttcaaaacctcaaaattgcatgaaaatcaagcagtttttgttggttttgtaaaccgtgttggtcccttttattaaattttaatgtttctttactcactaggaagctcttcttttgagagcgtaggctagttcctctaaggttagttacaaggtggtgataggcatgtgaatattggataagcaagtcgatggcattgtctaaggaggaaatggtgtataaggcgacccaatggagaggaggatgaggttggaatgtggtagaggaggtcgggatacaaagaagtaggtaatagttccaactgaggatatgatgaatgggttttatggtggtgaagaagtatgcggcggaatctttgggcagcaggatgtgggagatagga

SEQ ID NO: 72066 - DNA, 1520 bp, Oryza sativa
taatgtttctttactcactaggaagctcttcttttgagagcgtaggctagttcctctaaggttagttacaaggtggtgataggcatgtgaatattggataagcaagtcgatggcattgtctaaggaggaaatggtgtataaggcgacccaatggagaggaggatgaggttggaatgtggtagaggaggtcgggatacaaagaagtaggtaatagttccaactgaggatatgatgaatgggttttatggtggtgaagaagtatgcggcggaatctttgggcagcaggatgtgggagataggatcacacttgggttggaggaggttgatgtttgtggcaaaaaaaaggagcattgaatgtggctctggtagcaaaagaagaagatcaatcacaagcataggtaatttgatggcatcaatcaatgtaaaaaaaagataaaatagcatatgagagggcaaaataaggaagtgaagctagaaaataagtgcaacaaaaggagaggcaattttttacaatggaaaataaggggcacggtcaattatagaggaaaaaataactctatattacttatcttttttttaattcataaacttcataagtagagctaaaaatatgatatgatgttttgggggttatatatgatgttttttagccaaccatacattgtcatgtcaatcctagaagtctcttatctattcttgttcaaattgaattattttgcaacgtagaaatgctcggttgggcctatacaaggtcgagaaagtgacctaaactagccaccctaacatttctattatattatgcaacaaaatcatcttaagacaagttgtttttttcccaataagccagcccattaagggctttttgtgggtctattcttaaggaattttataagatcctatgttcaatcattatttaattggttgctataacgtccatatacacatgaaaaaattgtcgtaacatgacggatatcttcactttggacaggagatgcttgatatagcacataaatgcaatgaaattccaatacccaagccttgtgttccttctggatcaatctctcttccacattatgaggatatgctattgaacaaaaaacacatatttgttcctcgagtcgagccaacaccccatcaaattgaggaaactgaagatgattataatgatgatggttccaatgctaatgttgcctctcccaattccaattatgaccaagatctttttggatcgatctctcttccacactatcaagacatgttattgaaccaaaaccacctatctgttcatcgagtggagccggcacatgatcaacttgagaaaatcaaagatgatggttccaatgacaatgctgactcttctcattccaattatgtccaagattcttctggatcagtgtctcttcaacatcatcaggatatgtcattgaaccaaaaccacctatttgttcatcaagtagagctgacgcttgatcaaattgaggaaattaaagatgatggttctaatgacaatgttgactctc

SEQ ID NO: 72067 - DNA, 7367 bp, Oryza sativa
  unsure (1)..(7367): unsure at all n locations
accattcatgtacaattaacatcattctttttaatggatcaagtgttttcatcggaatgagttgcatcgggatgaagctctctgcacagcagacatattctgcagaccaagattatggacctaaatcctaaggagtggtttaaataacagtgagctgaaacagtagtgaagatcgatgcagaagttgagaagcatgtgacaaagaagatgccaaagcttaattagttggggtattgtgatgatctatcttatgcggttcctagtagaaatggactgcataaggattatctgtttcctgtttcttgagcacaaggggatcaatcgaccctccataattcttctcgtgtgtgaaaaactaaaggattgcagtcctcccataaatctgagttcatttcttgaggttcccaacgtcaactccttaatttcctagctaggcatacgcttcctggactactaagcgattcattttttataaaaaagaaatatatgaaagttattgtaaaaatttatattaatctactttttaagtttttttactaatacttgattaatcatgtgctaataaataatattgttttcaatgcatggaagaatattttcaatctctcctcccaaacatagcaagtactactctagtccgaaaaattaaggggcggagtcaagacccagccaccacgggcgagtgccagagctccgcccactgcattattacgtaccctgtttgattaacaaggaaattagtaaagttgtggagattatggataccccatatctatatgacggttgtaatttagtcggatatacggtaccaaatatagatggaatatctctatgaagactcgggttaggttctaaacttgtatgtcaaggaaatacccgggatcttagtcggttacgattgtattttatctataatcccatattccgttaggatatggactgtattttgtaaagcggactccttcccctatataaggagggtccgtgtgcctcttggggggcgattctttttccaatttatacaatcaataacacactaggcggaatcatccccagacaggagtagggtattacttcttgaataagaaggcctgaacctgtataaaattccttgtctccaaacccatccactttcctagcttgatagccacccccttttattattgccgaaatcttgcttcgacagttggcgcgccaggtaggggtagcgtcaagttctcgccgactaagtgcgatgggtttcgtttctggcatcgacgacttcgccttccctcccgggcaggtgttccggtttggcagcctcaacttcatcaccaacgacttcggcaagatctctctccttgactcggattcaaaccagtcggggagagaccaggtccccgtgccgttcggtattccgaactcggccgaggcctactccaagatcatctctcccgactcggcttcaaaccactcggacgagatccaatctactcttccgcgaccagatcaagacgacgggtcctatccctcaatcctgacgaaacttcctgatgatttggccgctgtcttcacagtcaagacatctcccactcgaagatctaagcgagctccggcttcggccccgatccgatctagatccaggaaggttggcgttatactccaacctctcgggacagtctcgacggaagagttggatggctacctcagctcctccggcgtcagttctcgaccaaccgagatcctcgactacgatgatttcggctaccactacgaccacggcgacctcgacaacttcgacgacagctatgaggataactacacgcccctcttcttcggcgtattcaaggctaacaatgaaatggaggaacagcaccaagcccgagaagcggaccaagatcgcgcacgacaagaagctgaacgtcatcgactagaggaagagcgacagcgataggagcgagaacgactacagtgtgagcaacaagatcacgaacggattgcaaaggaggctgaagatcgacgacaacgcgccttggaatctgggcggcgagcgagagagctcattgggcaacaagacgttgatgggacagcggtctttcgcaccccccagcagaacgcggttgcagcaatcactctcctcgacaccctcctcaaggaagacgcactcaaccaagcttatcatgtagtcaacatcttgaaccagacgaagaccatgatcgctgcctcggttccagccaactccgcaagcacccgcaccccaactggtagccgagtccctcatcttcgatctcaagactatcaccagccaagcctcagcattgccggcgtcaaatctagtcgcaggagcaggggacatgatgaacggtccgttcgctcgcctcccgagcgatatagggagcgccaagtcgaacgaccacagtccccacatcgaagatgccccatcgatcttcgcgacaccatcaaccagcgccgcgcacaagaggccatcattcaccggatcgctacgacgacgacgtggacggagttgctgccttcacaagcgatctgtgtcgagtggattggccagccagctttaagccgactggaatcgagaaatatgacggcaccaccaaccctgagtcttggcttaccgtctatagtctcgcaatctgcgcagcaggaggagacagcaaagccatggcgaactatctacctgtggccctagcggattctgcccggtcatggcttcatgggctaccccgcggcacgatcggatcatgggcagagctacgcgaccacttcatcgccaacttccaaggtacttttgaacggcccggtacacacttcgatctctacaacatcgttcagaagtctggagaatctcttcgagattacattcgacgcttctctgagcaacgtaacaagatctccgacatcaccgacgatgttatcatcgccgcctttactaaaggcattcgccacgaggacctagtcggcaagttcggacgcaaacctcccaagacggtcaaacatatgtttgaaaaagccaatgagtatgccaaagccgaagatgctatcacagcgtccaagcagtcgggcaccacttggaagccaaagaaggacacgccgactgcaggagggagcggaagtaacaaccacaaggatcgcaagcgtaagcccgaagaacttgtggccacaacctctccatcttcccgacaacgtccccgcgtcaacaccttcgacaagataatgaactcccaatgtccgcatcaccccaactccaaccacgtggccaaggattgcttcgtctacaaacaatttgcggagcaatacgtgaagaacgcacgtaagccctcagacggagatcaaggcacatcaaagaagaaagatgatgaagacgatgccccgactggttttcaagatcatcgcaaagaacttaatcacatcttcggcggacccctggcttatgaatataagagaaagcagaagctaacagaacgggagatcaatgcagttcagcctaacacgccccaatacctccggtggtcagagatagcaattaaattcgaccgctcagatcatcccgaccgagtggtccacccggggcggtatcctctggtactagacccagtggttcgcaacgtcaagctccgacgaactctcatcgatggtggcagcgcactcaacatccttttcgctaagaccctggacgatatgcagattcctcgcacagaattaaagccgagtaatgcacccttccacggtgttatcccaggattgtcagctacaccacttggccatatcactcttccagttaccttcggcactcgggagaattttcgcacagaaaatgtttgtttcgaagttgctgatttcgagacagcatatcatgctatactcggacgactggctctagccaaattcgtggccgtcccacactacacctacatgatgatcaagatgcctggtcctcgaggggtcatatcactacggaacgacatcaagcaagccgtcacatgtgacaaagaaagttgcgagatggcccaaactcacgagactactctcgcccgcgaagagatccgactggctgcgaccacggcaagcgagggagaagtgcctgcaaccaagctgacgaagaccgaagaaagtgatgccaagacgaaaaagattcccttagatccctccgatcctgataagactgctgtaataggcgctgagttagattgtaaataggaaagcgcgctcatcacctttcttcagaataataaagatatttttgcgtggaaaccatccgatatgcctggtatccccagagaggtgattgagcactctttacatgttaaggaagacgccaaacccatcaagcaacgactccaccgttttgcacaggacaggaaggatgcgatcaaggaggaattaaccaagctgttagcagcaggcttcattaaggaagtccttcatcccgactggctggctaacccagtcctggttcggaaaaagacggggcaatggcgcatgtgtgtcgattataccgacctctacaaatcttgtcccaaagacccttttgggttacctcgcattgaccaggtggttgactcaacggccggctacgagttactcagcttcttggactgttactcgggatatcatcaaatccgactaanagaatccgactgcttgaagacctcgtttattacgccctttggggcctactgctacatcaccatgccctttggattgaagaatgcaggagcgacctatcaacgcatgattcaaagatgtttttcaactcagatcggtcgtaatgttgaagcttatgttgatgatatagtcgtcaagaccaagcagaaggatgatctgattgcggatttagaagaaacctttcaagcatacgtgctttcaagatgaaactaaacccggaaaagtgcatcttcggagtaccatcagggaagttgctcggatttatggtatctcaaagaggcatacaggccaacccagagaaaatcaacgccatcctcaacatgaaaccgccaagctcccaaaaagacgtccaaaagctgactggttgcatggcggcgctcagccggttcgtctcacgactcggcgaatgggggatgcccttcttcaagctgctgaagaagactaacaatttccagtggggacccgaagcacaaaaagcctttgaagacttcaagaaacttcttaccactccaccagttttggcctcaccacatccaccagagccgctactgttatatgtgtcggcgacctcccaggttgtgagtacggtcctggttgtcgagcgtgaagaggaaggccatattcaaaaagtccaacgaccaatttattttgtcagcgaggttttagccgactccaagacaaggtatcctcaggttcaaaagttattatatggtgtcttaattaccatcaggaaattatctcactactttcaaagtcactcggtcacggtggtcacatcgtttccactcggggatatacttcataatcgcgaagcaaacagacggattgcgaagtgggccttagaattgatgtctttggacatatcgttcaaaccacgaacttcgatcaagtcacaagctttagctgatttccttgccgagtggaccgagtgccaagaagacatgccagaggaaaagatggaatattggactatgcattttgatgggtcgaagaggcttacaggcactggagctggggttgttttaatctccccgactggagaaagattgagctacgtattgtggatacatttttctgcgtcccataatgtggcggaatacgaggcgctactccatggactaaggattgcaatatctctaagtattcgccgactaatcgtccgtggatactctcagttggttgtcaatcaagtcatgaaagagtggtcatgtctagatgataatatgaccgcttatcgacaagaggtacgcaagttggaaaataaattcgatggactcgagctcacccatgtcctccgacataacaatgaggcagccgacagactggccaattttggttcaaaacgggaagcagctccttcagatgtgtttgtcgaacacctttacgaaccgaccgtgcccagaaaagagacagtcgaagccatggatattcaaggcgtaagcatgatcgaagccgactggagagaaccgtttataaaatttttgagcaaacaagaactacctcaagacgaaaatgaagccgagcggatttccaggcgcagtagactttacattattcatgagactgagctgtacaagaaaagtccgtcaggaatactgcagcgctgtgtgtctttggaagaagggagacagttgttgaaggatatacattctggtatttgtggtaaccatgccgctgcacggaccattatcggcaaagcttaccggcaaggttttttctagcctacagcggtgtccgacgctgacaagattgtgcgaacatgcgaaggttgtcaattttttgccagacaaattcatttgccagcccaagagttgcaaaccatcccgttgttctggccatttgcggtctgggggcttgacatggtcggcccgtttaaaagggtagtcggtggttacacgcatctctttgtggctatcgacaaattctccaagtggattgaggctaaaccggtcatcacgatcacaacagataaagttagagattttttcatcaacattgtgcatcggtttggggtacctaatcggatcatcactgacaatggcactcaattcactggcggagcatttaaagacttttgtgaagacttcggcattaaaattttttacgcctccgtggcgcaccctatgaataacggacaagtcgagcgcgctaacggcatgatattgcaagggatcaaagcacgagtttttgaccgactacgtccctatgctggcaagtgggtagatcagctgccgtccgtactttggtctttacgcactactcctagtcgggctaccggccagtcgccgttctttttggtttatggcgcagaagcaatgttgccgagtgaagtggaatttgaatcactacgatttcggaacttcaacgaggagggctatgaagagggccgagtagatgacatcaaccgactagaagaagcccgagaagcagctttaattcagtcgactcgatatttgcaagggttacgccgttatcataatcggaatgttcgatcgcgagcctttttagtcggtgacctggttctgaggaaaattcaaacaacacaggatcggcataaattatctcccttatgggaaggacagttcataattgctgaagtcactcggccaggttcttatcgactcaagcgcgaagacggtactctcatcaacaattcttggaatattgaacaccttcgtcgattttatgttaggcatttcgcttgtatc

SEQ ID NO: 72068 - DNA, 2838 bp, Oryza sativa
ctcttcgccggctttagcgtacacgccagagtccgtcctcagtatgatcttggcgtcctgcgtgacgtagcacgcccagttgtccacgtaggacagcggcccggccctgatcagcggccgcgtgtcctccacgtcatcgtcctcgtcattgtgctccgtgtcatcctcacactcctccctcagtaggcgaacctgcttgacacaccacacgcacacacccacgagtcggtaaacttttgttcatattgatataagatgatgggctgtagtaatggtgagcagtagtagcatgtacctcattgaattttgtgagggcgtccataggatgcagatggtgcagaggaggaagaaggagatgagctcccacaccgcggggattacccacgccactcgccaccgctcgttgtgctcatcagtcgtcttaaaatggacctgaattttgattttagaatttttttcatacattattttgaagtgctaaaagtcttcttatgttaattaatttacgagcttgtactaatgtaccacatgaacagttagtgtcatgacgataaaagtcaccagtaatgtggacgaaaacaactaaggttgtgtttagttccacgcaaaattggaagtttaaagaaattagaatgatgtaacggaaaagttgaaagtttatgtgtgtaggaaagtttgatgtgacggaaaagttggaagtttaaataaatgagttgaaacagggcctaagaaaatgattagtcatttatgagagcaaaaacaaatgctgaaatgttcaggccctgtttagatgagactaaaacttttaaatccctatcacatcaaatgtttttggacactaataataaatattaaacgtagactattaataaaacccatccataatcttggactaattcgcgagacgaatctattgagcctaattaatccatgattagcccatgtgatgctacagtaaacattatctaattatagattaattaagcttaaaaaatttgtctcacgaattaactttcatttatgtaattagatttgtaagaagactatatttaatactctaaattagtattaaatataaagttaagtccctggatcctcagttctctgaagttgctgagccatcagaaaacagctaggactgcagcgaagttatacctcaaatgtgatccagccgagcgacagggccacggcgatggtgagagaattcgcgaatttccgatacatttcaagcttcgccgtcatcctcctcgcctgcaagaatcagattaatcacagaattcattgatgattctcgaagaattattcgaattttggtagaattttgaaagtgggaagttcaaatgatgctaccttgagcttgctgatagttcttgacagcgaggtgaagatccagtagatgaacaccgtgttgagggcggcgacggggagaatgaaaaaaagcctcctcgccggcgagtggtcactgacgatgccgacgttgtcgccgacgtcgagcacctccgccgcggcgaggaacgcggcgccgagggcggccaccctggcgttgccgcagcccagtgcgggcctcgtcacgccgtaccccatggccacgagcagcgccagcacgcggcacgccgcggcgcgcacggcgcccgacgtcgccgcccagaacgtcgtccccgccggccggacgcccgacgcgtcgaactcggcgaggtcgaggtaccaggtggtgaccttcaccatgcccagcgcgatggccgccgtcgcgaagttctgcagcggcgacacctcgcgccagaacctcgcgtaccgggcgaaccagagcgcggcgagcgcggcgaacgccaacgacattggcgccgtataacggcttgagcggcgccatcctccccgggaggtagccgcggctgttcttccagatggtcttcccctccgcggccaccacctgcccggcggcgagcgacgcgtcgcagtggacgaagtggaggctgtacatcccggtgcgcgccacggcgacggtctcgtcggggaacgccgcgacgaggctgcccgggaggaacgacgcggcgagcaccttgggccagcggccggtggcgttcgacgacgcgggggcgcggtacacgaccgccccctccgtgcacccgcctcgcctcgccatgcccggcgtgcagcacagcgcgcgctcgccgccgacgacgtcggacaccgccccgacggcgtcgcggtcgccggcctcgaagatgaccgccgccaccgtgaccgtccggttgccgtcctcctccgccaccgacgccgcctccggcgtcctcctgaacgccaccttctcgaatctgcaccaagaaacccccccatggcgagcgcgtcacatcccaagaaccaattcaaacaacgaagcaatgacacttggcacccacaaccagctccggccaccgtaccggacgaacgactccgccgtggccgacgcgtagacaccctcgctgccgccgtgcagcacgaagccattgccgacgccggcgaacctctcgccggcgtactcatgcaccgacgcctccgcacaaacgacggcgcaagaaacgaccaccaccgccaccgccgcgccggcgaggaggagccgccttatcgaaggcatcactgacatcgccggagacgggagactgctgctaccaccaccgccgccgcggcagcatcggcggcggcgtggagtagaaatacgagaggtggagggatcccgagaagtggagggagaacggaagagacgactttgacgttgggaggcaaccatgaattttgttaggtccacccccttaacttcagaggaaaagaaaaagaaaaaaatacagagaatccattgcaata

SEQ ID NO: 72069 - DNA, 19428 bp, Oryza sativa
tctcacaactaacgtggcgccatgcggcatccaatttggttgctagtgctgcttatcgatcaaaaagtgtgaatacagtggtccacgtgtgaatacagtggaccacgtgtgaatacaatggactgtcacgcaattgtgcatctatctgtgtacatttgatcgtttcttccaatcccgtgcatcacgactctaggtgtttctctcctagggatgaaattaaatggtcgaaactatattatcatttttattgttttatgtaaatagtagcgatagcgatactactgtatatcaagatacctctatacttttataaccaatttaaatgaatacccacttgtataaattacataagaggccagatccagtcgccggggtgccagaactggccaaatgagcacaagatttggtggttcctcccaaggcacgacctgcctcccactatccatcattggtcgcttccctagcactgtcgcctcctcctctacctcaccatctgaattttccgatggcgactcggacggtggtgaggcagaggcggtggtggttgtttcgcatcctagtcgcccctgaggtgggagcgatgcggacggagctcaccttctagagttacggttctatcaatcttatttcaagagaattgaaacacataagaaagaagtggcttattatgaaagctgcgtcctcacggcacctctcctaaaaacacacctaaaaacatgaaaaatggaactatagactatggcgtcgttagtccacttagtgatccaattacaaaactatatgttatttgtccctcgactcacaaaaagaaactcaagttttatacctaggtccgacccacggttcactatttatgatgtggcatcatttttttttggttatattttatttgaagaaaatccgagctagaataataaatccctcaactactgtgaaaattctattatttggtcatattatatttgaagctttcgtcaatttggaaaaagcctggcacctgttgagtcagctagacttgtatccggtgttttggtttagtagacacacattaatggttgtgttatgatgattatgatatggaattttcctttagtgttgatttgcatcaaacaaaaatgaataatcactactggagaaaccatctttaatgggttgtccaaaaaccataatagtctcggttgcttaaaaaaaccagggctaaaaaaatttttagtcgcagttaaaaagggtagcggtattttttctatctcctccctagcgcgtagatcaacaaaaatcaaacagagcaagcgtgtcgatcaattctcaaaaaaaataaagaacaaaaaaaatcagaggcgcccagctcccttatctgttctcctcctccactcctccccatccatctcttcttttcttcctctcctccttctcaactcctcctccagatgcacttctcatttagttttctccttcttctccttctccactcctcccctccccttatctttgacctagctggcaggcgggagggccgcggcggctgcgtcgggggcggccggcgccgggcgggaggccgcggccggcgccggttgggaggcggcggccgacggacaacatgtttttttttcttctcttctctgttctctgtgatgaatgctgacgatgttgtagatgtgaactttttttttctctgttgtctatgatgaatgcttgttgtcctggagatattgtagatgtgaataaatgcaaagaatattgatgctttgatgttgattttattcatttgatttgtgatgatttgggcttttttttattttattcattcgatctatgatgatttgggcgatatgcaaagagtaaaagaacaatgaaaaagaaaaaagaccaaccggataaaaggaaaagaaaaaaaattttttaatcctggttggtaacaccaccggtacagactgttgcacctcccaggatcagcctgatgccgcgcattccaaataaaaacgcaaaataaaagatcatcgggcgcaaccaataaaaaatcgccgcttcattgatttcaatataccaggtactaaatattttcacatatcaaagaacgttgtagttatgttagaactgaaaaaaaatatcggaagaatgggagcataaattaagtgggtcacgttgtatatggagtgtatggtccgatgaacgtgctttgctggatgatggtcttttatattgaatttttacggtataatttattggtagtataaacaatccaatgacgaattagtttcctaccctactgcataaatggttttttcagggcgagaccctctcctctcctttctcactctctcacctcttcttctcactcttctctcctctgcgcagctctcctatctcactctcctcttgcagccagcggtgggcggcgcggccggtagtgggcagcgtggcaagcggcaggcaaggggcactgctggtggcaggtggagggctcgaccggtggcatcaggcggctctgcctccgccggcctcgtgacgggcggcaggcggtgctatcaacggtgggcttccccgcgcatcgacggaggcttcgatagctgatctggcaactgcggcgaatgcaggcgccggcaacggaaaaggcggcaactccctcggcccttccacgcgcggatcgagcgacgggctcgagcgggaggccgggagcggctctcccctgcccttccccatgcggatccggcggtgggctcaagcgggagggtaaatttgtctttccatgttacacatgacgggcagttccgtaaaaacccattcttcactccggtcgaaaggaaaataatcgttagctgtttcgcgatgcccagagaaaagcaggaaagtagcttgtattataccgttttcctctccctgttttgcggttgcaatcttgtggatttatcaccacgtagtatgtacctatgccgaatgtcgatgatcaggaacaagattaattatgcatagctagattaaagtgtgtttaattagagaaaataatcgccaatttgtttattactagtatttattaatgtattagatcgtcgttattctttggttgcgatctatagtgggactaaaaattaaatagtcctgttgtaaccaccaaccgagactaaaaatccatttttagtctcggtttttagtgtaaccgggactattatgattttcgccagactgatcaaatatggtttcttcactagttaataaagaacgtctgcacctggacatacgcactcgcgcactgtgcggagtgaggataaccggctcgatgaaacagagcaaagcaaatagataggggaaaatagaggaagtagagaagggcaaatctgtatatggtaactcaataaaattcagcagaccaagcatgatttcacgttatcaacaaaccatatatgatttctccaggaatttcacaacaaaaccatcgtgaccttctctataattatcattgatggtttttatgcacaaagcaatcatcaacgcaaattatacagaaggtcacatagatgtagtggtggatctagagtcctaacgtgtctatcgttatcatagcatgctaattatatttagaatatagtgttataatatatagacaagcaatttaaacatagcttttgtcgaatgtcatcgctgtcttctgacaccagtggtaacactgtagatccgcctgatagatggtaagcgctaacaaaatattatgttcatgttatcggatattatgataaaatagtaaccaaatttatcccataccttttagtaagttttaactctccaacaaagccatgatagtaatttcatcaaataacaattatcccttgtatatctaatctttatctttatttactacgtagtaaaaaatacatagtagtggtggtgagtcctggataatctaagggccgatattacccttaggatcctcgtgcagatcaaaaggctcagatacccctcatgctgtcccgcaccgcccccacctccgtatcacaccgtccgcccgcatcacaccgcctgcccttggacgcccccgttacctcctccttcatgccacttggcgctgcctccgtggcgcccccggtggctccttcgttgtgctgctgccacctcctccgccgcaatgctactccatcgcttcatagcccctctcctcctccagccctatgctccctgctccgtccggtgcaccgccacttcctatccccatcatgtattccaactttatatctccctactgctgtcatcctccaacttcatatctccctactgctgtcatcctccaggtaattgattctatattggtttggtttatcggatagtccgtggaagatcgagctgctgctaagtcaggatacatacatgtcacagcttaatttttgtttcaggatttataaattatttaataaattattaatagaatttatattaaatgttcattaatttataagtgaagttaaatgtgggaaataaaatttcctaaatataaagcatggatggatttaatttgtattaaattctccatgattaattatactctggaattttcttggatttttcagagctcaattattaattttaataatacaaagaatatttcagtaattattcacatattaaattaatcattaaatgagctggtttcaattttgttaaatactttgagtgttcaagtatattcaagatttttcttggaattacaattgaaagatcatttcagtgattaatttaattgggaaaagtaattaaaatccccttttcctttttgggccgaaacaggaaagttcacctttagtcctcggcccattcttctttctattcggccggccttatcccttccaatagtctagtttgcatccctgcttctatcgggctgtgcaatagaagcccagacaaaagtctgttttgcctccctgacactgttcatcttccagctcggacagagtccgagccagccatgcccgtgtcctgttgccgccgcctcctccttccaaaatccggcctcctcgttgctcctttttccaaattagttgagggaatggaatcctctcaatctcctctacaatttcccaagaaatcccaaaaagtttctatggaaatcctttccaatttcgcggatcaatctttccttttccggcgaagatccttaacattcccgcagtttttcccgtcgatatgggcttggacccgagctcccggtcctatataaaggaccccctagtcgtcctctacctatcccctcaaatcccgtcttccgccgtcgccggaaacgctctccccgcgctcgccttctctctccacctccggccgctgctccagccgccgtgcgccgtcgctgtggtcgtcgccttcggtcgccactgccgccattgggttcacgaggaggagaagaagatcgtcctccacttccccgaagccgaaatccacctgatgaggacataattagctcggatataaccatgactaccttatgtattaatcaaataaaggtgcatatgttctacattagatatatttgttatatatttgaacaaacgctgccacacaatgagtttcgtgtgtttttgtttgcagaggtacttgcttgggcgaaagaaaagagaccgagcgtaaggaatgcatggatgattgaagaagttgattggggaccaaaccaagaccttctgcaagtcttcttttttttttgaaggttttctttcatcttaacacgtcacttttggtccataaaagaaaagagataaagttctacacgttttgatttcggattcaggcctcctgacagcatcaactttaaatggacctagcctctgatctagaaggaattttgaggcctatgagtacttgttggaaagcttatgggtctactttcagatggttttgtccccatgtcaaaattcctaccgagctgccggaaatctgcaaaacaagccacatatctcatccagtccgaatctgatttgggttttgggccttgtaattgtgtcgtgggcttagcccaagggatgtgcgccatagggaaaccctaggacatccctaatcatattaattcagtagccgtcatcgtttagagttgggttttgcttagattatcctgtcaagaacagtttcgccgctagatcggtttgtggaaccccaaattcgagtgcttaattattcatatgcaatttggttacaatctatcttgttcttgcttgtgttctttaattcgcatgcagggattagccttctcggcgaggtaaaccgggtttcggcacttttgataaccagaggagacgtggtgctgcgattacggggctcagtagcgtgttcgttcagaagccggatcgagttgtgtcacgactccacccaaatctttgtttatcaataccaatcggaagatcgggacctaacatccctcatcaccaccggagctccatcagcgccgtcaacccgaagttcaccgtcgcgttttgatatccagcgaggccctgcagcacctcccattgtcgccaagttttgtcaccgcctcctttgggttcgcagctgcgaggtgaaggccgtccactcctccattgtcgctgctcatcgccggaaagtcgtcgctgccgtggaccagtacatcgccaccattcggatctcgtcaccgccatcttccgtcgctctccgtcatcacgtaagtgttggtaaggaccgtcgtctcgtgctctttctcccggtgtgctccctttttgccgctgctccgtagttcaccggtgatcgtcgctcccgtgtctgccgtccagtgatcccgcgtggttgtattatctttgccacgtcgttgcatctctgctgtcacttcaccgccacctagccacttcgttgtctctgctgtgccatgtctaactaaaccctagaatggattcaatctaatccgttggatctcagtcaactctcggttaagattaatctcagccatccaaaatcaatataaatccgttctctcttttcaatggcatattattcatttttaatatatgtcaactaccaaatataatctaattttttccagagattgttttaatcttttatctcagttataaatcatttgtatattgtttaattaatttggaatagtcttttctctaataggattaactggaattaaatcttgtaaaattcataactaattcatataaaatcggaatgaggtcgttctagtctcataattcatctacaatcatgatctacatgtttgtttactttatatgttctgtttatttggtttttattagtctttttcctcgttttgcatgttagcttgtcgttttcgtcgtttcgaaggttcgcgtgtgtgtcgtaagagttcaagaagataattgaagaccaattattgcaaggcaagccacacagatcctaatatacaattcctttgagcatgttgatcctatatttaaagtctctatttatttcaactgtgcatttattttcgaatgtcaccgggtggtgtgaacttattcctttgttatggccaatttgcgttcattactctattccttgataccttgtgttattataattttactagttgagctttgtatatttgttcagctagatgttagacataattgcttagccatgcttagaaacattagcacacaattgggataactaatgttttactattacttaatgatggatatttaattgtagctcacaatggttaatcgtgattggttaattaattaatatgccattaaaacttgataatggtgggttgtgagcacatggttttgatggttgtgctcatgacaattaaggactggttcacgagtttcggttgtgaaacattaaccgtgccaaccacaagccagcatgcgcaacgcctttaccttttgtatagcatggttcattgcggggcaccagattgagaagtggtggagataagcccacgggggtcgctggggagtccatgccttgtttataagggggtgattatgatccaggaacggtgtgctgtggtggattgtattatgcgaggggtactgtcacagctcctttccgaggtaccgtggtggtattgaggcgcatggtaacatgttgtggggctgtgtcttgtgggtacagtggtacacctctggctagagtaaaactattcgaatagccgtgcccgcggtcatgagcggctctaacaatgtctgtcgtgattagtctcacacttttcaccataataaataatgctataactggtaataatttgattagctcctggtttggaatgatacattcctggtttggagatagatctgtacagccgggtatggttgtttagtatggttgggtctgtgtagtatgggtgtgctgttcagtgttgattaatattgatgattaattactctactattttacaattctcgaatgtttgttaaatgctgcttttgtaaatgagccctatattatgccattctttggtatccttgtgcatttgcatatttgctgtgtggcttacggagtattccatgtactcaccttgcaataaacaatcaaacctcagttcaagaaaagttgcgaaggagaagacgtttggcttataccccaattgagctgcctgtgggagtgttgccggagcttcgctagaccgtaattccgctgctattttctcttttcttttgtaagtatgtaatgctgtattattgatgaatctgtatattaaattgtcagtttgtgtaccttgtctgattcctggacgaggatttgacacacaaattagttcagaaattactagtgaatttatgggcgtgacaagttagtatcagagccatctcaactgtaggataagccaaatggtcaaactttaaggactaattttcaaaaaacatgattttgtgaaaatgtttcctttcttccttctccagaattctttgcaaattgctttatcatcctttcctcttcctctttcagcttgagtagttctgaaactagttgttgaaacttgaagaagccaatgtggtctacttatcaagtggatcgaggaatatgaaggtgatgatcgatctgaagtgtccagttgtcaagaaggaatgaagtttggatcctaccttagaacttaaaccgccaaagtgactttgaagtatagttagtagggtagaacgcttttgtttgcttgtgtgtaggtatggttgcattctcatcattgaggaagttcattgatgagtgtgtaattgtactaggttgctcgtttaatcaacttgaacaatataatggtctacacacaccagatcagtgataacctagttaaggtctttatctttagtgtaacccctctccttctatcttctccaaatctgcaacgaatggtgaacactcatgctagtggaagtggaaacaataacaatgaagagaacccaacccttgctcaagttctggctcaacagactcagttaataaacatgatgatgcagcagatgcagaaccatctcaaccaagggaacaacaatgctccaccgccccagaacaagttagctgatttcctttgtgtgaagccgcctaccttttctagcactatcaacctagtggaagcaggtgattggctacacactattgagaagaagttggaattgctccagtgcacagatcaagagaaagttgtgttcgcttcacatcagttgcatggatatgcttcagaatggtgggatcacttccggatgaacagagcagaaggacaaccaatcacttgggaagagtttaccgaaggattgaagaagacacacatacctgcaggagttgttgctttgaagaagcgtgagttcaggacattgaagcaaaaggatcgtaccgtgactaagtttctttatgagttcaaccgtctagcacgttatgctccagaagatgtctgtactgacgaggaaaggcaggagaagatcttggaaggcctgaaggatgaactgtcagttacgttgatctctcatgactatgctgattttcatgagctggttgacaaagcaattcaactggaagataagaagaacaggatggacaaccgtaagagaagaatgactgttttccaggaggcacagggcagtagccagaggcagcatatcaagccatcccaagttggtgaatcaagtctaacatctcaagaacaatcgcaacagttgaacatcggtggtgagatcaattcagagactaatgcaagcaatgaagttaacatcaagcaagctactctatcggagccagttcagcaggatcagtctcaagaaaataacagtagtggaagggagcagcaagtatgtttcaactgttatgagccaggtcacttcgcaagaaagtgtccgaagccgaagcatcagcagccgcaaggtcaagtcaacaacattgtcgtcacaggagccaatgcagtgccagttgcgtcctcaagtgttacagctcagccaccagtttcaaagcagcagtagtcttctttaaagccttagaataattatcggagttatggaataagatagactgcagttgacctatgcccttttctttctagccgttccgaatctcgggacgagattctttgtaaggggggtagatttgtcacagcctgatttttgtttcaggatttataaattttttaataaatttttaatagaatttatattaaatgttcattaatttataagtgaagttaaatgtgggaaataaaatttcctaaatataaagcatggatggatttaatttgtattaaattctccatgattaattatactctggaattttcttggatgtttcagagctcaattattaattttaataatacaaagaatatttcagtaattattcacatattaaattaatcattaaatgagctggtttcaattttgttaaattctttgagtgttcaagtatgttcaagatttttcttggaattatttgagcattggaagtatttttaacaattgaaagatcatttcagtgattaatttaattgggaaaagttggcaatacaccgacgtataattgtattgacgtggatttccttacaaaaaccctaggtatacatatttaattataccctaaggttgatacaagtcctgattcgacacaatatagggccccatcatttggctttttcccaaataagccaaaacggcttattagggaataaaaaaatgaatttgtaggtaaaaattttatatatgtgttcttggtgacttaaaagccaatgcagaaaaaaaaactacgttgaaaatatctcaaaatcaatctcaaaattaattttaaaaatttaaaatttagctttttctttggctgattaggccatccgatgggagccataatatttcctaacaagaaaagaaataactaatcatgtctatttaagagatatactaaggaaaatataaagcagtattgtcgtagttttcaggattcctcattgaactcggcttaatctggataaatttccatctaccaatcagtttctttcattaaccaattccacaaaataatcgtaacaaattttggtgttaacaagaagtcaatgtgatttggaggatatatgaagatcttgtttcgtcgatcaccttaatggatggttcattccaccggtgctcatcgtctagttccatgaacaggcataatgacaatggtttcattgtctaatcagatctctttggttcccatttcttgattctccctttttgctaggaaccatttagttccaagaaaaactatcttagccaaagcaatgtactccctttgtcccgaattataagatctatatatttttttcacgatcttcaatgacttaagttaaccaataatttatttcatattgtatcatcaacaaatatacaattagcattacatggaagtattttataatacgaatgtaatgacataacatatataatacttggtgtagatattgttagtgtaattattaatcaaaagttatcgagtttgattttacttaaaaattaaggctccctataattcaggacagagggagtaagatgaagatgggctattatattgtattgcaaagttccaaaaaaaatctagtttattataacatgagtgatgtcagctatgaaacatgcgaaagtgaataaagccaaaatttaccgcagaagaaaataaaaatgccattttgtaacaacacaagcaagagagaaaaagaaaacctttcatgggtttgtggatcactggtttgcatgctagaaaataggcactgctgatgacaatgcaggaagttgatatctctggtacaggtcattgaactcatgaaaatttcagaacacataaaaaaactaaggggcaattgcttatttgaccctgttttgaactgtaactaccaatttaaccctgctttttaaaatgtgcttatttgaccctccttttaaaaaacgaagcactggtctgaccatattccgtttggatgagttaacggtgttaatttaggcgtaaatagtccattttacccatacttatttaacccagttgcttgtttgacctgcttcttatcctctctctctaatctctctctatctccctcgagcgctgcggcgacggtggcggcagttgcggcggaggaaagagcgacggcggcggcagctgcggagggccgacggctgcggaggagcagcggcgctgggagcgaaggggcggtggcggctcagcgacaccagcggtggtggtagaggggtgttgacgtaaaacacgaggcctgggagatctgctgaactccagtgcaggtccaaaactcgcgttcgggtatgctagcgtggcagttgatttgatcctgcaatcaacaagaaataaagacaaagaaaccgcagttaaacctataaatgatagctgatcggctagatgccgatgacatatcatttatctctgagccgatgtcatatgtaaatcaatcggcagttggaactagataataaaggactaaatctattcgatcggctatacatattaacaatatataattcttatatcgatatatatttaaatcaagtgattgggatagatcagtccctatgccgagacagtataaatcacttagatcgaaatatatattaataatagaactatatatgtttacagcaaatccgatcagatagatctagcatgtatcggctaatactccgatacagctctatgttaagatattaaaacaagcagaatataccaaaccgaagcttaatatacgtagatgcaataatatcttgacataaagagcagatttaacatgtcaacgaagcatatagagcaaatatagttaaaccagataagatcggctgaaactccgattctaccctaatcggcaaccagaaggcaggctagagactaatattctaagcacgacttaatagatcaaactcaactgatgcagcattaagtatgaaaagaagaacaatatgtagacaatcaagctgctggaagtttcatagagtggtggagatcttatataatctaaatcaacgtcaaaatctaacctaattggctgccctctattaacagatgttagccgattgtaggttagatagtgatattgccagagattatgtaagatatatcataactcgatgaattacataaacaagattagagtatcataaagatggaagcactaatcccgagaatgcaagccatcataacaagttttacctcttgttgaagatcgaaaccgatgcagctcaacccaaaagcaagaattcgtcgaaataaaacaaaagcaaaagggtggcgatgcgccgaaattgtattgaacgtgtgtgttaattgattacatggggttcggggtttatttatacacaaaaattacaaactatgtccatatcaaacatgactcgtatctctaacaaactctaagatacaataagtctttatggcagacttttgccctaaacatatctctaagaaaattacataaaatatcctaattaatagatacaattgccttctcaggactctatccaagtgcggcaaccatcttgaagcaccttaattcaacctgatatcgtatacgaagttgtattgtcagaatcggctatatcaacttactcagtccgattcggatccagccgatcctaatcgtagctgatttggactcctgccgattcttgctctgttctcgaatcgatctccgccttcgactccacttcaatctaatcctcttttccgatgctgatattaccaaatttggtcgttaacatatgccccccaagtctggaatatttggtaatgttccggatttgctgtatatcaactccgagcaagtttcgcactttgccgttttccgactgttacagttgtgctttaaatactaaccgtcaccctcgaaaaatttcacaccgtcctcctccgttttcaccgctaaaaccaactttgttctctctctctccagcgatctctccaacacacaaggcgatcccaggcgatttcatttccgatcagatctccgcctatggtgatgtcgtcttccgctagcccgtctaccgcgccatcggcagagtacgctgaggtaagttctcatcggatagatcccttttcctcgcatgaaatcgatttcctcttttctcatcgtgctttctgcttcccgattcctttggatttgcagcacctttccaacctagtcgcgattcccagccggtcgcacgaaaaccactattttcttggcccaatcggcaatattgaccccattgatttcatcattggtgaaaccaacagaatcccctttagactagtgtcacgaccggaaataacccaacgggcgttccttacgtgcgtgtattattccttgttccaggaggcaaggtacaccgaaagttgatacatttcagagtttatcaagcggaagcataaatagttacattattacatgggcggcgaaggcccagcacacaagaagacaaacgggaaacagcggaagacaagggcgacgaccacaggcgcttgactgcaggcacgagctaaacaccaaagccttcatcatcaaggggctccttttctgggtttggcaaaattgagcaagactgagtacaaccaccgtactcaacaagacacacccataagtgcagaataaatgcaagggagtacaagggggttataatataaagggttagggtttgcagtaaacagcattaaaagacacttagttgctcaaagctattttgtaaatacgatcctagagctatacaagattattaatcaaggccgtgaacccacacgaacctgccttaacccaaggcctacgatgattcagaccgaactggcaacccgaccctgggtcccaactcgtcccaagccaacccaggccaaccatttccacattttagttgttaagcaggttttaaaattaaaacactaacttggatacattgctcggcttgcccataaccaagggcgcggctattcgaataggttatactctgatcagaggtgtacatctttacccacaagacagatcttcctcacatgtaaccacgtgccacataccaccatggtatacggacggaagacgtgacatagtttccaacccatcctagccatagacaagagtaccgacccaaccccacctacggccggaacccccgggacaggtaggcaggactgagcccctatcagcaggacaccggccctatgccatgacatctcgactaccgggccgcagctcgtgtagccttcatttgtcctagagatgtccattgacccccgactttgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccaacctaaaaccattttgaggattttgaatagagggggaggtgtgaatccaattccacaataatccaaccattccatagtgtccaggtgatatgaatatcccaaagtctagagttgtaaaaccacctaatgttacctaattaagcggcgaagcatctacctaaattcatactagtggtaccatgagtagagtgtccactagttggggttttgtttattctagggtgaacaaggtaataataacaataacaataataaggtcataacaaaggtaaataggcatggctagataaaacagtgataacgcgggaatttaagtaaagcgataatgcaataatttaaatcaaaataattttataaactgggattcaatattctcaaggatgatgtgacttgccttgctcactttcccaaacgtcggcttcaacctccacgaagagcggatcttccgaagctgcagcgtctacacgaccaacggaaaagaaaaggcttttactctaacaaactccacataacaagcaggaacaaagcacaaaaatgggttcttgacttcttaaggaaaaattagagacttgaacggtccaattccgagttcaaatggccaagttatggccatttgaagtttatatgctatttaaatgaatatttgcgaatttcttcatttaaattttaatttaaaaaggggtttattgcatcagccgagggggaggggcgcgcggaccgggtccacgggagtggggcccacgtggcagcctcacggtccacggtggaccgggtgcacccgggctcacaccggccggcgccgtgggccccacgcgtcagccgcacccgagggcgcgggcggctgacggccgggccccacgcggcagccactcggcgcgcacgagggcggccacgccggcgcggtcggcgggaggcggcgcgcccgcgccccgatggtcgccggcggcggccatagacgcggcggagcggcggccgagagaggggagggaagggggaaaggaggcgacggtccacggctcaccccggggcgacggcggcgacggaggaggcggccggagcagagggaggcggtggcgcggctcgggttgtcggggacggcggagctccggtggtcggcgaccgaaacggagaggtggacgaggtcggcgaggatgcggcgaagccgaaggaggcagcgctgaggcgggagacggtcccggcgagcggagaaagccggccggaggtcgtcagcgacggaggagagagagagcgacggcgcgagctcgattccggcgaggaggaagggcggtgagaggcggaaacggacggaggaggtgcggggagggtttaaatagggttggaagggggagagagcggccggaggggaaggaaaccagcgcggcgttctcgggttccatcaatggcgtcggcgggattaggggaggatttccaaacgaatccaagggagagagggagggaaaattgaggggaaagggagagggaatcacggggaataattcccccctattgattgcacgcggggacgacgggatgcggcggattcggcggcggcggcggcaggagcggcgggaggaaggggatgacgggtgggccccacccgtcagcgagggtggcgggtgggcccgcccgtcagcggcgcgcgcgcgaggagggaggccgaatgggccgcgggaagaggagaaagagggggagggagatgggccgaattcggcccattagagagaaggagggattttagggtttttctttttataaaatcattttaactttgtttatttcttcttaattattatttgtgctctgaaaattccactaaaatttatttacacattttaggcttttaggaaatatacaaaaatcctctaagccttatttgacttttaactttgcacattttaattgttggaggctttcacacagattttaattattctaggcataatttagaggatgtattttagagtcgttttgggacgtgacaaacctaccccccttaaacggaatctcgacgccgtgattcggaagaactggcgaagagatcgggatgggctgccttcagctcgtcttcacgctcccaagtagcttcttcctcggcgtggttgctccattggaccttgcaaaaacggattacccggttcctggtcctgcgctccatgttgtccaggattttcactagtctctctacgtaggtcaagtcttcgcgaacttcaatctgctctgagtcggcctgctcggacggcactcgaaggcatttcttgagttgcgacacatggaacacatcatgcacgttgcccaaggaggcgggcagctccaactggtaagcgacttctccgcgtcgagcaatgatacggaaaggacccacaaaccgaggtgcgagcttccctttcgtctgaaaccagcgtacgcctcgcagcggcgtgacccggagatacacaaagtcatccactgcgaattccaggttacggcgtcggttatctgcataactcttctgccgagactgggccacctttagattctcccgaatggttctgactttcgcttcagcttctctcaagatatcggtcccgaacacttggctttccccaacttggtcccacaatagcggtgtccggcatttgcgtccatacaacgcttcatagggtgccatttgtatgctggcttggtagctgttattgtaggagaactcggcataggggagactcttatcccaggtcttcccaaaatctagaacacaggcacggagcatatcttctaggatctgatttagacgctcggtctgtccatctgtctgtgggtgatacgcggtgctgaaatttaagcgggtacccaactcttcttggagcttcttccagaagtgagaggtgaattggcttcctctatcagatacaattttcttaggaacgccatggagactcacgatcctagcgaagtagagttcggctagtttgctccctccataggtggtcttcacaggaataaaccgtgctaccttggttagtcgatccacgactacccatatagagtcataaccgccttgggtttttggaagtccggtgatgaaatccatcccaatttcatcccatttccattctggtacttgtagaggttggagaagtccggccggtcgctggtgctccgccttgacacgctggcacacatcacaaagggccacgaactctgcaatttcccgcttcatactaacccaccaatatttttctttcaagtccaagcacatcttagtgctgccaggatggatggaatagggactttcgtgagcttcctgaagtatcaactgtttaagttccctgtcgtctggaacgcatacacgatttccgttccatagggctccatgttcatcttctgtgaaaccagcggctttaccttgtttcatattcttgaggatcccatgcatatctggatcattcttctgagcctcgcggatttgatcgagcaaggtaggcttggcttccagcgtagccaagaatccatggctaacgatgtttaggttcagggcttccatctgttgattaagttccgatggaatgtcacggacgccaagagtgttgcaatggctttttcgacttagagcgtcggcgaccacgt

SEQ ID NO: 72070 - DNA, 5577 bp, Oryza sativa
gttacaagtgaagtgagagtgctacagagattaagtcagcgagccattggctaatctcgatcggtcgagcgagtttagtggccaaattgcgtacttgtttgaatgcatccatccattcataaggcggccactggattttagtgtgtgtatctagcttagccaatacatgctcatggtattcgttctcaaaggtacattgcataggttgtatgcggatctacaccttttttggacactgaaataccctgaattactattttctgcgtatctttttctcaagcggcaatatagttttatcagtgtaactaccccaagctttcaacaagcctatacccgatccgtcgtaaaaagccatcattaatccattatttctatattaaaataattcattactgctagctatcaattagaaacgacaacaacggttataaccagccaacaggacggtaacccgccaacagcagcaagtgtctaacggctagactgtgcagttgtaatcaaggtacacttagctaccgaacaaccccaattttttaaatcttttaaaatacaaccaaatttgatcccgaatcttaaattcctatttaaaaccaaatttattcagaatttcctaagccatccgatcatcagaaagatcctgaaaactagggcacatgaggattatctgcaaagctccagagccagtcctttaaaccggtagaatatccccaaccccgtccgtacgacccaggtgttccggtgcgggtagccaatagccaaagcccaaagagcccagcaaccgaagcggccgacgtggcgcatcctcagccgccgcctcacgccgatccaacggtggccagatcgatccgtgcaaagtatacgtggcttcgcacggacccatccatctgtgccctagtttaatcccccggggcgcgggcctaatcaacttgattaagcgccactaaccaccccctggaacgatctccccgatatttaggcggagattaacgaggcctctgtgcctcgtggggagtaattaatggcggagaaagttttggttaatcaaagagaggggggtaattagatcgatgagtggtcattaacaaacaggtgtcagcccgacacggaggagcctggtcgtgacacttgtcctccccgggatccatgttggcccatatgggtgggctctcattggccgaactgcaaaagctgatcatttcccttgtgcggaaatgtgttgttcatttttgttttgtttttgttttttttacgccttgtgagatattgtcaatatttcaagatgtactccctccgtattttaatgtatgacgctgttaactttttgataaacgtttgacctttcgtcttattcaaaaaatttatgtaattataatttattttattgtgacttgatttatcatcaaatgttctttaagcatgacataagtatttttatatttgtataaaatttttgaataagacgagtggttaaacgttggttaaaaagtcaacggcgtcatacattaaaatatgagggggtataaaatatgaaataaagaattattgtagttctagcttgggtcatgcgtgacaccatcatagtacggtagcagccgcagtagcaacagggtggattataaaggaagaagttgaatgcatttatgactctatttatcagggtttaaattatgacacatataatggaaaaattgtaaaaaccatctcaaatgtcactataagtttgagtttccccctataagacgatttgtggtaaatacacccccctctcttagttcaccttgatttgagattcccctgattgccattgctcgtccattctcgtgacaaacccccccccacatgtgttcacatgaatactaatacgggaggagttgtggtcaccactcatgttgatcaagcctaatgacacgattgtgacattcttacacatgacacgccaacaccttgttgggcagtgtgatcacgagtctccgcacttgaacatcagggttgtcgaaagatgagctactgcgcttgcctcatggggtttcgggtggctagtttcttcgaggattcaaaaacgatgaaaatgagctcagtgtgacactgtgctgctaagaaagataatgtgttcagggtcatatacatcaagagatgagctaagtcgtataacacatgagaaaagagaaaaaaaatagtgtgagcaactggggaggaatatcaaactaaggtgaactaggaggtgagtattcacaaaagatcatcttatagcggaaatcttaaactcagtgtgacatttggagtgatcttctataaatttccctaaatataaaatgtacgatcggggtttaaaaaaaatgtacaatcataaatattgtttcacctctgtatgttgatcgtgctgataagagtagtcatgagcaggggcggagacaggagtagggcagcttgggcttgcaaccctattcctagtcctaaatattcattgaaattccattttaaaactttaaaaactagaagataaaggcaaaattatatatattcaactaattgagccctaagtttagaaaaattttggctccgccactagtcatgagggtgtgcatgcacatgtatctttcgtgttatcgggcaaaaaaaaaacaatggtttagaatgtactaccaccatcctagaaagatcgcagttttgtacagtatatgtataatatttggccgttcatcttatttaattttttttataattagtaattttattgttattagatgataagatataaatagtattttatgtatgactaattttttcaaaaagaaatatatataatttttttaaataagatggacggtcaaacattagacacgaaaactcacaactggatttaaaatgggacgtagcaacaaggcagaggctgtactggccgagagtagccattgtttagttcatagtgggtgagtaaataaaaaaatgtaagtcgcaactgcaagttttaagatcattaagtcataaattaatatacattgttttccctcattaagactgagacaggaaaaaatcgatatataaccacatgttggccaatttggatggactctgattggccgtactagcgaactcactagttcctttgtggggaaatacgttatttgtcaatatctttttttccacgtcttgcgaattgcgatgtaggttcatgcatggcactacccaaatgaaaggagtagctgaccaggatgaaatacactcccaatggccaatgggcgttcgagtcaattgaccactcgattctatcgatttgttttgtccgagtaacaggaacagaacagcttgatctatcttatcgcccccatcatcccataaatggcttgattcctcaaaaccaaataacccacaaatgtctctaaaccagcaccagaacgtttggactttggagaggtccaaacctgaaacctgatggctttttcatgggtaaattgtacaaccaacgaccgacctgatcacctgaccaagtgaccatccttgatcaagctgtacagtatggagatgcacgggcttttttttcttcttcgcaaactctatctatgtacactcgaatactctcctctctccccaaattacaaacacaaaaccagacggctacgagtcggaccctgaacacagctcggcgcagcactcgtagcagccgaggcaggcgaacgccgcgcagacctgcgtcatcacgatggcgcactggtcgttcatcttgttgcaggccttgatgcagcacatgcagcagaggcagtcggcgaggcggctgcagcagccggcggccttgttgaggatctcgaacgtctccagcggcttcacgtcgccgaaacccgtgacgaggttctccctggtggcggcccggtcgccgaacccgagcttgaggcattggagcgggatccgtcgaggttcgtcggggcccttgtgacctttcagtttctgcttgacctgttcgagtaaacaggcaagttagttgggagttctgagctagcgtggttgtcacaagatccatttctcgtaaaccagtttataagcagggaccattggtattattataaaaacagtgggacttaccttttgtgctgcatctaccttctccaatgtttgaagtaggaccatgctcgtgtactctgaaggaatgctattttgaatgcttagtttcaccaccttcaaaaatcaaacgaaatggagttactgaaacccatatactgctaactgaatggaactcaaactactaaagaaagtaacatatttcaggggcaactgcaattcacaagagaatgtgacctataaagatttcaaactagttcagggaataaatgaaatggaaagcgaacatcaaaataatattcagcaccaacaaccacactagggctgagtttagttccaaactttttcttcaaacttccaacttttccatcacatgaaaacattcctacacacacaaacttccaacttttccatcacatcaaaacattcctacacacacaaacttctaacttttccatcacatcattccaatttcaaccaaacttataattttggcgtgaactaaacacaccctaaggctgtgttcggatatggggagttgggaactaaactccccgcacggaaaacggatcggtccattagcgcgtgattaagtatttactttttttttttcaaaaatggatcaatatgcttttttaaagcaacttttgtacagaaactttttgcaaaaaaacacatcgtttagtagtttgaaaaacatgcgcgcagaaaaagagaggggtgagctgggaactctgtgttcggcacaccaagttcccatctcctctccatcgtgtttcgtgcgcacgtttttcaaaccgctaaacggtgtgtgttttgcaaaaagtttctatacgaaagttgcttaaaaaaatcatattgacccatttttgaaaaaaaaagctaatacttaattaatcacgtgctaatggatcgctccgttttacgtgcgtaggagattggttcccataaagcccaagcgaactcaagcatttttcaatgtattgcccattaaatgcttaaatgcttcagacaagcaatgtgagaactttcaaacattaccgattatcttcactatatctcatgactccaaaattcagtggaggtataaagcgaagaacatgtataatgcaacccttagccaaaagcctgaaacataaactcacctttctctccagttgcttgtcagaagaaagccatgccttcgctgtgagaaggccaatctgctgtgccgccaaaacctagaaatcataaataaaaaaaatgcatatattattagtatactcgagaaatctatggccccaagtatgatattgtgcaagtttctcaatggaaagaagagaaaccaaatgtacacaatagtgagcatcttactttgtcaaggggtatatcctttatatgctgcaccttaagttcaatcgagatctctctcatgtcagccaagtaacctttagctgtaaccatatctgggaacttgcattggtatttcccagatatacataaaggactatttgatgaaatgtccggaatgtattcagaatcgat

SEQ ID NO: 72071 - DNA, 1068 bp, Oryza sativa
tctacgtatttatattcattcattaggtctattcgttatttgtgtataggagtaaatggacatggatacacgcatccatacacacaagtattatagctcacatgtaatatcttgatttgctattggctagaaaatagtggggatggtgtatgtatcgagtttgttatatattatgagagagttattagttttcgttggttttagtgtacctatgaaatatttagatcaatttaaaatggagggaggatcatctttggagaagttgaggttagacgtggctcaatcacgacagccggccgtaataatctcatcgaagacaactcgccgacgagggaaacgacgttaaccataacgttgacgacgttgataccgtgaaaatgaaaataatattttaaagatctatttataaaaaaaaatttgaaaaaaactacaatgtgaaaaatactccgcgggcggtgagcggagtctcggacgacatcgcggcgcttccaaagaaaaggagcaacgtatacacgcggtcaaaacacagctgcggaaaaaggccctgggccccactttgtgggccccgctcccccgggccggccacgcgcgtcaagcacgcgccacgtggcctccaaagggacgacgacgcgcgggagatccgatcgtgacggctcgtttcggcttcgacggtcgggatctccgtctcgccgtcggcaacgcggcgtaacggctagttttgtgtcgttttctggggggaccgctccaggagccgtgcgtgtggtgtgaactccgcaagtccgttatacaggagtacgtacgtcgcgccatcaccagctgtgaccgcctggcgcccggtgaacggttttgaaacacgttctcgcttgttttttttaatggtgcgaagttctattgagcaggaaaaaattactccctccgtttcaaaatatttggcaccgttgaccttttagtacgtgtttgaccattcgtcttattaaaaaaacaattatttattcatatcatttgatttaaagcctcatcgtttggcatattttctgaatatgtcaaatgacatattttgcaaacgaa

SEQ ID NO: 72072 - DNA, 3545 bp, Oryza sativa
tgataggcggaaacggacggaggaggtgcggggagggtttaagtagggttggaagggggagagagcggccggaggggaaggaaaccggcgcggcgttctcgggttccatcaatggcgtcggcgggattagcggagggtttccaaacgaatccaagggagagggaatcacggggaataattcccccctattgattgcacgcggggacgacgggatgcggcggattcggcggcggcggcggcgggagcggcgggaggaaggggatgacgggtgggccccacccgtcagcgagggtggcgggtgggcccgcccgtcagcggcgcgcgcgcggggagggaggccgaatgggccgcgggaagaggagagagagagggagggagatgggccgaattcagcccattagagagaaggagggattttatggtttttctttttataaaatcattttaactttctttatttcttcttaatttttatttgtgctctgaaaattccactaaaatttatgtacacattttaggcttttaggaaatatacaaaaatcctctaagccttatttgacttttaactttgcacattttaattgttggaggctttcacacggattttaattattctaggcttaatttagaggatgtattttagagtcgttttgggacgtgacaactaaccaaccctaatctgggtcactggaagaatactttcaaatcttggccatctcttgagaaaaccacccctgagaagagttggaccacctggtaccagcacgtatcggctagtaagaaagttcactgggatgagattgggatcggccaagcgcttgctctcaccatagccaattctgctaaggatgaacctctgatggctgccgccacctatttttggtccaacaccctcaatgccttcttgttcaaccaagggccgatgactccaactttgatcgatatcaccatgatcactggtttggatgtgacttcatcggctaatcccatgagcatgaacaccaagaatcaattcgacttcaggacaaaaagcataggtggttggtctggctatgtagcagcatatatgggtcaagggtctgttactcctcgagagcatgtagccttcttgctaatgtgcctcgaaaaatttctcttttgtggatccagttgtggccctacaaccaactgacaatttgtagccgaagccttagaatcaaagaaagaatttcccttagcaagatcctcctcggctacttataacaaacattgaacaatgcatcggccaagatagccgtcagctcagtagtcggtgcaggtggaccatggtggctgctgcaaacctggttgaacctaatggtcatgaaagtcgtcaatcggccatctgtgacagaagctgagttcccattgccagagccgattgtaggagatgatggacaagaacacactcatcgcagatgcacatcatatggggaatatgcgtccacaccaaccgatgctggagcaaagctatcggccgagctgctcaaggattggttctgcagcttctatgaaggctttaagaaagacgcccgagtttggtttccttatgaagactcagtagatcttgaacttccatcagactttagatttgaagatatcaatcatgaaaagtatcaaaaatccagagaaattcttacagctgcaatcagcccatgcatccttcctgtcggcattcatcaagaagaaatatccaagtttcctatgagttttatcacccaatgagctcggctagacaacttggattaggccaactcccaatcggcttattctttgccgacaagatccagtgccgaggagaaatcacatcaacgctgatgatggatcggctgcttaacctcccaggaccccctctaggcagcattgacaacattgagttggcgggattcaagagcagaaacttcgacagatggtggggtgaatggaagctgcacctgttttcatcaatcgacttcgatgtatatgacagacctattccctgatgtcataccccaggtaaaccttgtcattattaacttgaatgatggttagccgattcgtcacttgactaatcttttgttcttgttttgcagaccatcgactcttcccctccgcaccaaagcaacagtggcagtgacattgaatatgctccaggtctgattcctaatggaggtggaccatcccccctgttattgactaccatgccccaaagacttcaactctccatcacggcctattcagggaaccagccgatgcaggcaagaaaagaaaaactagatcatcggctatgggtactttggccttagctccaaagaaaaaggccaagtccaagaaaactaacccgactgataagccgactgatgatctgcctgccttagatccatccatcgaacaagctctagatgaagaggaaattggtgaagatgttgatcaggctgcagttgaagtgagtgacatagaaagaacaccatcaacttcacccaagcagacatcaccaactccttctgctcgcactcatttcacaagagtaagcaactcttcttgatcccttttgtaatcattttactttatggccgattactcacaaattttgtaattacagaaaacaagattgctatgaagaagaaatcggctgcagcaacatctaaaccagctccaccaataagatagtctcgattttaattagttgatcccagccgattttatataacactcgtttattttacagcctcctcctcctccttctccttccgtccagcaatcgtcaagtgaccgaactccatcggctgtgggaagtcaacacattgaggaagaacaaccagctgctcctgctatcccagtatttttccttcgatacaagaaattagatcggctatattttacctagctcttattctctccgaaattgtctctgcaggctttagccgatcttttctcctttgatatcagagattatcttgatgagacagaagaagatacttcaagcaaagctctagctcccttatccgatgatgtgaagaagacacttgaagatatctgtcatcggctggaagcatcatcattagataacttggtggtaaactgtgggccaattaggactcggctacttgagatccaagctctaatcctagatgagctagccgacatccttactccaggggtctatcttgagcaacatcaattcaagctggaaaaggccaagttaagactagccgaacgtcgggagcgcaaggatattgaggccacaattcaagccaatcgtcagcttgtgcatgaggagaaatccaaacttgatcagctttcggagggtccgatcaaatccaacattgatcggctcgaggctcgcaagattgagctactggcacaacttcaggaatgcaacgccaagttagatctggagcacaagaaactagccgatctcccgcggtccgtcgaagagcaaaaagcaagacttaaataggctatcaagaatgttgctgatctgaccaagtctttgaagatcattcctggaactgatgctcaagatgcccaagccattgaagaagtcg

SEQ ID NO: 72073 - DNA, 9583 bp, Oryza sativa
ttgattaatctcgtattgggttcttatgtggaaacttctttcaatattgcttatttttaattccgaattttagctatttttaaattgtacttctacttagactctcctttttctttttttctttttctccgattaatgtgggaatttctagctcccacagcgaatgtggtgcctcctttcaaagctgttttaataatataatagatagatttctttctctaaaatttttaaactaatacttaatgaatcatacgctgatacattgttttaattttttttaataatcaccggaggggagaggttccccacctagatttccattgaagagaaaaatagggtacaattgaagtgttcaagctagctagcagctagcagttacaaatgcaaagagaaaatagaattggaaaatatagctttccaagactggactgctattctctctgggattttgaaacggtgttcctagaggtttgtttcttctaaacatcgtctcaaaaggttgagaagagattgcaagtttcaaaagaccacatcatgtcgatggttccacaggcaatagaaacacagcaagtagaaagttctgaagtgtggctgcaggagcggcggcgccggagacagcatttgtaaatttctaatgtcggaaatatttggatggattccaatagatgtctagaaacttatagacggtagaaacgttgtttattttgtatgccgagaggggttccaacccttatagacgggcaaacctcaaaatataaattaactagatgacacccccacgtattgctgcggaatatttacgtgttaaatactccctctgttttaggttataagacgttttaacttggttaaagtcaaattactctaagtttgactaattctgtagaaaatagtaataatatttttaacccaagacatatatatgatgaaaatttattcaattatagatttaatgaaactatgctggtattgtaaatattactatttttttctataaatttagttaaacttagagtagtttgattttaattaaagtcaaaatatcttgtaacctgaaacggagggagtagttactatcctggtaaggatgtgcattctaagaacatgttagaaatgaaggcaaccaccatttgaaatttaggttgtaatgtatatattaattgagaaatctcaatacatgtgtatcaaataattaatgcggttatacatttaggtttaatatatgagtgtgctgcaaaggaagagattagtcactcaaattttctaaaagaagaatcttcaatacagagtgaaaagggtgaagcagtgaaccatgcttccttttttctgccgttatgttggactatactaaggtagtacttccatgttagcgattgtccgtcaataaatgttaagataaaagatttacttagcactagtacaaatattatttaataactaagctgataagcaagcttaaaaaacagaggatgatataatgtaaatattttaatgcaccattagataccaaaacaaagctatggcgatgaaaaacaaaatacctgtctcatgatagaaagattagataacacccatgattagatcagctccaggagattaggagaagagatgaccgattgtcatatagaaccaaactgattgaggataaaaccggggaactgccatgagcctgacaatcgatgtgagataaaattggagaactgccatgagccttgacaatcgatgtgagataaattgcttgggtgtttgaaatcttgaatgttacaaacgattgtgagaaatttcatgagtctcgaattgcttgggtgtatgaaggccatgtttagattgtagccaaaataaaccttaccaaaagtttagcaatattatcaacatgccaaagtttggcaataaactaaacgttgacattttttttgataacgttgccaaaaaaaataatatggttgaaaatagcatcaatatgaacagcccggaatttcatgataaaatcttgacaatcttaaattgcttgggtgtatgaaaccggataactgacattgggtctcgacaatagatgtgagatgaaatttctcacaattgtctgaaatcttgaatgatcaatgaatgtggctaatcctatgctatgccactgcttaatttatagcttggttgactggttgtatggcttggcagtttctagaagatgagcagtccaccgaaagatagtgggccaataataatggtatggctaataataaaggtggaatggcttggcatgcatgtaaacatgcaggaaccggtagagtgacatggcccaagaaaatttggacttaaaaagacattcttgctgcacgctagaaagtaaacatcttggacatcaattttagatctaatggctagattaatttgaagtgatgtggcaagctgtgaaaagagaaaattagcactagttgcacttagtgagaatgaaccatatagatatataaaattaatgcccttctcgattaattccttcataaaaagttaagaaggatttagagaggattacttaatctccaacattccttccggccttcacataagaattaaccgaacaagctttttttttctaaggcgtggaagaactctttttcaaaagaattttcaagcggatcaagaggatgttttgagaatgaaaagatcgaatgctaattttaaataggacctctcatgttctttttatagagcatgcatgtgtcatacgttcaaaacacgtcaattataaaaaaaaaaaaagaggtggtacactttaactgtatgatttagtgcaagcgcaacaataatgttcagatgatgatgtaatgctgtccgttcttaaactgcaagatttgcagacacttctttgccgactaatctcaaagacaatataagtatttattgatcaccgcttttcatcgaatcaatcactagctagtaacacaccgacacaggtggggcctggcccacgtggggagagccggagagagaccagcaccgcgtctagcttccacgtgcttatttttaaaagacaaaaatacaaatccatgtactcgcacactcgttagtataaatgcacgcgcgtactttatttttataagcaccttcaaaatacttaccggtactccctgttttaggttataacttcaaatttaactaaatttatagaaaaacagaaatattttcaactaaaaataaatttattataaaaatatatttaattattaatttaataaaactaatttggtaatgtaaatattacaatattaaatcttgagttgaaaatatttctattttttctataaacttggttaaactttaaatagtttgactttaaccaaagtcaaaatatcttataatctaaaacggagtatacctttagattgatgaagtcgtcattgatgtcacactatcgacgagtatattatatatcactgaaagatgaattagtcgtaaatgtgaacatatcaagtctagaatttgaattcggatcaactgattccacttcgcaacatccatgtgcttttgaattccacgtgaaggagaaaaagggtttgaaatattggacttttgcaaatttatcttctaaaaagacttcagattccgttgattaattatgtttgaaacgagaagttctggggagttaaaactgctaactggcatggttcagaactgagtcaagcacaccacaacatcgaccagagcaagaattccgaattccacgtttcgaaaatttcttaaaactgatcaaatcaattccactataagtttataattcgctgaatcgtgagcctcttttctcctctttccatccccctccttttcccttcctacttccaggctccagcagaccagcacgcctcttctcctcttctcttcacacaacgtcattgtgttagcagagtcactgtcagcaataggaggcacacgactattatcctccctcttacgtattgttcatggttatggcgtcgcagagtctacaccagatattgtgcatgcaagtacatatatgtgtaatgaggtgacagtcatcgatcaaaattgaaaagcagattattcatggaattattgtcatgagttttctacttgattataaaaataaattgaataatttgagaattaaacttaaataataatttataataggtaggataggaagtaggagtacacatcatcaaaagttacatagcttatcatttagacacgtacatacgagacaaacatactatttataagtgtaaacaactataagacagttgacaaaggcacacggacagtaggaataaggtaaagatcgttctttcttcgaattgtagcacccaactcctccatcatgtccaccttggttggcgagatgccatcagggagctcccaatcaaagtggtaaagcaatgaggctagagcgagctccatgattacttctgcaaatgccatgccagggcacatccttcgtccagctccaaacggtataaattcaaagtttgttcctttgaagtctatatggccatcctcaaatcgttcaggtatgaatgtctcagcatcctcccaatacttaggatctctacctattgcccatacgttaacaagcacagtagtacctatggggatatcgtaacccatgacctcacatgtctcccgacattccctagggagaagtagtggcactacaggatgtaaccttaaggtctctttgataataagttttaagtacttcaattcaactaagtcatcttcagatatcgtttgctttcctttgatgacgttacttaactcagcttgtgccttcagcatcactcttggattcattatgagctcagtcatcgcccattgaagtgtattagctgatgtctcgctcccagcaccaaaaagttcctatatgcatgaaaaaaaacatgatttcccatatatgtaaaaaaatatgttatcaattacttccttcctttgttcagtgtgcatactttttttttattttcatatatactcgctccattcatcagttaaagttatttaattttattcttaaacggtaaaactttgtagattttgacattaacagtagtcaaattttaagtgcactcaggtaaaagaggtttggtaaaatatgtcttatatttcatcctttcacgaatataatggattatagatccagaaagtgtgattgaaccttcactaaattagggaagagaacgtacgttagggtacgattgtagatacgattgaaaaattaattattggtaagataaatactactctaagctcagaagtattcgtgtgcaattaagggagattagtacagtattaatcagcaagtacttgtctacttaccaggacgacggctttgatattgcccatggtgagaggcatctggaggctcccatccttctgaaccctgagaagcacatcgacgaggtcctcgtcgtcgtccacggcgccggcggccctccgctcctcgtgctgcctcagagcgcactctatcagctcgaagttcttgcggggttcgcctccgcccgccgcgtcgtgccgccgacgaagctggccagcctcgacgacgggaacaggtcgccgaggctgaacccggaggtgatcttgatcgcctcggcgagacccttcaggaactcgtcccgcctctcgaaccggtcgccgatgatggtgcgcaccgccgagtcggagatgagcgccgcgatccgctcgctgacgttcacgggctgcgccgccggggcggcggcgacggcggcaacaaggcggccgaccttcgtctcccggatgcggcggaacgactggacgcggcgcgcgctgaggagctccaccacggcgatcttgcggagctgccgccacagcgcgccgtagggcgcgaacaccagcccaacgccgtcgctcatcaggacgcggatggtggaggtccacggccgcgtcgcgaacgcgacgtcgtgcgtcttggtgatctccctggcggcgttggcggatgaggcgacgacgacgcggagctcgccgagcctgagcgacatgagcggcgcgtccagccggcgcgccaggtcggccatggtgcggtggacgagcgggccgcccatcgcgacctggtggaggttgccgatgaccggcagccgccacggccccggcggaagcctcggcttgccggcgccattaccggtcgccttcctcgccaccttgtggaggacgagagtgagcaagaggagagccaaggagaggcacaggtagccggtgatgtcttgcaccatggccatggtttgagctgtcgagcacttcatggaaatggtataaatagggagaagttcttttattttgggggggaacataaatagagagaagttgattcatttattatttgttgtctggctgctatctctagtttgaaaacataggcaagagaaataattgcaaaatgaaaggcgcatagcgatttggaattttggactaccatcccattggcattaatacagcttgcagttattagtcaaatattggctgtggagttcagagcatgaatagtgattgtaggcaactttcgcagttaagttcagagcataaatactgtgatttagacgactattatctgtataatcattttaattacaacttataggcctcatctttttgcgtatgcttatgcttatcaaccaaaatttcaaatttcaatattaaatatagagtttattttagggatttttcatcgtagtttatttttcagcctttgcttttagatcgttaagaacatgtatatataagttttattcacaaattacttttcatttgcaaatatgtcatatggcttattccacaaataagcgaaacaacggggctcaataacatacagagaccacccatatataacagattatctaatcagatatctcaaatatattcgtatattcaatgacttaattatacggaaaactggttttatctcctcgttttttcatgtcacctatagttgtaaataaaaaattgataagataggttaatatgagatatatcaccatgcaaacatgcaagttttcgacttctacaagttataacaaactaggaaggtggcccgcgcagcacttgtattatttgaaaggtaagatttttactgtttgtttaaaaattttgtctgatagattaagggcaaactaaagtttagatactgttattttataataatttaagggttctattttcttaaggtatctttaaaatccattcataaacttttgagtaggagattgattaagtacttacgatttttgaatcatgttctttttctcgagtaaataataaactattgcttgtagtatggctacaaatgaaaaagtgagagcaagatacttaaaattcttgtgattaaatcgtctcatgaaggtgcatgatacaataagaaagggagggaagcgtatacatggagaaaaagaagaaagggaaaaatggaaaaaagggaggggaagcgtaggtacccacgtacgtaggtgcgtaccgaaggtggagaggtggaacctcgtagtatttggtttgttctaagatcaatttaatctaatggtttataatattggacccatcgattaagtgaaaatcaagtaatagatactttgctttttttcttataatttctaatattttagagcatcacgtggcagcttgagggcattttaagaaattttaatggacttaccacatgtaattataatattaaccatgtaatatatatgtatgggatatatgttaatattcattctagcttcgtccatgtttatatatagtcatatttacaattatttatagtagctcttacatattcatcttacgactttgattatgcgttgatcaccaatttactgatcatcatgactcgcatgaaaaaattataattatgtactacttagggtttagggtttaggacaacttaaattgatgaattatcttatttatgtgatagctatttgagattataaacgaatgaattaacttctaaaaagttaaaaagatgtttaagaaaagcaccatttacgaacttggaaagcgtggagcgtgcaaacgaaaatccaaaagatggaatcagggaaaaaatagcgccttaaactcccttataacactcttatcctagtaagagttctattgatattcgttaatattgtgctcacatttgtaacataatgatttctttcaattgtacaaacaaataatacaaaatctgaatacaacataacacaatacattataattattatgtaatcaactatcgatttcggcttaaacagagctaagtgttaacacggtgcttaattcttctctcactgcatcacacatttaattttcttttcatgttattaacaaaatcggtagcgctgcagcggtcatgatcacctgagatgcctcagacatgacgctttgtcacacatgcgaaaggaaaaggtgtagacgtgcattatgcagcaggccaaaaagagaactttagacactttagttattaataatagatccgatgatttaaataatgggtcgtacttgttctagtataaatataaattagttaatctatattttaaattgttaatttaatgggtacacaatataacggtgtaaactttattttaaaacaatgtattatttgagaataatagtccaaagtaattataaaaatagatccaatgatttaaataatgggtctatctgtttaagtgcatgtatatattagttaatatagatcttaaattgtttatttgataggtacacaatataattgtgtaaattttattttaaaatagtgcattatttaaaaataatagtacaaagtaattagtacaccggtttaagtggaaactatcttacattattgatttaatgggtaaacatataatatggtgtaaattttattttcaaatattatagagctaatttagttacctgtgtttataaagagttatataatggtatattctttgtttataaaattatcaattgtataaatggaaaaaagtagtaaaaaaaggaaacaaaagggagggaggcgtacgtactacatacccgtacgtgacctacctatgcacgtataaagaggagaggtgggacccatagtattttgtttgttttaagatcaattttatctaacggtgtataatattggacccaccaatttaagtgaaaatgaaggggtagatgttttgtttttttttagaatttctaggattttctttaatttatcatagcgccacgtggcagaaggaagtttaatggacttttagtatataataacataaatgtgagtttatgttaaataaattcagtttaatttgtttccgtaaaaataacatacagtatcatgcaatttatgataactactgccatttgatctgcggcctacactactgttgaccccagcaagataaattgcatctgtccttactaatccattggaatcactggtggagaagtgctttttagtcccggttcgtaacccccctgtagtcccggtttttaaaccgggactaccaatccgggactaaagatcgttatctttagtcccggttcaaatgcccgggactaaagatcgatctttagtcccggttggtgttaccaaccgggactaaagaga

SEQ ID NO: 72074 - DNA, 15779 bp, Oryza sativa
tataagcatttttactatagtgacgagtcaaacgtttttaactttatctattaatagaaaaaaaatattaatcacgtaaaattgatattattagatttatcattagacaaactataataatatgtaactctttttatttaaaacatcttacttttatagatattgttggtcaaagtagtatcacaaaaaccgtgtcacagtccaaaatgcttatattgtgggacggatggagtaaatgtaaacttatatatgttgtcggtcagcaaaattccaataaagcaaaagtcttttcaatttttcatctacaatgaaaaatgcagcagatacgaggagtggtaaaagaactagtaataacactctagtagtagctgctgcggaatgagttggcggctcagggtgtaacccatttataggtcaaaataagtggactcgcggcgcttattttagcatataagtaggtttcgcgggttagacacttacaatccttagcggccttcttcagagtcatagcaaaaggtttgtttgtgtggagagatgttatacaatttatggatatcttcacagtcatagcaaaatgtgaggtaaaggatgaagaaacctccttttgggggtgatgtatggaatagcatagtcagatcaatctctttcccaagagcatattcttttgtttccaacgaaaatgattcagtttgcatcgcaagtttaaaagacatatctcaaaccttcattctccactttataagaacatgcttatcaggaatatatccaaatgttctgaattacttgcatctatagaattcagtgccccttcagtcaatgattgttggttgaaacctgtaataaattgggattcgtctttaagctttgaagaaattctacatcaaggcagccaagatgtcacatgcttcttctcactctgttgaaaaggtcctatatgcaacatggaacatatggaatggaagcaaaggaatggccatattattcctattttggaatagaagaccctctttgttttcttggaagtcctcttaaaagtgaatactcctctcttactacatcgtgtaaatcattacgagagatcagctttatgtgattggatagacatgctgtaaattgttcttttaatttttaatatattgagccgtacagtgtttctgttaaaaaataaaataaaatgaagaataaattcctttgtgaactatcttttattaccaaagtttcattctagaccatcttttatttttttttcacttttcgctaggtatttttggttttttattttactttaaccacccaaactttcttgttttgataaatacatttgagagatccaagaaattctgtagaagaaagttttttaaggaaattaatttttagagacataaagcaaataatccgcaacaataatctagcgaagtagctaaacagaacatagccttaattcacgactagacatttctaaatatgagagctttcttagagggttcccaattagtataggaataaaaagatcaattgatcgatgtagttgcttctttaatcgtatgaatgaaaaaaaaatgtggataaaacttttatatgttattagcagtttaaaagccaaatgctggaaatagagcacgatgaaaaaaaaaacaaaatcaactctaaacttaagtttcagctgataaattaagtttcgaggttgccactctcaagatctgatccaagggatcaaagatgtagtaataaatgtttcatccttgtttcatcaagttctacggagtactagcaagggtcagccacagatataaagaaatgaagtgccggggaaaatagaagtccatagatcgcatggtgcatggtgaaattaacccctgaaagtttgctgatcacaacaatattctactcctacttggttcagttctctgtcttgttagtaacatcgtacattactttacatgagtaagaaatgggcagatccgtaaaggataccgtatcacaggcaaactagaaaacgcagcttacaaagagtgcaatatggcggaaaaacaaaactattcttgaaagaatgaactaatcagtctattacctagcaactccattttgatgatttatggtcgatggtcgccaacttctctgatgcagatgctcaagatgacacctacgcacaatgatccatccagttgctgatatatgagcataagaatgaatgcatgttcagtagagcaccggatagttgtcagactccgcatcatattcatacggataaggctttcatgtttgtatctgcccagacttggatggttgaatttagtacttgatcacatgatgtcgcaaccatagttcatacataaccatgtggaacgcgtcgtaaggaagaggaggtgaatgccacacaaagtgtttctgtacctgcaatcccaattaaacatgttacagtatagtaccgcactgctgaaacttcagtgcctctaaacaatggctgaatcaaattatttacacgcaaacagacctgagggcagctaatgttctgaacaagacaagtgacacattacaatcttgaccaagtagcttatttgtactatgaatgtgatctactatatttattttccattacagttaagtacaacgctgaattacatgcttccttttgtaaataattcggcggcttcatagaaaaaaaggagggtcaagagttgcaaacctgaacaagagatttgtgcaattcaacaaactcttcctgtgatatagatttaagtatactttttagttgatatacatcacgctccttaagtacaacagcaaattttctccagtctaggatatcattgaaaggcaaatcgtagtagtctgacaaaataactaaaaggatgaaacaaaatggattagaactcaataatcagaagggtactgaaaatatcagttcccgtgaaataggaaaaacagcataagtagagtggcatgtattatgaatgtcactgggtagaaatactaaccaggaacacaaccgtagtgtattgaatcagatatacgggcactattaacttgagagccaccaggacaaatacagaactttgtgtggtagaactgcttctggtaaaccagctctccaatagctctactgatccgattgttactgatagcaagctctgtatcattctcccagacttgtgccaaaatgactcttattttagaattgcgatggccagcccaaaatccaaggattgtcctgttgccatggcaaaagcaacaaaagacaaattttgtaggagtgcaaatagatgttcaaaccatagcatcgtcacaaatttatggtcatgacaactttcattttgctacaaggtgattcgttgcacatgaacaaagtgctgaactaaatgtaaaaccatgtagtcttctgaattaatcataggttgtaagattcaaggcatgatcaacaagataaccacgtgagtaagtgtgagtgttttacagaatttctcaagtaaacagatatttttcacttgaaggcactattactagaaaagtctagaatcatacatggaggcacacatatatagtcagtctaggaaaaagaatcattcagaagtcccaaatgaacaatttttttatgaagacaaccatagaagaatataagatcacatatatagcataagaagcagtaagtgtcattccaacctgttctcaacatcatttcctccttcaggcagagcaaatggctgcaatacttgaggaagagcgatatccttatgcggtataaagtcaacattatagcttggagaacagacaactctaatagaattcttcaccatgaatggaagtccttcaaaagccctaacacctacatcatggcaggtgacaaagaaatggtccgctccaagtgtcctgttccagtaaggatacttgtttatcaagccttccacataatccttaactattattgtcatgttctcatatgaagtaccctgcaaagacagacatatgcacgtcaacaattataaaagatcaattacaaaagatatggacaaccaacatacaatttcagtcacatctaataacaggaaattcgttcctgtatcagatgaaaagaaaaatgcatttcaatgtttgtaagccgacaaatttccgaaaccaaagatcttgcaccagactatactgctgactagaaacctatcggcacatctacaatatcgttctactttcgcttcaataatgacatgcaggtataaacaacacattaactaatactactttgagaaccgttactatcccaaattcacagtgcaatgttccagctataggctgaagaaaggaattttacatcataaagcgcattctactattaataaattcatttgccgattgccccaaccacacagcaaccgagcaatactcaatgcaccaaaacggtgatgccatcctaacacgacaattaggccctgtttgatttagattattgagtggaatgttgtcacggattatctacttgattataggagtaaatcgaatattatattaagaaataaacttaacaaaatagcttgaaacaagtgatctaaagttctaaaccatacaatacagtagacgatattttttttttgagaaaacgtatttctcgaagcatggagcaaacaatctgtttcaataatccgatgaacgagctgaaaagaacatggccttacaatgctatggaagtgtaaatagaagtagagcggagaatggaccttgccgcgcatcttgtggggggagatggggacgaagaagaggtgcgccttgtcggggtcgccggtgcggaagcggctctcgcggatgttctggaagaagtagccctcgctggcgtacttccccgtgagcttccgcggcgtctggtagaacgtcttggggtcgccgtccgggtacatgtacaccttgaagctccgctccatctccgcgtaccccgccgcgaaggcctcggcggagtggtacaccgacggccgcgcgaaggaggaagggcgggagccgccgatggcgagggagggtggggccgcggcggggcggagcgagcggagggagaggaaggtgagggagaatagggcgagggcggcgagtagcaggagcgctcgggggaggggcgccgcggcggcggaggcggcgccggggaggcggccggccatcgccggagttggggggaggggaggctggaagagtgatgcgagggtggatcggaagggtgtgggaagttgagggtgttaagtgtaaaatcagcgttaagaatgacatgagattgaagggacattaggccctctttgtttagggttataagccaacttataagccgaaaagtctaagaccctttttctttcagcttaagattattataatctagattattgagtcagattactataagctagattgttataatctgtagtagaataagcggttagttgtttcttttctagattattagagcctagattattgggtttgcaagtctaaagagggagtggagtggcatggtgagtaatttttcacccaataatctggaaaaagctcacctaaatgagcttatcagattataataagctggactccagattataataagctgcttcaataagttgtatgtttctttcagcttactcccaataatctggattataataatctcaagctgaaagaaacagggcctaagcctgaacaaacaaatagttttttcgtttgtcttttttgaagccataagccactctaacactattaagccaaaagctaggttggagaagctttttttggcttacgtgaggtagatgcatgactccaccattaaacttaagacattaaatccaccagcttataatatataaatcatataagcaaataagctgacttaaaaatctaagccaataagcctaagcctaaacaaatagggcataattatttgtcacgtgccaattaatgatttgccactcgatatcgatatctatgatatgtgggtctagtggcaaattctttagaaccactcgtaaaagtggcaaaacgttaattattccaggatttgaaaacatgaattaaagatggttcaatcatgtttcaaaactcatacatatatgctcgtgaggatccatatagtatttgggaaaaggaacaacaatgtttactatttggcacattcacagattcactatccaactacgtgtgacgacgatcatttctctttgctcgtctcctatatttcttcattcgagatggttgtagcttgcatcaacgaagtaacccacgttatcatggatgacattgccatacggtgttgtgctctgatcattcaacaactttgatataaacaccaactccaatagtagtagggtattgagctaggatggagatcctctatcttaagtcacatgattttgagtcattgacatgtggaacttttttgatatggatctacatttcagtaatcctaaagtcacgtgatttaaggtagatgattgctatatgtggcggatgccggatggccttgagctcaagtccgaagaatagtgagcagctacaagcgaacataatagtgagcactaagcagtgagccatgcaagcaaggtgagctaacaatacgttatcccaattaattgcactgtaagctccatttatatatccatataagcaattaatacttactttcattggactgataatactcatcgagccatcgttttggacaagaacatgatctccaaaaatatcaataaatatataatgctattgaagtggagtaccttttaagagtaatctatgtatataatctccgtaattctaagataaatattttagaaattattcatattcaaagattttatagtttacaatcggccttgttaaaaacgacaagtattatcaggcctaaggtagtgatacaattaaaatatgttatatttgtaattagctggaaagataagactgacatgtgtcgtgcagatggtttgcttcaggctggaacagattagttttaaaaccacgtgcattcaccaccccctcttctttttctcatttggagaaccgtggagcactggggaagaaataaatttgcagattgattctatctagtaaaggcgaagataaaatcagtaacaatatggccaaagttccctgccagcaattaccacccaggaggccaggacagaattgaacataaaaggtaacaaaaaaaaacaactacataggagtatatcctaaaattatagccatcaatatatattgctcctatactactagtagtacaatgcatgatgtatccatgtttcagtaaataatttgaccactgtatccaaaggagccagaagctgggaaaagatcgagtaaaacagtttcagaagaatggcagttctatacttctatacaagctttctgaaccaatatacttctacatttcatagctcttcagaagctagcatacaaataaggaaaataatatataaaattgtacattaggggaaaagggtatgttagtgtgcatgcaagcctatgttcagatataagattcatggatgtgtctgaactcagaagaggactgagttggcatgcgtcgcaacatgcaatattgcaaatgaagtatcaccacattcagttactggagttgcgacgactgaggtagaagaacaatgcagtacatgcggctgctgcataagggaacacggtccacatgccctggtttcaaagcaaagcataatttgattagaaaaggtaaacaaagattttactctcaatttttcaggagaggggaggagatttaccacagctgccgcaacacttgcgagtgcaacaacaggccgttctctcaggaaaaacccaacagctagctgcaatgagacatcattagtgtcagctgtcgtaaatacagattgaagaattcttattcatgtatttaattcgattgatctgtaagatgtttgaatataacaatggtgtcagcctacagattaacaaggataaacattgtattgtaagacaaaacatttttttagttgccacaactgcattggaggaacatagaaataatttgcagattgattctatctagtaaaggtgaagataaaatcagcaacaatatggccaaagttccctgccagcaattaccacccaggaggccaggacagaattgaacataaaaggtaacaaaaaaaaaacaactacataggagtatatcctaaaattatagccatcacgccaagtagtaagtctctataaagttagatcaaacgtcctgagcaagtgacaactcagtaacttcagaagtaacagaaaattaaaatccaaattacctggataggaagagtaaatagacaaccacagcaaactccagcaaaataacagtctgctggtatgccctgtttgtaatcgtcagttaaaatatcgggtttatcagaaatttctgacagaatcactgtgagtgaagcctgggaaaatgactaaccaatgcgccagctagaaatcctgtaggattgcgaaccccaactgaaaatcgctcaactgcaccaaacatcacagatattagtgacttctcactgtcagtgattaatgaatgtaacccactggtgttgtttctggatgcactaagtgcagcactataatctggcatttcaggaaaatgctccttactcagatataaactcttgagaaattataatctcagatatataccaaatccaattaggttgccatacttttgcaccgcacgcgatatgcttagtgctttctccttcccaattccaatctaaaaacagatgtgcaaattatatctcattcagagtgaagaatactctttcagtctgttattctttaccaaaattatgaaactatgatataagtaaaaatggcaaataaatccctgctttataccttgctgcttatgtcttcagatgctcttgtttgcctaaaaagtttacctagatagaatggaaccatatcactaatacaaacgcccctgaatggaaggatgggtcaggtaacaaaagatggtccatgattaattgatgatcgattgactgacaaaaaggaactgtgcacgcaccagtaaacccataacactgtggaaattatataagatgcattcattgagaatgaattagcaagagactgccaggttccatccaaacaaaggctgcgtgctaaagaaatcccaacctacatcaagaaaaaaagtaatcatgttcttaacatgcaacaatcaattacgcagtgaacataaaagtttgcagtaagttattgaaacttagttgggcatggtcacagtgaagatgccagtacagaggacagacccaaacatttaaagcttcttcactaataaatagtccaaatccagcagccatgagcaaccaaaagtaaacccacctgaagaaatttattagcaattcgttatattttaaaaagttttggaaactcttttagtgtgactatggtacatgtgtatataaatgattcattttacatatttttcaccatccaccattaatcatcatatatgttgcaatggtgcaaggtggtaatcttaggtagttaggacaaaaaaaaaatccttggtagttggaaattatccccaaaagcatatgtatctagcatgtagtttccactcacaaataaattcacaatctgatataacagccaaaattatggatgctcatggagaatggaatattaaaatccaggaatcaacaatgtatttgtctttgtcttacttcagcagcacatatgcatttttttttttttgccgggttagcacatatgcatttcaggagtaatatgcaacaacacaatgttttaactgtgagtgaaacagaaagataacccataaaattgtgaaatgcacataccctggagtatattccggaacaataactttcttcccaaacagcgaaaaagtatatccgatggtcgctgccgcatccggcggcgccgaagcatcaacaatctgtggcaaactgaaagatggacctgaagaaggctgcctcatgaagagtgaaatcacagtagcagtagctgccacacccagagcaagtgccactttagcaaggaaagaagcagcagtgctgcttgatttcacttccattgcatcgattatctcgctctcatcttccccaccaccagaagaagattcagccccggaggccgatgcccttgcagcgcaggaatccatacgggagaaattacgcgaactgtttgtatttgcgagaattatcagatgaggaatttcgcaattgcgcagataattactgaaaattccaccaggcaattcaacaatttaatcctgatcctatcagaagcggttccacggagagagagagagagaaaaaaaaacccaacctcgtaatgcgaccgcgagcggcggaacggcgtgcgccggcggagaaggtggcgcggcggcggaggcgagggagagggagcggtggcggggagccgaagcggccggcgaccgtcgccatgggaggagacggcggcggcgacggccggcgagagtgtctcggtgtcgccgccgtatgtttgtgtggcgccaagcgggttgcttcgttggcacgaccgcacgagaggatgatgggctagaaatggaatatgccaagatgccatccaattcgaatttcatttttgtatttttttaaaaatttaattatcggtttatgaatttaagaataccatatttaaatcatttaaatatacgattagtggtcgaaatttaataaaaaaatagaatttaaaaaaggtgaatcatgccccatcagttgcactaataagctaaaaccaaagctaaaatttaaattttaagttgaagatattttaaggcactttctttttcagaattgtatttttagttactaataacacaatttttaaaggttttacttatgcattaattattatgtcttaataagttgttttggtttattaggggatatgggtaaccgataatgctagagacaggttggtgcactgatgagtgaattttactgttttcttccatttttttctgaagaatttaaatattttgttaattgcaaacgatcaagttttggtgcattttttgatatatatctctatctatctatgtgcaggttcatatacacatataatctatttagagaacattatgttacacagtacaaagtaggatacgaggagagaaaaacgcagagaaaacatctgttagtacaatgccatccatcaagatcgtcgtcaatggaagccatgagatggcagcagtatcagaaacagggaagcgacggcggcggccagcacacggcagccaccggcgccggcgctggatctcgccgccgccgccgagctgctgctgtcggtgggcttcgccgccgtcgccgcctcttccggtgggctggcaatggcgacaggcggcaacggcgggtccagcacgtcgcccggctccagcaccggcgccggcggcagcgccggcggcagcgcccccggcgctgccaggtgcaccagcgcgccggcgtccgccggcaggatcgcgtagctcaggttcaggctcagatcgctgcacggactccctgcaattcacacagagaagttaaaatttagagcaaatttcatcaaaccccatatttttataatatcgaagttgcataaaatcctgagcattatggccagtggcacatagcctcatctatttattttgacaaaatcccacgcctatacatatttggtaaatatttacttaccgtttcaaaacatgtaatgcatatgaaacttttagttttttatttcttcattaagtttgtcggtttaactcttcactactttgaaaagtattatttcagatgtattgaaatcaattgaaattcgaatcaaggtgggaatttttaaaacattagaccataaaatctcttatgttttacaagtcataatacctacgattttctgtaactttgatcataaaacgtgaggctttataaaatttacttttaagatgattaatttatattaatttcttgagctgaaaaactagttctagttggtgtctatggctttgtgggaggtaccccttccatttcagattataagccgttttgactttggccaaaattaaactacttcaagctttgactaagtttgtagacaaatatactaatatttacaatactaaattagtttcattaaatctataattagatatattttcatatatatttatttttggatgaaaatgtacttgaagtaatttgactttaaccaaattaaaacgacttagggcctgtttagttccccaaaattttttcctaaaaacatcacatcgaatctttggacgtatatataaagcattaaatatagataaaaagaaaaactaattgtacagtttgcatgtaaatcgcgagacgaatcttttgagcctaattaggtcatgattagccataagtgctacagtaacccacatatactaataatggattaattaggctaaaaaaattcgtctcacgatttccaggtgagttatgaaattagttttttcattcgtgcccttataatctgaaacgaaacggggagtaggagattgttgcttacggaagtaggtggcggcggtggcggggtactcggtgatgaggccgtcggccatgacgtggaaggcgtaggtggcgatctcgatgatggggtcggcccagtagtcgaatccgaggttcatgaactcgttccggagcacgccgacgtagacggtgaggttggcggcgtgcatccggtcggcgacgtcggtgaaccgcgtgaggaagaagccgttcacctgcgcgatcgacccgcggccgacggtcaccgccgtcgcgaactgcttgatctcctccaccgacggcgccgacgcgtcgctgatcgtctcgtccaccatcagcacccgcctgaacgccgggaacttcttgaacgccgccagcaccgacgtgtcgtccgacaccaccatcagctccggcaggtgcccgccctccttgtcgtagctcgcgttcgccagcgcccccgacacggcatccaccagcccgaggcctcgcttcgcgaggaacgatgcgtgctgcgttcaatatcacaattcatcaatcacaaaaaaaaaaaaaaaattgctcagcctcagctcaaccatgatgatgagatggattcaggttgagaagagaagcatggtgattgtttgtgtacctccatctcgaccatgatgccagagacattggtggccttggccaagtctaggaattcaggcaatgtcacgaacttgccggcgttcttcgcggcggggttcctcttcaggcctgcctgggtgtacggaccaagaagatcggctgacgaaattgatcggacaaacaaaacaaaagagcaagatgtttagtgaatgaatatgtgatcatcttggatgaaataacgcatgaaaaagaagatttcaggtgctcattattacgttttaatgtttggatttcgctccatgtgagatcaaaggagaagatgcccgacttgttctgaatttcactgacagtggagattttggtcatgaaactggtggacgccgtcgtgctggtgctgaggtctgcagatggctggcagaaggccacgccgtctttcgacatccggaccgcgcaatcgatgatgtcggcgccgtctttcaccgcctgctgatatgcgaggtcagtgctgcccgggtagacgccgctcgcgccattgtgggttatgatcagtggcctgcctccatctgatcgaattagagaaatcagtgcaaatgtaggaatggtggtaacttatagcttgacaatatgtgacggtgaacagtaaaagtattttgcaacttaccaccaccaggaggaggaagaggattgcccttggtatttgccaaacacgctgcaaaagatcatcaaaatgatgctgttattgatgaataatacagtatgacaattttcattctttcatcagtaaaatttctgcatatgttcttcttaccaacagctcctgatgcagtgggagggaaatccgttatcacgccgtcgacagagaagtttgcattgccaatgtactgcaagtactctgcactgggatcaaagctgtagttgtaactcatggagacatcattggcaaatccagaggcaaaaacttcaagcccaagggcatgtgcatccttgaccaaactagtaggcagccgcagatactggtccttgcccaatggccaaatgtattccttggggacaagaatccctgatgcaaaggccttgacggatttcaggtctttcaggatctctccatacgttttcttggtggtatgctcagcgacgtcttctctaagaaaccggaaaattagcttggtgttgcttttcttgagcttagcacccacgtttttcaagaatccaatttctggtgaggagatgtaagcgacactaaaatcttttggtaatcctaatatgtaatcttcggcacttaatttgtgctcctggagaaataaagcatactgaaagcaaaaaaaaaaaagttaaaaaagaacttgtgttagagagacaatatagcgtactaagaaaagtgcctcagtaagtctgtgggtaatagtgaaataaaaattacctctacattaacccataaatgtgggggcttgagtccgacaagatcttcaagggtaaacattcccatggctccatcaaatgtgcttgggcgagaaaagatgtcctggatcactgagggatgatcaaatcacagaataacaagtcagagaaaagttgcagcaaaaaaaaaaattatagcttcagaatttgctacaacctgctatgtggcgaaccacctccaaggctccattccaaccttatctattcaaaatacataagaaaattatgaatcattcatatatttttatattttgaaattgacttcattcatggagcacaaataaaaaaaatgaatttttatttaaagactgtatgcaatgtttcactttgaagactgaaattactcagtttttttttctgcttacatgtgacattctgatacagctcgtctgcggtgaaatccaaagcaaaccacccatggatttcctctccattcaccttgtatgtcttggccctcttagggaaggcttcggcgataagcgtcgagttctctaatgtcaatccagttttgcagaagcccaaaccatcactggacaattgcagatcacagtacagaaccacatcatgcaagctactcgacattgcaaactggtacgagaactggcttgaatcaggaaacaagccggagaaccctccacgagcaatgacaagaggacgctgacctgtaggacaccaccacaaagattagcaaatcaaaatgcttgatcaggtgaaacaacaatctttccaattgaaaaaaaaaacagcaaagagaacaagaagatgtttacctccaagagtctgccatttctgtactggatctttcaaagccgcatgggctccatgaaaaagtaggaggatcaagaacatgtgaggatatctttctcccatttggacaggaggagcaccctgcatcacataatatttttgtgaactaatcaaacagcggagaagattaaacaatattggagtaaaaaaaactataccaaaacaaatgtacaaagaaaccgctgaaggatcatacatgcaaatcaaaggtgaaagataacctctcatcaaacttatttctttttcagagcagagaacttcaaatttaaattcatgcaaatcaaaggcgaaagataacttctcatcaaacttatcttttttttcagaacagataacttcaaatttaattttgcagagcaacatgctcgagaaaaaaaaagatacatacctcacatgaaactg

SEQ ID NO: 72075 - DNA, 60800 bp, Oryza sativa
agaacccaatacgagattaatcaaaattcgaaataaaaataaaaaaaaatctaaaactagaaaaggaaaggagagtccaagtagaaatacaatttaaaaatagatgaaattcggaattaaaaataaggaatattaaaataagtttccatataagaacccaatacgagataaatcaaaaatcgaaataaaaataaaataaaatctaaaattagaaaaggaaatgagagtccaagtatgaatacaatttaaaaatatctgaaattcgaaattaaaaataaggaatgttaaaataagagtccatataataacctaatacaagattaattaaaattcggaataaaaataattcccacattaatcggagaaaaagagaaaaagaaaaaaaaggagagtccaagtagatgtataatttaaaaataactgaaattcaaaattaaaaataagcaatattgaaagaagaatccaatacgagattaattaaaaattagaataaaaataaaataatatctaaaactagaaaaacaaaaagagagttcaaataggaatacaattttgaaacaactgaaattgaaaataaaaaataaaaacattaaaataacacaatacgatattaactaatttttttaaaaaaattctgaaattagaaaaagaaaaataagatatcaattaggaatacaatttataaataactaaaatttgtgataaaaataaagattattgaaagaaaagaccatctaaaacacatgacgagataaattaactaacatgcctataaagaagtagagtggtggcggttgatacgagatataaaaattgttaataaaacatcaaatagaatcctaatgacgattaaaaggagagacgtcaggcaggccgtgaagcaaacgagtaaggcgattgccgggacttctagaaagtaaaaaaaaaacaaaccccattgataatcatattcgatttttaaaatctcaatgataataaaaaggagaagcagcaggcggggtgtataagagtacagttgcagagctgccgacggttaacaggacttctagaaaataaaaaaagaattctagaatcacaatgataataaagagttggcggcggacgggctatagaggggcatagtggcatcgtttgatgggacttctaaaaattataaaaaaataaaactacaagtccaatttttaaaggttttgaacttctaaaaagtaaaaaaaacccaatgataatcatgttcaattttaaaatctcaatgccaataaagaagggagacagcgggcgagccgtaaaggagtacaatagcaaagccgctgacggtttggcgggacttctagaaagtaaaaaatgaacccaaacgataattatgttcgatttttaaaatctcaatgacaacaaagagaaaagacagtggacgggccgtagagtagtataatggcaacgtttgatgggacatctagaaattataaaaatgaaacccaacatgacaataaactctaaaaactataaaatccaatttttaaaggttccaagaagaatgaatgaaaatagtggtagatcgagcaagcaaataaataaggagatgacataagagttagcaactggtgtgacttttaaaaactatatgattagaaacacggggatagtaaggtttggtctttcaaagtcttaaagacaatgaaatagctagatagctatttaataaattttaagtaaaataatacttaaaaatatatgattttgtttaggtgctagccgcgcaattgcgcgggccacccagctatttaatatgaaatttgttttagaaaaataaatgtacatcattaattgttcggaaaacgttacgcatggaaacgagaaagtgataccatctaaaacgttgtacgatttatgctaatgaatactcgaagaagatgataacttgtaacccccatatggcgccaaagcgaaccgacgacggcaaactcgatcggctatgggcctatggcagtggcaagtgataacagggctgcttttgtcacttgacagggtcacctccgtccggaatatccgtggattctgcgtcgccagggcggagctagtatagctaagggggtgtccatgaacccggttaaaaaaaattacctatattttatctattttcactatttatataccccgttagtttaaatttagacatctgtatcaagctaaatttgattcaaatcaaagtaaaacaagtaaatggaaccccttcgttttgttctagctccgccactgtgcgtcaccacatatggagtaggagtagatggagaaggttgcgtgctgcttcgacctcctcaaactcaaagctcacgacgaagctgaccgcggcaaaggcggatgacgatgaggcccgagcagcagcggcctccatctggacatgttccgtggctcgctctgccaccgcatactctcgtttactaacgctttatttagtcctttaaattcttttataaggttttttaaaaaataattaaatttataaaaatatagtaatatgtacaaaattaaattaatcttattaaatataccattgaatatatttttgataaaatatttgttttgtattaaaatattgatatattttttctataaacttaatcacactgtaaaataattaaaataacttataatataaaatggaaggagtagtattttttttctgatttactagtgataaatccctggccataataactttctattaaaaatgcatcattgttacgtaatattaatagaaatcaggattaatttaaagcttggtgagtcatataccacgactccattaccgtttatgtttgtactttctatctaagttttaattttcatttgtgataaaaaaataattttcatttgacaaaatgtaactcatctgctttgaacagaagacagcagcataagcctctaaacgtggaaacaaatgaaaatattaaattccattgacgggagaccagaaattagctctccgcctctccctccgtccttgaagttctacagctcaagttttgttttaaaatgaagctagatcacctaattagcttcattttaaaacagaacttaagcggtataactacgattaattaggggattgtgattggccgagaagagaagaggaagtaggtgaagaaaatgagtgaaaaatggttataattggttgcatgatccgctcaccattagtcgtagttgctgaaccgactttaccaatcattgaccaatatttccgatcaaaaccgaagtcgctacacatgtagcaaccaatatccaattgcaaacaacaaatatcaagcagtaacaatgtgcagtcaccagcaaggacgaagtgctactgtgctagcctccttgattcgccaccaccaagcgaatgggagaaaccatccctgctactaccgcagccaatggctgcggcggcaatggaggcggagtagataaggtgaagacgatgatggataggccaggttgggggtcagcggcccatgaggttcggaagtttttatgttcgattagtatcgatagacatgactccatagaacttatatgtacaccctcctagtcctctatctcctttctccagccaaaactgagccctggtccaagtatagatggccatatgatctgaggcccatggcttggcccaagcacggcacagcccgactagggtcgtaccgtgtcagcctggcccgacagccggaccgagcctgggctgcaccctcgaaacggtgggccggccggcacggcatgatcgaagaaaaatagtagaggaatccaaaatagacttaaataaccatataaggcaaggcccaaagacaagaggagtataaaacagacttatttttcagccattatggacatagccacagagtcgagggatgagaaatagactaattctgtggagaagcacgatggacccgagtcgtattggaccgtgtgtgtagcccgtgggctggcacgacacggcccggcgtgtaggtcaggccgtgcgggcccgaaaaggctcgaaaacctcggcccagacactgccgggcctaggccgtgctgtgccagacggcccatttggccatctatgggcccaagcaagccagttcaaccagagcctccctccacacatcagttgtgccctcctcatttgctggtttatcaactagtatcaaatttgaattttaaagcttagttttagagttaatgtggattttttatcatattcttttttaccttagtttttaatttttttataccctagataaagtagactaacaaatatttactcataaattatttttgatgcttgctcgtttttttcctgcactcataacacaactgatcactacttcgggtgcaaagttgtaaactcaactaattaccgtaagagggtcagggtttcaatcatttaggtggacgtccactcatttattgccgttctactatcttactgatggatcggctgtgggaagaggtgctcaattcacaatcagcctttccctttttcagatcagtccgcgtccaccgaagaaatcgcggcaaactcggcaaacttttgacgtttaccggacaggcaaagctaccatcacttcgttgtcgttgctgtatatccacgaccacgtcaaaactgatcccatggcgccaaactgaacaccgtgtcgatctccgacctcgtcgtcgccgcgacaaaaaccgctttgatcatcacctcgtcgtcgacgcacctccaccgcatatgtagcagtagacaagtagcatctgcatctgcgtgccatacacgattgctccagctagctgcacctgcacatcgccatggccatggccgacctggagttggagaaggttgcgagcttcttgctggcggcgctgctgccgctcgtgctcttcaagctggcggcggcgaagcgcggtggtggcgatggcggcatgaggctgccgcctgggccgtggcggctgccggtgatcggcaacctgcaccagatcatggcgggtggccagctcgtgcaccgcaccatggccggcctggcgagggggctcggcgacgcgccgctgctgtcgctcaggctcggcgaggtccccatcgtcgtggcctcgtcggccgacgccgcgagggagatcatgagcaggcacgacgccaagttcgccacacggccgtggagccccaccgtgcgggtccagatggtcgacggcgagggcctcgcgttcgcgccctacggcgcgctgtggcggcagctgcgcaagatcaccatggtggagctgctcagcccgcgccgcgtcaggtcgttccgccgcgtgcgggaggaggaggtcggccgcctcgtcgtcgccgtcgccacggcggcgacgcggcggcccggcgaggccgccgtgaacgtcggcgagcggctcaccgtgctgatcaccgacatcgcggtgcgcacgatcatcggcgaccggttcgagcggcgggaggatttcctcgacgccgccgccgagtgggtcaagatcatgtccgggttcagcctcggcgacctgttcccgtcgtcgaggctggccagcttcgtcagcggcacggtgcgccgggcggaggcgaaccaccgcaagaacttcgagctgatggattacgctctcaagcagcatgaggagaagagggcagctgctgcagctgccggcgccggcgccgtggaagacgatgaggacatcgtcgacgtgcttctcaggattcagaaggaagggggcctcgaagtgcccctcaccatgggcgtcatcaaaggcgtcattcgtgtaagcaagtatacattcttggtcatgttctatctgtgtgataatgttagtattatattagaatataaaattcatgctaaatggtagtaagaaataaatttacatgtacaagaatataaaatggatggtaactagtaagagttaaatgacattaacatatattgcaagtctttaattgcacctctactacttgttttatgcaacatgacttcatgaaagtttcaaaattttcccctgcattctataggacctttttggtgccgggagtgagacatcagctaatacactccaatggactatgtccgagctcgtgaggaacccaagagtgatgcaaaaggcacaaactgagctacgtgattgtcttcgaggaaagcaatcggtgtcagaagatgatttgatcggattgaaatacttgaagcttgtcatcaaggaaaccctaaggctgcatcctgtagtgccactgcttcttccgagagaatgtcaagagacatgtaacattatggggtacgacgtgcccaagggtacaaacgtgctcgtgaacgtctgggcaatatgcagagatcctaggcattgggaaaatgctgagacattcataccagagcgatttgaggatagcaccgtagactttaaaggcacagactttgagttcataccatttggagcaggacgaaggatgtgccctggtttggcatttgcgcaggttagcatggagcttgctctagcctcattgctatatcatttcgactgggaactccctagtggtgttgcgccaagcaatctagacatggaagaggagatgggtatcaccatccgaaggaagaatgatctttacctggttccaaaggtccgtgtgcctctatagtttggctcgtaactgcttcacacaatatgtgtctcctgtgacccgtacctgccaagtagcgatcatgagcattccattgtgtttcatgcccttatggtgttatgctgctcaacttttttaatgttttctcgaaataagtaccatcatagttgttcatgtaactataaattacgagtttaatttgtgtcgtagttaacaagctcgagttgtttgtgttgttttccctttgctaaaatgctaaaacattcattggagagggagagagtggtgtaagctagtcctaaagaaaattaagaacaccaaactcctaaggtacaatagacaattcagtaattagtagttgagttttgaactatgatgggttcaatactaacattcttaaaagtagaattgaaaaaaatatgtcatatttcaaaatcttcgcacttccaaccggaatggaaagcaaattgaattgactccaccattgatttttttcttaaaagaaaagattaactcctccatggtcacaacgtatgccttgcaaatcgcaagaaaaaaaaaaggaagaattaaaaaatctgcaagacaaaatggcaatacataggttggtggagaggatgcagaaattggaaatgttgcaagcagaagaaatttgaacatggaaaaagaataaggaacaaaaaatgttgaaaaacttgagaagaaacattaaagccaaagtgaaaaggttgaattaatcctaggggaaaaaggagagggtatatacctggaaattgaaataaagggatgaaaaatgtttggatggacaaaacatggaaataaatagaaaagagactgcctatcgaatgtacattcaagagaatttctctcacaaatctgtcaaatgtaactacataattgtaatgaaattacaacataactagtatataactacacaattcgaatgtaagtcggatgtaattcataaccgacaccgtggcttgaaatggaagggccatgcatttaagtctagggttgtgggatcaactcacatcagctactcgcttgtttctcgcatggagcacaaatcttgacacgcatccagtggcaaaaaattgacagattttccctcaattttctgttgaatgtggtacaacagatcctaattgaaaaaagaagatatttgtgttggaaaaaaaccatcaaaatagccacaagacacagagagtagcaagggtccagcctaaaatcaattgcctctctcataactgccactctgccagctgggctcaattcatcgttttcacagtttgagatcactcatttactccattcggtttcattttaattgacattttggacaatgacacggattacaaaatatatctttgatcttatttttctactataatatatacaataaataaatgcatgtttacttttattatagtgctttgaaagacaaatctatatatgttgttctagtttgtttaaagtaaatatttttaaagttattaatggtcaaagttataaaagtttaacctaaccttgtctaaaacatcaattattatagaaccggagagagtatctttttcattgattttcccgacaccaaaattctaaaaaagtcaagcaaagccagtggccaccgctgaactcaaaatagacgttattacataatctgataatcatcatgcatccatctatctcttgcagccatgcatgcatcagctctctttggaagttcatccctagcaattactcccatggcgacaaaatccaactcaccatgacaaagctgcttctgtcacttgccacctagtagtaaacagtaacacctctgcatatatgtatctgcatctgcgtgctgtgtgtgccatggccatggatggcatggagaaggtggcgtggtgcgcttgcttcctcttcctggctcttatggtggttaggttgaggacgaagcggcgtggcgacaataatggcggggtgaagttgccgcctgggccgtggcggctgccgctcgtcggcaacctccaccaggtcatggcgcgcggcccgctcgtgcaccgcaccatggccgacctggcgcgccggctcgacgcgccgctcatgtcgctcaggctcggcgaggtccccgtcgtcgtcgcctcgtccgccgacgccgccagggagatcaccaagacgcacgacgtcgcgttcgcgacgcggccgtggagctccaccatccgggtcatgatgagcgacggcgtcgggctggtgttcgcgccctacggcgcgctgtggcggcagctccgcaagatcgccatggtggagctcctcagcgcccgccgcgtccagtcgttccgccgcatccgggaggacgaggtcggccgcctcgtcgccgccgtcgcggcggcgcagcccggcgaggccgtgaacgtcagcgagcggatcgcggcgctcgtctccgacgccgcggtgcgcaccatcattggtgaccggttcgagaggcgggacgaattcctggagggccttgccgaggggatcaagatcacatccgggttcagcctcggcgacctgttcccatcgtcgaggctggccagcttcatcggcggcacgacgcggcgggcagaggcgaaccaccgcaagaacttcgagctgatggaatgcgctctcaagcagcatgaggagaagagggcagctgctgcagctgccgccgccggcgctgtggaagacgatgaggacatcgtcgacgtgcttctcaggattcagaaggaagggagcctccaagtgcccctcaccatgggcaatatcaaagctgtcgtccttgtaagtactctagttgttctccctttttttttcttttcctgtggatgctaatactatatctcccttaatttcgataggatttattttattttttaaaaaatctttaataccaaactataaatttatttggtcacaaaaatataacttaatagctactccccctttcgcaaatataaagtattttggccatctccaattgtcaatagatattagggattttgaactactatggacatgttttaattgcacctagcacctatcacttaattttgttcctttcttatcccccaaccaccatgaaatcatcttcgcttatttaatagaggatatcattgtcttgttttcatccttaatctcgctaaaaaaacatagcatccattatgatggagtaagacacaactttaaaatataaatccactaccgcaacaatacatctagtttaactactgtttaggtcagaatatataaaatttacctttaaagaataacttatacggataaatggagcgagtacatgaatttcctttttataaaaaagtatgcatagtgaacataggaaggaattgatacaatattttctacactttatgggaaatcatgtattttttaccatgcatataggacctttttggtgctggcagcgagacatcggcaaatacgcttcaatgagcgatggctgagctcataatgaatccaagaacaatgctgaaggcacaagcagagttacgtgatgccctccaaggaaagcaaatagtgtcagaatatgacttggttaaattgaagtatttgaaacttattatcaaggagaccttaaggttacatcctgtggtgccactacttctccctagggagggaatgtcaggagacatgtaaggtcatggactacgatgtccccataggtactattgtgcttgtgaacatgtgggtaatcggtagagaccctaaatattgggaggacgctaagacatttagacccgagcgatttgaggatggccatatagattttaaaggaatgaactttgaatatttaccttttggagcagggcgaaggatgtgccctggtgtggcatttgcagaagcaattatggagctcgctctagcctcattgctctatcactttgattgggagttccccgatggcatctcgccggccaagatggatatgatggaggtgatgggttctaccgtgcgaaagaagaatgatctttaccttgttccaaatgcccatgtgccggttgccccatagttgttcacacattcgtacttgttcatcttgcaacctctgtaataactgatgtaacttctttggagtaaagccaaaatgaattcaattataaaaaaaaaagagttcgaaattgttgctgcgctcctctagggcgcccctaatgcgcgacaagtcgcgcagtcacacgagcgcgtgaccaccaggtccactactactactcatagtcatacactactactactacagtactactacgtgtatatatgcatatgtatatatcttgtatacatacatataaactttgtattattgtatacatacgtataatttttatattaataatacaaagtttatacgtatatatataaagtatatatatacatgtatatataatttttatgtgtaccaaaaaatcaacgtataaaaaatatacacatataccaactttgcatacgcgtatacaaactttgtatatgtacatgttaaaaaccgtgagaaaaaaatatgaatacaaataagtttgtatacatatgaatacaaacttggtatacacacgaatacaaactttgcaatatgtacatcttaaaaaaaagggaaaaaccaaaaacagaagagaaacgaaaaaacaaaaaagaacagaagagaaacgaaagaaaccaaaaaaagggaaaaatcgcacctccgtcatggcgcgccgtccgccgccctctccacgcgcgacacatgtccagtcgcgcgggagagactggctgcccattagctttttcggctcctctgtctcctttccccactcaagtcgagccctgggcctcggccgaagtatgctagagtccagacctatctcactctaaacatcctggaccagttgtcattcagtttttatcatttgttggtttgtttactagctgcaatcaaaatctgaaatttaaaatttagttttacaattaatttggggtttttacatcataatctatttttaaaactttatattggtatttagaagcctaataatatagatgtaaattttatttttaagttcttcagtcgtaattcaacctatcactctgaggtcccgtttggatcatttcgtccctggactaaaattagtccctagactaaaaactttagtcccctactgtttggatctagggactaaaagggaagtcacgtggaccgagggagagagagaagagagaggctatcactttagttcctataagtacctctaaggacattcccaaatcccaacccatggtgtccataactagtgtctatggtgtcatgtcaacaagacatcacaataaaaactacactctacaacccatggtttcttaaagtgggccattaataaatacatcatctctcttctccaccaatcatatttattcttcatttattatgaagacactattctctcccaatgcaaaacttgatagtgtctagtgcatagattctcgtgttgaagctgtgtcttgcatgagactcagtttcttcctctcttcactctctctctcttaattaatatagtgtcatataagctaaaagtcctacgtggcaatgtagttaatgccatagacaccatcctagatggagggttgggactgccctaagagggactaatggattttagtcaaatatgcactttttaattcctttttagtcacccatgtttggattcttagggactaaaagggagggactaatggattagtcccatgaaccaaacagggactgaatcttccaaaagagtggtgcaaggttggaaactccctctgtcctaaaaactattcttttggcctttttttttctcaaaaacaccattgtttcaaaatggggtgaattaaacctttttgatactattttattattttgttatccttttagccatgaaaagtaatactacccgttttctctctcttctcgttttctatctgcgttaacgattaaacatagagtaaatttcctgtgtacccctgaaaactcactcaatccctttcatacccttgaaatttacccgatcccttctatacccctgaaatttcaatttgatcccttccatgcccctaccgttacattttccatcatttcactgttacgtttggttgcaaatgtcctttttgcccttgatgatttaggtttaaatataagcttcaaaaacaattaaaaattttgtttgagtgtacagtatgtgcattttataaaactaaagagactaaataattagtgcataaaattttgacataaattttgaaaataaaataaatgcaataaattaaaatttttatttgaaattttaataggacaatggatttttttatcgggagcattcattaaaagaatgttgtgaacattggtagttctatttttatatgaatgctcctcacttttatgactttttttttaaaaaataaatatgtatttttttatttcattatctatcaatattttttgggataaataatgcatcgaacaacaaactcataactataatagtcttatgcaagaagcttttatatttttaataatgtaattcatgaatttctttgttcatccaagggtaaaatggtcatttttatagaaaatagacggtcaactaacggtgaactgacgggaggggtatggaagggatcagaattaaaaggaagtaagtaaaatttaggggtatagaagggattaggtaaaatttgaggggtatacaagggattttctcttaaacatatagtagtattttgatctcctgcttatcatggctttaactagctaaagctaatgtgaaacaagagtcttttagagccaggagtaatggccatcctacttggaaggccaaaacatgaccaaaaaaaaaatcaaaaaatgaagatctttttgttaggaaaaagtaacataacaaaagccacgagataaataagcaaacgtccagcctctctcaaacctgccagctggtgtcaattaatcttttccccttttgtgatcgcccatttatcatttttatttattttccagccactaaaattctcgtaagcatagccagcgcccagcgaccaccgctgaagtcaattaattacaaaatcggacgaccttaattagagtacatcatcatgcatccacctagcatccatctcttgcagccatgcattgcatcagctatctttggaatttcataattagcaattagtaagcagagatttactcccatggcgacaaaaatccaacaaagctgcttctgtcacttgccacctagtagtaattaacagtaacacctctgcatatatctatctgcacctggacgcgagcgtctggcttagagtagcactcgatcgatctgtgttgccatggccatggatggcatggagaaggtggcgtggtgcgcttgcttcctcttgctggctctcatggtggtcaggttgacggcgaagcggcgtggcgacaatggcgcggagaggctgccgcctgggccgtggcggctgccgctcgtcggcaacctccaccaggtcatggcgcgcggcccgctcgtgcaccgcaccatggccgacctggcgcgccggctcgacgcgccgctcatgtcgctcaggctcggcgaggtccccgtcgttgtcgcctcgtccgccgacgccgccagggagatcatgaggacgcacgacgtcgcgttcgcaacgcggccgtggaacccgaccacgcggcggctgcggtgcgacggcgagggcgtggtgttcgcgacgtacggcgcgctgtggcgccagctccgcaagctgtgcgtcgtcgagctgctcggcgcgcggcgcgtccggtcgttccgccgcgtccgcgaggaggaggcgcgccgcctcgtcgccgccgtcgccgcgtccccgcgcggcgaggccgtgaacgtcagcgagcggatcacggcggtgatcacggacgcgacgatgcgggccatgatcggggacaggttcgggcggcgcgacgagttcctggagctgctcgccgacatcgtcaagatcggctccgggttcagcctcgacgacctgttcccgtcgtggcgtctcgccggcgccatcggcggcatggcgcgccgcgccgaggcgaaccaccggaggacctacgagctgatggacagcgtgttccagcagcacgaacagcggagggttcacgttgctgcgccggctgacggcgccatggacgacgcggaggaggacctcgttgacgtgctcttcaggatacagaaagatggtggcctcgaggtgcctctcaccattggcaacatcaaagcaatcatcctggtaaatgctactacttctgctgctctgatttatgaagaacacacattaattcatagtgttttagtttacatatagaaaatagatttacatatggaagtcatctatttctacattattatttgcagaagagtaattcatttttatagaagagtttgttagtctttttttttaagaatgtctattgcttagttgaggttgcatcttgttatttcatttttctagaagtgttagctagtcttttttttttctaagaatgtctattgattagttcaggttgcatcttcttatttcatttttctagaagtgtttgttatttcttttttttctaagaatgtctattgattagttcaggttgcatcttgttattccacaggacctcttcaatgcagggagtgagacatcagcaaatacgctccagtgggttatgtcagagctaatgaggaacccaaaagtgatgagaaaggcacaagcagagttaaggaacaacctacaagggaagacaacggtaaccgaagacgatctcacaaatctaaagtacctgaagcttgtcatcaaggagacgcttaggttacatcccgtgctgcccttacttctcccaagagagtgccgagaagcatgcaatgtcatcggatacgacgtcccgaaatacactaccgtttttataaacgtgtgagcaatcaacagggaccccaaatattgggacatggccgagatgtttaagccagaacgctttgacaatagcatgattgacttcaaaggtacagacttcgagttcgtgccatttggggctggaagaaggatctgtcctggcatagcatttgcacagtccaatatggagcttgtgcttgctacactcctatactactttgactgggagcttcctagtggtatgtcgcctgaagagttagatatgactgaggacatgggactatctgtccgaaggaagaatgatctttacctacatccaacagtttgtgtgcctctgtaggccgtagtctcttttgaagtgtttgtatgacaagtcatgcattatgatgtgcccaatgacttaataaatttgttgcttgaatcaatactttcgtatatttttcgaaacatttgaaatttagccaagaggcgaacaatacatgttattcaaacctgacttagtaataggaaatccacactatctaaatgatctacctcgtccactcacatatgtgctagtctgctagtagggggcatggcatgtgattgttgaatttctaataatctaagaatagattgtccttctttttatcctagaatatattgtccttgattgtgagcatcattttaattcatggaaatgctggctagaaaagaaatgtaaggagagggagaggtgggtggatcccacatctggagaagaatataataatatcaatgtgaaacacttgtgataattagtgtagtagagaaagtcgagatcaaccatgtaccttacctaccataacatggtatggacaaagggacaaggttgtctcaactactaaacatatcggacctagttacctagtgtgctaggtatacaaaatgatggaggttcgtgtttttcttttaaaactgtaggatgattatgttgctcggagtgttacctaagtttaaaatatattggaattgaatttagtgtccataacggacctcccgctatggttgtctccagatgagcacgacaggaattagccgaatctattgtctaggctcataaaaagttaatcgtcaaaaaaaggctcataaaaaatttaaaatttaatatgtcactgacaagaagcaattatgacatttcataatactattctgatatatgaaccccataaaactcataataataggtattctcatgcaacttgtagggtcaatatcgtgcctcggtaatgcctcatgtgtcatgtaataatatactagacaccatatgttaaagtgtatcttcatatcttctactactaggtatatccccacaataccttattaccttcataagatattcatacaaataataattgattgtctccctatcttaattctcttatattttgagactgagaaagtatctaattaatgtgccggatcccagatatctatatgtaacgctccgcttttcgtgagacgttaaaaactaatttggcaaaatcctaattgcgaaaatttcgttctttgagtgttgagtctaagttgtgccaaagatctccatttaaatccctcccttgtctcgataccctgttatcaaagatcgtctcctcaaaattaccatcccaatgtagtcccgaagctcgattccttctattcgaaatcccctcctggaaccccatccgtgaactttgtcgaatgcccgaatcctaactccgtccaaggattcaccttcgcgtcataagctctctccttggttccttcaaaccgattctcaaattcgaattcaacctctcaggttttgattcatctatctttctccctgtattggttcatcaatctacccttgttttctttctcgaacttctgacccaagtctgaatatgcaaatcgagatcacttccacccttgaactcaaaatcccaagattcaatccctttcgccctgagttctccccaaaatgatttccgttccgaaataatctcaaagtccgaacccttctattcagacttctctccaaaatccttacccacatatctcgttgagtagtcaaactcaaactctcaagttacactctctttctctaaattatccatccccttttcactcgtctccgaatattgttcccttccttgactccttcctattctcccgagaccgagtatcaacctcgaaattcgaatccagactccaactctaaaacctcccaattaaatctctctgtgaaagtctatttaacctccctcataggttggattccttcatcctttttccggtccacctcttccttctcttccatcccatctctctctgaatctcgatctatctatctatcgatcgatccatctatctatctactatggccccgtttggtagagctcctaactccaactcccaactccaaactccaactccagtgagagctagctcctctaggagctgaggtaggtaaaaaagtgtttggctagattactcagctccacatttctacatcctttgtcgccatttcatcgaacaccttctaggcgtcgccttgacgttgccgccgcagccggtcagcccacgagccaccgccgccgggaagcccacgcatctccgccgcctcccaagccgctgcgcaagcgccgccgcacaggccgccgccgtcgcccaggctgcctcctgccgaagcccccgcacgcgagtcgcctaccgacgccgctgccgcgtgccgcccgtcgcggccaccgcaacaccgcccgcagccgccgccaccgcctgccgccgccgatgcgccgtggcctgctgtccccgtatgctgccaacgcagacgccgccacaactggttgtggccgtcgtcggaggatggggaagaagatgggccgccgccacctgctggccccgccgccgcgccgcccgtcctcgtcccccaacagccgctctccgccgctaccgcagccccccgccgccagcctccggccacgcgtgggcgccgcccgtcgtcgtcccgcagccgccgccgcccgccgctgtcactgcccgtcgccgtcgacgctgctgcagcccgccgatgccgccgcactagctcgggattgggaggaagattgggggaggagagagaacgggaggaaagaaggggtgaaagggtagttgagtggcattttcgtgtaaatacactaaaatattagagggtagtgggtcttttggggtggagtggagctgtggagcagcaaaaacccagctccacccccgtagttcattttctaggagtagctctgccaactccactccaaaaaaagatgaatctggaccgtttggcacagctcccgctccaggtaagttggagttgggagctagagttgtgccaaacagggcctatacctatctatctgtttatctatccatctgtcaatccatctgtctatccgtccctctacctatcaacctacctttctgtctatctatctatccatggcattctaccgctatctcccttgttccatttttgaataatgatcttccctttttgaaatcctctgaaataatccttcatgccgccaaatacaaatccatcccaaaaataccaaaattcccgcttttgaagcccttccttgacccctcccttggatccaccttgaaccctcgtgtacaaatatacaaattgaattcaaattcaatctccacatcaaacttctctccaaaacaaaccttccggtaaaagtctattttacctccctcgtgatgatttgggccgaaacctgccgctggcccatctctccccagctccctccatctccacgtgcgccgcacatgaccaccgaaagagagagcgctgtctctctcccttccctctctcgaacgttctctctctctctccctcgccgcccccaaaccgctcgccgccgtttgaatccgctcgccgtttcccgtgcgctcgcgcgcgtggccgaccgtctgggagacgccatcgccaccctcggtcgtcgcctgctccgacgaccaccgcgtgtccgtgctcacctccaaacagtccccgtccttttgcagtcgtcgccggcgtcatcctgtcgagccctgcgccccacgccgcgtgcgtccaaagccgcgaggcacagctcgtgctcccgccccctctcctcccaaaaacggaagggacatgcctcccttttcaccgtccccctcccctttttcccttctgggctgggtctctctctctcccgcccatgtctccttgcgcccggaggcagagcaccatgacgcagacgccagtggccagctcgccgcccccaccttgaccgctccacgctgccagcccgcgctcgcgtttcaaatttcgccgtccgatccaccgccttcgccgcccaacgcatccacgccatcgccgctttcgcactgcccacgaaaccgccgctgccgcccgtgaacaccagccgagctcccttgaccgccaatgtcggtttccctcctccaaaccgacctctcctcctcgcctataaagcccgcgccctcccctctcgtttcgtcttcgcctcgctcgaaacacccgcgccattgttgccggccgccagctgctcgcccccgtctcgccgtcgcacggtccgtcctctgccgcctcctccctcaacctcggtcaccgtcgcgcggccaaccccggagcatcgccgccttcttggtcgccgcggccaagaacgccaccgccgcgaccaagggcgccaccgcacgcctccgttgccttccccggcacgcccgccgtgacacgatgccgcctcggcatcgcgttcgtcgccctgcgccgctgctcgtccatgcgccgccatcggccttcccatcctcaactcgccgccgacgccgttacctcccgtcggtgagctccctacctctcttttcctctgtcccagcactcgcgtagctcgcgtcgcgcgtgctctgtttccgccaccgtgcgcaatcgagagccaccgttggcctccctctcggcgactcctctagccaccgccgttcttgagttccctctctacctccccaagccgttgtttcagccgccggcctcccctctcgccctcgcgtcgcgtcgcccgattcgccgctgccgcgctcggccacttccgctgtgcctcccctgccgtcggcctccctcctctccttgattcccggcgccgccaccttcctcgggccccccctcgacctccccaacccctccccctggccgccgaccttcctcctcgctcccgcgccgtgccgcccctcccgccgccgcaaggcgccgccgcgagccacagcccggcgaccatcgggtcccgcgtcaccgcgtgtgcgccgcaaccccataccgcgtccactaagcccgagcgcgtgagccgcatcccttcccatcgcgcatccacgtcggcatcccggcgagcttcgccgccgccgccggccgtcgtcacgcgtcgtctccccaatccgagccatggaatcggttctccttgacctcctctagccaccggtgttcgtcgctcgcttcggcttgccgctgttcgccggatttccgccgcgcgccgtgagccgtccgatgccattcccgcccccccctcttttctctccccatccgacgtggctgcccacgtggcgttgaccgggcccgcccctgcccagtcagtcggtcagccgtccccctccccctctctcccctggctcgtggacttggcccattggccagccttcctcctcggcctaacaaaacaaaggaagtttacttttactccctcttccgagtccggtgctcacacaccgaagagctaaaggtccgcaattgctccctccaattgctcctctctctctctctcaccttcttattggccccactcgtcaatgagtcaaagataatcttgagaatgtctttccaatattccacaaatatttctctcttctataaattcagtaaattattttatcttatttcatgggttaataaatctttttcccttgatcccataaatcaattctctattccaaaatttcatgaatcattttccttataaatcatttcctttggtcccgcatgtcagagatggtcaataatattcttgagaatattatttctataaatttcatgaatcaatctccccttgttctacaaatatcttccttcgccagaaattctaattaaacttccaaaattcgtatctctcgatccaatcgtccgattgaccccgttccacttccagtaattccataaaattgagatctatttaatggcactattatttagtctaaatagggtctttttcttggtctcttgtttaggtttttgtttgtttgcgcatagttgcggttaccggattttcgtcgatcgtggatatcttgaagattcgtgaagcttcgtgaagaccctgagcaaggcaagccacctttgaacatattgagcctatatttgaacttaattatattgcttacaaaatattatgcattgataggactacacttaatttgtttgccccatctgaaaggcagaccggtgggcctacccaactcgttgcatctgatccttccattgttaattgttatatcatgttcccttgtaactatctagttgcacctcgatattcgtgcactctgtgcgagtatcgacggtcgccttcaaacttaaaatctgagtaacttcttgggtaaaacttggtttacaaaagctttggaaaacccgacgcctgggtcggtgccttgtgaaagaaaatgagttttaaaaataaaactcgcgacacaaggccattcctgggcggaatacttgtgcggtcgcatctaaggaccgattcctttggaattacatccgagcatacaatagtgtgaccacacgggtggaatgggatgcccctggctgagtaaattgctaatcgggggagccttgatgccgagagacatgtggattcgccagggtggtgtcggggaggacccatgggcttcctggcacagtatggtctgggacctaacctgttgttggtctgggacccctctcgtcggcatatggcaatcctgtgtctgctctcgaaatgccttgtcatgaaagcccttaggtcaccagacgtggtcgttctacacgggctaggtgattcgggttagtaatgtcgtgtgggtaaagtgtaccccctctgcagaggttaacaaactgttcgaacagccgtgcccacggtcatgggcggatgtgaggtgattccttagcgtagtttttgttttaccctgttttatgaaaaggtgttaaggtttgggaaacctaatgcttgggaagcatttagctaccctggggacagcgggaccgggtgtccctggaagtgattggtcgtttggggacctctattatcgggaagtttggaaaattggtttggtttgggaaaaactagatttgaagccaactctgggagttgtgcaaatcgtgataaataaatttgttacttctcacctcccgaccgagctgagacttgtctcgctctggttgtagaaagcacacacttagattgttgaaaacttgaaaacaaaactgtttgcaaaataacagccttcccttgaagcctgcattaaccacctaagttcccctggcttgctgagtacgtaagtactcacccttgctctctatataaatatagttcagtcagctccgaagatgaagttgaagtgaagtaaagattagggtttcgtcctagttccctgctgctgcctgtggtgttgggtgttagaccgttggttccgctgctgctgctgttgttggtgttcgcctcgtccgtgtcgtcggttgcattctcgggctgtctgagctgcaacctaagttaaggtaaataagtcctctatttattttaaggattgcaatgattcatatttgtcaccgtgggtaccagcgctatgtcctgggactggtactgagatcgcggtttcgtaggaagcggttcgcgccgtttttcccacgacacgctcctgtcaggtgccgttgtacggcggtgccagattcggggcgtgacactatacagctaaaaattgactctctccctatctaaaataccttatattttgagattgagaaagtatctaattaatgtgccagatatctatacagctaataatttattatctccctatcttaaatctcttatactttgagaccaagaaagtatctaattaatgtgctatatatatatatatataattgattatctctctatttaaatctcttatattttgagactgagaaaatatctaattatgcgctagatatctatacaactaataattgattatctccctatcttaaattccttatattttgagattgagaaagtatctaattaatgcgccagatatctatacaactaataattgattatctctccatcgtaaatcccttatattttgatattgagaaagtatctaattaatgtgccagatatctatacaactaataattggttatctccctatctctaacaataaatctccagctagttggttttgctttacatatgaatcagtttattattgaaggcatgacagaactccactgtccatagctaccaagtgatctgacaacagcaaagtgagagtggattctaagttcaagatgtaggaatatattatatatactctacttacttgggttaagtggcatgttcacgagtgtatgagtatgaggtacgtgtctattgtcgtatatacatatgcattttccgtgtaatcaaaactaaataaatataaaatactctagttagttttcaagcgaacactctatgactcactcgacaacacttatccaaccatacacaggtaccatatacagatatgtatcatccgtgtactaaaaaatagtaatatgctctactttttttaagcgaaatcttccactcactcactagatacttgtccaaccatacataggtgccatgcatacatatatatcttctcgtgtaataaaaaatattaaaatattatacttatttttaagcaaactctccttcaatagacacttgtccaaccatacataggtaccataaatacatacatatcttctcgtgtaataaaaattattaatacattatacttatttaagcaaacactcctttaataaacactagtccaaccatgcagtggtggagtagtatatttgtctttttttctggatgtacaaggtatcatcaaaatcacagctatcaagccacaccacttcattaactttctcattaagaattgatttcgccttaactatctgccaatattctccaggttggaagcctctgctgccaccaaccttctcccatgtataaatagctgggtgcatctcgtccatggcactcacctcaccacacacccacagccgccgccatggagcaggtctcgtgcttcgccgccgccgccgccgtcgtcgtcgtggttctcttgctcgcccgcatgctcctcgcgccgcgcggggagtgggacgggctgaacctgccgcccagcccgccgcggctgccgttcatcggcagcttccacctcctccgccgcagcccgctcgtccaccgcgcgctggccgacgtcgcgcggcagctcggctcgccgccgctcatgtacatgaggatcggcgagctcccggccatcgtcgtgtcgtccgccgacgcggcgcgcgaggtcatgaagacgcacgacatcaagttcgcgtcgcggccgtggccgccgaccatccggaagctgcgcgcgcaggggaagggcatcttcttcgagccctacggcgcgctgtggcgccagctccgcaagatctgcatcgtcaagctgctcagcgtccgccgcgtcagctcgttccacggcgtccgcgaggaggaggccggccgcctcgtcgccgccgtcgccgcgacgccgccgggacaggccgtgaacctgaccgagcggatcgaggtggtcatcgcggacacgacgatgcgccccatgatcggggagaggttcgagaggcgtgaggacttcctcgagctcctcccggagatcgtcaagatcgcctccgggttcagcctcgacgacctgttcccgtcgtcgtggctcgcctgcgccatcggcggctcgcagcgccgcggcgaggcgagccaccggacatcctacgagctggtggacagcgccttccgccagcggcagcagcaaagggaggccatggccgcgtcgccgcctgacatcgccaaggaggaggaggatgatttgatggatgagctcatcaggatacacaaggaaggtagcctcgaggtgcctcttactgctggcaacttgaaagccgtcatcctagtaagtatttttcttactcccctgaatgttcagatcagaatagagcttttctactactctggttgttcaggtaagatttttctgctactctgattttgtttttgaaggaaaaaaacagttcagacaaaagttcagaagagtatatatatatatatatatgttcttgcagatagtgttcaattaacttgatgtagcatatgtattttccttagttgtttatctggttaaagtttcacatgtgttgcattttggcattgtacaggatctctttggtgctggaagcgagacatcctcggatgcgctccaatgggcaatgtcagagctgatgagaaacccaagagtgatggagaaagcacaaaacgaggttcaaagcatcctcaaagggaagccatcggtgaccgaagccgacgtagccaacctaaagtatctgaaaatgattgtcaaggagactcataggctacacccggtgttgccgttgctcatcccaagggagtgccagcaaacttgccagatcatggggtatgatgtgccccaaggtagtgtcatatttataaactcgtgggcgataatgagggaccccaagcattgggatgatgccgagactttcaaaccggagcggtttgaggatggtgagatcgacctcaagggtacaaactatgagttcacaccatttggggctggacgtaggatctgccctggcttggcattagcccaggccagcatagagttcatgctcgccactctgctctaccacttcgactgggagctccctaacagggctgcaccggaggagctggacatgactgaggagatgggcatcaccatccgaaggaagaaggatctctacttgctcccaactctccgtgtgcctcttaccgcatagcaccttccgtccttgatgtgtgcaatcagtatgtgtgcttgtgatgcctctacatgaggtcgcacaagttgtacctcgctgctcgtttcggctttaataaaccgacagaaatctccttattctatgtttggctttcttaataaggttccatgtttcattgctgtgatttctggcactgcgatttacttacgggagaatcaacaaaaatagttcattgactccaacaggaggcagctaactatcgaagtgcaaccgatgctaaaaaccgatcgacagtgtgtacatgaacgtgagtcgcgacattgccggctttgtagccgtgaggccgccgcgcatatcctccggatagttgttaaattatagtacatgggagcaaatagctagatcctcaaacaactatctcctgggatagttgtatagctatagcaggagatttaaaaccttgcaaaagacaccaccgcatttatcaacgtgtaggtgatttttggggaccctaaatattgggacaaaggctgcccaaggagttcaagctagagcgaatcacagataacgcaattgattttaagcacacggcctttgaattcattccacaagttgtatgggcatgttttttttttttggcatgctggactatacgagcatgttgctattgttgataatatagaagtggaaaccacatattttccaaagaaaaattgtccaaatcgagcagaaaattttggaatataataactagagaattttcacgtataatttcacgaggtaaaggatgttgatgtgaaaacacgaggcctgggagatctgcttaactcaagtgcaggttcaaaagcttgcttttaggtgtatgagcgtgccagttgatttgatcctgcaatcaacaagaaataaagacaaagaaaccacggttaaattcataaacgatagccgatcggctagttgccgatgacatatcatttatctttgagccgatgtcatatgtgaatcgatcggcagtcatgaataagtaagaaagaactaaatctattcgatcggctatagatattaacaatatatagtctctatgtcgatatatacttaaatcaagtgattgggatatatcggtcgccatgccgagacagtataaatcacttagatcgaaatatatattaacaacaagactatatatgttcatagcatagccgatcagatagatctagcatgtatcggctaatactccgatactagtactctatattaagatatcaaagcaagtaaaatataccaaacaaaagcctaatatacataaatgcaacaatatcttaatcataaaggacagatttaacatgtcaatcaagcatataagataaatgtagttaaatcaggtaagatcggctgaaactccgatgctaccctaatcggcaaccaaaagcaggctagagattgagattctaatcacgacttataaggtcaaacccaactgatgcagctataagtatgaaaagaaggacaatatctagacaatcaaaccgttggatgtttcatagagtggtgaatatcctatataatctaagtcaacgtcggtatttaacctaatcggctgccttctaataacagacgttagccgattggaggttagataacgatattgccggagattatatgggatatatgataactcgacgaattatataaacaagattagagtatcataaagatggaagcactaatcccgagaacgcaagacgccataacaatagttgaagatcgaaaccgatgcagctcaacccgaaagtaagaactcatcgaaacaaaacgaaagtaaaagggtggcgatgcgccaagattgtattgaacgtgtgttagattgattacatagggttcggggtctatttatacccgagattacaaaatatgtccatatcgtacatgactcttatctctaacaaactctaagataccataagtctttgcggcagacttttgcccaaaacatatctctaaggaaattacatgaaatgtcataattaatagatacaattgccttttcaggactctatccatatgtggcaatcattatgaagcacattaactcaacccgacaatgcatgccgtgtcatattgtcggattcggctcaatcggctaaccctgtccaacttggactctgtcgatcctgatcgcaaccgactcggacttcagatacttactctgtttccggagtgatctccatctcgtactccgcttcgatcccatcttcatctccgttacttggattaccaaatttggtcgttaacaaaggtataattagatttgaattacaactcttatcttccatttttataagtacaagtatgcaattgtaatatctacatgaaaaaaaaaacataattgactttcatactcaactataatttgtataacaattagattcaatatatggctcttagcttctgtttttataaataaaattgtttttttacacaactatattgaacaatctacaccgctatattttgaatactataatttaatggccaagatctttctttttattcttcaattaagtgagaatttttagcctctagaagaaatgtgttgccttcatcttttatctattttttactatagtagatatatcggtagatataagtagataggtttatttttttaacaatatatggatatagatttgtaaggttatggataacatatacctaatagtaatcaactaagcttggcggggctcatcatataccaagtcctatatggaatcataccacgtatatagaaggagttccggataaggaagaacaagtagagttctacatggaaactgtaagaactactcggattgtatgcatattggtctcctagttctacttggacaatgggacatctatgggtataaatacaagacccattaggaggagagggagagggagagagacgaagacaacatctgtcagaatagacaccaatacacgccgccggacatcaacatcagaaataagcctagacatacccaatctggcgcctacggaggatgacaagagggatctggcgctatctctaatcttgccgggtacttattcaaggaggaagactaccctgtcgtcgacaacgtgttggtgttccatgctgccaagttgacgacaagtagataggttatctcaaatattgtacttgtgtaattctgatgaataagagcaacatcggctttggccaacaggagtagggttattacctgattctgatgaataaggggtccgaacctgtatatactccgtctcttttacctcaatctcgcatataccctggtaccaatgatcaccttactatataaatacagtagtcgtgatctaaaacattgacaagatccgatcattgtatccataaattgatatacacaggtaatagatagatagatagatagtggatagagaaccaatctctatacacagccaagataggtagatataaatagatagatttagttttgataatggatagagatattgcccctacgttcacaagtggatatacacataaaagatagatagataatggatagagaaccagtctctatacacagccaagataggtagatatagatagatagatttaattttgataatggatagagatattgcctctgcgttcacaagtagatatacacatagatagatagatagatagatagatagatagatagatagtgaacggagtacaatctctatacaccgccaagataggtagatatagatagatagatttaattttgataatgcatagagatattgcctctgcatttacaagtggatatacacataagagatagatagatatggatggatttaattttgataatggatagagatatggtctctatatttataagtgaatatacacaataataaatagaaagataagagatgatctatgtggcgcctccacctcaagatgacgtcaaataaaatgtatttttatggagactttaacaagacaactcaaacagtgctctccgtttgttttttttccttcttcaaatatatatatatatattctcgtgtaataaaaaaatattaatacattcgacttatttttaagcgaactctatttaatagacacttgcccaatcatatatatagccatcataaatacatatatatcttctcgtgtagttaataaaatacttatacactctatattaataaaatattaatacatatttatcttctccctcttcttcactagctagacacctgtccaaccatatagtggtgtattaactatgtgccaatgttctccaagagtccaggttggaagtctctgctgtcactaaccctctccagtgtataaatagccgggtgcatctcctccatggcactcacctcaccacacaccactccaccatcactcacagccaccacccgccgccatggagcaggtctcgtgcttcgccgccgccgccgccgccgtcctcgttgttctctcgctcgctcgcatgctcctcgcgccgcgcagggagtgggacgggctgaacctgccgcccagcccgtcgcggctgccgttcatcggcagcttccacctcctccgccgcagcccgctcgtccaccgcgcgctggccgacgtcgtgcggcagctcggcgcgccgccgctcatgtacatggagatcggtgaggtcccggccatcgtcgtgtcgtgcgccgacgcggcgcgcgagatcatgaagacgcacgacatcaacttcgcgtcgcggccgtggccgccgactgtccagaagctgcgcgcgcaggggaagggcatcttcttcgagccctacggcgcgctgtggcgccagctccgcaagatctgcatcgtcaagctgctcagcgtccgccgcgtcagctcgttccacggcgtccgcgaggaggaggccggccgcctcgtcgccgccgtcgccgcgacgccgccgggacaggccgtgaacctcaccgagcggatcaaggtggccatcgcggacaccacgatgcgccccatgatcggtgagaggttcgagaggcgggaggacttcctcgaggtcctcccggagatcgtcaagctcgcctccgggttcagcctcgacgacctgttcccgtcgtcgtggctcgccggcgccatcggcggctcgcggcgaggcggtcaaccgggcgtcctacgagctggtggacagcgccttccgccagcggcagcagcaaaaggaggccatggccgcgccgccgcctgacatcgccaaggaggaggaggatgacttgatggatgagctcatcaggatacacaaggaaggtagcctcgaggtgcctcttactgccggcaacttgaaagctgtcatcctagtaagtaactttgctactgctcttaatgttcatagataagttttctactattatgattgttcagataagaattttctgctactctgaatttgttgaagaaaaacagttcagatcacaaattaaatttcagatgggtaatatatacacacacacttgcatattgtctttaacttgatgtagcatatctattttccttagttttttatcaggtcaaagtttcacatatgttgcattttgtcattttataggagctcttttgtgcgggaagtgagacatcctcgaatgcgatccaatgggcaatgtcagagctggtgaggaacccaaaagtgatggagaaagcacagaacgaggtgcgaagcatcctcaaagggaagcccacagtgactgaggccgacatggtagacctaacgtatgtgaagatgattgtcaaggagactcataggctgcatccggtattgccattgctcaccccaagggtgtgccagcaaacttgccagatcatggggtatgacgtgccccaaggcagtgtcatattcataaagtcgtgggcaataatgagggaccccaaacattgggatgacgccgagacattcaaaccagagcggtttgaggatagtgagatcgatctcaagggcacaaactatgagttcactccatatggggccggacgcaggatctgccctggcttggcattagcccaggtcagcatagagttcatcctcaccatgctgctctaccactttaactgggaactccctaacggggcagcaccggaggagttggacatgactgaggacatgggcctcaccatccgaaggaagaatgatctctacctgctcccaactcttcgtgtgcctcttaccgcatagcacctaccttcctcaatgtgcgcaatcagtatctatgcttgtgatgcctctacataagatcttacaaaatgtacctcgccactcgtggctgccttaataaactctccttgtttttcaatgtttgattttcttaataaggttatgtgtttctttgttgtgatttgtggcactacgatttatttatcgaagaatcaaaggaattaaatagttaaatgtctccaatggttggcagctaactattgtagtgtaagtgattccgaagagccgacaacgtatacacgaacgcgagtcgcgagattgccggctttgcaaccgctcgccgcgcataacgtgtcctcaggatcaacactgcgcaggataaaacctctattcttctaatatattaacgtgcaattcttgtgtgcgttaaaaaaaaacactacgcaggatagcatccgccgccgtacgtcgcccgtcagtcgttcatcctgtctagctcgtttcaggcagccgatcagttccatctgctgccgcatccgcgcatccgagtgccttgccgagttccgtcggccgtgtagcgtagcgctgtcgccgagcgtccgcgcgagtgctaactgttgcaagcctgaaactgcagctgctaaactgcactgaggcctgaatcctaacgatcaagaagaggtgagagcagcaggcaacagcaacaccaccaacgttgccatcgccaattgaggccttgtttagttcacccctaactactccaaacttccgactttccatcacatcacatcacaccacatcacatccaaaacttttctacacacataaacttctaacttttcctaaacttccaacttttttcaggaactaaacacagcctgaattgcaaatttgttttctatgttgccatctgcactgcacgtctgcaccttgctatgtttttcttttagagaagggtattttctacccggcatctacatccaaccggatatatacggccattgaaatagggaacttagccccgcaaacaacccaatctgaaattcactccataggagatttgaactcaggaccttgagtactactcagatcactgtaaccactaggctacatggttaataggtttgttcgtttctcttgttaattcttcacagagttcaaagcctcagaggatgaacttggagatggaaagttgaacgatactacgctagtatgttcaatccacatgttgtatgggctatttttttcttttttttggggggggaggcatgttggaatatacacacatgttgctactgttaacaatatagaagtgaaagctacataatttcaaagagaaaaatgcccagatcaagcagaaaaatttgaaatataataactagaggattctcgtgtataatttcacacaaaggtaggtaaaggtataattagatttgaaatacaactcttatcttctatttttataaatagaagtatgcaattataatatctacatgaaaataaaaacaaatttgaatttcttactcaattgtaatttgtatatagaggcattttataaatacaaatagattcgatatacgactcttagcttctatttttataaataaaattgtattttgtacacaactatattgaacaatctatacagaggtataatttgaacaatataatttaatggccaggatctttcttttattcttcgattaatatgagaatttttagcctccaaaagaaacgtgttgcctccattttttttctattttttaatataatagatatatcgatagatataaacaagtaggtttattttttaataatggatatagatccaacctccgtaacaaaaaatggatatacacagttaatagatagatagatagattgattgattgatttatttatttatcataatgcacagagaaccagtctctatatacagtcaagataggtagatatagccctcgcaaaaaaaaaagataggtatagatagatagatttaattttgataatggatagagatattgtctctgtgttcacaagtgaatatacactaaagttagatagatagatatggatggatttaattttgataatgggtagagatccgttctctatatttataagtggatatacacaaaaaaaaaaagatagataagagatggtctatgtggcacctccacctcaaaacgacatcaaataaaatgtattttatggggactttagcaaggcaactcaagcattactgctctctccttttgttcatttttttcttctttagatatatgaagtaagcaatttgtatgtttttctctctgtttgattaattgagatggagatatatatagcatccatttgtggcacattacatgggattgagaattagattttcgagcggtactatgtttacagttcaattcccccacatgaaaacgagatatttcaaattccccaaattatgagatgtaaatacatggcctcaaaagcagcaagaaaacacaaggataagtacagtgtccgggccgttgcaaaaatcttagcctcttatgatatctgccgttgccatctcaattcagtgggcaccgctcgcggcgccaccgcatgacgagacaacgcggtttccgtggcgtgtagcagcaggcagcagcagcagccagcctcgagctcatctgcaatggcgccccgcgccaagacggcgccgccgtgcgccgtgcatcgatcttgcagatgaaacggctctctttgtcatctcatctccatcgcctcgtatatatctgttccctagcctagctagctagctatcctgcattgcattgcactcgcgttcgcgtacttacgttgtcgtcgtcgatcatctgatcaccatgtacgacgccgtcgcctgcgtcgtcgccgtcgtcgtcgtcgtcgtcttcgccatgctttgggtgaagctggcgaggagtggtgatggtggtggtggtggtagtggtggcgtgaggctgccgcctgggccgtggcggctgccggtcatcgggagcctgcaccacgtggtgggcgaccggctcctccaccgctccatggcgcgcatcgcgcgccggctcggcgacgcgccgctcgtgtacctgcagctcggggaggtccccgtcgtggtggcctcgtcgcccggcgccgcgcgcgaggtcacgcggacgcacgacctcgcgttcgccgaccgggcgctcaacccgaccgcgcggcggctgcggcccggcggcgccggggtggcgctcgcgccgtacggcgcgctgtggcgtcagctccgcaagatctgcgtcgtcgagctcctcagcgcgcgccgcgtccggtcgttccgccgcgtccgggaggaggaggccggccgcctcgtgggcgcgctcgccgccgccgccgcgtcgcccggcgaggaggcggccgtcaacttcaccgagcggatcgcggaggccgtctcggacgcggcgctgcgcgccatgatcggggacaggttcgagcggcgcgacgagttcttgcaggagctcaccgagcagatgaagctcctcggcgggttcagcctcgacgacctgttcccgtcgtcgtggctggcgagcgccatcggcggcagggcgcggcgagcggaggcgaacagcaggaagctctacgagctcatggactgcgccatccggcagcaccagcagcagcgggcggaggccgccgtggtagacggcggcgccggcgtcgaggacgacaagaaccaagacctcatagacgtgctcctgaacatacagaaacaaggggagctcgagacgcctctcaccatggaacaaatcaaagctgttatccttgtaagtaaaattgacacctgtcgtattaaaagcaaagtaaaatatatctactctcttcatcccagagtaacaggttcagattaagtgtactataatatatcatatctcgtatgagattgatttattttaggacggagagagtatgtgctatcatggtggattatatttgctcaattagatggtacagctctcaaatctttgtagtatttttcattcgatcttttaactttttataggatctctttagtggaggtagcgagacatcggcgactacgcttcaatgggcgatgtcggagctaataaagaacccaatggttatgcaaaagacacaagccgagctacgtgacaaacttaggagaaagccaactgtgacagaggatgatttgtctggcttaaagtatgtaaagctcattattaaggagaccctaaggcttcaccctgtggtaccactgcttgtcgcaagagagtgtcgtgaatcatgtaaagtcatggggtatgatgttccaaaaggcaccactgtatttgttaacgcgtgggctatcggcagagacccaaagtactgggatgacgctgaggagtttagaccagaacggtttgaacacagtactgttgacttcaagggcatagacctcgagttcataccgtttggcgcaggacgaagaatatgtcctggtatggcattcgcagaagcaatcatggaacttctgcttgctgcgctgctctaccactttgactgggaactccctaatggaatggcagcgagcgagctggatatgacagaggagatgggcatcaccgtccggaggaagaatgaccttcacctccgcccccatcctccgtgtgttgtaaggtcaaacttccgtagttttgttgagagagagagagagaggcacttcgtgtagataaataaaatgggttacaatatgatttcatataataggggaaagttttaagactagaaacttcagtattaaatgagtcagaaaaaagttggtgcatcgacaagtttcattcttaagacattctagctctgtgatgacctcgatggaaccatactaccatagagatttgtgttttgaaactggaagctagctggattatgctgttcgagaaatgcatacaattttccacgataaatacattaaatctgagcagcaaaatctgttttacacactattacatacggttagagtaattttgctgtcatcgacagccatttaggctgtgttcttccccaactttcgcaactcaccttcctcgtgtttcacgtgcacgctttttaaaatgctaaacggtgtgctgcaaaaggtttatatacgaaagttgctttaaaaaatcatattaatctatctttttaaaagtaaatatttaattaattataagaaaatatggtactccgttttgcgtgcgtgggaggtgagtttccaacttcacatccgaacacagccttagtagtcttagtatctcaggtattagtatggaccaaaatttatttataacgaatataaagtatcttatggtaaaaaagataaaatcccccatatgattaaaattaatagctctataatggtatacgtaatactcgtcgacataggactgaaaccataaaacactgtagtatgtttgtatgcttccccatttatactttgattttaacaaagcaaccgaactagggtcaaaatttcggaaacccacccacccacaccccacccaaaaccccctctggaaattatttcggccgatttttttttggatatttcatggttttatgtatttggcaaatgttgttaaaatttcaaattatttcggatagaataactaaaaattgagaaacttcagtatccgatacaaataccgaaaatctctccgttttatattataagttgtttgactttttttctagttaaactttattaagtttgataagttaaaaaaaacagcaacacctaaaatatcaaattattttcattaattataacattgaatatattttaataatatgtttgttttgtgttgaaaatagtactatatttttctataaacttatcaaactttaacttagaagaagtcataatataaaatagagggagtaatttgaaccccgaaccaaagtagacaagtagtgcctcaccttgtttggagtagcatgtactacgatccctccgtcccaaaaaaacaactcaacctatgaggggatgtggctcttcctaggacaacgaatttggataaagcgtagcccaaattcattgtattaggagtggtcaaattctcttctaggttgagtttttttttaagacgtggacatggagccaaggttgtcagtatctcgattcgtatcctagtatcttacgatactacgatcctaccaagccgaaacgataccgatcccacctagtatcctatttttatactatcgcgatcctactattcattactatacgatcctacgaaatcttaggtggtattctgattctacgattcctacgatactacaaaatattatttaaaatagcatggtttgaaaataatgtaaataaatatgctcaaatttatataaaaatcagttcaatatatcaaaatcaacgtggtttctcttaataaatgtctctatttgtatgacatatatcattactatattttctttatatagaatggctatatataattaatgtaaatattaattaagcttaaaaaaagaaaatctcatagtatcccgatactacgttacgattctacgatacgatattactttgagcaaaacgttactctctccattctaaattgatctacatattttataggtacaccaagaccaagaaaaactaataactctctcatactatatttactttagcaacaaactcgatgcatacaccatccccaatattttctaagccaatagcaaatcaagatattgcatgtgggatataaatacttgtgtgaatacatgcatcaatgtccatttactccaatgcacaaataacgaatagacttaataaacgaatataaatatgtagatcatttagaaataacatcaaaagaatctatatataaatcaatttggaatggagagagtactacgtagtatccgatagtgacaaccttacatggagcaaagcatgggccacctcgagatgactagcaccgggaattgaagcagtgagcccgtacctacctatctactactactatatgccactccaaatactcgcagaattaaacggtagtctttgtcacttaattggcgccgaagcctcatatatactacgtatgtgttaaccttgcgaagctgcaatgttgcacttgcactgcactcgcctcgccgcgatctgatcgccatggatcacgtcctcgcctgcgtcggcatcctcgtcgccttcacgccgctgttcctccttgccgtgctcccgctcaagctgacgaacggcggcgacggggtgaagctgccgcctggcccgtggcggctgccggtgatcgggagcatgcaccacctgatgggcgagagcctcgtccaccgcgccatggccgacctcgcgcgccggctcgacgcgccgctcatgtacctcaagctcggggaggtccccgtcgtgttggcctcgtcgccgtgcgccgcccgcgagatcatgcgggcgcacgacgtcgcgttcgcgagccggccgctgagccccaccgtgcggcggatgcgccccccccccccccggcgacggcagctccgcaagatctgcgtcgtcgagctgctcagcgcgcgccgcgtccggacgttccgccgcgtcagggaggaggaggtggcccgcctcgtgggcgcgctcgtgtgtttggcccatgtggcccagaagtggttgtatagtggtggtttagtaccaccttgaaagtttaggtgggttaggatctgcttataagccttggtgctgcgccatgattggggccaggttcgagaggcgcgacgagttcttggagggggctcgccgagcaggtgaagtgttgttggcccaaccgggaaaaagcctgatgaaaattcaaattcaaattaagtacaaattaaaatccatgtgctaccatggtagattatacatgcttagttactctactactccctctgttttatattataagtcgtttgattttttttccagccaaactttgttatgtttgactaaatttatagaaaaatttaacaacatctaaaatactagattagtttcattaaatctaacattgaatatattttgataatatgtttattttgtgttaaaaatactattatatttttctataaacatcatcaaattaagtacaaattaaaatccatgtgctaccatggtagattatacatgcttagctactctactactccctctgttttatattataagtcgtttgattttttttctagccaaactttgttatgtttgactaaatttatagaaaaatttaacaacatctaaaatactagattagtttcattaaatctaacattgaatatattttgataatatgtttattttgtgttaaaaatactattatatttttctataaacttgatcaaagttaaagaagtttggctagaaaaaaaaagtccaacgatttacagtatggaactaagggagtagtagttagtagatggtacatctgatgttaatctcaatttttttcttgtttttttctcctaggatctctttagtggagggagtgagacatctgcaaccgtgatccaatgggccatgtcggagctcatgaagaatccaagggttatgcgaaaggtacaggctgagttgcgtgacaaactagcagggaagccaagggtgacagaggatgatttgtccgacctaaagtacttaaagctcgttattaaggagaccttaaggcttcaccctgcagcgcccttgcttgtcccgagacaatgccgtgagccgtgcaagatcatgggatatgatattccaaaaggtaccaccgtatttgttaatgcgtggctattggcagggatcctaattattgggatgatgctgaggtgtttaggctagagcggttcgcaaatagtaccatagacttcaaaggcatggacatggagttcataccattcggggcgggaaggaggatgtgctctggtctagcctttgcggaagctattatagatctactgttttctaccctgctcttccacttcgactgggagctcccttgcggaatgacagcaagtgagctggacatgatagaggagatggcccttactgttcggaggaagaacgaccttcacctccgccccatcctccgtgtgccgcaaactcaaacttcttctgcacttctattttgtgagagagctcaaacttcttctgtatttctgttttgaaagagagttcaaacttctgtttgttttgagagagtacttttgtttattttgttttgagagagagagagagcgcgcgcgctcaaacttcgtttgcacttttgttttgagagggggaatgcgcactttatttcggtaaataaaatgaatcacgacgtggtttcatcagaaaagaaataaggctataaacttcagtgtgaaattctacaagtcaaaaaaaaagttggtgcatctgcaagatccatttctgggacatgcgctctgactcactaaggcgatacagattattggaacaatagatttatgttctgaaacagggatgttagatttatgttttaaaaataggaagctagattatgcacttcgagaaatgcttacagttttttgcacgataaatacactaaatctttgtactcctgttgtaacaccttgactaccattaataaaatagttataaggtagagcccctctacctttttcagtcaaaaaataaataaatacactaaagctgagcagcaaattctgtacaatttttccaggttaacatatggataacatgatgagaatcaacagctctccgatgggaaactacagagaagagaaaaacagatataattcagcaaatctacatgtcgaaagctgaccaaaatcaagggcaacctggtatccgtccagaaagtaaaatccttcactatttctcacctctccaaaatcagcaacaattttacaggctttggatatcttcattaactccggtctgaaggagttttggagaatatgaattacaggcagctgcctaggttgtcagcaaatccgccactggctgactagagaaggggttttggatcacaaatttatcattttttttctaggatttcagcagatgcaatatatcatgtaaacagtaagaggcatatcaacatcgatgtctccctttcgcacttggagcagagcaatccaacagcaaacagggcgatgagacccaaagcaaaagaaatgaaaacgctaacaatttcagctgaatcttcacagcaactatctaaatgttgcaaaactgcaatatgatatacatttctgggttctgaagctatgcttggtgagcaacatctattccagcctcggtaatgagctgttctgtcaacgaaaagagcccggcaatttccttttcagcatcaagaatcatatccatttccttgtttggtttggtcttggaaacaattctagtactgtttacacttggcgatgcaaccagattgatgccagaatcagttttgccacttctcaggaatcccttagccatatctgcaagtttcttcaatgtagtagtagcagcaagtgcctccacctccgcagcttcagtttgaagattttggagccccatatgaacggaaaaatcagaaggtctcttgatgtcactaggatctttcaggaacccttccaacttgtctacctcctccttcacatcccaccttctcattaccgccttcagctcttgatctttcgcgtcaagtgcttcatgggcagctcttaaatccatgtccttctgatgcaaggattcttttaacatctctatgtcagcctccagttgattatgcttgtgcaaattggacttgagggctgtacctgtgctcgaaatctcatcatccagcaatgcataaatgtccatctcttcgccttctactgaactagcaagattgccagtgagttcagctatcttttgcaccacagattcagcttgtgagcaactgaatttcatgctatccaatttattctgtagtgtctgtatgtgttgttctttatcctgtaattcggttctaacctgaacaagttgatcttccttgctatctagcagctgctttagttcaacaacttcactgttcacttcagcaagtctgcgttgtgtttcagaaagctctgaatccttctcctgaacagctatttggatagattccacctttgatttcatatcttggacttcatttcgggcttctaacagctcagattcttttatttcaacaagctttaatgaattgctgtgctcattttccttctgaacgagcgccttttgaagcaactcaacttctttggttttctcttctaagctctctctttcttttgttaacactgcttccagagactcaaccttctccttttcctgaagtaacagtgattcaagttcatgacagcgagactgtgcagcattgagctcctttgccttgccttgaatctccaaccgagcagcttccaagttctggttgaaagatgaaagcaatagcctttgaccagagagttcttgaacttgtttctgcatctgcactgcttgatcttctatctgttttcgagaggaggagaaagcctcttttgaagcgattagttcagaccgtacagcatccagcagagacctcacacgtttgaagtcactgactgtatccttgataccatccatatccttgcatgctagttgcgccacttcctttaactctttctgtgctgctaaccatcccatattctgcctctcaagttcttgctcggcgatttttagtttctgttcattggcctttctcaattcattcgatctggaaaaatcaatttcttttcttttaatttcactccggagctccttaattgttgcttcttgctgctcagcagcctgattagcttcaagaagcagctgttccttggacttgatctctgaacgcatcaaggttacttcttcattcttcttcaacatatcttgcttaagcttttccacttcagttaccttctgagaaagcaaatcttgtgagctggcaattttcttgtcttgctcatcaacaagaagcttcaggttatcgatctgcctcacttgtaaaaccagatctctacttgccttacccagtgatctctccatttcctgttgccttgcatatgctctattgatcccacgctctctctgatcaagatccttcttcgcccggttcaggcgtacctgatcaactgaaacccgattctccgcatctcggagatccctctctttcttcctcaaggtagacaaggcggcctcaaattcagacttcagtacatcaatgctcatactcagctcactatcctgggaagcactggtatccaacctttgcgtcttcgcaaacagccgctccaatagctccctagctggttcagttgctccattctcgccatcagtgatatttgctctaatacctttaacaactgatttgatcaaatgaggagcacatctcatatgttgagcttgaaatgacaccatgaaactcaacttctgcctgaacagctcctgtcgggattgcagaaaacagtgtgcatcagtagactgctagaaaaaagttgcaacaggacacctcctagtgaacctatctgcaaaaatggggattttatttgtacatgaaaattctcccggtgaaccaaaggactgaaatgatatagtatgccaaagttaactctgaactaaaaattcagaactatatttattcacacatagtttcaatcttcagcaaagcgacatagcgcagcggatgaattttgatcccaaatctatcgccacacacaaactacaatcgctaatagttctcgttaggttctccgttatcaagattagtttaaagatgtaccggaattgaccaccgtcaaaccaatttcagccaaaaaactcctaattaaaaaactaccactaccaggcagcacaacttgaactagaaaaccaaaaaaaatccgatcctccgtccccttcaaaccgctagtagacgagctcggaatcggaaaccgaacgagaacacacaccaccaacaacgaacaacgagcaacgagagaggagatacgaggagatgggaagggatgctcacatgtgtgacggggcggcacgacggggagccgcagcggagaaccgccgccgccgtcgccggcggcgaggaggaaggggagaggggtggcatggcggcctagcacgtgggtgggggggagggagcggatcacggccgcccgcgcgagatcggacggctcacggcgcgcggagacgagagaggagaggagatgatgatgtggaggccgaaccggacgcgtgtggactgcagtgcagtgcagtggagtggggtggggtgtagtagatgattgatgactcgagtaagcgtgacacgtgacgctcgtgtcgcttgctctttttttttctttttcttttctttttgttttgtttgttttgatgggtttgtgttgcttgctgttctgggttctggtgccgtttcgtttttattcgggggtacgtgaggacaggaaatgctgggctgtactacgtgatgagagaaatttgaattcgaagatgtttaaagaaaccgaaaatttggaaggattttagtgggattgtcaccgttggatgggtgatgaagaaccctggccgttggatcaaaaccgcccgcggtccaccgtaggagttctaggtgggccttgtccttcatctgggcccaaaaacgggagcgcacctactcatctaggctgtgctcttttcagtgagttcctaactcacccccttgtttttagcatgcataaattctttgcaaaaagaaaagaaaatcttatgaaagttgcaaaaaggtgacatatttttgttctgctatttctgtcaaaggaagtaacaagtccagtctcttcaggagtagcaggtaaatagagatatctgagacataatttgctctctgaatgacaagttttgcatggatttgtttctgttcttcattttttttctgtttctggtgttcttagtttttcttcgcaccacatacagattctccgattctcatggtgtgcactgcaccatcctacactaaccctagcaagaatgaaatatgtatatcttgagaatcctttgtaaaagtgtaaaaccttattgtccctcgagaatctctatatcatcctgctatattaaaatattgtcccttagtcaccttcattctttcttttaaaaaatgtcagaaaaatggagttctacgtggtgaaaagatccttcctttcttggaatggctctggctcttcagtaccaacatgcatggtaactgcacatattttgcacataagagtatctctaacagcctctccaaatcgaactcctaaaacacccatatagccaactctccatctgatttagctagtcaaattaactgtatactccaacagcctctctattctaccctctctattttgactatgacaccgggacccatatgtgagccactcccttattctttctccccttccttcccctcttcctcttttcttttctagcgttgacaagaagcaggcggcggcagcaagcggggaggggacggcggtgaaggcagcgtcggcgggaggcggcgctgcgtggggaccggcgggctgcgcggcgggaggcgggcgccgtgcggaggcagcgggcggcgctgcgcggaggacggcgggcgcggcgagcttgtgccgcgcggaggccagcagccacggcgagcgggggcggcgggttgcgccgcgcgggggccggcggccgcgacgagcggccgcggcaagcggaggacggcagtcgcggcgagcggaggccggcggctgccgtgctcgagtttctccccatgcctcgtcgggctcctgtgcttggctgccgtgtggggatgaggaagatgggctctgtggggcccaccattggccagccaaataaagtgaccaaatttggctagtggagggagggttttggccagccgatagcttagccatccagttgaagaggctgttggagcacgtttttttggctagaattgctaaaatttggtttgaagagtgggatggagaggctgttggagaagctctaagtaaccgatgaaatactgagaatcacaacactgggaacaacatgttaactttggatcagcaccagatatgcagaattttacaagccatggtacaaccataccgaaaacagattgtaacaattaaccatacacacagataagtatatctgtgagatgacaagggaagcacccaaacctgccggtaaacaaggcataaacacgcatgcagaggtaaacacacaatgctccacggaaggaaaccaataactcctgctgatgaatgacagataacttataattctatgcatcaaactacctagctgaaggtactgtctcacttgaatcaactgcctcgtctattgtatctgcttttgagttcttctcttctgtgatgcagtctgaactatcaggatgagacgaatgagatgagtcctggaaggagctggtcagatcaggcttgaacatctcatcattctccaagttggaaagcttctcagcagattctcccttgagcagctcaacgacttcagacattatcggcctctgttcctgtttgttctgactgcatgcaagcccaacaagcaccattcgcttcagttcagcctcgacgaagacatccttgagctttggatcagcaatttccttgaactttttgtcacgggcaagtggaagtgcccactccgtgatagttagcttcgtagtggggtttagcttctcaactggcctctttccactggcaagctctagcagcagtactccaaagctgaagacatcacagctttcagaggccttcccaagcatggcgtattccggtgcaagataaccgagtgtacccttcacctttgtagtgacatgggttgcaccatctggaatgagctttgcaaaaccaaaatcggcaacccgtgcttggaaattcttgtccaacagaacattgcttgacttgatatcccgatgaatgatatgtggtgtcgcttggtgatgaagatatctgcatggtagagagagatttcagatgtaagattacttctgcatgtactgaaagttgtcatactgttacagcataatgaatatttcataaggatgtaaaacatgcttacgcaatcccttctgcagaatcaatagcgatcttcattcttcgttcccaaccaagatggcattcagctgcatgctgtccatgaaggtgggagtgcaagctcaggtttggcatataatcgtagactatcaggcgttcttggccttcggcacaatagccacgtaagctcaacaggctcttgtgtctcactgtcgccaaaacctccacctcaattgcaaattcagtttcagctttgttgctccaactcttgagccttttcaccgcaatctgtcccatgtagttaacagaagaagcgttaggttctggttaaagtgaactactttttcctgattttggattaaacagatagaaggtaaatagttccaacataatacttatgatttatgaaatgatgttcaaaaacatacttgtcaaaacgatagtttgaatttgatattgtaggggctgttcagattgatgctattttcaaccataccattttttggtaaagctgccaaaaaaatgtctatgtttagtttgttgtcaaatttggtaaatacataagaaatcctgccaaaattttagcaatattgtcatcttaaattttggcaacattgccatcttgctaaaattttggctacaatctgaataggcccgtatttttttttcaacccaaaatgaaacacaactcaccgggatgtagcagtttgggggttatatcaccatgcaacaaactaacaagtaccaatgtagaacagtttcatcatcttcataataaatgtgcaactgtctgatggaataagtcttacgctgttggtcttcttgtgctaattggtctttgtgttctttttgcttttcagtgcatctttcttttatgacagcatctcctttcacttttactttttagagtagcaagccagctataaatatatatcccaacccccctcccctgcgtgatggtatggcacttgtgagaaataaacagaaaattgccccaactctccttcttgagctcccctctgtcctcagtcggcagcaggaacaccggctgttcctacttatccctcttcccctgcgctgacgagcagcagctcctcaaaggcagtctcttccccacgcagcagcccctagtggcgtgccatgtccgcaggacagtctcagcgcttggtcgcctcgagcgcgcggctccggcaggaggccgagttcaccgcggcagaggaacgcgagcgagtggtggtagagaccgctgcgacggcagcgagggcgtcaaggctggcggcagcaaaattggcaacggtaagggcggaagtggaagcggcggcggcggcggcacgacagtagcaccaacagctctatctccgcctacggcagctccgatgatgagctgacgagggaggcagctcgtgagcgggcggagcagtgggcagctgcgcaaccccacgcgcgcaatggcggcagcttagattggcggggatgcatgtggcggcggcggcccagacgggcgtggacgcggcggcccggttgggtcgacggagatcgcagccgttgcaagtggcatggctctccctcaccggaccggtaccatggtcaccacaggatttaggccgtcatcagggaagtcggccctggcggtgtgtggcctaaaccctaccctcaccaagaccaactacgtcgagtgggccgtggtgatgaggataaggctccaggtgcgacacatgtgggagccagttcggcacggcgacgtcaactacgacgaggatcaacgggcgcccagaagcggactgccaaggaggcctgggacgccatcgctgcggcacgcatcggaagcgaccgcgctcgcaagtccacattgcaggcacttcgcaaggagtgggagaacctggccttcaagccaggtgaggatgttgatgactttgccctccgtctcaacactctgctgtagaagttggtgtcgtatggcgacgacacctacgatgaggagagagccgtcaagaagctcttccgctgcatcccagagaagtacaagcagattgctcgctcgatcgagtctctgttggacctctccacgatgtcgatcgaggaggcgataggtcgcctcaaggtcgtcgacagcgacgagccacagcctctctcgaggcttatcaccattggcaggaagcttcatctcactcgagagcagtgggaggcctgccagggtgacgggaagaagagggagtcctcttcctcgacaggccgcaagcgcggcaagggacacgtcctgcgaggacgcacccagggtggcgcccgcggaggcgcctaagccggcgcgagatgacgcctgccgcaactatggcaagtttggccattgggccaaagactgccgacagccacgacacggccaggccaacgtcgcacaggtggaggaggaggaagagtcggctctgctcctggcacacgcaagcatcgagctatctccagcggcaccggccgcagcggctttcctccaacttgatgagccgaaggtacgcgccttcctcggagatggctccagcaacgacaagactgatgagtggtacctcgataccggcgccacccatcacatgactgaccgacgggagttcttcaccgagcttgactccagcgtctgaggttccgtcaagtttgggggtcggctccatcaccttcaccgccaaatccctgtgctcaccggagtctactacatccccgctttgaggaactctatcatcagcgtgggacagctggatgagaaagattcatgcttgttggtcgagcacgaagtcatgaggatttgggattgccgtcgttgccttcttgccaaggtaacctaaggcaccaatcgactctacgtcttcaacgtgcaagtggcacaaccggcctgcctccacttcgaggccctgaagcggctcagtgccaaggagatggtgcgaggcctgccgtgccttgaccacgtgaagcagctctgcgacgtctgcgtgttaacaaagcagaggcggctcccctttccccagcagataagcttccgagccaaggagcggctcgagctcgtgcacggggacttgtgtggcccagtgacaccggccacaccaggaggacgacgttacttcatgctgctcgtcgacgacctctcccgcttcatgtgggtaatggttctcggcagcaagggagaggttgcggacgccattaggcgcgcgcaggctgctgcggaggcggactgcggcggcgaattcacggcggctgaattcgcatcgtactgcgctgatgagtgcattcagcaccactacttcgcgccgtacagcccgcagcagtacggcgtcgtcgagcggcacaaccagacggttgtagggatggctcgagcactcctcaagcagagggggatgccggccgttttctggggagaggcggtggtgacggctgtctacatcctcaaccgctcgactaccaaggcccgtacgaggcttggcatgggcgcaagccggcggtctcccacctgcagtttttcggctgcctcacgttcaccaaggagatcggccacatcggcaagctcgacgacaggagcaccccaggggtgttcatcggctaagcagagggctcgaaggcctaccgtattctcgacccagagacacagcgtatgcacacggcgtgcgacgtagtgttcgacgaaagacgagggtgggcataggacaaggcggtggacgacggctcgactccaacgtacgacttcactgttgagtacgtccacttcgagggagctgggggagtaggtagctcttattcactgagtgtgcctacctagcccccgagcctccaccgactccagcagcgacacgctctcgagctacgacttcggctgcaatgagttcttcgctgacaccatcacaaccggcgaccccacgcactccagcaccaacagccacccctccgggcacatccactccgacgccaggttgtgtcaagcacagcccggtggagttcgctactccgctctctcacgacgaggagcgcatcgacgcataccacgacagtgagccgctgcggtaccgtacgacgggagcctcagtctttcgcagaggccgagagacacgcagcatggcgtgccgtgatgtagtcggagatggacgcggttgaggaaaaccgcacctgggagcttgttaacctccctcgtggtcaccgcgcgatcacccttaagtgggtgttcaagctgaagagggatgaagccggagccatcgtcaagcacaaggctcgcttggtggcacgcggtttcgtgcagcaggaggggatgccttcgcccccgtggtgcgatccccggcaaggagggcaaggtgctcctccttgcgctggctgctcaggaaagctggtgcgttcatcacatgaacgtcaagtcagcgtttctgaacgacgacttgaaggaggaggtctacgtacaccagccgccaggatttgcgatccccgacaaggagggcaaggtgctactcctgcacatggctctctatggcttgtggcaggcaccgagggcgtggaataccaagttggattccacgctcaaggggatgggcttcgagcaaagcccgcacgaggtagccatcaaccggctgggcaatggaggaaatgtcctgctggtgggtgtctacgtcgacaacttggtaattaccggcaccaaggatgcggaggtggcggcgttcaaggaagagatgaaggccaccttccagatgagtgacctagggcctctcttcttctacctagggatcgaggtgcaccaggacgactccgggatcacgtttcgatagaccgcctacgccaagcgcatcgttgagctggctgggctcaccgattgcaacccagctcttactccgatggaggagagactgaagctgagccgcgacagcaggacagaggaggtggactctatgcagtatgggtgtcttgtggggagccttcgctaggctccccacacacggccgaacttggcattctccatcggctacgttagtcggttcatgcagcgaccgacgatggagcactagcaggctgtgaagaggatcatccgctacgttgcggggactctcgaccacggtctctactacccgaggtgtcctagaaaggcacacttcgtcgggtatagcaacagcgaccatgccggtgacatcgacagcgaccacgccggcgacatcgacaccagcaagagcacaagcgagattctcctcttcctcggcaagtgcctcgttaactggcattcggtcaagcagcaggtggtgaccctgtccagctacgaagcgagtacatagcggcctccagcgcttcgacccgctctggcttgcgcgactgcttggtgatctcttcggcagagacactggagcggtggagcttagggtggacagcaagttcgctctggccctagcaaagaaccccatttttcacgaacggagcaagcacatccgggtgaggtaccacttcatccgaggctgtttggaggaaggaagcatcaaggcgagctacatcaacaccacaccaaggactagcttgcggacctgctcaccaagccccttaggaggatcaagttccttgagctttgttctaggatcgggatggcccaactttcccacaagacgacgcacaagacttaggaggagaatgatgaaataagtcttgcgttgttggtcttcttgtgctgattggttttgtgttctttttgcttttcagcttttaggacaggactagcatctttcagtttgggatgcctgttaggacagcatctcctttcactttttagattagcaagccagctgtaaatatgtatcccaaccccccggatggtatggcatttgtgagaaataaacagaaaattgtcccaactctcttagcgccatcctctcgataagagtaaggattctgttactaacactatcattataatagtatttagtatatttttctttcatgtgtttaatcacgtaaacaagattaatccataaaaaagactatagctatcaagtattttacacgttacaggacaaaatcttgcctcatctttcacccaaatatcactatcagcatgctacttattttttctggctcctagtagactaggtgggacaaatacactgaagagaagcacaatagtcatctgtctttgtgaagacaatgtgattttcaatagcctcatattccggctgtatgctttcttttgtgttcataccttccaattatgattttttctagcttgtaatcatgcaatccttgacaagactattggtataagcgaaaaaaattgataactgaagctaagaataagtcagttgtctactcagaccaaatccccattagacacggccttaaaccgcacgcaggtccagtttggatggccatcatgttcaaagaatatctgaaggtagcttttaaaaaacggcaaccattttatactgctaattaataccactagacttttttttttcaagacgacctacacaagacaaaaaagtttctattgatatagcaggaaaaaattacaaggttaccactagaccatgaacaacgctagaagtggatgtcagttaaacaacaatcatcaacatcactgggtccctccaatgctttgccatttttctaatcaattagaaaaaaaaaagaagacaacaaactaaagtttgtgcagtgtggactgcatgattctcagatttcttcctgttctttttttctttttcaagattgaaagaggaacacctcacctgtgatccatcccagagctggccccagtagacgctgccaaacccaccctcaccaagcttgttgtcatagttgaaattgttcgtcgctgactgtagctccttcagcgagaagatccgccatgtcgtctccttcttcttcttcctccggccaggtagaaccctgagtatagaacaagcaaacagatcaacaaacgagcttcatttcctcttcaaactctcaagtacggactcttcttcccaaaaaaaagaattggcacatttttaacggattaattagatataagtttccactatgtcattctatttcagcttgctgaccaacaactgcaatccgagagcgaacagaaaaattccccaatacaagcagagaaaattccacgcatcatttggttcatccatccaatgaaaacaggtgaatgttgcggtgttgtatgctcgcatgattaatcagcaaatcacacacaaaaccacaaaacttgatcagcaactcaccatttccccaaacaaaaaccattttctgcttcaagacacttctcagctcccagcagaaaaaattctccccagaaaaaaaaagttcttcttagctaatcaatcgagtaatctgttttgagcaaacccatcgaatccaccaacagaactaatcacaaacaaaattgcaaatgtttaccgacgattccacccaacaagtcaaaaccacccccaccctcgtaagtcataacccacccaaatgagcaaatctcccctctccccccccccccccccccaaaaaaaaaaaaaaacacaccaaacaggcaaacagcacacacgaatcaatcctcaaatcgccagatatgcactcacccgtccacccccttgcagcaggaagcccaccccatcgccgccgacaccgccgcagccccccaaatcagcacgacacccctccctctccggagacctcccgccgcgcgaggcagccccgcttcctcccctcaccgccgccggcgaccgcgagacagctggttgaggagagagagagaggagaagacgaggagacccgcggcttcctcctctcgtggtggtggtggtggtggtggtgtcggctcgtcttctccacctcgcactactcgcgtcgtctcgtcaccgcgcggcgcacgcaaaggcaagctcgggggcgcggtcagctcacccacgtggggaccgaccgggcggggtgcgggtcggacacgtggcgggcggcgagtgggccgttttgaacccggtgaggtaacggtcgggtttggggtgtgggcggtaacgtcacgcggcgggtgaggggtcggggtcggggtggggtactggagtggctgacgtgcgggggccaccaccgggggcgatgatgacctggcagcttgaaggggtggggccctcggctgttggtgggatggctacgtttgaccaaaggaagattcctgtggcctgtgggtgagacttttgctgaggtttgtagtacttcctctgtcccaggaaacgcgtcgttctggcgatcgtcccatcgtcccagtaaacatgtcgttctgctgcttctgcattactctctccgtctcgaaaaaaaaaaaaaggcaaactttagatttctgtgtccaactttgactatctatcttatatgaattttttttataattcatattttcattgttgttagataataaaacatgattaatattttatgcgtgacttgtctttttaattttttttctaattttttcaaataagacgaacggtcaaacgttggacacggaaaccagagtttgtcttttttagacggagggagtacgaagtaggagtgtgcaagttaatgtggtttttcttgtggttttttaatgcgttttgtagtacagggaatagattttactaaattactaaactaatgcactaatgagactattaaagagctataggggtgtttatatcagggtgtaaagatttgacgtgtcacattgggtattatataggttgtttcatagagtgttcggcactaataaaaaaactaattatagaatccgtcagtacataatttattaagcctaattaatccgtcattaccaaatgtttactgtagcaccacattgtcaaatcatagagcaattagactcaaaagattcgtcttgcaaattagtcacaatatgtgcaattagttaaatttttagcttatatttaatactttatataggtattcaaacgttcgatgtgacggagtgaaaaattttagggtgggatctaaacagggccgtagtttttgaccaattcatttgagtactttgaatatttcaggcgttctactgttagtactcctgttgtcttggtttgtctcatttagtacgtgaatttttagtgcgccacaacttgatgaccacgaccgatttggtatcactatcacacactcgatgattatatgttggtgtttataccacgaccgatttggtattacttgctccgttttaaaataagaacattttgtcctcttttttccttaaaaaattaacttttaacaatcatggtatcgaagtttataaaaatagagaataattgcattcgaactaaataaagtaggagacaattacaatggaatttaataaagttggtataatttattctttttgcttttgtattgctaagcgtgggatatgggtgaaaaatgaacttattttgaggggatggaggccggcggggtaaaatatataggacactttggctttgcaaatttagaccgacgtgttgttttcaacaagtcaaacaagccaatgctagtaaaaggacagtggcatatccagctatggcgtatgcagaatgtgcgttgatatttaggacctattcagatttgaggaattttgtgggccaaaattttagaagaattgaaccgtttgctgtaaaattcatacgtttcgaaggagcatttataatttgatctcaaacaagggcgcaaaagttagagagactgctcaatgaaggcattttactttgtgttatcatactgtataaaaaccatccatgcgtaccaagcaaaaattttcacaatttgaccctttgcaaaaactattttacaaataaaccgtcaccaaaacttatttcaaaaataacccttggcgttgaactaagacatctcagtgctaaatagcgtggcgctgaatatgcgttggcaagccgacttagtcacccatccgcggtggcacggtattcaacgccagttgacatggcgctgaggtgtctaagttcagcgccaggtgatttagcgctgaccaaaagagtcaaatttgaaataagttttgacagcagttcatatgtaaaaaaagtttttgcaaagggtcaaattgtgaaaatttcaacgtaccaagggactaattattgcctactattttattatgggatttgcccatatatacatacccagagaagggaagacaaagatgcaataccaaacaataagataagaatggaaagagacaaatgcccctcacaaaatccacaagtgaatgccatcacagctggtagccccagaaggccagaacaggactcctgttggtctcattgaggttagctagccagccactatggagtggagtagtgtattatggagcatagtgacccatcactttaataagcaccggtgattggcacgcttcaatcatggctttgtatctttgtgcttgcaaaagtctcaagcaatcccaaagcaaagcagatggtaagatgttctgcaggaattttgtaatgtcatcatccaatggccatggctttggccccaattgacctgttctcacctctgcctgccctcatcacactaatttttttaaaagatgatcatcaaactaatttaatccactaccatcaattatagttgaaaaagaaagccaaattggaccattgctttaacccgaaaaagaaaactgaaccggtgcttcgctcgatctggtccaattcaaacactgtttatgtaatcgaaaattcgaaccgctctaaactatttgagttgggcaacttcattgtgaatcatgaattaaagtagagattttggaccggttggcatggaaaagagttgggctccacgtatatgaatgaaccaaagaaaagcccaacgaccagaacaccacaattttaaacctaaatcacttaaaatggcgcaagttcatggttgaaaaaaaaacatataaatgtcataccttatggcctaacttttttttttcaaaacacaattaaaatgcaagcttttacaacacaccctacgtccctacacatatgagcacctccgaaaaactaggacagtatatattgagattgacgaagtcatcacgggtgtttcgctgtcaacgttcaagtctaggaagctactctcacttctcggagtaacatatttttcttagacgtatacatagtatatgtgcactcctatttgtccatatttatttttcaaatttggtttcactctccagataggactcttgggcttgtttagaaggaaatggcccacgcaaatactggcccatcacgaggcccaaatctgcgtgtccaaggaggaggagagaagcagcaaagcccaacttcatctgcctcgtctcgtcctcaccccgcctcgccgcctcaaaccctctccccacctgcatcccctctcctccacggcggcggcggacaccaccgcacaatgaggagctcccctgcggcgagtggcaccacgccgtcgaacatggacagcgggagcgaatctgacagcgcccccgaggagctcaccgccgtccaggtacgcccctcctgcctacgagaggaagccgaggacgacggccgtcgcgcgagctagagctcagctaacccctgtatccgagcgaggcttcgtgtgcgtcgtgctgccatgcgctggatggatcatggatagcacctcgtttgctgcgcccgcgagagctgagaagcacaagtactagtttagtagtgagctagagctagggttgttggatgtttacttcgatctcaccttcgcgatgcctcgtcttggagatcttggagttcgtgctgaccgttgctcgctgttgatgcttcgtagggggttgagaagcacgacgagatcagtaaagttgagaaggacagtgccatcaggtgtgtgcccctttatccctttgttccttgcgtgtatgctaggcttgatgattggatggataagcactctgctgattgtgcttcccttattttgatttgtgttg

SEQ ID NO: 72076 - DNA, 696 bp, Oryza sativa
ccgttgatcaaattcaatcgtacgtgagtcggacagttgggtcatatgcatagcaatttccaaagttaaatagcaaaagatagccttttcatcagaagatagaacaaaacggttttacgtgaaactagacattagacctaatttgttttgtctgttacacggaaaacacgtgcacactgctatgttttcaaaaccggtcagttttagctggttttcataccgtgttgaccgaaagttgttggtttttatcgggtttctataaaccgttgataagcgggtataatttccgatacgaaaaggtgaaccctagccacaagatggtccaagatgccactaagttcctaataatggccactgtcataggaagaagattctccaaagcaacaattccatggggacgctcacgtcgccgttgcttgtttgggaaatcggaccaagattctaatatggaaacttgtgtggagaaatgggatgtcgtgacgacgctcaagattgttgccgtcatcaaagcttgcaagaatttgacaaagctttcgtcattccacaatcaaatcctcacacacaaccaccctatgtgccagacataaccaccaattcaagaacaccacaaagctgaacccgcagccccatggcctcaagccttaccaacacaccaaaggcaggctagctagatccatgacacacgtgacaatgctg

SEQ ID NO: 72077 - DNA, 640 bp, Oryza sativa
taacttcgtaaattaagggaacggttcaactttttaaaattgcaatgatagctatgttctagcttttgtgcagttagcaacctcaaacacagtggaatcaaaagaacaagcatacctgtaacttttggtagtactgttcagcaaggtctggtgggcagtgtgcttctcgaagttttgttacaaaatttacaacaaagttctcgccaaatctttcatacataaccttttgagccatcatgatttcaccaaacagggcaatctaagaaagaagcagattagactaagctcttgaatgtaaagaaatacatccatcaccacgcaaaagtcatgtccatttcaactatagtaatgaagtaaaatgacaagacaataagttgtgagacaacaatcatttaaaggaagaaaataactcatgttctatttgcttttagattagtaattaactaaatgataacctagcaagactgtcaccgagaattgcattgctacatgcctactttggccactgagcctctaatcatttatgccctccttgagaagtaatgaaagcaccaagacatagctcattgcatcccattggccaactgaattttcaattgtcatattaacattccatcagcaaagggaacagattagtttg

SEQ ID NO: 72078 - DNA, 781 bp, Oryza sativa
ctctagttgtacatgagttgtacaactggatctcatgagcaattttacggttcttaaggaggtaccaaaaatttagtataaaatttggtaccttatagtacccaggtatcaaaaggtattaaatttacaatagaaaaagtgatacctcatggtacctcctcaagaaccgtaaaattactcggatctcatacatatagcagtactcttttactttcctccctgtttatccctaattaactttacactgttaggcctaattaattttctctacattcgtcccgactggattctcaagtagacgacatgcgtacgtagcatccaaatacacgactcgtgcgcccgtaagacaccaaactcccctcttaaaacgacgcgacaatcacaagccgccgcgcccctgcactgcaccaccctctcgccgccatgccgtcgcttgggatcgcgccgctgctcgacgcctacttccgccgccgcttcgccgcggcgggcctcgtccaggcgtccgttccgctggacggcggcgccacgacggtgcaatgctggcgcttcccgccgggggcgagcgaggagctccccgtgctcgtcctcctccacggcttcgggccaccggcgacgtggcagtggcggcggcaggtgggcccgctctcccgccggttccgcctcgtcgtgcctgacctccttttcttcggcggctccggcacagcggccgccgacgcgcgctcggaggcgcaccaggccgaggcggtggcgaagctcgtcgccgcggtcgtgggggctgcgg

SEQ ID NO: 72079 - DNA, 3482 bp, Oryza sativa
caagttcttgtgcttgccatgatgccatctgacatcgagatcaagtagttcttggatcatctggatgatccgtgatgtcacctcatggaagtgtgacgtaccactgtagtatcatacaacaactgattgatcactgaatcgtcgaaagagatatggtccctgaattcccaaccgccttcgtagctagctagcactagcagtcactcacctgtcaccaactcaccaaccaatcatccctggatggagatgtctccctcaatttcccaaccgtttcgccgttcttccaatcaattcagagtttcagaccgccgttcgatccagcctagcttttccagttagagacatcctactgtttttgtgtagttgacaagcacagaggcactcacactgtgtgaatgtaattgccatctttgccaggctaataatcttccaatcaaggtgagactgaatgaactctgcgttttcctatctgaatttcaacaaacaacaggcctacctgtcacctttccccaacctatccgagctggattctcaaattaactcgtcgtcctttttcacttttttaagataaaatgccttattcattaattgttcctgagagtcattatctttgctgacagcctcttgactttagtaccagtaacttgttctctaaaagaatataagaaatagtaacatttaacactgttgcagtatctctacaccgacaaaatagaagaaaagaaagagctgatcaaggggataacactgggggacaaagaaaaattccagctcactccacttcctcaggtatgcatagcatttagcagctgacaaataattacagaagtgctttacttgccaagtttacctttatcaaatgtctctgtctgtctaatctttcaggaagttcttgtattatggggagagcatgatcagatatttcccatacagaaggcatttgaagtagcaaggtcagtacttattccttctaatataattgcattattaatacatatgaagcaaaacttttgccctctttttgtttaaaaaaaaaacagtagaattacatgttgaagttgcaccttgtaatgttacttacacaagatgaattaacgcaaatgcaggcaacttggtgcaaatgctaggttggaaatcataaagaacaccggccatatgccacaggaggaggacccgaaacggttcaatgaggccctcctgaacttcttgttaccagctccaaattcgtcgttgtgatggggatatcaatgccaacttcttgagcggctatctgtggagagtacttgatctaagttgtacattgtcttatggcacagggtaaaacttgtaccttttgagataaaagtgggaaatatgatatagagtatatgcattgtttttcttctcatatacaaaattgggttgaatcctctgcacttgctagtttctacagtaaaataagggggggaaaatgaagttccctggatttaataaggggaaaaaaaccccctgtaagaatgaggggttacatacattaaaccaagcactggtaaaaaaattctattctgcgctaacttatgcgacgcctgatttgtcggacccagccaacctttacctcctgaagtaagaggagtttcgctttgatatcttgtgctaaggctccataagctgatctgttgagatccctcccctcaagcattctcactacatctggattgtctgtctgtccgactgtccctaggtaacactctgacttccttggcctgtttcaattgctctcttgcatgcaattagctcagcaaagcaagcatcctcagccgggatgatggaagaagttgtcctgcaccggatcggatcgacaagcgctcttggcgcgggtggtgatcgaatacgctctgctcgggtgcggcggcgtcaagagacgcgatgcttttgctgacatgatatgtaaacgatgcaaaatcgtattagtgtgatcattagggaatgaagacaaaagtgcaattaaaatgcttgtcagcatcacctctttctttctttctgactagctgctttttgtctgcaactcggcttgacgcattgctttgtcacgcattgagaatagttcccttctcctctgttctcatccaaagaatgatgaaaattacattatgttccccccaaaaatatggtgcagcttgttggaaagatttatgcatgaagctaagccttcatccacactatcttatgaggattgctaccgtccagcaggttgtaccgggcggtactggtaccgcgcggtaccaagacacatctaaccgttgaatccgggatgggtaggatcgggagagaaaagatgagcaagggtggatgagggagtacctgtttcgagtcgtcgttcccggcggcggcggcgtccaagtcattgtcattcccggcggcggcgcagagcaacaagggaacgctggcagcgcgggagaggataaagtctggcggcggcgcgagagagaaaaaagggaacggcggcggcgcgggagaggaaacaagtccggcggcggaagaggaacaagtccggcggcggaagaggaacacggcggtggtggcgaggaagaggaacacggcggcagcggcgaaaatcatccagcttcgctagggttcaagccgctcgatctcgatccagacccatctattgcacgcgaaattacaatactgcccttccaccgattatcatcactcggtaccgcttcggggacaaaactggtaccccgcggtaccgatctacgccagccgttcgatctgcctcgatccaacggtcaataatcggtaccgcaaggtaccgttggactgtaaaaatcctcctatcttataccacttgcattggagctaagcttcagcgagttcggtttaggattagactatggtactacaaagagtgactgagtgaagcaaaatccaaacagcaaaagtatttttcatatgtactagttacacagaggtaaaattaatgcatctcacagtttccttgaaaaatgcatcttgaagctaatgctaaagcattaaacactcagggttttaatgttcatgcatgatacagcttttctttttatcatatgcagttaatattaaacaagaacaacaaataataactaacaagaacagatagtgtcacacagtattgcaatgcacatttctggagttactttgtatttctctttttgaaactaaagagtcagtgcttatatatttgtataaaaaaaggattgcacaaataattttaggaagacagctagaaaaaaaacaaagagatatgtgcgaagaaagaattgttagctgccagttccaaatggctaatagagcaactgataactaattagactgaagaaaagagcagataacattgcctacagtgctcctacggtgcagtttctactttgctacgactgctgtgcaatggcttacgactagccaggagagatcatatcaaactagaacaactttcatcaattggaaatcgaaaagccaat

SEQ ID NO: 72080 - DNA, 1464 bp, Oryza sativa
agttcccagctgcacccgtgcccgtcgcatccggccacgttgccatgtccagcgccccagccgcttacagcgccgaccactcacgacgtcagcgccggccactcgtgacgttggccgctcaccatgggcactcgcccactccaccgctcgtagcaccgactgtaccgcctcgccctggtgccgacaggccaccgcgactctccagccggccccctccccccgcgcagcaaggcggggcagatggagctggagcggcgttgcatgacggcaaggcgtgcgtccgcgccacgtgcgtgagggcaatctggtctttttcgatcatttctctctccatgttgtttgaaaataataaaataataccttcggtgtctagtagctaattaccactcttttgcgatatcctatagcaaattcatgtctttgtggtgtcccatagctaattgcacgttttctgagtgtcttctagcaaattttgcctatatttattaagaccatctaaaaagatgcactttttaagatgtagtagtataaattgccctagcaaatgttgccgctatcttaaaattgcttctggtcttatcatttgctcctttactcaggcttatggatggctaactttatttttttcagggaaaaagaacacatgctacttgagttaaccagctatccttccagccactataaataagtagtacatgactccactaaagcaatgacgtaaaaaaaggcaaacaagagaacacatcactatatatacatcaaaagcaatattttctgtggatatgctctgaataaactatgaactgagaactcattagccctaacagccacccttttatacggggaagaatatagccaaaaagaaaagaaatattgatgtcaaaagaatggtcctgcatgtttgtgtgctctgttctttttgggatgatttgctgatgtgatgcaaggttccatgatatgactttgcaattttgtacctttcttccctggccgctagttgccatttcaatgctgagaggtcatttccaagaaagaaatattaataatatcctatagcttatataattatcgttttgaacgagaacatggtattgaaaaataacttcgaccactattcccagttataatgtatatagaaatatcaataaatatattattttatttaaatagtttttaagattaatttatacatataatcttcatacttctaagatatatattttaaaatttatttttcttggtttttttctttttccagcggcaaaatttctcaaaagtgaaggaatctcgaataggcaaatataacttatggcccaagataataaaattgccaacaaagcataattcacaaaatatcctatacttgttccttttcttggagcaaccatcaacctttgtcacacataatttggaactatctccatatatatagttcttcatcgttattgtaattcttgaaaaaga

SEQ ID NO: 72081 - DNA, 993 bp, Oryza sativa
atagcatgttttgcttgtgtgtttgtttgtcgcgtagatttcggccgtttcgtcgatccgctgtttctcgaagacgttgctgaggtctcatcagtgcgagagcaaggcaagtcatgcattacaattgatcatattgtacccaatttacaaatatcccgcatttctattaaatgtcgcatacttttacaatgtcatgtgagatgggtcctattactcagccatttattgttcatatgccattgataactttggtatcaaaatgattagatgttggtttaggaaatacttagccatgcttagctcaactagtacacaaatggggatcacattattacatagactctgactatgagcatagttttggattggtgccaccgcaatggtgttagttaattaaaatacaccgaatggtgggttgtgggtgcatggttttgctggtcgcacccatggcaattaaggaccggttcacgggaaaccctgggagacttaccgtgcttaccacaagcgggagtgggtaactgcttgatctgaagtatagctcgaccctttcataggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattccaatagccgtgcccgcggttatgggcgatcaaccaggttcaccgtgattagtctcacccctagtttagcttaatgaactggtgtatttcaggtggttggttgggcatgttgcaacgtggtgtagcgttggacagtgattggttaatattgattaatt

SEQ ID NO: 72082 - DNA, 5932 bp, Oryza sativa
caattaagcatgtttctgttatagtagaaacacagtgaatcttctaaaatcatatctaattcatccgagctcagtttaagcccattcaagtctcaataaatcaagaaaaaatgcatagaatccattaaaaatggttttgttctctgtttcagtagtcttattgcctgtttgtattgttttctttgtatgtcgcttagattccggctctcccaccgctccggtgtactttgaaatagtcgccgaggttcctccagcagcagagcaaggtaagtcatgcttgtcacttgaacatgttgatcctatattacaaatgctctatcgttttcctttaaatactgcatcgttttataatgttactatgggatgtttacctactgttacagccacactaatttttgtaccatgctcctttgttagctttgggtataacatgactagagattggattagggattgcttagccatgcttagttcaactagcacacaatgggggaaatacattaatacatagatatcagattctagtaatgatgggttaataccaccgctccggtgttggtgaattaaaattaactaaattgtgagctatgggtgcatggttttgatggtcgcgcccatggcatttaaggaccggttcgcgggatgccctggaagaacttatcatacttaccacaagccagcgtgggcaacggctgggcttgtagtgtacctttcctctagttgacgcatcaggcaagggtgagcgtgatggagtttggatgggccctgcgacggcctatgcggcttccggattcatctaggcacgagaggggactgcccgctgccttgcgaggagtgggggtgaaacctgaggtgtggtgtgcttggttagagggggttatgcgaagggtcctgtcacggtctctatccggtatgtcgtggtggcatgtcggcgcacggaaacgtatcgtggggctgtgtcttgtgggtacagttgtacacctctgatcagagtaaaactattcgaatagccgtgcccgcggttatgggcggtcaaccagattcaccgtgattattctcagccaagtctagtctaatggaattgaatagcctaggtggatggttgggcctgttgcaacgtggggtagcgttggacagtgggtggttaatattgatttattattacaactggtttactgctttcaactactatttataaatgctcgctctatgcaaacgaacctctatagctatccctagttaattccgtgcatcatacccctattccggtatgacttgctgagtacagtgggtagtactcagtcttgctctattttccccaaaccccagagtttgagtatgcgttagatggtggcttctccgaggagtaggcttcgtccgtgccgtcaaggatgcctgtggagtggtgttcccgctgcagtccaagtcaaggcttagctccagttatcttttaattttccgctgcatttatgtaagattttatgatgtttgtaagacgtggatctgtttgtcaactttgtcgtttgtgtacctcggccggtcctagacgggggttttaacgcacattctgtttggaatcctattcgggaatttctgggcgtgacaagttggtatcagagccgaccttgattgtagtacaagccaaatggaaaacctaagagtctgaatccttttcattgcacacgttctttgcaattggatttgttcctgtggttcaagggaaaaatcttggtcgcttgttcaagtgagatttgtcaaatcaggtcagtctagggttttagtaaaattatttgagatttatttaacagttagtcgggatttgatgggaggagtgcattaggtgctaactaagagatgtgggttgcaagttatttatgttcctattgttattgttattattagtatgtatctaatttctcattattttatcgctatgtaagtccgtctcacttattcgctctcatgcaaaaatgatctatgcataaaattccgctcttattcgcttattttatttgtgtcctttattgctttatttaaattggatttgagcatgcattgatcctacccctttgccttctctagatggccgaccacccacccaaccaccgtggagaaggcatggatgattttgtggctgaattggcttgcatgaccttggtggtgggctaccccaacgcgccagagtactcaactgttccaccgctcagtggcgagcttcctcaccgtgttcgtctggaggttcatggctatgtggacacctgccttgctaatatggtggttcaggcatctggaggcaccgcagatcacgcctgtcaggaggcagcatatctggtgatggccaggcttcgtgatcgccacaactacactttctgcaacacggcgtaccgcttccaccctcgccgagcaagcggtgatgacgtcagcacctttcgcccgacggccggcgagaacgacaccaccttcggccacatgtgcgccgtgatgaggggaagggacaggatgcactctgacctgcacaaggcgtccaaggccttgaatgatgggaagctcgtgaggatcatagctctgaaggatgagatagcacgcctgaagaaggaaaacgctcagttgaagggtttcccagcgccaggaggagtccggatccgcaccacgcccctcaagttgacgactgtacccatgcgcattcagcttgcgcctaggaacccacctcctcccgcagctcctccagtacctccagcagttcttgcagtgcccgcagctccagctccagccccagctccagtcccagtgtcagctcctgcgtctgctctctcctttgctccagcgtcagccgctaggggtccagccagtggcaacggaggttggttgcctgctactcccagtggcagccgcgaccacagcagcagcagttctagtggcacagagccgggcaccggcgagacgtatctgccagactccaggagccgctcagagggacctggtgacgagcaggaggatgcctttgactccaccgaccgcaggagccgttcgaggcattaggcacgttttcccttagtttatcgactgtttagtttttgtctgttagtttgtgtgtttaggtttgttcgcttgtgggtcagtcgacggtcgatatcatgtgcctatgatatggctatcctaataagtattttgcttgctgttttaagtgttttaattctgatcagaacaattgcagtttaaattcctataaaataaagcttagttcctgagcatctgtttttcttcttttccaccccctccgtctgctcttccttcagatggtcaacaccaggaatggcagccgtgcagcaggtgagggcagcaacggcgaagaacgcaccgacggtgggcatcccaacagcgactccgtcaatggtccgccaccgctccccgagaatccgactctggcccaagtaatggctcatcagactcagatgatggcagccatgatgcagcagatgcagcagcagcaccagcagatgcaccagaggatgtagcagcaaaccaagtagcagcagcagcagtttggtccccctccccctctatccaagttgccggagtttctacgcgtcaggccacccaccttctccagcaccaacaacctcatggaggcaaatgactagctccatgccatagagaagaagctcaaccttctgcagtgcaatgatcaggagaaagtcgccttcgccacacatcagctccagggtcccgcgtcagcttggtgggacaaccacatggctacccgtccgccaggtatggaggtcacttgggcagaattctatcgcagctttaggaaggctcaggtgccagacggggttgtggcatagaagaagagggaattccgagcactccactagggcaacaggacagtgactgagtacctgcatgagttcaatcgcctagcgcggtatgcaccagagaatgttcgcactgacgcagagaagcaggagaagttcctagcaggcctggatgacgaactgaccatccagttgatctccagggattacgcagacttcgagaagctggtagacaacgcaatccgtcaggaggatcaatgtaacaaaatggacaggaagagaaaggtagctcagttccggtccaaccaaggaagccatcagcgaccgcgcttcacacccggacagcagggtggacctaccaccatgattgtccgccagcatcgcccgttaaactcaagcagtttccaccagggcgcaagtggcagccagagccaccagggaggtcagcccaaccgcagtgcagctccgcgcccaccaatggcaccagcacagtcagctccattagcccaagccaagaaggagattggaacaaagccagggtcctattacaactgtggcgagcatggccactttgttgacaagtgtccgaagccaaggcgtgccgggccaaggtttgcttaagcccgtgttaaccacgcgtccacagaagaggcgcaagcagcaccagaggccatactgggtacgtttcctgttaactcaatccctgcaacagtacttttcgattctggtgcaacgcattcgttcatttcaaagaagtttgttgggatgcatgggttaagaaaagaagagcttagtacaccaatgagggttcataccccgggaaatagttcaacctcggtcagttatagcccttcagtgctaataggaatacaccgatcataatttctagccaacctcatccttcttgaatccaaagacctagatgtcattcttgggatggattggctgaccaagttcaagggagtcattgattgtgcgaattgcatagtcaccttgaccaatgagaagggagaaaccgtggtgtacaagtcaccagtctcaccgaagcagggaatctccttaaatcagattgaggtggaaaaccctgtggccaccgaggagaagagttcgaggaaattggaagatatccccatagtctgcgagtatccagaggtgttccccgaagacctcactaccatgccacccaagagagagattgaattccggattgatttggcaccggggactgctccaatttacaaaagaccgtacaggatggcagccaaagagctagcaaaggtcaagaagcaggttgatgagcaactgcagaaagggtacattcgaccaagtacttcaccttggggtgctccggtcatttttgtggagaagaaggacaagacgaagagaatgtgtgttgattatcgcgcgctcaatgaggtcacaatcaagaacaaataccctttaccgtggattgatgatctgtttgatcagctgaaaggagctaaagtgttttctaagatagacctgcgatcaggctatcaccagttgagaattcgggaagaggatatttccaagacagccttcaccactcggtatgggttgtatgagtgcactgtcatgtcttttggacttaccaatgcacctgcattcttcatgaacctgatgaacaaggtgttcatggaatttctggataagtttgttgtggtataaattgatgacatactcatctattcaaagtctgaagaagaacatgagcaacatcttcgtctggtactcgagaagttgaaggagcaccagttatatgccaagttcagtaaatgcgacttttggttatcggaggtcaaattcttgggtcacgtcattacagctcagggcgtggcagtcgatccgtcgaatgtggagtcagttaccaagtggaccccgcctaaggcaatgtcacagattcggagtttccttggacttgcgggttattaccgtcggttcattgaaaatttctctaggattgccagacctatgactcagttgcttaagaaagaagaaaagttcaagtggacggccgagtgtgacaagagttttgaggagctcaagaagaaattagtgtctgctccagttctgattctgcctgatcagatgaagga

SEQ ID NO: 72083 - DNA, 15908 bp, Oryza sativa
  unsure (1)..(15908): unsure at all n locations
ctgcgtgacttgctgagtatgtcatatactcaccttgcaatcattcatcagagaaagagttctacagaaatgctgatggtgtgaaggattatgcgtagccctggtcaagttgcctgtggagtggagtcgtctgcgccgtttatcttattttccgctgcttagatctttattgattgagaggaactatctacctctgtaatgacattttattcgcttattaattagagtaataatggtactctattatctttgttattgtgtgcctcggctgattcctggacgagggtttacacacatgtaagcgtttggaattttggatagaaattccgggcgtgacatgtacccacaagacacagccccacgacacgtttctgtgcaccgacatgccaccacgacataccggatagagaccgtgacaggacccttcgcataaccccctctaaccaagcacaccacaccacaggtttcacccccacccctcgcaaggcagcgggcagtcccctctcgtgcctaggtgaatccggaagccacataggccgtcgcaaggcccatccaaactccatcacgcccacccttgcctagatgcgtcaactagaggaaagctacactacaagcccagtcgttgcccacgctggcttgtggtaagtacgataagttcttccagggcatcccgcgaaccggtccttaaatgccatgggcacgaccatcaaaaccatgcacccatagctcaccatttagttaattttaattaaccaacaccggagcggtggtattaaccaacatcattactagaatctgatatctatgtattaatgtatttcccccattgtgtgctagttgaactaagcatggctaagcaatccctaatccaatctatagtcatgttatacccaaagctaacaaaggagcatggtacaaaaattagtgtggctgtaacagtaggtaaacatcccatagtaacattataaaacgatgcagtatttaaaagaaaacgatagagcatttgtaatataggatcaacatgttcaagtgacaagcatgacttaccttgctctgctgctggaggaacctccgcgattatttcaaagtacaccggagcggtgggagagcccgaatctaagcgacatacaaagaaaacaatacaaacaggccataagactactgaaacagagaacaaaaccatttttaatggattctatacatttttcttgatttactgagacttgaatgggcttaaacggaaacatccttaattgatttattgcgtaataaataaataccgggagagggaggggcggcgccgacatgcgggccccacaaggcagtgactcgggagggcggtccatggtggaccgggtccacggaccggggaggagcggcgcaccacgttgtgcacacgtggcgctgacgcggcgcacacgtggcggacacgtggcagccacgcgggcggcggggttggacggccccgatataccgcccggtagatcggacggcggaggcggctcgtggccgggcgcgcacgggcacggctcaagctgacccagcggccgtggcgcgctgcggcgcagcgcgccgcgacggcgatgcaagcgggcgaccggccggcggcggagggcggcggcgtcacggcgacacggacggcgacagtggcggctaggcggctaggccgcggcgcggcggctaatcggcgcgggagagagggaggaaggggaggaggggtctcaccgacgttgactgacgacggcgagcgacggagggcgatggcgacggcgagacgggctccggaaccacctaggggatcaaaagggatgagttagagagggaggggaaacaatggatggctagggcagcgaccgaaggcgcctgccatggcgaagctcatcggcgcgcggcgtggatgggactccggcggcggattgctacggaggaggggtggacgggacgacccgcacgacggtgaacgcgacgacgtcgacggcgcggctcggcacggtggctagcggctgcgaccggagcggcggcggcgggcggcggagagaaggacgacggcgctagggcggtggagtgcacgggagcgggcgattgcaaaatgaaaaagagagagaggagggaacgggggtgctttatttagacccacgagggtcgatcgtggtcatggagaccgcgatttcgccggtggagtgtggagaggtggggaggagagagaggcgggattcaaaaattgaatcccggccgtctcgagcgcgggcgcggccggaaaagaggggaaagtgggcgcgggaacgcgggcacgagggttacgtgggcgacgtggcccgggacacgcaggagcggggcgcggcgacggttgctgggcgcggcggcgccagctggaggaggcagacgggcccgacaggagggccccacctgtcggcgacccggggaaagaggagggggctcgggcggctggctagcccgtggcctgcggccggcccaacggggagggggagggggagagaatgggccagcggcccattcgaaaagaaaaaggagggaaaaagaaaagaaaaagaaagaattgaatttctagggattaaataatgcttgtgctcatttttagttggttaaaattatttctagggctctgaaaattccactaaaaatcttgttagcatatttcgacatgtagaactcaagaaaaattccacatgccaatcccgattattatttgcattaatttattagggtttctctcttgcttttacaccgatatttcctctaggtaatttataaattcaatttaggcttgggaaagaacttcagggtgtgacaccgagttccttacgacaatccgtcttgaccatccaaccggggctaaatatggaggagtaccctccccaggaaattaacttaggactatatacacacgcggaggaatacccgtactgagctgtcaccatcaacggcctacctcgcttccgtagcatataaccctaaataaagatatccagtaatctaaacaccacgcataaatcaccaaatactactctaatatcatcatcatgatatagagtcatcgtaaatatgattagtatgcccacaccattgcatctcccagataagctatcatcataatgaatataacatggatatataataaagttggtattcatactcggaaagtagttctataccaaagtagtataaagaagaatattctaaataaagtacaagtcttacaaaagaaggaaaagctactagagccatacccgaattcttccgaagactccgacgactgaaaactctattctatttctattccactataccctagagactatactaagcatgaggatgtatgaaacttcttgcttgaggtgtgtggaagaagtgatgagaagagttccctaaatagactgccaatgacggttgtggagttggaatggttggaattgccctccaaccatcattgggaagtgatccacactgtccagggagggttcgactgaaccatgggccggctcaatccagcctatcatcggctggtgacctcctctcttgatatattttgcaggcttgtgaattttggcccaattgtccattcattgataagtttgattctcgacatcgtccaattgatcgatcacctgttttgatgtcgtttctccttcattttatgtacattctctgcaaaaggttagaatcctagtgctagtggaatatttattatttaaacataaatatgcatttcaagcataactagttcttttttatttaggtaatattgacaggcaaaactggtcgctaatgaccgtcaacagcaagcgtagcctatgagggagggaggcgcggtgtattgcaaggctaggagggagggcgctaccaggccacaacacgtctcttccgcttcgtttctcctttttttcgcgaatcttgcgctactctcgactccacaacccaaccacgacgcgacacatctccttctctctaattctccctccgtgcagcgcagaccacagaggcgcaggtactttaccaccgagtggcaggcgcttggctggctggccgccggcacgccgggccagcctctgatcactgacacctcacgcttcttctcgtctcatgccggcggccagcctctgatcactgacacctcacgcctcttctcgtctccactccccagtacctttagctctaagccctaggaaaactgaggtgtttttttgttcttgtgttatttctttaatttttttctaagaaatttaggttcgcagcaggcggtgacgggaggagaggcggcagcggcgggcggccctctgctagatccggtgggaggggaggcagtggcagcggcggcggcccacgggcgacgtcggcgggctcacgtcttccagatccagcaacctctccgaccgcctctcctcctatcgcctacctcctccttcatccggtgagcagcggtggtcaacgctctgctgctttcaccctgccgattctctgatttggattggtttttaagatatctgatttaatgatgtgaagcactccatgaatttttgatcgtgtgatccaagaattgttgattgtgtgatggctgctgatatgcagttgtctttttggtagatttttggatgtttatatcggctcggctcaaatcgtatacgtcaattgctggcacctttgagtgttcttactagtgccgtcttcgtggtgccagttgggaaaaccgacatctttgtggtattcctaacaagcaccagtaaccctatctgggatagtgtattatgccaatttttgtttcgttggctcacaaaagtttattagatgttccatatcggctagaagtttaaataaaatacgtcagagaatctaccacgtctaataaactgaacccttattagagcggggcagctcaaattttaacattgacggtagaaacagtcagtaaaatgtagttcaatttttaagatgggactttacttttcagtgagattcgaataaacctgacggtgttaataacgtcaggaaaattcactgtgacggtcaaacctgtcagcactatttttcctgaagaatacacgtcaggcaaattaaaaatttcccaacaagccagttcggacagaattttcctgacagtttcacgtcaggagggttttggttgtcagggctagttgagtttttggcagtgttatacgcgtgattgcggaacatgaaagttcacacgtacaactcacagctatgcatttttgcatgtactatacctccaagtagattcatagtattggatatacctccaagtaaattcatagactggatatacctccaaatagattcatagtactggatatagtactggatagtctatttttatccatgttttaccattagacttatttaaaatgttttgtaaatataaaataaataatagctacataaacttttaataacatcgttgattttttatccatattttgccattagtcttatttaaaatattttgtaaatataaaataaataatataaatttctaataagacgaatgatcagttttataatacaatggtgtcatgcatcatgcattacaaaatgaatagagttagacggtgatcaaacataaaaaaaatcaatgattcatgcattagaaaacgaacgtcatgcattagaaaacgaatgggcggaaaaaaaagaacagaaaagagaggattgagcactccatcataaaagaacaacctaaagagcatgtgcaaatttacccctggttttttctaatttagctaaacataccactcgaatgacagtttggttgtaattttctagtggcagtactgtaataacgatcgtagaaaattataatcaagattcaaagcagtagaaaatttataattacccaaaaagagggggaatctgtaaataccaaaaagagagggaatttgtaattaacaaaaagaaggggaatctgtaattaccaaaaatttataattaccaaaaagagggggaatttgtaattaaaaaaaagagagtacgccttccgttccataaaaaacacaccataaaaaacacattataatactacgaatatgaacatacttataaaaagacacattgtaatactacgaatataaatataacacattataatactatgaatataaaaatacttcctagacttagcattgcccattgcccatattcatttagatattaatgaatcattagatattaataaatctagacatatacatgtaatactacgaatataaacatacttcctagacttagcattacccattgcccatatttatttagatattaataaatcattagatattaatgaatctagacatatacattagacatatacatgagtttagatatatgatgtttagattcattaacatctatatagactttttagcattgccatattaatgaatcatgtacatacatgtgtttaaattcattaacatctttttagcattgccatattaatgaatcatgtacatacatgtgtttaaattcattaacatctatatgtacgtggacacaatgctaaaaagtcttacattgtaaaacaatgtaaaacggagggagacggagggaataccttaaaaaaaatacattggaatactacgaatataaacatacctctattattcactcctatgttttttttaacctctattattcactcctatgtattattcactcctatgtagtatcatattcactcctatgtttttttttaagtcctattcactcctatggtttttttttaagtcccatgttgtttttaaggacggaagacgtaacattcagtcctacttcaaggacggaggagatactggataacaacattactagcaacattatggaaacattttaaaaggcaggcaggtacaaacttcataaatacaaggaaacattttaaaagacaggcaagtacaaacttcagaaatacaagaagctatgaccgatattaatattagcaacacattgaagcatgcaaccactcgtttttattcatccatacatcggagtattggttattctgaacagtgtacggccactccaaagctggagctaaactgaacctcaaaaagggctcagtgatggccaccaccggggagcttctccttgatcttctccatcatacccttcttctcgtgcgtcggctgcgtcgtcggtgtatacgccgtcccgccggcgtcggtggttgtaccagcggcggcggtgtgtcccgtgccggcaccatatccgccggtcgccgcagtggccgtcggctgctgctggccgcccttgttgccgccggggagcttctccttgatcttctccttgattcccttcttcctcctccctcccatcccgtcgtcctcagacgactgcacgtcatatataatacattgatgacacaggaagatacgtagacataatctagttacggttaatttacagtgtgttgagaaacgttaccgagcttgagcttgaactgccggagcggcggaggatgccaccggtcttgtgctcctctctcgccggctggaactggccgcctgcgtgcggatacgcgccggtgccggcggtggcgccgtgtggcgcccctgtgccggtggttccgtatgccatggtgtcgggtgttgtggtggctccgtgtccagccatgtgcctggtgcccaagccaccggcgccgtggtgggctccggtggttccgtacccggctgtgtgcccggttcctagtccaccagctccgtgctgagctccggtgacgccggttgttccgtacccggcggtctgccccgcgggtaaaccggcgccggcgccgtggtggactccggtgccggtggtaccatgcccggcagtgtgcccaggcattaaaccaccggcgtcatggacgccagtgccggtagcgccgtacgccggctgaccggaaccaccatagcccgcggcgtcgtgggtgccggtgccggtggcgccgtatccggcctgccggccataacccccggcgtcggtggcgccgccgaacgcatgctgaggctgcgcaacgntgccggcggcgccgtacccttcgcgcctgtctcttgcgtcccggtgatgccgtggccggccgccaccgggttgccgtactcgtcgacgcgcgccgccgggtggccgtgctgctgtccctggaagtgcgccatcttctcagcgtacgacgtcgctcgagcccgactcgatcacttgcgtgtgtgtgtgctcgcctgctcgagaggcgacgagttgatcaactgtttcagttggaaatgatctgtgtggtgggtgacgcgaggaggagaacgaggcaaagcgttggacttataggcgaggcgcgcgcggcgcgagcgcgacacgtcgagggggcacgtgtgagccgggtggatgcgcgacgcgtggagaacggtggggagccgacgcgtgcatgcgcggtgtgctgggatggggggtggagcggcatggaagccggtttgctttccacctggatgaggatgagtgcggacgtgggcttcggcggagattctgcgcgtcgggggtgtgcgtgggcgacgtcgagtagaacaggcgttctgccaggtggttaggttaggcatggatgcggctggtgacttgactcgactggaaacaaacagcctcggatatatatttcttttaaactgtcgaaaggtttggagttcaaatcttaacacaattctaataaataaacatagtctattttaaataaaatattaaaaatgataaacatttaaaatgtcataaatatagagaaaaaatagtagtaaactttatttttggtgttttgtactaattgagtttaaccataagttcggtctgcaataacacatctagaagattctacgactgaaacttaacccaaaatctattgtaagcggaatagtaaaatcgttttttgctaggtattgttttgtcaagaaattttcaagggaaaatcacatggatttttaaaaccaccctacacttggctattagaacaatataaagctcactaagaggataaagacgtacacaagtatcttagttagaaaatacaatataattgaattttgttttaaaatttctagatttaaaaagttacaagcatattaacaaggtacaatgtaattttatataaattacatcgtagcttaaaataacttacaacattctcattacactgtaatttgaaatgtggcttcaatttatttttctaataacgtcattaagctcatgtatacttataataccaaataggcatattgcatactttaatttgctggatcattttattacgtaactgtttcagctgggtctcacttattaaccagttgccagcctgattggccctgctctggttgctgcacgcacgccaggacatgacatggctctctatcagttgcagtctgtttgtgatcaaacgagaaaagcaaggatcttatacgtaaaatcaatggtgaaaattccgtctgattttaaagatgaaatctgttgaaagatatatagcaaaccagtaactgacatagtcccttggctcgtgagcttgtaactacatcgcatcccctagaagatagtatgctaatgggacgctatgaaattgcattgtcattcttagaaataaaatacacccgtccaaactcggataaaaatatatatttcttgctctgctaaaaaaagatcatggtaagaaatatggctctcatgaccgtgtaaaataaccaagtgttgaatatttcggaacggaggaaatatatatgttttgtggttagtctccatcttaaattaactatggggagaactgtgtaaaatataaggtaatctttatccatcaaacggtctcttggatatataggtcaaagataagttatgactccggttgagcctgtaatgaaacaggtcaaagataacttgggtggcctatcaatggtgggccaggctttacactatattttttccaaaaaaaaaatgatcaaacttaatgaaatttgacttagtacacaacaaaaacatctaaacctatgaaacggagggagtacagtggcatatgtacctagaaagttttatagatcatctctaaataaaaatggtgctgacagtagggtataatccatccaaaaaaaaagaaataattgtggggcatctttgctttgtgttgcgaagtttttttttcttgtaacaaggctgttttaaaaaatatattttttgaaaacgttggtactttttttagaacatgattttttttaattgtaattttgtttgttgacgtgcaatatatatgtacgcatatttttttattatcatctcatatgctccaatatgtttctaggaaatacatatggattggagcatacaaatcagttattcccagacactggatgtgattactaccaatcaaacactataacttcttatgtatccaattcaaccacaaaatggagcgcacttaattaatttgccaattagtccttcgctcgctttttagttgtaggtgcattttgctagacactcagaaattgttgaatagcacttcttgtcctttgaacagcaataggcaaagtccctctctttctgatagcaaacattcaagctcgcatggctgaccacgtttttcagtcccatcggaatattgcttccgatcttccttatggtttgacctagagatggaaggaatcatatgtactatatgttttaaaactgaaaaagaaatgatgaaatgacatataaatcaccaaaaaaaggaatttagttttcttattacctcttatttgtgcaggaagagcggagcacaccacaagaaccaagcaaaacaacatgagtccttggtaggcaggcttcatacatttcaccattgcgaaatatatatgacgctactatgttttacctgtcttattgtgatctatgtagggaatgttggtttgcgtgaacttgaggagccatggttcatatatatagaacaaatatggctgctatatatggaataaataaatgctagcttatctggaggattttaatcataatctaaaaggatctggaagattagcctgaattatgattaattgcctatttgatgacaataaattgttgctgtaaaatgaaatatcgtaaagcctaattttagctacatggacaaacttatcttctcggtcttgcccaaacgtctattgttgattaattccaccttaaaagagcgattttaaaaatatatcacccttattcttctgttttatgataatagattaatgtttatttttttttgtcaaatctactaacttgtccgaaagtctaattttagtttcactctaaaacatgtcaggctgtactatagatttcaccatcaaaaggttctaaatgtttcttacttaattgcatttttatgacaataaattagtgcctacttagcatcaaatctggtagattatcctaattaaaatatactttcaatagcatggctaaatctagcaggtgactctcccaacgtatgctaatagcaataggccccgttcactgtttccttgcggtgaattcacctattaggaggggatggttagaattaattctccatggggacataaatgagaggaggcatgtccccgttggtttcacggggggcggggattgttcttcattccacgtccccgctccccgcgaagacccgcgtaggggccgggtccaactttaatgtattttagttatcctgtgtgattatattgtttgtagtctttgataaatgataactttatgtttttatcatgtgaattagtagaaaatattagtagatgtatgctaatatattcatataaagtacgaatatatgttgtattgcatatataatttgacatgtgtatatttttttaagcaagggtgaaatcaccgcggggatttattccccgtgcggggatggggatggtaacaaagcttcccccgctgtgtttcgcggtgacggggatgtctcgcgggggcagggatggggatgcattccccgaggtgaattctccgttgccatctcttgcactactaaacatgcatgcgttttcaaattttcttttttgtttaattgctcggtttatggcacgatttcttcactgtacttatcagattttgttggtgtaaaccctaccttctttaaatattatgaatttaatttccactttgttgtacgtatgtcaaacatattcgagaggtgattgtagttgttttcttaggcgttcggttttctccgagattcaagctaggaatttcccacgtctctgggttgtcggtatgtggggtcaaaatagagttattgcttttgtcttatagttaaaaattttagcagtaaatctactttgtgttttctctactatattccattgaatttgatttgttctatagtaggtatgaaatcggttcagatagtttccatgtctattatatattttttggcatgtctattatattaattaattattaattttattgttatatagataacattgaaattgagattattatgtggatacaacacatatttataattctgtgtttttcttaaaaaaataaaaacctaaagagtctaattttcaatggtatattatatttaacacaatttagtatattcttaattttgtaagcacggtacaaggggttttcctgttcccatagatattcatgaccatatttgttccaatacatatttactcagtatctgtattcgataatattttgcttcatttccttttacgattctgattaaaaaaatgaaaataaaatgatagaggtagtttctgttaagaaaccagtctactctactgatcagcacatgagcagataaacacaaacttatgttccccaaagttctacatgtgctatacatgtcagacacttataagagacatataggagattacttcttcaataaggttgtcctcatcatcgtccatatggacatcttcaccatccttagtgttgacaaacatgtcatcatagttttcaatgtgagcttcaggctcagtggtgaagtatgactcatattggctcattttctcattagagctcaaccagatgcttgggaacatggcagttacgagaccaatgctcaatgcctccacatctatagcaattatcatgttttccccagatgttccacatgtaactttcttgcattcggcttttgcctttgggcttacccttcccttgccccttgaacatgatacttcccttacccttctatctcttctccctgtggccccatttatggtcacgtgagtcgccatcaacatcaacattggcttgtccttcagacattgccgtagacccagtgggtcgagcggaatgattgtttaaaataatctcattcggcctttttgcaactaaaaggactgaaataagctcagactactttgagttcttgtattgttgttgaagcaccatgcatgttgttggggtggtaggtggataactttttctcaatcatctcagtatcagtgatcttttggtcacataaacataaccaagcactgatccaatatagggcagagttatacgccactataaatttgtagtcttggaagcatagggtgattaggccatgttgtgcccatgggagcaaaattgacccttgatggtcgcagcgatccttcagggattgccataataccagtggatcttcctcggtcatatactcagacttcatctctgggtggagatggtggcacaagaatgcaattcctttgctttcttcgcctttgtaggatcctctgtgccagcttcgattagcacaatagtatgaccaagacccatggagtctagcttaatttcaacatccaatgcagtgaggtagttgctaccatccaacgcaagctcgatgaattacttctttgttctatctgacatgtcccatggcatcattttgtatttataacaggtaaataatatgtgcagggtcgatataaactggtcatgagtaatttttatgatcactagcatgtgtaatctttaggattaccacacagtttaccatagaaattaatttaagtaatccttaggattacagattgcgtgattaaatattatgaatcatgctaggaaattaattatataacattaaaataaaatgttacgaaagatcatgcaaacaatatagtaagcatgtaaacaaaacgaagagcatacatgggcacaaactccatgcatattgtgcaaactttaaaaaagaatagaaaccagtaaacacttctccactatgagcccacgagccttgacggcaaagttgaccttagtgacagcaaggccccatatgggtgatctccatagaaccaaaggacatccataacacttttagggtcgtgtagaaggtttgtttgcctccactatttgcgggcaacggcggtagagccatccattaagtttacataccgatgcttcaggaacctttcatcatctctagcattttaacgataatggtagcagagccgccatcatgtatcaactaatgctgagaggatgtatcatctcaagcctttggatggtaacggcggtagagccgccttcatgttactaggcattgctgagaggatgcatcatctctagcaattggacaataacagcgatagagccaccttcatgttatcatgtattgctgagagaatgtcagaggatggtacttcaggtgccatattgttcttctgctcatttcaactatagtagaatatanntntgcatattaagancnagatgatcattaggcattggtttctcagctgtttacctgtttagcttggtgaagactcgtgctggtacattnttaagaagccattctattctactgatcagcacaatagcagacaagcacagagttgtggacacagaaanatatggatgaatganagctttatttcatcggattgcgtacaagttacatgagnagattaagtatgaaaatataattcaaaatgatgttttagagaagattgagtatgaagatataattcaaaattttatttcaaagaatatcaaaaggattatgtttttcagtagaacatgaggtcaggtcaaactatttaagcattaatgttttatatgttcctaagaagaaccatatctaaaattttatgcttttgttatgctccgttttcatatttttggggcccattttacgttttgcacatgggccccaaaatcatagatacggccctattcatctgtaacaagacgcatcacctctagtacatgtgaagcctagattctggtttctctcttcacctctccctaccttttctctcccctttggaccacctatatacccatggttgatgttagcttcctccggtactaccccatttgagctgccaccgtattctttgaaagccattaattatctggaatttactattaatttggtaaagcgtgattttctctttatatatactaccgggagtagctactcctgcatcatctgctatacgtgctttcaagccgatcgctattttcgtgggatacaaacttttgaatgcattatgcacgtcagttgtttgcattatctgcctgacggccgcatatatatatagagagagaaaatcctctatgtacccatgaaagttcacctaatcccttctatacccctgaattttgctcaatcccttacatacccctgaattttagtttggatcccttccatgccctttccgctagttgaccgttagttgactgttaaattcttttgaaaaagtccattttgccctttgctataaagaaacataataaattaatgaagtatattgttggaatgtaaaaatttattggatgagactattatatttatgagaatgtgatgcaccatattatttgtgacaaatttacttttacatatgatataaaaagttaatacttatttattagttattaaaagttcttttatgtagcatatgtgttttcatagtaatacaacatat

SEQ ID NO: 72084 - DNA, 15016 bp, Oryza sativa
ggacgccatgcaaacacacaatccttgccatatacaattccgccaaccgacttccggaatatgttgtctttactgggatgaaatgagccacgttggtaagtctatcgactatcacccaaatagagtcatggcctgatgacgttctgggtagaccagtgatgaaatccataccgatttcctcccatttccattcaggaatcttcaaagactgcaacaaaccggcaggtttctgatgttcttccttgactcgctgacaaacatcacatactgctacgtactctgcgatttcacgcttcatacttacccaccaaaatctttccttgagatcctggtacattttggtactaccagggtgaatggaatataaagtatcatgagcttctttcagaattgcatcttttaaatctttgttatcggggacacagattctctcgcccaaccatacagttccttgctcatcctccaagaaaccgatagcttttcctcttctcatattctttttgatttctagaatatcaggatcattaatttgggcttctctaacttgatcaattagagtgagcttcgcttctaaagccgcaacaaaacctctactgacaattcccaaatttaatctttcaaattccttacataactccaatggcaactgtcgttctttcgtctacttgcctcttgacttttgccaattcattggctgccattctataaggtctcttatggatcggaattgttcctggtaccaaatctattctgaactctatatcccttttaggcggcataccacgtaaatcgtctgggaacacatcaggatactcccggactacaagaatttcttccaaagttatttggttcagtcttgaccttaaagactcagaagacaatgcatgaacagttacaactcgaccatcattgctggtgagagttacttttctgttagcacagtctatcacacccttatatctggctaaccagtccatccctaggatgacatcaaggtctttggattctaacaggataagattggccagaaatggtactccctgaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagcactgttgcaggaactaggttaacaaggaacgtacccaaaatcacatctggagcatcttgagcttctgcagcagcaacatggttgacacgggcctttgatgctggtgcggtagagttgctctgggcagggacaaccttcacgcgtcggggctttggacacatgtcagcgtaatgtcctgggtctccacagttgaaacacaccacgggcttgctgccttgctccctcttggcaggctgttgctgtgttggagctgcaacagggcgtggagcttgattacggaggttgttgccagcattgttgttgaagaactgacgctgcggacgaacaacagacgaagaacctccctgaggcatggactggggtcctaaagtaagacgcggcctctgactattcccctgttgtgccatgaattgagcaatctgacgtttcttctgttccatgcggttgtacttgtcctcctgacgaatagccttatccactaacttctggaaatcaggataatccccagtcatgagtgggtaagaaagctcatcattaagtccttccaagaacttctcctggcgctcttcatcagtgcgcacatcttccggagcataacgagccagacgattgaactcgtgcagatactccgtaacagagcgagacccttgagtgagcgacctgaattccttcttcttgagagacaccactcccgatggtatatgcgtcttccggaaagcagcggtgaactcaagccaagtgataggttcagtagtagtcctgttaaggcggaaatgatcccaccattcagaggcagggccatgcagctggtgtgatgcaaatgagaccttctcctgatcagtgcactgaagcaaatccaacttcttttctatggcgtgcagccagtcaccagcttcaacaggattagtggtgctagagaaagtgggcggcctcacacgaagaaattctgctaacttgttctggggaggtgcatggttatttccctggttctgctggttctggagttgctgcatcattatgttcataagctgtgtctgttgagccaggacttgggcaagtgtgggattctctccattgttgttgttgttattgttgttgttgttggggccattcccgttgctacgagtgagcaccatctggcatggacaggagcacaagaagagaaaccggggaaaactacttaagaccgagaattactttagcttttattgatcttaagtgagtttcattattacaaaactgaagattctcacaccactgaactcaccaactacctaacactcgaaagcaaacaaacgcacgcacttacatcccaccactgatgtaaatcacatgcgagacacacacaaccaaacttaaaacaagcaaactaacacaacgatctaagacaacgggttgacaaggcattctaagtcttccgggcatcggagttgattgaaggctcgttcggctcatcttcatcatcttgagttgctccccactcgatcttgtaatgggcgtgcttggattcttctacttcatcatcacttatgatgatgaccggaggatctgctagggctggggtaacttctttctccaccacacggacctttggcgccaattgataacgagggacaaataaagctctcttccttgcggtaagacgaatcctggccttctgcggtggtgcttctcccttcaacgcggctagttccttctccaaacgatccactttgtcttctagtttgcaaatcttaccacgattccggtcttcacgatcttgagctgctaacacagtctccgcacgggtttcatccatagcccacagcatctcaaccaaatgccttgtggtagcatcattctcaattccttcagtctcaaggtagctgccacgatcacttccctgtggttggcgaggatggtagcgatactcagtgtcggccaactgatcacaatagcgatcgcggagctctcctatggcgatccttgccacctcctgacacgcatggatgtagtttcttcctccagcttcgaacatcactgaggggatttcatcactattactgttcaaagtgactttgactcggcacttctcttcatgacgatcatgaggaatctgggcataaaaaggggcagtcccaaatcctatggcaaaggacatcgtacacaactcttggacaaatccctcaacaccaaacaagtactcaggcttgtagcgcggcatctaaagacaaatgaaaggagggagttaagacatttatccaattaatagcacaagtttttggattaatttgaataaagttggaaaatcaaagtaaaaagtaaaccaaacttgcaggataatttgaaacagttggaaacaaggccacaaattttgtacttttgaacaacaggttccaaaagaaataaaagaaagttataaattaacatgcgaaatttatttaattgcagcaagattaaataaagcaatattgtaaaacttttgctggtaaaatgagccattagtacagtaatagatgtacagtactaattacactggaataaattttgaatgagaaccattaaaagagattatgaagtgcatgtgccattagtttggtttaattaaaagagaaagggaggagaacagttctacttttccaatatttttagagggcttctatgggtaaccatttggcacaacctagggtcaaggaggctctgataccaacttgtcacgcccggaatttctatccaaaattccaaacgcttacatgtgtgtataccctcgtccaggaatcagccgaggcacacaataacaaattgataatagagtaccattattactctaattaataagcgaataaaatgtcattacagaggtagatagttcctctcaatcaataaagatctaagcagcggaaaataagataaacggcgcagacgactccactccacaggcaacttgaccagggctacgtctaatcctccacaccatcagcatctctgtagaactcttcctctgatgaatgattgcaaggtgagtatatgacatactcagcaagtcacacagcaaatatgcaaatgcacaaggataccaaaggatggcatagtagggtttcatttgcataaacagcatttaacaaatatttcagaaattgataaaacagttaagtattaattaaacagtattaatccaacgctacagaacataccctgttgcataggcccaaccgttctgaacaaccatcccggctgcacagttctatctccaaaccaggaatataccattccaaaccaggagctaatcaaattattaccagttataacatcttttattatgatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccccttgcataacacaatccaccgcaacgcaccattcctggatcataatcacccccttataaacaaggcatggactccccagcgacccctgtgggcttatctccgccacttctcagtctggtgccccgcaataaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcacagtaattaattaaccaatcacgattgaccatcgtgaactatcattaagccatcattaattaattaatagtgaatcataagttatcccaaaagtgtgctaatgtttctaagcatggctaagcaattatatctaatacatctagttgaaccaatatataaagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaattcttcaaattcttctcctgcgaaaacggactctccggaaacgtcggaatctaagcagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaaagggatttattgcgtcagcggctagggttttcggtggaccgggcgcacggcgacggttcacggaaacgaacggccgagatcgatccatccaaaacagacggccgagatcgatcgggtctacggcggctcacggcagacggccccgatgacgtcgtcgatgacgtcaccaccggcggcggctcgggcggcgcaaactcgccggcgaacaacggcgcttcggcacgaacggaggacaccaggatgtagagggcgacgcggcgaactcaccggtgaccaaaacgtcggcggaagagcaacggagacgaagaagaagcggcggcgaccttcggcttgacgacggcgacggtgctccggcggtcttcggcagcggcgaaggggctataacgtcccgccttccccaggccgggcccgcttacatctgatagctttcataggtcatagactgccctcacagaccaacacatgtcttttttgcacactttgtccacgcttaaccctggagttctttggagattggcttccggaaaagaagttgcaacttgttgatatgagtattctattaatcctattaagccctagaccgggatgttacaccctcaccccccttaagagagatcgacgccgccgtcgatcaaccctaggccaggaacgtcctctcttggccacgtccatgtgtccagtgccagcgcatgtgccatgctgtgtaaccactcccggtctacaccagacatgcgcaccatgcctgcgcccgtgaaaccgcgagagtcggctctgataccattttgtaacgtcccgccttccccaggccgggcccgcttacatctgatagctttcataggtcatagactgccctcacagaccaacacatgtcttttctgcacactttgtcctcactcgtgtgcacccacgaagaatttcccggtcggtcacccatcctaaattgctccaggccaagcacgcttaaccctggagttctttggagattatcttccagaaaagaagttgcaacttgttgatatgagtattctattaatcctattaagccctagaccgggatgttacaccccacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataaaataaacggcgcagacggctccactccacaggcaacttgaccagggctacacctaatcctccacaccatcagcttcactgtagaactcctcctctgatgaatgattgcaaggtgagtatatgacatactcagcaagccacgcaacaaatatgcaagtgcacaggataacaaaggatggcatagtagggtttcatttgcataaacagcatttaataaacatttcagaatttaataaagcagttaataattaagcagtattaatccaacgctatacaacataccctgttctataggcccaaccattctgaacaaccatcccggctgcacagtcctatctccaaaccaggaatgtaccattccaaaccaggagctaaacaaattattaccatttaaagcatttgttatcatgatgagaggtgtgagactaatcacgaaaaacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccggcacttctcagtctggtgctctgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcattaagccatcattaaattatagtgattcataagttatcccaatagtgtgctaatgtttctaagcagagctaagcaattatatctaatatctagttgaaccaatatatatagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagagttgtttgggatctgtgtgacttgccttgctggccttggaattcttcaaattcttctcctgcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagatttaatcggattaaaacacttatattgattttaattgaattatgacgcaataatgaattatttttgaaaaggaaaaggaggattattgcgtcagcgggctagggtttcggtggaccgggcgcacggcggcggttcacgcgaacggacggccgagatcgacttgatccaaaacggacggccgagatcgatcggtccacgaccagctcacgggagagggcgacgatgacgtcagcggtgacgtcaccaccggcaacggcgactcggcggctcgggcgcgcatgctcgtcggcgaacggcgacgcttcggcacgaacggagggcaccaacgggtagagcgcgacgcggcgaactcaccggtgaccaaaggagcggcagaagaccaacagacggcgacggcgacgaggttaaaacggcggcggtcttccgcttgacgacggcgacggtgcttcggcggtctacagcgacggcgaaggggcggacgaggacggcgacgacttggcgaccacgacgacggtcttcccgagcgacggcgacgtctggaacggcggcggcgcacggctggagcgacggcggcgacggcggtgctagggcacacggcgctagggcgtttccgacgacgagaggcaaaggcgagggtggcggcgggtagaggagagctcgggggtccttttaaaggggctcggaggcggcggcaaaggcccacggcggccggcgacgagaaggaaagttcgggaaaatcgaatccgaaacaaactcgaatccacgaatttccaaacgattttagccggtgtttccaaaggagaaaaggtagaggagatcccggagattgattcccctctatcaattcggccggaaacggaaaggagcggccggatttggaaggaaacggcggcggcgacgcgctagggtttcgggcggcggcggcgcgaggtaaacgatgggtccgacaggtgggacccacctgtcagcgagcaaaggcgcgcgcgcgcggcggcggactgggccggattgggccgaggagagagagaagggaggttttgggccgactttcggcccaaagccaaaagaagacttttaaaacctttttccatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaaaaattccatttaaacaacaatttatatattttgaattttcagggtgtgacaggggcggacgaggacggcgacgacttggcgaccacgatggcgacctccccgagcgacgacgatgaccggaacggcggtggcgcacggctggagcgacggcgacgacggcggctcaaggttgcacggcgctagggcgcttccgacggcgagagacgaaagcaagggtggcggcgggtcgaggagacaccgggggtccttttataggggcaaggaggcggcggcgaaggcccacggcgaccggcgacgagaaggaaagttagggctcggagagagagagaccgatccgactcgacctcgaaaccaacactttccaaacgattttagccggggattccagaagagaaaaggtagacgagatcccgaagatcatttcccctctattgatttcaccggaaacggaaagacgcggccgaatttggaaggagacggcggcgctagggtttcggacggcggcggccagaggtagacgacgggcctgacaggtgggccccacctgtcagcggcagcgagcgcgcgcgagggcagctgcggctggacttgggccgacttgggccgagaaggagagagagcggttttgggccgactttcggcccaaagccaaaagagacttttaaaatcctttttcaatttaaattattcatgaaatgcaattccatttattaaaaatacttccttagctcaaataaatcccagaaaaatctaggaattatagaattaagcaaagtatttaatgaaattttatctggtcccattttatattggaatttattaattaaaattagatcttctcttctagacttttaaaataaattctaataattccaattaaacgacaatttatatattttggatttttagggtgtgacagtacagttgtacacctctgatcagagtaaaactattcgaatagccgtgcccgcggttatgggcggtcaaccagattcaccgtgattattctcacccaagtctagtctaatggaattgaatagtctaggtggatggttgggcctgttgcaacgtggggtagcgttggacagtgggtggttaatattgattaattattacaactgttttactgctttcaactactatttataaatgctcgctctatgcaaacgaacctctatagctatcccttgttaattccctgcatcatacccctattccggtatgacttgctgagtacagtgggtagtactcagtcttgctctattttccccaaacctcagagtttgagtatgcatcagatggtggcttctccgaggagtaggtttcgtccgtgccgtcgaggatgcctgtggagtggtgttcccgctgcagtccaagtcaaggcttagctccagttatcttttaattttccgctgcatttatgtaagattttatgatgtttgtaagacgtggatctgtttgtcaactttgtcgtttgtgtacccggccggtcctggacgggggttttaatgcacattctgcttggaatcctattcgggaatttctgggcgtgacactcggcaatcaggggtggcttctcgaagcaccaggagggcatcggaaggagggtattagctaagtgtcacatcctgatttttgtttcaggatttataaattatttaataaattattattagaatttatattaaatgttcattaatttacaagtgaagttaaatgtgggaaataaaattttcttaatataaagcatggatggatttaatttttattaaattctccatgattaattatactctctggaattttctcggatttttcggagctcaattcctaaatgatacaaagaacaattcagtaattatttgatcaataatgatctaattataattgttaagtgcttttcttgtttaaaatccttaaattataaattgttgtttaaaagaaattagcagaaatgattttaaaagcttaaaagagaagatctaattttaatttgctaaatctcaatataaaattgggctagataaaattttattaaatattttgcttgttcctctattttctagaattttctgaattgtttgagcaagggaagtatttttttaataattgaaacaacatttcaccatttattttaattaaaaagttccaaaacccctccttttaagttgttgggccgtttttggcccaactctctctctctctctctcccgcccgcggccgagccggcccagccgactcagccggcccagccaagccggcagccgccccctcctcctctagccaccgacatgtggggcccacatgtcggggtcatcccctacctccggccgactcaggccgagcccaagccggccgcgccgcgccacctcccgtctccgattccgccgccctcgctcgcatttgagtccgagtgtttgagggattttgatcccctcgtcctcctctatctttacccccaaaaatcggagctaatcgttgagtattttatccgaatcgaactcgtttttgagtttatctccaaaaccgagtttttgatttcccgatcgatttcttgcgggaggagtccgatctcttcaatccaaggctataaataggaccccctagtcctcctcttttgtttgccccctttcccgagctctctagtgccccgtggagtcaccgccgcgccgccctagtcgccgtcgtcgccggtcgccgctcagccgtgccgcgccgccgcttgcgtcgtcgccgccgccttttctcaccgccgttaggtgcgcgtgagggagagctagctcgtccgccccctctccgctgtcgtcggtcgccgtgaagccgccgccaccgtcgactgaaccaccgcgccgcatcctctcgtcgccggccaccatcggtcgtcgttgggcgcattggtgagtaccgttgcgttcgtcttgttgccctctacgcgttggtgccctcttttcgcccggccaaggtccgtagcgccggtggtcgtgccgcccgagccaaggccaccatggatgacgtcagcatgacgtcataacctttcctttttagttttttttatagatgaaatagattagatcttcagaaaaacatatctaaataaccgtagatccgtttcaggtggttcaagttgctaaatttttctaaaatcaagatcttcatgttaaaaatattgacgtgtactgtttatgcttgtttttgtactgttttgttaatttttgttctttcgctttattttccgacgttccggaggagagcgttttcgttgaggaaggttcggaagtgtttgcggaagcccaaggcaagtcacacagatcccaaataaccctttgagcatgttgaacccgtttaaagctattattttatttcaactatgcattatttttgaatgtcatcgggtggtgaacctttccccgttaattaatggccgaagatgatcttattttccaatgggttataatttgattagcatgaaccttatatattggattggttcagctaaatgctatatgtaagtttgcttagctatgcttagaaacattagctaactaaaggggttaattataaactatattatattatattattattatggttatatttaatggtcgctcacgatggttaatcgtgtgatgttaattaattgataattataacctggctaaggtgggttgtgagcatatggttttgatggttgtgctcatgacaattaaggaccggttcgcgagctactgttgtgaaacatttaccgtgccaaccacaaggcagcatgggcaacggctttaccttttgtatagcatggttcattatagtgtgccagactgtgaagtggcgagaagtccgtgggggtcgctggggagtccattgcctctggttttgagggggagattatgatccaggaacggtgcactgttttgagttgtgttgtgcaaagggtattgtcacgatttccccctttgcaatgccgtggtggtatttccgggcatggcaacatgtgtggaatcgtgtcttgtgggtacagtggtacacctctggccagagtaaaactattcgaatagccgtgcccgcggttatgggcgagttgagcaatgtttttcgtgattagtttcacactactcatcaatgttaataatgtgagaattaatttgactcctggtttggaatggataattcctagtttggaggtttgatctgtacgaccggggttggttgttcaggtttggttgggcctgagcagcatgggtgtgctgttcagtgttgattaaaattgatgattaattactctattgttttactactcttaaatctttgctaaatgctgcttttgcaaatgagcctatattatgccatcctttggaatccttgtgcacttgcatatttgctgtgtggcttgttgagtatgtcatatgctcattcttgcaataatcatcaaacctcagttgaagataaaggatccagaaggaaaagacgtttggcttataccccagttgagctgcctgtgggagtggagctgaagccatcgctagaccgttaattcctctgctgtttttcttttctttgtaagtatgtaacgttattattaagatggatttgtatattaaattgtcagtttgtgtacctcggctgattcctggacgaggattttatgcacaaattagttcggaaattactagtgaatttccgggcatgacactaagtaatcatataagtaggatgtatgtatactagaagtataggaataggatctttctattttcctttccacttagcttagatagttatgaataagagtataaatactttttcttagtgtcactctaccctttgaatgatattaacccctgcctagactttggttattacaagtaatatataattattagtgtggttctctctattataatcttcccacgggattactcaaatatgattcccttggaatactcttgggtgaaaagctacaatggtatttccatgcacttgcggatgaactctgtaaccataatataccagaagtatttctcaaccattgctaggaattatatttcgagtaatataccagaagcatttctggcgccgttgccgtggaagattcataaaaaagattactataactaatactttatatttacctctgtataatcactgtcctttgtaggctaaccttggttgttttcacttctattgtggaaatagggtagtgcatgactggttttaacttgccggaaaatttcaaggaaaatccagaagttttctttcagagcttcaagccgcgagtcgttgctccgcagaaaactcttccgatagagaaaccagccattcccacgccaccaacctttaagactatggctgacaagaccctccgcgaattcactgctccctctgctgacaacgtggcca

SEQ ID NO: 72085 - DNA, 4633 bp, Oryza sativa
ttggggacaatgtcaaattggcgtacttcatccaagaaaagaaaggcttcactaatcagcccttctttcatgaagccgtcaactagaatagtgcatgtaatgatattggggtttatcttgttgtcaagcattagttcaaataaccccaatgcttctttaaggtatctatgtctacaaaatgcatatataagactagtgtaattgtaaacatctggaacaaaattatggttaaccatgtcaatccaaagaccataggcaacctctatatccatatgtcggcaacaaccatgaagaacaatgctgtaagtaatttggtcatgcttgaaaccttgatatttgagacgttcgaaaagttcaagggcctcctcaacttttccagctttgcaaagaccatgcagaagtgaactgtaaatgacaagagtaggactgactctgtttctttccatttcatcaagcaaattagagcctaatgatagagcaccttgtttgcaaagcgcatcaactaatatgctgtagctatggacatctgggacaaccccacctttcttcatctcatcaaatacctccatggctttgtgaacctgattatcgttacagaaaccatgaatcactgcattaaaacaatagctgttgcaagggtagcctctctgccgaagcacttgaagaaagtcccatgcagattcgacttgtttggcacggcaaagtccataaaggtaggttccgtaggttgccgcagtcggcttcacgcctctgattttcatttcacaaagaagatcaaaagcttcctccaaacatggtttatcaccatgtgtatacatactcatcaaaactgaataagagtagacatttggtgagggaccagtgctcttcatatcatcaaacaaactcctcgcatacatgaactgattcctcttgactaaggacttcagcaagaagttgcaaagctgaagctcaactccaatcttcttggcctcgatgtaggtgacaagagcatcctcaaacattgacaactctataaaaacccgtatgagcgcagcataaacttgaagcaatgttatcgatccacccaaattgttcaccagcataagtgccaactcaaacaactccggaccagcatttccacagtaattgacaatgctctgaatcaagcaccggacctctatgactctccgaggcaagaatgactgtataagcaatgcaaacaacccaattgactgggaaaggccatataacctctcacactccctgaagcttatctttcttgcgccgtcccagtttgaagtccgcactgctagtgtgatcaagggaagaaggcactgacgtctataatcaccagaaatggtactctgagtgggctcttgatgatccaggttgttcaagcaacaagccagtgaagtaaatcgcgacgcctgtgggtggtttctggttatgagggctcgacgcaggaaccctggcactgccctgtgcatagacaagggacgcccaatcccctccttacattgacaggatatgagcaggaagaagatcctacacagaaattacacttcatggaccaggcctccgagaaagaattcgcccaggtttacaaatttgaatcaaatctcctgcaaagagaacaaaaacacaaaatcatatcgctataacaataccagtcaagctctcacttgaagcaaagaaataatttaaaaaaagaaataataaaatttgtgtgttccagagaatcccctggtcagtgagctcccgcgaacgagagcccggtcatcgctcaccgacgaagcagccgtccactctccgagtctccgggcgcgagctggatgagaggggcagggggtgggcgggcacagcggcgaggccatggggagcttaccgggagggacgacactgaggtgagctggaggaggagcacgccgaggaagtggcggaccgcagtccgtcccacgggagcagcgctagggtgaggcggcggcggaagggctcgccggcggtgggcggagggatccacggcggcggcggcggcggggaggcggggaagagcgagaggcgatggccgtgcagctcctggggtttaaggatgtggttgggccgtatctgctttccatgggtgggccggattgcgcggctcagaagatcggatgggctcctcttcgggtgtactgagttagtgggcctcaaatatgggcttcggtttacggaacatccagcccataccgtcgtgcggcccgtccgaccgtaccaaagctcatcagttcaagtagggtaggctgagtgggaaaagctaacgcgcgtgcccgttggcggttgagcgttccggatagtttagcctaactaactaagttattagtagataatgacgataattaagatacgatttcctttttcccggaagattttttctactacctgactgaaaactttcaagttagatttgaaaatttttgaagccaaattttaaaaactttcaaaactcaatttgaaaatttttaactcgaaatttaaatgtgtaagacaaattttgaaaactttcaactcagatttaaaaactttcaactcatatttgaaaactttcaactcgagatttgaaaactttcaagtacagatttgaaaatttttaagttaagatttgaaaaaatatgaaagctttcgactcagatttaaaaactttcaacttgatatttgaaaactttcgactccgattcaaaaactttcgatccagattcgaaaactttcaactcgagatttgaatactttcaaatcagatttaaaaattttcaagttaagatttaaaaactttcaaatcaaaacatttaaaaaaataagtgtgctaaagattaaaaaaagtaatcagaaaaaacgggaaaaaaagcgaaaaaaaatcgcaaaagaaaaaggaaaaataaatcacgaaaaaagaacaaataggctaatgggccttgggctgggagtagctggcgcgcgcgcgagactagcaacccccaggttgagtctcacttttccaacccacctatcttttttttcacgccaaactgctgaatggtgtgttttttataaaaagtttctacacaaaaattgttttaaaaaaatcatattaatctattttttcgaaaaaaagataatacttaaataagtatcacatatataaaatacagtatgagtattacacattggtagtttggtaaaggtagtacaaaatttaaaattatgttgtcattttaatatattttaataataaattgagaaaaaaaacatatatatactattatacgagagaaaatataataatactagctgcgcaatctgcacgggccaccatgctagttaattaattaatcaattaactagtcttgatttttgatcttgcaggcattcacgtcccattgacgggattggagtttgggacgttgcagtctacagataaaaatgctaaaagcgatgttgcaaaacaaaaaagaaaagacagagaaacgatgaatgagatgtttaatcgtgcgctaatgagttacttcggtttacttgcgtgagatgttagatcctactccctttctaggttaggtttttttggatttgggacggagggaatacatcctagccaagtttgtcaggccattttagattaatgccaaaacatactctaccaatatttaaatagttttctagatatattttggtatttggaatagtgcatacggtggtttatatcattggcattaccaatgtccaatttaaaatttctagattccactcaaagctttgctctaagttgacattaaaaaggcaactctacctcagaaaaaaaaattggtggtaccaaaatttatctaagttttggcactagcagggtatacaaactagctcgtcatttgtcaacattgacaatctttcaaataaaatcttagtgccctataaaaaataatcttagggagaagaaaatggagaatttaaaacatttagtatatacgcctaactgcaagtccaaatatactttctctagtcaacattactcgtcgtttccgagaagcaatttgcactgagtgtagtttaattgagttgtctgaaacgacgtatatttctgtccagagggagtatatatttatggcaaaatttgctacgggactcttaaaaaacgtgtaattagctgtgggacaccgtaaaaacgtgaattggctatagaacaccgcaaaaaagtgataattagctactagacaccggaggtattattttattatttcctataaaaacggagagagagagtgttgaaagtaccaaaatacccctgtgtcgttttgcttgttctggagtcccactgatgccgctgccccatgccagcgagctgccacgccatgaccggactaaacaaggagagaaagagataagaaatagaagaagaagacaagagaaaaaaaaaaggaagagcaacctgtagccatcgcgtggccgccggcgaacagcacgccgtgccgtgccacgccaccacggcatacggctgccgccgggcagcccacaccgagaccgcggcgctcacacgcgcgccttggcacgcactaccgtcgctcacgccgtgcctctgccctcgtcgtcgcacggtcatgccggcgccgtccgaccattcctcattgctccaccgccgcacatggca

SEQ ID NO: 72086 - DNA, 928 bp, Oryza sativa
taatgttgcagcaaactgataattttgtcactaaagttgcagttttctaaaatttactcttaaaaatatgttttaggatatggtatgaccactatctatctgaatccaatccgtttttaccccagagttagacattattactttaatacttttaaacttttttttttgtttaactgatttgtattacctctctgttgtcaaatatatgtcgtcatgtattatcaaaatctttagatgattaatgaatgcaaaaaataataggatttaacacaataaaagactattagtagtagaatagtcatgaaaacacttttatatatgaattttaatacttttttaaacatataattagaaaaagtagtgatcagttttgtgcattgaaaactgtgttgtccaaaacgacaagtaaaaaggaacaaaggtggtactaattacttcctctagccattctaaaatataaggattgtttctagttgtttagcagtagtttaatcacttcaattgtcaatttttgaattttgaattgtttagattacctttccaagtatccgactgggctttggaattcatgatgatgggaaccatatgagttattagtgtagtactccttccgcctcataatataagggattttagagggatacgatatttttctagtactacgaatctggacaggcctattcagactcgaagtgcttgaaaaatatcacatccctctaaaatctcttatattatgggatggagggagtaatgtttatattgtgttatgaatttgaatcaaagaaaccttatattttgaaacgaatggaatataaagctatgtcatttaactggctagtcaacaagtggattggtaactctagtccacaagcgttttgccttttacagaatccatgagtgacctgaggcttctaaatggtccaaatgg

SEQ ID NO: 72087 - DNA, 3071 bp, Oryza sativa
gcacagtacaaaatcgccctcccccagggcggcaagggggccgcctgcaaatttccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgagagggcgattgggcggtaggcgactacttccgtcaattttcaaaatggaaaattatttttgtaaaacttttaataaaaaaaattataaataaaaaaaattcggtggttttcggtcgctcgttttggtggcactgaccgtccgaaaggcacatttgggcctggtttagttcccaacttttttttaaaatttcaacttttccatcacatcagaactttcctacacacataaattttcaacttttttcttcaaatttttaattttagtcaaactttcaattttggcgtggaactaaacacacccttggctccagttaaacactgatgaactgtagaattactgttatctgaccgtaacctaacgtaaatgcagtctctacgctgatcaaatcctctgaaccaggtactaaaaaatgttgcatcatgtcttagttttgtttttttatgggatgagtagtgatccacaccaattattggaggggcctcttccagacttgtctttggaccaaacaacggacttgtctttggatataaacagccagccagttctcactgattgctggctgctgttgtaaccacaggaaaatttctctgaacttcctccgcaaaagaaaaagaaaaggtctgaactgctgaaagcttggcaggattcagatacggcaaacaggagtagcaggacgagaccaaccctgtcaattctctgttgctttccctgtttccatcttctgcatgggccaagaagacctcgagagtgaccagtagagtagtacagtgtagatgtgtgtgtgtgtgtgagtgacccaataattggaggaggctatctcaatcttgcgtgctctcccgaggcgagggaatcagagccattttgtctctggaagacaaggaaaatggccatcacgatcaatcaccagagtttgtaacgaatggctgcttgcttctcttgctcaagaatactccttttgttaaagggtagtggcatcgtattcctatcatgctatcatatgtactcctttttatcaaaaataaaaataacctagaagtgaatttgatactaactagtacaactaatcatgatatactcgttccgttccaaaaaatatgaatctagaactgatgtgatatattaggacgtggcacatccagtactatgttggttttttatgggacggagagaatactcctattcaaattcattgtatagtgtcaaatttactcataggttgtttgtttttgcgatggagggagtattggtttgactggatgggtcatggaaaactggaaaagcaacagcggtatgcatggcaaaagagggacaaaagaacaagacgaaacataggtaggattgcaggatgctcaagtgagaacttgtagttgtagatgaagtgaagtgacaagccgaagtcccgtgaacgaagcaacaaaaaattgtgggagttttccatttgttgtatgtgtattatttgcgatttgaaatccaggctgtgtttagttccttccaaagttagaagtttgggttgaaattgataccatgtgactgaaaagttgtgtgtgtatgacaggttgatgtgatggaaaaagtttgaagtttgaattcaaagtttggatctaaacacagccccaatgtttaaagagaactttaacgattaaatttggccacgaccggtaagccgataaacaaaagatgagaataaagtactgtatatacaacttccagcctcatcttttcacttatgcttatgtttatcaactaaaatttaaattttcaaccttaaatttagagttgattttagggttttttttatcgaagtttattttttagcctttacttttagatcgtaggaacacgtatatgaaaaaattatttttcatttgcaattataccgtttgtcttattccctatataagcgaaacgagggaccttccctgtcttgcttgtgatcatcagtcatctcatctatccgctggatgtgaagttacgacagaaatgatccatcgttcaacttgaattacacttgtactactagcggtgtacgctcgcatgtcagcgtaacgaaacgatgacatcgccatcacagtaggagtattggtactaatctggcaggaccgaagatagagatttagacggtgaccatagattttgtggcaagttttggctataataacatgtgaggttaagggttaatatgcttcaattttagcaatgaatcaaacatttgttatggatggtcgtaacttgtactcctaacctctttctatatttaatgaaaaggcgcactcttgtaccgttttccgtttaaaaaaacacttgtactcctaactcaagtgccgcaaacttcagcaagcagccaaacaagtgcaatactagtactccatgtcgaccaatttaagttaaaactttgaaagccaacatgatttattggtaatgttggactatctgcaattaccagaccgactcaatcccgaatccatatcaattttggttatgtataattcagaatttcaaatacaattcttcaaatccctcttttatctttttttttaaagacaacagaaatgttttacatccccggcctcttccataagacacataacctccctctttgttttgtaatgagagggattttatcctcattttgtactacgagaaaatagctctatactttcatacaagagtgtctggaacaccgaagaggaattcaagaatatgtaaggagttaattagtattacaagccaaagataatttttccctcgttgttttcagaagatggaagtagcaagtacataccagacgtgcactactggtgaacaacacaaatacacaaatggattagagaagaaaaatatctgacgcagactgtggtctg

SEQ ID NO: 72088 - DNA, 18138 bp, Oryza sativa
agtgggcatacccgtcggcagcataggagagagaaggacgtgaagcagactttgtggttggagagaaggcaacttgtgctgggcgggagcaagttggctggcagaggaggagaagggatggaggagtggagatgggctggaagtaggagaaaaagacgggccggaaatagcccaagaaagcgatggagagtttaatttgtcgttcaatttaaatttaattaatttcttaaatgaacattgtgatattaaaattatttcttgagctctgaaaattcacaggaaatttcaaatagtactttagggcatgcagaatattaaaaaaaatatttctagctaaaattttgaatgaaaattttattttccacattattttcacttttaattagctttaacttttaatataaattgtagaaatttattatttaatgatttttagtcctgaaagaaaattgaggcgtgacatgttttccatgcaattaaaaatctatcatgtgtacatgtggtatctctgactgtgtattccttgtaatcaaaaaaatatcaaagaacataacgaaggatcaatattaagtgcacatcatctattatggatggattagttcaaaggtgccaaaaggtagagcaacaaaattaaaccgcacgtacatgcagattagtcagaaatttatgaaaataccttcatgatttaattacagatatggtggccgagagtggatatttctgggtgcaaacgaatttgtggattcatggatcaaagccttgagcccttgaccaacacctgtacgtgcacaatttttatggccaaagagcaacattggttgtgcgtctatgtatggttatgatattaatctacggtcacgatattgtaatgcatctattcaatggccagatttttttttgttaacatttgagctcgtagaatgtatccaagtagtataggtctagatagacagacagacagatagatagaaagatgtaagatagatagatagatagaaaggtgtaagatagatagatagatagatacattgattgatggatggattgatttagcatttttgaaaccaaataaaatgtaatttaatagaaagaaagaaagaaagaaagaaagaaagaaagaaagatagatagatagatagatagatactccctctgttccagaatataacaagttttagggttggacacagttattaagaaagtaggtagaagtgggtgatggagggttgtgattggatgagtagtggaagtaggtgggaaaagtgaatggtggagggctgtgattggttgggaagagaatgttggtagagaagttgttatattttaggacaaatccttaaggctaaaaattgttatattttgaaatggagggagtagatagatagatagatagatagatagattgattgatttatggatttatggacggattgatttagcatatttgataccaaataaaatgtaatttattattcgagaatagaacaatcaggatgaaaattttcaaaaccgatggatagaagtgatattaatcaattgtacacattatgatatgacaacaaaaatattgaagcagtaattcactatcataaaacaaacaattaatcataacaatttggaaaacctatgtttagaagtggctttaatataagataacttaaggataaggataaaacataccagaaaatcctcagcttacaaaagtaattaagtcaacattaatttcttccatatataacacctatctttggtctatatatatgaaccatggatcctgaagttcacactcatcaacattcaactcaatagtcacaataagacacaaaacaaaacatagtagctcactcttcacaatatgaagcacgcccaccttggactcatgttgttctgcttggttcttctagttttctttgctatccctgcacaaatacgaggcaattatttttttttgaatttgtatgttttttcatcattttctttgcactggcaagataataaacatatgactccttatgtctctaggtcaaagcacaagcagggccccggtgggagttagcattggagaacttaaacttagtgtttgcttttcggcccctccatcgtggtcttgctgttcaaaggacaacctgtgctatccatcacttgaggcatgcctggaaaagtgcaagtacgatgaataggcacgcagccgactcagaggctaagtgctccgatgtgtgattgaattggacacaatatttactaataatcatatatccggtatatttgggaataacatatgtatatgttccaacagatatgcattttctaaatccatattgaagcatatgagatgcgtggtgcttatgtttaggagttgttttcataatcaacaaaatataattccatattttcaatgctagaataaatattgggccaaaagaaaaccaagaatctcatttcataaatttcgttatcgcacataaagacccaataaattgagtctatgaaaaagagttgagcatgctagtgggcgtagttgctatagcgacactagacgtgcatggttgcgcttcccatgcaggttttggttttgcttcacgtggcatctttagcctcccgttcaaagatctctacatatcagaactttcagttttcctgaacttccatctccaaaatcacaaaactttctcttcaaacatatgaaaacattcatctgaaaatcacattactttccaaccgtatctaaaacttttatctaacaaatcataacaactttcaattcaactataaaactgtcatctcgaaattgcacaaactaatgattcaaattaaaaacttctaggcaaacttcataaaattttcaattgaaaaatccaaaaattttcatgctgtactcaaaatccctcttcctcctcaacgatcgtcatccttgtaataacgaccgcaattatgaccaagttgttcattcctgctattgccgctcctgcacggtgtgtggcagcagtggcgagggtggtgtctccatgtggcggctagcaactacaatgctgcccctggtggctagagttgaggagctatggcatgggtggtgcagcacaatatattaggcgaacttctccaatctgttgatatgtagatatggcacaaaatgttgaaggaacaacttcaacatgctagtagataatgccgtaagggcaattgtgaaagatctcgaatccacagacagcaagagcttagtccaaagctccaagaagatttaatccaagttgtgaaataggaacatccagttgtattggtaagttggtaaacggaagtaagctacaaacttgagggcatcgcctcaatttataggcttcaaaaccccatgtacaactcataaacaactatatgataactagatgacaacctatttgataagtaggatgttactcaaaacaatccatctattactcaatgacaccaagaacacaactcaaaggacatatatcttctagttctagcagtataaggacatatgcaatgacatcgtaattattgttaagccttcatgaagcatgtactatagatgcaaaactcaaattgccttcttgttcttagtcaaaaatcatattttgctcgtaacacttatactttttgaattggtcgtctaatgtccctcatcaatgggggtacgatatggccaaaggagttgacccagggatgaagcgcggctgggaacgtggacaaggatcatggcctgacacaagcgcagattgaagggcaacgacgagcagctctactgatgctgtcgattggaaacattgaagagagaaggaaagcagcgaacgaaggaataagaagagggatcatactcctctgccccccaccccgatgggctagatgggctctaaacatgcacctgtggtgcagctgtgccaaataggaatcttgcaatacatatactgcaaatcacattttaccacgaaagattttgctggtatcaatgtgtgccaccaacatattccagcactatgactgtccacatggcatgttgaacagtggggatagtcgtcaggcactacaagagatcttatgataggtgacattttatttatgtcataataacaaagagttatgtcatgttttgaaacctgtgactctcatgtgatgaaaatccgttcgtcacagatcatgcgtctcgaatcaggctctacgacgaaacatacttttttgtcattaatctagtgatgattcttctctcgtcattaactctgcattatcttgcaaaaaaaacacaaaatctcttgtgcctaccaaggtccatgtagtatgcaacatgtttatgggcctcagcccaattgcaagcccaattagattttgggcctaacctatataaaaagaagtattttattcactattttcatcccaattatattttatccaattttttttgtgtgaaataacaaatggttgaaccccatttcaaaagcccatataggcccaagcttatacaagcccagataacatccaatagcataaatccaatatacaatatggcacaagcccaacatcccatataactcaagctcaatgatatacgcacaaattcatagtctagaccttagtaaccacaacaggcttacttacatcagttaaacaaacaagtgtagtacatcttgaccaaattcagccacaaatcgaagagcaaacaaccacaagtctatttgaaaagataggtttagtcaatgagcaaacaaccacaacagcaccaccatatcctagatagcaaactaaagacatcactgaccatatctacaaagtcgagccacaagtaactgaccaaaacaaactcagatgtccaaaagttcacattcgctgaccatatcaaagttacatctccaagtgacacttttggcagcagccatctcacattatgaattggtaaggcaacatgaagaaataggcaaaccttactaggggggtgggaggggagagggccaaaagatggggtattcagaccaatcaaacaacggagaagggaatcggtctcctctgatgacttcttcaaactttcaatctcttgcaacttcagctcccttgcttcttctgaatcagctacctttttctttaaggaatccaactcctcctgctgaccatcaagcgtacctctaagatttgatgcgtcttacatctctacctcaagttcagcttcaagctcttgaacccgtgcaacgacaacacctttgccgcttctctttggtgcggttgactcaaggtcaacattctgaagaaactttgattttggcattacttgggaaatgtcacactcagaaaattctcgaaccagaatttctaagctgaatgtgcattaaatccctgtccagaaccagccagggtagacaaatgacaattgttgacatacagacccacgtcttacaaaaatataaaagattacaaatgcagcaggaaagattaaagcgagctaaaccgggaagcttgacttcagcagcgggcgagtccactccacaggcaaaccttgacggcagcaacgaaaccaatctctctgagacggctccactgagaagaacttcaactctggtgtgggggaaaagagagcaagactgagtactacccactgtactcagcaagtcataccggaagaggaagtatgatgcaagatataaccaaaggaagctaggggttcttttgtataaagcaggcatttcaaagcagtagttgaaagcagtaaaacagctgtagtaattaatcaatattaaccaatcactgtccaacgttacaccaagttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagatacgattccacacatgtcgccatgccccgaagtatcaccatgatactgcaaagggggaaatcgtgacaagaccctccacataacactcccctaaccatccacaccacgctaaggtttcacccccacccctcaaaaggcagtgggcggtcccctcttgcgccgcggtgaatccggcagctggacaaccgaacacctcggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgtccagcaaaaccatgcactcacagcccgccattcagaattttttaatttactgacacccttgcggtggcaccaatctaaagctatgccaatagtcagagtatatgtaataatgtgacccccatttgtgtactagttgaactaagcatggctaagcatttcctaagccaacatctagtattttgatacccaagttatcaatggcataaggtaaccaatatgtggctaaggaacaggacccatcccacattacattgtaaaagaatacaacatttaatagaaaaatgcgggatattggtaaattgggtacaatatgatcaaacgtattgcatgacttgccttgctctcgaactgatgagacctcagcaacgtcttcgagaaaccgcggatcgacgaaacggccgaaacctacacgacaaacaaagcacacaggcaaaacatgctataagactactgaaacaggaaacaaaaccatttttaatggattctttgcatttttcttgatttactgagacttgaatggacttaaacggacctcggatgaattacttatgaattttagaagataaactgtgtttttactaataaagaaaaagtccttaataaattattgcgcaataatacccagggctgacgtcatccaaggggggggcggcgccgataggcggagcccatgggtcagcggctcaaaggggagaggaagggggcgccggcatgtgggccccacgggcagtggctcaaggtggccggtctaccgtggaccgagaccacgcgggtggtccaccgccggtccacaggaccgacggtccggatcggctgggaggccgatcggacggcacggcggcggctaggcatggctcggctcagcttcaaaactggccgaccggccatggcaaccggcggtgacgcgcacggtcgccggcgacggcaatcggcggcgcgggaaacgacggcggacggggtacaggacggcggcgtcgaccaaaggcaacggcgagcgcgtggagagaggcggcgcaaacgagagagaggggaagagggagaaggggggatcctcaccggcgagtatggcggccggagcggaggatgaaggtggcggcgacgacctggcgatgaggaggggcggacgggcggcggcggcacctacggagggagttgagaaggattaggagtagagagagtgaccacggcggccaccattgttggccgggagacgaaggagaatggatagctcaccggtgtgcgaggagaaccgggctccggtggggtttagcggaaaccgagcggcggccgaggtggctcacgcggcggcaatgctaatggcggcggcggcttggcgcggcggcggctctagcggcccggcgcgcgaccggaggtggcggcaagcggcggcgctagtggcgagcggcgcggcggcggtaggtggcacgggagagcgcggcgaaaagaggaaaagggagagggagatgcggggaagctttataggggctcgagaggggtggacatggccgggaaaccccccgatttggccggcgacgtgggggaagagagagagagtgggggggattcaaatcgaatcccgcccatttgcgggcgcgcgtgcgggcgggaatggcggggagggcggcgacgtggggacgcggagtaggggcgcggcgcggagcggagaaggcggcggcgcggacggtttcggcggcggttgccgtcgtggagcgggcggctggaggaaggggacgacttgacaggtgggccccacttgtcagcgtcccggagagaggggaaaggggaacgggccggcccaaaggaaggaggccgagcgcgggagggagtgggccgacggtccaatagggaaaaatgaaggaaaagaaaaagaaaaagaagaaaggatttttcctgggatttaaaattgcactttggtgatttttagttggttaaaattatttccaaggctctgaaaattccactaaaaatcttgttaatgcactggagcatggggaactcaagaaaaaattccaccacgctaattccgattattaattgcatttattaactagggatttagctctaggttaattaagataatttcttcgggcaatttatttaaccaatttttaaagcaagaaaagggggggggggaaacttcagggtgtgacaaacctaccccccttaaacggaatctcgacctcgagattcggaatggctggcgaagaggtgcgggtgggtggccttcaactcatcttctctttcccaagtggccacttcttctgagtgatgactccactgaaccttgcagaatctgattactttgtttctggtccttctctcgctggtttcgaggatacgagtcggcttctccacatacgtcagatcttcctgaatttcgatgtgatctggacttgcctgttcctcaggaactctcaaacatttcttcaacttagagacgtggaacacgttgtggatgccaagcatgttggagggaagctcaagctggtaagcagcttcacctctacgttccaagatcctgtatggtcccacaaagcgtggtgccaactttcctttggtttggaagtgatgtactcccctgagcggagtgacacggagatacacataatcccctgtttcgaaagcgagctcccttcggcggttgtctgcatagcttttctgccgagattgcgcgattctcaatctttccctgacagctctgactttctcttctgcctcatttaaaacttctgtaccaaacaactggcgttcccctgtctgatcccagaagagcggagtacgacaccttcgtctatacagtgcttcaaacggtgccatctgcagactagcttagtaactgttgttgtaagagaactcagcatacggcaagcttttgtcccatgctccaccaaagtcaagcgcacaggctctcaacatatcctctagtatttgattgactcgctcggtctggccatctgtttgtggatggtaagcagtgctgaaattcaaccgggttcccaattcttcttgtaatttctgccagaactttgaagtgaattggcttcctcaatcagacacgatcttcttaggtacatcatgtaaacacataattcttgccatatagagttctgctaatttcttccctgagtaggtagtgtgcaccggaatgaagtgagccactttggtgagtcggtcaacgactacccaaatagaatcatgccctgatgacgtcctgggcaaaccggtgatgaaatccattccgatttcttcccacttccattctggaatctgaagtggctgtagcaaacctgctggcctttggtgttctgcccttactcgttgacagacgtcacagagtgctacgaattcagctatctcccttctcatgttgacccaccagaacttttctttgaggtcttggtacatcttagtactaccgggatgaatggaatactgagtttgatgagcctcggttagtatcaagtcttttaattccttgttttcgggtacatacaatctttctcccatccagattgttccttattcatcctcaacaaaacctcgggcttttccaactctcatgttctttttgagctctgctatttcaggatcacttgcttgagctatgcgaacctgctccaccagtgtgggctgtgcctctagggcaaccacgaatccgtgctcaactataccaaggttcagatgttccaaatcgcgttgaacctcacaacatagttgctctacccatacaacattgcagtagctcttcctgctcaaggcatctgcaaccacattagccttgccgggatgataatgtattcccatatcataatccttgatcagctccaaccatcttcgctatctgagattcaaatcaggttgagtgaagatgtactttagacttttgtgatctgtatatacctcacaacggttaccgatcagatagtgccgccaaatctttaaagcatgaacaactgcggccaattccagatcatgcgtcgggtagttgccttcatgaggacgcaactgccgtgaagcataagaaaccactttgccatcctgcatcaacacacatcctagcccctggcgagatgcatcacaatagactggaaatctttcgtctgatcaggcaggattaagactggtgcagacaccaaccgtcgtttgagttcttcaaaactcctattgcattcagcagaccagataaacttttcttccttcttcaatagttgtgtcattggcttagcaattttagagaagttctcaatgaaccggcggtaatagccctcaagtcctaagaaactccaaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgcttttttaacttttcaagtaccagccggagatgctgctcatgttcttcctcggacttggagtagataagtatgtcatcgatgaaaaccatgacaaacttgtctagaaattccataaacaccttgttcatcaaattcatgaagaaggcaggtgcattagtgagtccgaaagacataactgtgcattcgaacaacccgtaccgagtggtgaatgttgtctgtggaatatcctcttcgcggatcctcaactagtgatagcctgatcgcaggtctatcttagagaacacagtagctcctttcaactgatcaaacagatcatcaatccttggcaaaggatacttgttcttgatggtgacctcattgagtgcgcggtagtcaacgcacatcctcttggttttgtctttcttctccacaaagataaccggagcaccccaaggcgacgtgctcgggcggatgtatcccttctgtaactgttcatcgacttgcttcttgacttccgccaactcgttggctcccattctgtaaggcctcttgtggattggagcagttccaggtaccaagtcaatccggaactcgatatccctttttggtggcattgttgtcagatcgtccggaaaaacctctggatactctctgactatgggaatatcctccagcttcttagtggttttctccactgctacctcttgttcttcaccagcagcctggtttaaactaatccctggcttctgcggcactggagactggaaggttaccacctcttcttttgcattggtcaacttgatggtgcggctggcgcaatcaatcactcctctgtgccttgtcaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctgttgctgactgcgcctcctctgcagatgcatgattgacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcactgttgttgtgactgccactatggtggttcttgttgaagcttcccgggtggtagggacggtgctgccggataatcatggtggaaggtccaccgtgacgtcccatcgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacagaaacttctcctgcctcccgtcatcggtacgcacgtcctcaggggcgtagcgtgcgaggcggttgaactcatgcaaatactctataactgttctggttccttgttgcagggaacggaactctctcttcttttgtgccacaattccctcgggaacctgtgctttattgaaactatgacaaaactctgtccaagtaacctctgccccagttggacgggtcaccatgtagttgtcccaccaaacagaagcaggaccttgcagctggtgtgtagcaaaagcaaccttctcttgctcgttgcattgcaaaagattcagcttcttctcaatggcatgaagctagtcgtgggcctcgatttggttggtggtgcttcagaaagtgggcggcttgacacaaagaaattctaacagtttggactgaggaggtggaggaccaaactgcaggttctgctgctgctgctgtgcttgctgctgcacctgctgcaacacctgatggtactgttgctgcatctgttacatcatcattgtcatcatctgagtctgattgtccaacacctgggcggtggggacggactgttgtcagatgcactgttggcacgtgctccattgatcggctcttcgctgccactggcgttgttggagtcgcgtgaaccattccttgtctccatctgaaggggataggtagaaatatgagaaaaggaagaaaaacagggggctcagaaactaatctttcttataaatttaagtgtaattatcttaatcttgattaaaacactgaaaaagaggcacgtaactcctaattgaggcagtcataccactgacatatgatatcgaccgccgactaatccacaagcaacaaacctaaacacgaaaactggcaagcaaacagactaagaaggtcggggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgatttttatgcatagaacaacatttttcacgaaccgagacaaaagacactaatgcaactgactaaacaataacttaatgcatgaaatagatgcatagtcatactgatacgcataaacttaccccaccgaacatagacacgacctaatgcatatcacccgacaattcccgaccgactgccgaataaattccgaataaacttttactaaatccctagactgtccctagtcgagaaatccaattaaataagcgaccaagatttttcccacaaatcaaaagaacaaaccccaaaattttcccgaaacaaaatccaagtgcaaaagggcatatgcatatgaaaaaaaagggttcagagggctcttaggtttctagttggcttgtcctacggtcaaggtcggctctgataccaacttgtcacactcagaaaattctcgaaccagaatttctaagctgaatgtgcattaaattcctgtctaggaccagccagggtacacaaacgacaattgttgacatacagacccacgtcttacaaaaatataaaagattacaaatgcagcgggaaagattaaagcgagctaaaccgggaagcttgacttcagcagcgggcgactccactccacaggcaaaccttgacggcagcaacgaagccaacctctctgagacggctccactgagaagaacttcaactctggtgtgggggaaaagagagcaagactgagtactacccactgtactcaacaagtcataccggaagaggaggtatgatgcaggatataaccaaaggaagctagggattcttttgcataaagcaggcatttcaaagcagtagttgaaagcagtaaaacagctgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataacactcccctaaccatccacaccacgctaaggtttcacccccacccctcaaaatgcagtgggcggtcccctcttgcgccgcggtgaatccggcagctggacaaccgaacacctcggccgacccaactccatcacgcccaccctcgccaccggtgcctaggaaagggtcgagctatactttagatcaagcagttacccactcccgcttgtggtaagcacagtaagtctcccagggtttcccgtgaaccggtccttaactgccatgggtgcgtccagcaaaaccatgcactcacagcttgccattcagaattttttaattaactgacacccttgcggtggcaccaatctaaagctatgccaatagtcagagtatatgtaataatgtgacccccatttgtgtactagttgaactaagcatggctaagcatttcctaagccaacatctagtcattttgatacccaagttatcaatggcataaggtaaccaatatgtggctaaggaacaggacccatcccacattacattgtaaaagaatacaacatttaatagaaaaatgcgggatattggtaaattgggtacaatatgatcaaacgtattgcatgacttgccttgctctcgaactgatgagacctcagcaacgtcttcgagaaaccgcggatcgacgaaacggccgaaacctacacgacaaacaaagcacacaggcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaaagtccttaataaattattgcgcaataatacccagggctgacgtcatccaaggggggggcggcgccgataggcggagcccatgggtcagcggctcaaaggggagaggaagggggcgccggcatgtgggccccacgggcagtggctcaaggtggccggtctaccgtggaccgagaccacgcgggtggtccaccgccggtccacaggaccgacggtccggatcggctgggaggccgatcggacggcacggcggcggctaggcatggctcggctcagcttcaaaaccggccgaccggccatggcaaccggcggtgacgcgcacggtcgccggcgacggcaattggcggcgcgggaaacgatggcggacggggtacaggacggcggcgtcgaccgaaggcaacggcgagcgcatggagagaggcggcgcaaacgagagataggggaagagggagaaggggggatcctcaccggcgagtatggcggccagagcggaggatgaaggtggcggcgacgacctggcgatgaggaggggcggacgggcggcggcggcacctacggagggagttgagaaggattaggagtagagagagtgaccacagcggccaccattgttggccggagacgaaggagaatggatagctcaccggtgtgcgaggagaaccgggctccggtggggtttagcggaaaccgagcggcggccgaggtggctcacgcagcggcaatgctaatggcggcggcggcttagcgcggcggcgactctagcggcgcggcgcgcgaccggaggtggtggcaagcggcggcgctagtggcgagcggcgcggcggcggtaggaggcacgggagagcgcggcgaaaagaggaaaacggagagggagatccggggaagctttataggggctcgagaggggcggacatggccgggaaaccccccgatttggccggcgacgtgggggaagagagagagagagtagggggggggattcaaatcgaatcccgcccatttgcgggcacgcatgctggcgggaatggcggggagggcggcgacgtggggacgcggagtaggggcgtggcgtggagcggagaaggcggcggcgcggacggtttcggcggcggttgccgtcgtggagcgggcggctagaggaaggggacgacctgacaggtgggccccacttgtcagcgtcccggagagaggggaaaggggaacggaccggcccaaaggaaggaggccaagcgcgggagggagtgggccgacggcccaatagagaaaaaagaaggaaaagaaaaagaaaaagaagaaaagatttttcctgggatttaaaattgcactttggtgatttttagttggttaaaattatttccaaggctctgaaaattccactaaaaatcttgttaatgcactggagcatggggaactcaagaaaaaattccaccacgctaattccgattattaattgcatttattaactagggatttagctctaggttaattaagataatttcttcgggcaatttatttaaccaatttttaaagcaagaaaagggggggggggaaacttcagggtgtgacaaacctaccccccttaaacggaatctcgacctcgagattcggaatggctggcgaagaggtgcgggtgggtggccttcaactcatcttctctttcccaagtggccacttcttctgagtgatgactccactgaaccttgcagaatctgattactttgtttctggtccttctctcgctggtttcgaggatacgagtcggcttctccacatacgtcagatcttcctgaatttcgatgtgatccggacttgcctgttcctcaggaactctcaaacatttcttcaacttagagacgtggaacacgttgtggatgccaagcatgttggagggaagctcaagctggtaagcagcttcacctctacgttccaagatcctgtatggtcccacaaagcgtggtgccaactttcctttggtttggaagtgatgtactcccctgagcggagtgacacggagatacacataatcccctgtttcgaaagcgagctcccttcggcggttgtctgcatagcttttctgccgagattgcgcgattctcaatctttccctgacagctctgactttctcttctgcctcatttaaaacttctgtaccaaacaactggcgttcccctgtctgatcccagaagagcggagtacgacaccttcgtctatacagtgcttcaaacggtgccatctgcagactagcttagtaactgttgttgtaagagaactcagcatacggcaagcttttgtcccatgctccaccaaagtcaagcgcacaggctctcaacatatcctctagtatttgattgactcgctcggtctggccatctgtttgtggatggtaagcagtgctgaaattcaaccgggttcccaattcttcttgtaatttctgccagaactttgaagtgaattggcttcctcaatcagacacgatcttcttaggtacatcatgtaaacacataattcttgccatatagagttctgctaatttcttccctgagtaggtagtgtgcaccggaatgaagtgagccactttggtgagtcggtcaacgactacccaaatagaatcatgccctgatgacgtcctgggcaaaccggtgatgaaatccattccgatttcttcccacttccattctggaatctgaagtggctgtagcaaacctgctggcctttggtgttctggccttactcgttgacagacgtcacagagtgctacgaattcagct

SEQ ID NO: 72089 - DNA, 18831 bp, Oryza sativa
cagggggaaaggctcagatgcaggcaatggcagcgggagtctctcgaggttatctggtttgggccgtgcagcaaggaggcaactagcagccatacttgatgagttctgggggcatctctttgattaccatgggaaactcactcaagaagctagctctaaaaggtttgacatcttgcttgggctagacgtaagaacacctagctcaactgtaagagcagacagtcaagctaatgaaatcccgaagagtcccatggtacgagacaatttacaagggtctgccttcttgggaagttcaagggatctgatgtctactaagaatgagatgtcgaatttggatctgacatatgggcttcagatgggcaataacattgggtcatcagcctggtctcagggcatgcagttaccaagtacccaactgcagagttcaagcaacagcttactcgatcaaggtgcaagattaaattcaaattttagcacgccatcatacgcagacaacaaccaattctaccaacctgcaacgattcatgggtatcagctcgcatcatacctaaaacagatgaatgctaatcgaaatccttactctagcatgccattggacccacagcgacttccaaaatcttctgcatcggctgtgccaacctatgtcgattctgtcatgcatgctcgtaaccagaacttgcttgcttcattgggagctactccttcacagatcgcagcaacatcccggataggtactatgatggcagaaagatcctattatgtcccttccactcttgacgggaatgaaaatgctggttcatcagcttactcaaagaagtaccacagctcaccagacatatctgcactgattgctgcaagcaggagtgctctgttgaatgaatcaaagttgggtggtggtaccattggatcccagtcgtaccttagcaggcttgcatcggaaagatctcagtatacaaactcggtggccaggcctgcagctcccttggcgtttgatgagctctctccacctaagctcccaggggatatcttctcaatgcaacaaagcccaaacccaagtgcaagatccctttgggctaagcaaccttttgagcagctgtttggtgtgtcgagtgcggagctcactaaaagcgagttcaaccctgcaggcagatcgggtggcatgaccaaggatgatttctcttacaaggagtctgaggcgaagcttcttcagtctcttagattctgcatctcgaagctcctgaagctagaaggatcagggtggctgttcaagcaaaatggtggcagcgacgaagatctgattgatcaagttgctgcggtagagaagctattgcaacaaggaaccagtgacaaccaactgctgcttggtgatactcagcaaccaccatgtgataaggcagacatccagtacatgcgcgtactgcctaactgcggagacgactgcatctggcgcgcctccctcgttgtcagcttcggtgtctggtgcatccgccgggtgctagacctgtctctggtggaaagcaggccagaactttggggcaagtatacctatgttctcaaccgtcttcaggtgagctatttcagtcctgaactagtctgaatttgagtgttgtttttcagtgcccaagacttgactgcaaacctgaaactgctcattttcaacgtacaagactaactctgtcaatcatttttttcgctcaaatgtaatgcagggcatcctggatcctgcattctccaagcctcggagtgctctcagcgcgtgtgcgtgccttcacagagatatccgggtgctcaacagcctgcgccacagtagcctggtagcaacaaactccattccaaggcaaatccgaggttccttcaccaccgcatctgtggtcctggagatgatcaaggatgtggagaccgcagtctcagggcgcaagggcaggagtggcaccgcagctggggatgtcgccttccccaaggggaaggagaacctggcctccgtgctgaagcgatacaagcggaggctctcgagcaagggacaacaataataaggcatctgggcagcgtgatcctgtcgcgttttagggggactttgaccattgttcttcaaggatggcagccagccatggtggcttgccctccctgagccctggattttttcgttgcacaacgtttgcagggacctgaggaattggccaacacttctggtcccttccatcatatttcgtttttttttgtttctttcttgtttttttttttttttttgcatgtgatgtgttgtataatggtaactgttcatgtgccagaagaacaaccaccaaaatgtacaacagatgtagtcagctgatgcaccattgtaaagtttagtctctgcattttaaccttttttttgggggtcattgacaaactgaatgaatgccctgtgtaatctctcttcagagaggatgccaagactgagaaaaagcttttgccagatttccagattccttgtgttcatctaatatctgtcatgtctctcacattttctccagcttatgatctttttgtctcgttggcatttgatagcgtgtgctggagatgtctaccgtatatgtggattactgtattaagcttctgggaccggtgtatatatataatttgtatggatagagataaagaaatactaactcgatatggattagttatatcctaatgtttctctaaacaccaggcgtagtggcactgtactgcaacctcacccaagaacatgtttttggggttcagacttgagagtatccattgctgaatttgcctcaccgcaagtttagtcttgcatttcacaaaattgcaaggatagctaacaattttatcacaaaaccataaactttgtggccgtgcaattggatatgctctctttgctcagaagcttttgaggatactgatcacctgttcagaaactgtgcctttggacttgatttgtaccgggaaacttgacaacccggccgacacagtattctcgattagatgttgggaaaacaagatagccaaaacaaatacggcacaaaaggcaaaggagacctctgggaatactaatcaggagagagaaacttaggtggtgtttgaatcttcctttaagatgaagattaagtgtttcacgtaaaacgaggtgataatattatgtgattaattaagttctaatcattacaaacttgaaaaatatattaatttgatattttagaacaacttttatatagaaagtgttcacatgaaactaccgtttagcagtttagaaaagcgtgccacgagtatccaaaagcttatcaattttgttggagaaaagaatagggttagtcttccaaggttcttttattcggcagagctcccgctgtcggttctttaaagaaaaactcgtagattaggccacccatcaaatataaatgtaatactccattacacaaatttaattttacataagggttcaaaattacattatagtttatttacactacgaattacatctgggtaaatttttagaaatttggaagcaaaaccgtgaacacgtcatcaaaaactggatgtgggctccacgagttcagaggatgttccgaacccgttttgatcgcccacggcccgccgccccgccgtggagccgatccccgccaccgccggcgagcagctgttccggacggcgtcctgctgctccctgcgccgcccccatcccctcggcctccgccgagctcgttcctgcgcggtgagcatccttgccgacgcaccagaaccctcttttttttctctctctctctcgttgtacccacacacctctactcgaatttgctctatcttctcttgtagatctgaaagctaggttttcttttttacttgtcttaacctttagttacataacaggttttttcccacatcaggtccacatcgatctataatagccaagagcccaagacctgcagggcttcccgggggtggtgcatcttctcaggcggaggggcctccttggattccttgaagtttatggcgccggcgaccaaactcatcaccgtgtgtgcaccggcaaatatgacgaacaggtccccctgtacatgtgcgcggtcaccttgagttggtcacccctgtcaaaacatagtaactttgtcaaaacctaacctaaacaaacatgtttttttcacaaaattcttcattcttacctcatgtctgattttaacaaatctagcctgtggtttgccttcagatgagcaatacgccatccatgcatacttcctgccgccctctcctgtttcctaatgcgctgctcaaggcgcctcatcataaccttttgcaccagaaaagcatcaaaatgttgcttgtcagcacaaaacaataaatccttctcaagtctcaacgagggggtaaaacttccagcatcacaggtagcttctccaggtcactcctctctcatccagttaggaatcgtggatgcaaatgcagaatcgatttcatccgtccccgaaaagaaatacaagggattttggcaatgcgaatgcagagccaaactccctcatatttggatttggggacagaggtagcagataggcaaggcaattagagcagtaattttaccctggtagctcttgtggagaaatagcggggctgggcgagtgcggaggaagcccatggtggggtggaggtggcggcggactgaacaagaaacaacaagttaggcgcatttaacggaggaatagtgcagtagcaataactaggaagcttgtgcaacaaaataagcaagcacacgcgacaacaaaatgatccaatccaattacttagaatcaactcaactcaatagtgcagtagtagcaaatcagaaaacaacttcaactcggactggcagctgctgacgcaggacgaggcgcgcggccacgtccgcgagtacgccgacaacgccgccctctgggaccacgacttcgccgcctcgctgctcaagctcagcaagctgcccatgccggtggggagcaagggggagatcaggaacaagtgcggcgccatcaaccacagcaagagctaattcggccacttatgcagggggttacgtacatgcatgcagacgatgtggtcgtagccatatgttttcttgttatatctcatcgttctaaaatacagaaaaccttgtactcgaaaaaaacatcatatagtactatcaaatcagtctagatttatactactagatagctagtgtctaatcgagtactaggagtatattttaaaacaagagtagtttgttattacttggtactagcacgtcagtgaatgtacgtgcacaagaaatcctcgtcgataatgaaaactagcatggtattggagaatccatctcttaaacccatcaagtcgaaatcctgaagcaccaaaatccccctacttgatacgcaactatcgacgtttgatgtcgcaattctggtatttgcatagtatggggatcgtcggtgctaggatatacgcgagactgaggtgaaagagacggagacaaggatttttatacaggttcgggcccctgagttgtcaggtaataaccctacatcctgttggccggagccggtattgcttttattcaccataatcacaccagtacaatatgtggggtagcctatttaactgttgtcgacatgtcggtctgaaggtctgactcgtagtcgacaacagggtagccttcctcctcgaatccgtgtccggcgagatcagagatagcgctttcgtctctcctgacggtatccggagacaccgtaggggaatagccatgcctatccctaaagtcgatatccggcggcttgtcttggcatatgttggcttgtatgttgtggcttctgttattccgtatattgtggtggttgttgattgaggtggtcgtctgtgtcgatcgtggtgactgtgttgatcctgtcatggtgggtgtcccactgtcctcctaggggggcttgtatttatacccataggtgtcccattgtccaagtagaactagggaaaccaatatggatacaatccgagtagtccttgtcgtttccatgtaaaactctggttgtctttccttatccggaactccctccataactgaagttagtttctgtataagacatggtatgtggtgggtcctgccgagatttagtcaactactattaggtatgtggtatccataaccctgacagtagcccccgacttcaatgcaaatgaacgaattcatattctcaaccgcagaccctggagtaactgttgtcgtgctcacgttaccgttctcggtgagtttagagataacgttagactttctttatcagcctcgtgcgggcaccaaaagggtttgtctaagtcaatctctgatgtcaaccaaggaagtacagagcgtacgactaagtctcccgtcttgctgtaatcgagaatttggattgaagtcaagaaattctatctcggctggtacaccatctcttcattccgtattccttgtcgagatccagcaaccgttctcgagcgatcgagaaggcgtagagtctgcgacggagccttgtcaacatttgtcgtactcgccatagtcgatcttggtgtagaaccatagagacatagagtcttcgtcaatgtcgaatagaattttcctgaaatcaatactcagaaaagaatattagatagaaatagcccccgagcgaatgcccaaagggtgataatgttataatatgtatggtaaattgaaaatgaattaaatttaccgaccaatgttttgtgtatgagcgtcttctctcttaccgacttcgatcagtcagtttgtagagtcatacactctccctagcccccagccttgtcatcggagaatcgttctcggaggataaggctcttggacccttgacctgccttggttgaacaaacactgatcctagcccccagccgtgaagttggaaagctcagtttccgattacacggcttggttaatacgcacggcgagaactcttacacgaccagatcttacatggtcttttgtctctacaggatccgacaaggccttatcggctctgggcgtccccagccgaagttcccttaggttcctcggaggccttgtcaagacggcgtaatgggacagtaggataggtttcaacgctaggtgtcgtcgtggtaagggatctctgggtaaaacacttggcgatattgtataccagctatcaactttgttgaaatagaggtagtaggagagtcgttacaccgctggtcgagaaccaggcagtagtcataactcgaccacttaaagtggaaatagtgggagaaacgctacatcgctggtcgagaaccaggcagtagtcgtatctcgaccacttaaagtggaaatagtgggagaaacgctacatcgctggtcgaggaccaggcagtagttgtaactcgaccaattaaagtggaagtagtgggagagacgctacagcgctggtcgaggaccaggcagtagtcgtaactcgaccacttaaagtggaaatagtgggagaaacgctacatcgctggtcgaggaccaggcagtagtcgtaactcgaccacttaaagtggaagtagtgggagaaacgctacatcgctggtcgaggaccaggcagtagtcgtcactcaaccacttaaagtggaagtggtgggagaaacgctacatcgctggtcgaggaccaggcagtagtcgtcactcgaccacttaaagtggaagtggtgggagaaacgctacatcgctggtcgaggaccaggcagtagtcgtaactcgaccactagaagcaaatgtacgagagattactacgatcaactggttgagaaccggtgagtaggtgtccctcgatcatttggagtcgtggtacgaggaccactacgctgccggtcgaagaccagtcgtagctgttcctcaaccatctgaagtcatggtgcgaggaccgctacgatgccgtagtcatacctcgaccatctgaagttaaggtgcgaaagattgctacgtactggtgcgagaaccagcgtgcgagcagaattatctctcgaacaccaatggaagttgcggtgtgagagattgctacgtattggtgcgagaaccagtgagcgagcagaattacctctcgaacaccaatggaagttgcggtgtgagagattgctacgtactggtgcgataaccagtgagcgagcaaaattatctctcgaacaccaatggaagctgcggtgtgagagattgctacgtactggtgcgagaaccagtgagcgagcagaattatctctcgaacaccagtggaagtgctagagttggtttattgcaagtgtatctcatgtggccagcatgactcacgtacccaacttatagcatatccggatgtccgttcgcaatcatgtcgggtgatcaagccgacgacgttcgcaaggaattatccgttaacaaccttttctcaagtagtccagccatggccggtgctatgagataggtcgtcggtctttgttggtaggttgggtgcgataactccgcatttgtcgagaatgttctcgataatggagtatattcgaccataacctactcgagtgctcaattgttcctgaaaaatattttctagaaggcaagatatatagcagataatatcgagtatgtactcaaagaactgcatggatcttctagtattatcaggatacaataagcagatgtaaatatcagggcattatgtaaaccgtaaacaagcatgatttatacataagagaacggagtgagcccccagcgttagaccgtagttggtctatcgtcggaagtactcgcacaacggatgttgtataagaaacatgctctaggtaaacataataaattgctgatatgataatgttgtatcatctgaataggtacgataaattgcatataaaatattacgtacctttgtagatacatgccggatgtatctacgaaattagtagatcaatttgaaaaaccaatctaccaattaccttattgcgtactcgttcgacatcatatgatctgacatcttttggtacggcgcggagcttgaggcttgggtgatctcgatagaccaagttgtcgatgacgatgatggttctgatcttgtcggaagacatgttccggtcgggttagatctccacagccgaagtcgtcgagtagtttgctattggagaatccatctcttaaacccatctcgtcgaaatcctgaagcaccaaaatccctctacctggcgcgccactgtcgacgtttgatgtcgcaattctggtatttgcatagtatggggatcatcggtgctagaatatacgcgagactgaggtgaaagagacggagacaaggatttttatacaggttcgggcccctgagttgtcaggtaataaccctacatcctgttggccggagccggtattgcttttattcaccataatcacaccagtacaatatgtggggtagcctatctaactgttgtcgacatgtcggtctgaaggtctgactcgtagtcgacaacagggtagccttcctcctcgaatctgtgtccggcgagatcagagatagcgctttcgtctctcctgacggtatccggagacaccgtaggggaatagccatgctatccctgaagtcgatatccggcggcttgtcttagcatgtgttggcttgtatgttgtggcttctgttgttccgtatattgtggtggttgttgattgaggtggtcgtctgtgtcgatcgtggtgactgtgttgatcctgtcatggtgggtgtccccctgtcctcctagggggcttgtatttatacccataggtgtcccattgtccaagtagaaatagggaaaccaatatggatacaatccgagtagtccttgtcgtttccatgtaaaacttttgttgtctttccttatccggaactctctccataactgaagtcagtttccgtataagacatggtatgtggtgggtcctgccgagatttagtcaactactattaggtatgtggtatccataaccctgacaatagtatgttttctcattatattattcaaatatattaaaatgacaacttaattttaaattttgcaataactttacaaaactactaatatgtaatatccatattgtattttatatacgtgttagttattaattatttttaatatcaaattttagttatttgtaaattatatatattgactcattttttaatatatttttttaattccgaattttctgtaaattgtatttctatatagactctatgctcttcttccaatattatttatttttatttcagaatttttattatttctaattgtatttctatgtggactctaaactaatttttaatttcgaatttcagttacttataaattgtattcctatattgactttaaactctttttcccatatttttcttaatttcgaattttagttatttgtaaattgtatttttaattatttttaatatcaaattttagttatttgtaaatatatatatatattgactcgtttttaatatttcttttttaatttccgaattttctgtaaattgtatttctatatagactctatgctcttcttccaatattatttatttttatttcagaatttttattatttctaattgtatttctatgtggactctaaactaatttttaattttgaatttcagttacttctaaattgtattcctatattgactttaaactcttcttcaaatgtttttcttaattttgaattttagttatttgtaaaatgtatttttatacggactctaaactctacttttaattttattatgtttattccaaattttagttagttttaaattcctatatggactctatactctacttctaatattccttattttttaattccaaatttctatttttttcttaattgtatttatatatagactctatactctacttctaatattccttatttttaattccaaatttctattatttactaattgtatttctatatagactatactctacttctaatatttcttatttttaattctgaatttcagttatttcctaattgtatttctatatggactctatactctacttctaatattccttatttttaattctgaattgctgctattccctaattgtatttctatatgtactctatactctagttctaatattcttatttttaattccgaatttcagttattttctaattgtatttctatatggactctagtctcctcttctaatattccttattttttaattccgaatttcaactatttttaaattgtatttctatatggactctgccttttctttttctccgattaatgtgagaatttctaggccatgaaagcgaacgtggagacttccttttctattcctttaataatataatagaagatataagtaacaaaaaaaatacaatttgacatgaattatatcaaaacaattagtatttgtgatcaaacgggcatgcatgtggggtcagcccaccctagcccatggcttgatgggtacatcctgattattatgcactgctcgacaaggatatgccgtggcggctcacgtggtaaggccagaaccaagatatggccgaagaggagccaggacgtgcacgtgtgacccatgaaatatttttttcatgaaattgcacgttagtatattagaaaaaaaatagagttttagttatacagcgtaatcgaccaaactggtcgctgtcggttacaaggaaaaagattgcggaagggaaaagagtcaaaactagaagttgttgctcgtatctagcggcactactacgaaaaccatctttcgttgcggccattttgggttttcgctggtggtttttggtaccgtcacaaagcaaaggccagtgaagatcaagatcttcgctagcggttatcggccgccagtgataattgatttttgctggcggttgtgttatactggccgccagcgataaacgattttcgctggcggttgagttataccaaccgcctgtgaaaatagtggcccaggttaaaaaaaaatgacaaagcaacactgctccgttcgcctccgtcaacaccggttcaaattattcccaaatccactcctcgattcacaaattcacataaatttacacgaacaatttataataaaaaatttccattcacagtcaaaattttccattcacaatccacagaaatccacaaaaatgcacacaaatccacacaaatctacagaaatctgagcaccaccgcccgtgacctggcggcgtcggcttcacgctccccacggcgcagcgtcgatcgtgacgaggtcaaggccgacggtcgtgctccaccgcccgaggccccgcggccgtgcgccccgcgccgccgccggggcggatctgtccttcccggcggcagcctcctcccctcggacagatctaggagagggtagaggaggggatgggagggcgcggcgccaccgcttccttcgtggtcatcatcgtcaccgcttccgtcgtagtcgctgttgtcgccgtgcacatccgcgccgcgcccctcccgcccgtcgtcggcgccgcgcccctcccagatctcggtcgtcgacaagaggtggaagctggaggagcagggaaggaggaggggagagaggtgggggaggaggaggagagggaggtggatgggtgggtggagaggaggagatagaggagagagaggcagtgggtgggtgaaaggaaaatatctcagcacgcgcgtgattttaaatgatgccaaatttttttagcgggctctgttttttcgctagcggaagtgtttagtaaccactagcgaaaaccgacgcgaaaacgtcggttttcgctggcggacatttaagagatccaccacgaaaaatagagtatgttttatggcggacgtcttaacgtggccaccagagaaaatcggttttcgctggcagtcctataccccccacccctcatgtttttgctggcgattttagcatataaccgccagtgaaaattatagtgtgacgccatgaaaaattgtttttctagtagtgcgggagggggtggcggaggagcctcctaatctcccaaaaggctcccaaacgagacaggaccagcgagagaccagagacgaacctcctagtgaatgtattggaaaaccatcgagaccggcgaaagagaaagaatcgaaaaccctagcgttccgctctttccaaagctgtaggaaaccaagaggaccagagagtcgaaggccttacgaagatgctaaggcaggcaagccctatctaccggccaccagacctgaagagaatcgctacggaggggccgagcaagcctaggcaagccaaagggagaccggatgtagtgccaaacttaacgagcgaacacacagtcgagcatgatgtggctcgctatttcatgcttctgagcgcaaaatgggcaggtcgagcgtctgtcaatgccgtgcttatgcagatgatctgccgcctagcaacgctgttggaacacgtgacccatgacatttgaaatcgaagttgggaaaaccaaaaataggaagaataagaagaataggaacaggaaaaaaaagaaagaaaataaaagatggcaaggaaaaataaggaagaaataggaagaacatgagaaaaattaggataatcattgtgaaaaaaatagatggccaacggattaggatccgctgacatgaagtcagagggacgtggtgactgatatgtgggcccaaccgctcgcgagcccacctgtcagtgaccacgtcaagggagatttcacgtcagaggatcttcttctgtggccgaccgggcggagcttgttcttggtccttgctgtgccaggtctggccatgcacgacatggccaaatgggacgtgtggaagaaatatgtgcatgcacatgatgaaacatgaatgtgtggaataaatactatgtcgttttgactgtttgttgacttttggacgagcttttcggcacctatatgaagttatgaacaatgaaacatgcagatctatagagatactagtgcatagcgtttattggatggtaattcgttgtcctaaaaataaaatggaactataccagtccaggcgaccaaacaacagtttttttacaagtgtttctgggcagtcgttcggcagtgtgacaacaatgacgaagagttgacagtcggcaatgtggcaattaacgagcaacaatctgaggcactccctccatcctaaagaaaatcaaatcatactaaaggggccgaatggcctgggccgcctatttgccaatcaaagtacacccaaggtccctcaacttgtcatcgagttacaaaatcatcccccaatcgcaaaaccaaatatatgacatccctcaacttataaaaaccattcactttaggtcattcggtggttttgaccctggttttatcctacatgagcagagtcagtgtgggacccacatgagcccacatgtcaggatgccacgtccgcaccctctctcttccccctcctctcccttcctcctctctctctctctcttactcttctcttctcttctctgggcaaaccggccagtggctgaggaggaggccgccagggcgaggcgcaagaggaggaggcgacggcggctgcgacgcgggagaaggcgagggtggcggacggtcgcgaatggcattgacggtgctgcgtcgcctccgccccgtgcgggcaggcgccgcggcattgggcacagaggcggagacagggccgggtgccgtggaggtggactcggcggacttggagccccggcctgctcttgcgccgcatcctccctctctccgtgtgctggctgtccctccctacctcctccctattcgcgtgcgctcgccgccggccggcgggcatgggagcaagcgagccgtccgtggcgtcggcagcaatggtggtgcgatgcatgaggatggggaggaccagcgtcatcgtcacgtcacgtcctcgtcggcgcgaagatgaaggagacggggaagaggaagaggtggtgcgcgtcctcctccttctcgtcgaactcgtcgcaatcgtcgttgtcattcgccgataccccgctccgcgctggcggcttcgcacgttgccactctgcccaccgtcgccccacttcgcctgcttgctctacccgccggcttcatgcggcgccgctccgcctattctgctcccctctggtcggctgctcccatgggagagagcggacagatacagagaagagaggggatgagagaggagaggatagaggaagagaggttgaaaggggaggggaagaagaggctgacgtgtggcggtgtgggacccacgtgggtagaagaaaatcgattgggattgagacagagagggggggggacctggagagacgcgcgtggtaaaggaataggttggttgtatgtacagaaagtggttggcatgctagctgtacggtggaagcaaaccattatggcttgccattgacttctttttaatttccttgagaaatagacaaaaatttaaccagatcctcctcagcaccgtagagggaaggtctcctcgccaccttgctaatgggctcgtggatctgggccgacgatggccggatccgtcatcctgcctcgtcacatggtgtcatcagggatgatggagacggcggcggtggagcgaagcagtcgtcaatgctagctacgaagaggtccatcatagataccggctacgaggtggagataaaatcagaaaaaaaaaagatgaacggattgtggatagcgcattacctggtcgtcgtagggagagaaccaccggtagcaactgcggcggtgctggcgatcaccgattagccagtcgcgacacaaggaagaggggcttgctgtggcaagagaaaagccgatccagatatttaggagaagacgataactatgcgtgatcactgttatgtggcggttttgcaatgactacttcctgaagattcgcttctctacgttctgtaacaatttaatgcgcatagagtaaaaaaataactcaagatgctgacatcgttagagtacaacaagaaactatctcactgttagtaaaaaaaattatttggactataggagtgggggcagggggcgcaggggtgggatcgagattggtcgttagtgagtaaaattttaactgcatgctataaacttggtgggggacagggttgggagcggcagtggtggggggttgagcagtgggtggggctgggggctgtatcacgtgccatttaatacgtagcaccttaaggtgccacatagtagttctatacacacacgcacacatatacacaaatttttacgtggaaaatccttacgggaaaaaaccacggacaccgactagcaatgatcgatatagagaagttgaatacaaacgcacgacacactgggttgtcgcacccttctcgtgtagcttacaagagacatgtaaaagagaaatctataagtcctagtaggaaaagacttacaatcataataagaaactaatcaagtgttttattataaaactaatccgaacatattgcatgctatttttttttgaaaggaaagcggcaagagtattgccgaatatattagaaggagagaaaagtatggtttacacgattaatgcggaaaaacaacttagaatcatctcagaaccatagatcctggtttgagaagggaagagatacactcatgacggttggaattcaaaactgctttcttgaatatcttggatgatctggtgtgaagtcttttgcatgtccggttcttctcctctgaagatctttgcgttcctttgtagccaaatgtaccaccaagttttgacaatctgaacatattgcatgctgaaatttggatcacatatttaacaatctccatcttaagacgaattttccttgtagcataaaaatccgaaacgctcctgtccagacgcctgattgtagggaaaacaatcggattctcatgcgtctctcctcaaaccgtgtgatgttataatggatttttttactgttccaatgggtatttaatgatgtttcactaggtcattttgaaatgttacacgggatgtttttttgatgtttaaggaggtattttgtgatgtcctcggctgatgtttcactgtatcattttttaatgttgcacgtggtgttctttgaatgtttcaggaggtattttgtgatgtttcagctaatgtttcactaggtcattttgaagtgttgcacacatggtattattttgatgtttttctaggtattttgtgatgtttcactatgtcatttggaatgttgcatgtcgtgttctttggatgtttcagaaggcattttgtgatgttttagaacgtatttcactagctcattcggaatgttgcacgtgatgttatttgaatgtgttagaaggttttttgtgatgtttcacaagatacttcactagcttattcggaatgttgtacatggtgttctttggatgtttcagcatgtattttgtgatgtttcactgggtattttactagctcatttgaaattttacacgtggtattttttggacatttcagcagatgtttcactagatcatttaggatcttgcacgtattgttctttcaatatttcaatgtatattttgtattgttttagaggtcacaaatcaatgtcccacttataataaaaatgtttcaattagtaatataattacatatgttttatttctccaaaatataatcatgtgagatctctttgtaaagatttaattgcaacaaattcaacggtgcaattgaatcacaaattggataagtatttcataagaaaaaatggtttataatttgctaattaagagtatgggagaagagacaaggggatgggagaagtttgcatgtacctcacatgtggaagagaagaaatgactgcgtgcatgcatgtggaggtttcccagaagaaaagattgcatgcatgcttagggggcccaatttttttctccaaaaatcgggcacccgttccgtagtgtcctccataaaaatcttcaatctccaaacaacatcatgtagtaccctcgatagaaaagagatgaaccatacttcaaacttaccattggtgtgaacttagcatagacacgaaacatgatgcacaaacttcaaactcgctattggaataaaatcctgaatatgctgccataaatttatgtaaccctagtagaaatgcaaaactctagtgcacaagacaaagtacttggatctcccaataacctactggtatgttgggtatgatggtagcaaaatttgtcagaaaattggatcaccttgtgatctagacaggagtgaggctccctctcgtcgactcaaatattcttcttcttttttctgtgcttttcctcttaggtaaataccccacttcaaatatttacttatcataatgagaatatgtactcaatctagacgtggtagattatcttcaaactcgtcataagaattaatcctaaatctgctcgcagtactacatgaatgctcattggtgccggttcttgaaccaacacaccttcgttttttatttttcaggtgctaaaaagtcgaaaaaaatatttggtatttttattaggcacctatacaatcacactctcattcccaaaagtcacataatttttgaatccatattcatacaaatgtgtcaagaaaaattcaaattcaagacatctcacttcacacaaagtcaccttgccatatcacctacaaacacttcttgtcttggaaacaaatgctattgttttgagaccactatcatttgaacttataatccatatttaacaccatagataagataaaatgaaaagtgtagaaaaatgtagatcttatctatatctacaacttttatataggttttgtgtctatctgatatcgtttagaaattttaaatatccactcatgcaaataggtttgagacattgtaacacattttcggacattcaaacaaact

SEQ ID NO: 72090 - DNA, 9524 bp, Oryza sativa
ggcggcgcacagggcggcggcggcggcgcacagggcgcggccggcggcgaggttgcagcacatcacaaagagtgagaggtattgctccatctccaatactccaaatgtgcctggtgatttgtgaatgaaattatgaaacagaagattgtgatctatttcagtgtatatttcagtgtatatttggtagatttggtagtacatagcacatagcagcagattgtgatctattattgaattatgttatttgtggacagaatgtcgaaccctgctgccaccgttgagtcacaagttgcattgacaccatcttccactcccactccaaccaatgctccaagcgtcgaaataaatgattcacaaggtacagaagtagaacatgataataagagactgaaatctgcagcatggcaagattttgttaagaagaaaataaatggtgcgtggaaagctgaatgcaaatggtgtcacaacaagcttggagctgaaagtagaaatgggactaaacatttgttagaccatattaaaacttgcaagtctaggcaggctagaaaaggtctaacacaatccaatttgaagatgggaatagatgcagaagggagggttaccgtagggaaatatgtctttgatcaagaggttgctaggaaagaacttgcactgatgatatgcctccatgagtacccactttctattgtagaccatgttggttttcgtaggttctgtggtgcattgcaacctttgttcaaggttatgaccagaaacacaattaggaaggatattattgacttgtttggggttaacaagatttctatcagtaattattttcacaagcttcagagccgtgtggccattactactgatttatggacagcaactcatcaaaagaaaggatacatgttgaggagggtgttggaacttcagatggagttaatgcttcttcaagtgttgcccctccagggggatttgatttggtggatgatatatttgatcagtatatgtctggacaaactgttgcctcttcctcacagattcgcactgagttagatttgtatttagaagagaaaccgttgcctaggacacaagattttgatattatcaattggtggaagtttgggggcattaggtacccaactttgagacagattgcccgggacattttggcaatccctattacaacagtagcatctgaatcagcatttagtactggttggagggtgataactccaaatcgtaatcagcttaaacctaatcttgtggaggcacttatgtgtgtgcaagcatggggtcgtgctgatatgttaggtaatttcatttttgcttttgtatcgttcaagtttaatttgtcctttcatgtttcttccatttcatctaattgcaaatcacattatatgttgatagctgaaattgctaacaagaccaatgcattgaacacggtacttgacgatgaatcagaatcggtatgtcctacactcccactttattgtttttattactataatatacaatgcttagttgcttcctctaattttgatttcaggaagcatctactgtcactgaagcttgaggtggagatttcataagtgaaggatgggctagaaagcctgcaattgcaaactatctacctatatattttattatgttggcaatgtaatagtatattaagacttctatatttctgtgagactgaatttgcttgctgtgtgtgatgtgttgaacaattcaactgttgaactttgaaggcttgattcgcttgaacagttgaactcatgtgtgttagtgtgtaactgtgtgaaatgatggatatcatcaatgtgttcttgctgaatttttatgatgaaattgaagtattcatgctatttttgatggtgtgttaattatgtacaatatttctttttgatgaaatgatgattgtgttgtattttttgagctgattggattgagatgctacccaatgcggggccccggtcgggttgcggggccccgcaggggtcgggggcgggggatgttttcaacccgcatcactggtcggggccgggggcggggggtgaagtcgggggtcagggtcgggggcgttccagcccaacccatccccaccccgcccggtggccatccctaactacctttccactattcgcacgaggtgcactactacaacaaaacaacccaacggagacatcttatttgtacgataaagacgttttatctcgtctcctacagataactgagacgcttttataaatcgtcgtaggaacgtctccgtttgcaccgtctcaaaattatggaaacgctttttaaagcgcacctatattatttaagacgttgctagagacatgtaaattgcatctctataaaatatagagatgcttttatagaagcattaatataggcacgcacatcaagcattaatatttgcagattgcaaagttcatgcactaaccaagtcattaacgtgaacaatcttaaaggtaaatagatagttttttttatattgcaactctgcaaacatgcgtcctatagcagatactcttcttttttaatctgagactgaatattaaatattcatttttttttctaaataattataatattattataatggtatttaatgatgacgattaggaacagtgtgtttttttcttctttctctatataaataattatatattatctaataacgatgacacggatataataaaaacgtctcaaaactcatttctacacatgagacgttccaaaacgtctcaatattcctctctaaacgatttagttttgtgctaacctgtaaagcgtcttaaactatgtcctcaactaataaagcgtctcaaatatcgtccctattttaatttttcttataaaaaagagacgacttataaaatgacttaagtgaaacgtcttaaaacaatagttttgttgtagcgcgcgtgctctgcttcttcttgtatacggaaccactataggatccagtaatttattcttaatccgttcatcaagtcaatctcctacataggctgctatgttgcaaagcaaaagcatatactagtatattttaaaaagcgatttcatggacagacgatttggcatgcattatataactactctgagtacagccaggccagtgtttgtcacatggctgatggctcagatatacttttatgtcatggacgttgctggtttgagcaagtcggatgattaatttgatcgatccgacggcagtatgcatatgatgatgtgataagccaactaccacagagaattattagtgaagagtttttcactagtgactcagtggtattattggcccagttcctactgtataagcgaggatttattcgaggaaagagggaccctatatcataccattacccaccagttatcatcgccatctctagctctctcacacgttcgaccacagtctcgtcaccaccatctcccttacacgcaccattttcttcatgatcaccaccatctcacatctttatctattataaaaattaaagatatttttgcctatttttcatacgtcatctcagtccgattccctccccgtatgcgcccgattactcctagatcacccgtataaaaaacatgcaaggattacgtattttctttcttaaagcttttcatccgtcatcgatctcttgcgtaatcaaattcgctaattggctttcaatagagccttcgcccgccgcttgtgccatcatgcacagcataaggcagtccaaatcgatcatgtatttcataatgtaacacagcctaatctctgtccccacggaatgccccagtctttcctcagaccaactttgtcacgtattaatccatccacagccagcataagccgccgcctacgataactgatcttcataggtggctggtttaagatgggactggataaaaactcgtggcttgttagctcgctcggctcgtgtctatctcgactcgacttggctcgccgaaccagagttttagctcgttagctataacgagccagctcgagatggctcgcgagccgctcacgagccatgaaaacatcagaccgagcagccccggatgacacctatccaaaccatgtaagcccaactaggccacggtagtacagtgcacatcctatattcagttaataaaggcgacagttgcggctcggcaacagaaaaaagaagagaaaaaagaaaaaagaaaaggagagaagaaacggtgagactccctcgatcccttctctgatgtcgccattcgccgccctgcgcccctgccgctcgcgctatccgctgtctgccgtcgctccctgctgttccccactgtcggagcaaaggagatccggtggccatcaacctgaggctgccggatctggcgccgttgacctcatggctaaccactggatttggtgttccatccgtgacaaagggacggtggtggccatgaggagaatttgttggccaacgaggagggagacgctggctggcggtgatgtaggcggcaacaccgtggcgcggtaggaggtgatgccagctcgttatcctaagccggctcggtatccaccctagtttaaggtgatgccggctctaatgcatcttcgttgggagcacctttattaagccacctgtggtaattttatatcagaggcgaaacctcaaatgtatcttcgcatggtggcctgctatcaaatcccttgtccacaaattacgtagacgggtgtttgcgccgaaattttggcctgccttaataaaatagctcgcgtagtcgaaactcatgtaacacacactggtggagaaaccatctttcgtcggtcggccgatttccacaatagtcccggatgcaataaaaaccggtgctaaagatgatctttagtcccagttcaaaagggtaacgggcatatttgatctttagtcccggttggtaataccaaccgggactaaatatcatctttagtcccggttcgaatgctgtcagggcatgtcgggccccccgggatctttagtcccggttggtcgtaactttagtcccggttggtattaccaaccggggctaaagatcctggtgatctttagccccggttggtgctaccaatcgggactaaagtcccacccctatatatatgtcttcttcctcctccagctgcccgagcaagcttcaaaatttcttcaaaaaagaggggaggtcatgccaaaatttttattgaatttattttgatgattacatacaaatcggaggtgcctaaaaggtttgcaacttcatcgtccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattataattattgtatgactgtcattattgtaagaataattatttgtgtacggtttttttttactcatgtagatggatcggcaatggatgtacactgaccggcggtccaaagagtttattgacggcatgcactattttttgagagtggccgaagctaacaggcaaaggggttttatttgttgtccatgcaataagtgtaagaatcagaaggagtattctgcatccaggactattcatttccactttattgagtcggggttcatgccaagctataattgttggacatcccacggagagcaaggtgttaaaatggaagaagatgaagtggaagacgacaatattccggactttgctcagtatgttggatttgaagaaaatcaaacgggtgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttcttgcaatggaaggcaaaaaatagggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgatcgattgtatcctatatcgcggtgaggagtatgagaacctagaagcatgccctgtatgcaaagcactacgatacaagattagacgagatgatccaggagaagttgacgggcagctaacaaagaagagaattcctgctaaggtgatgtggtatttccctataataccacggctaaggtgtttgttcaggaacaaggggaatgctagaatgttgcgatggcacgctgaagagcgtcaacaggacgggatgctgagacaccccgccgattgttcgtagtggcgaaacatcgacagaaaatttaaagaatttggaaaggacgcacaaaacatacggtttggtttgagtacggatggcatggatccttttggagagatgagcagcggccatagcatttggcccgttacgatgtgtatctataacctccccccctggctatgcatgaagaggaagtacataataatgccgattattattcaaggcccccaagcaccctggtaacgacatcgatatgtacctaagaccactggtcgaagatcttaaacagttgtggaagaaagaaggtgtccccgtgtgggacgaggacaaacaggaggagtttaacctacgagcgctgctgttcgtaaccatcaacgattggcctgcacttagcaacctatccggatagtccaacaaggggtacaaggcttgcactcactgtatggatgaaacataaagtacgtatcttaagcactgtaggaaggttgtatacatgggtcatcgtcgattccttgcagcaaactacctggtacggaagaaaggcaagcacttcgaacataaggccgaccaccgtacaaagcctaaacatcgcagcgggaaaacagtgtttgctatggttaaagatcttaaagtagtgttcggaaaggggcctggaagccagcctatagagagcgaagatggtcacgcggcgatgtggaaaaagaactctatattttgggagttaccatattgggaattcttggacgtacgccacgcaatcgacatgatgcacctcactaagaacctttgcgtaaaccttcttggcttcctaggtgtatacggaaagttgaaagatacactggaagcacgtaatgatctgaagcatatggaacaacgcggcgaccttcacccggaaccaaaggagaaaggaagccattacttgagtccagccagctacactcttagcaaggcagagaagaaagtatgtttgaatgcttggagagtataaaggtaccgtctggatattccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatatattagaagcccttcagaataaagtggtgcaatgtctcgtcagttttgagttgatatttccaccttcatttttcaatataatgacgcatctgctttatcaccttgtgaaagagatccgtattctcgggcatgtgtacctacacaacatgtttcctttcgagaggtacatgggcgttctgaagaagtatgtttgtaaccgtgctcgtccagaggcaagcatcgccaagggttatggaacagaggaggtcatcgaattttgcatagaatttatcgaagaccttcgcccaatcggggtacgtgaatcacgccatgaagggagactacggggaaagggaactctcggaagaaaagcaataatgacggtagacaacaatttattccgtaaagcccatttcactgttctgcaacactcttcattggtagctccttacatcgaggagcacttggctcaatgggtacacattctacacgagagcccaagacatgaagagcacgaaccaaaacagcgttgttcgtgtcgatgccatgggacacgatggaacaactggcacgtattacgatgccatcgaggatatatgggaacttgactatggtcctctcaaggttcctctgttctagtgccaatgggttaggttgactggtggaggcgtaatgattgatgacagtggtatgacaactgttgaccttaacaaggttggatactcggacgaaccttttgtccttgccaatgatgtaacgcaagtctttttcgtgaaggacatgtctagcaaaggaaagaagggcagagggcctaatgagcctaagcgtcaagtggttatcccaggcaaaagaaaaatcatcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtatgtgcggtcaaccgtcaccgccgatgtaatgccgtaattattgtgtacacgatataaactattttggatgtattgattatccatataaatcaattgatgtatggcataatttactatcattcatatgctacatttaattgaatatcattcatatgctaattataattaactagagaatttttaaaagtattaaatcattcatgtggcatttacagatgttaattagagtttttcacaatttaatttactatctttcataggctacttatatatgactattcgaatttttaaaaggtttaaatcatgcatgtggcatttacatatgttaattagagtttttaacatttaatttaatataattcctacgctaagtatatatgatgattacaatttttattaattttaaatcatgcagtatgtacatacaaatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaatctttgtaatttaaataatgttaatgcattaacttctattttagaaacacatatgtaagcgaaaataatatgcagtgctataatctttagtgccggttcttaaccctaaccgggtttaaaaagaatttagaaatagtgggaaaatatctttagtcccggttgatgattactcccggttgttctcatca

SEQ ID NO: 72091 - DNA, 38908 bp, Oryza sativa
cccgatttggccggcgacgtgggggaagagagagagagagtacggggggggggattcaaatcgaatcccgcccatttgcgggcacgcatgctggcgggaatggcggggagggcggcgacgtggggacgcggagtggaggcgtggcgtggagcggagaaggcggcggcgcggacggtttcggcggcggttgccgtcgtggagcgggcggctagaggaaggggacgacctgacaggtgggccccacctgtcagcgtcccggagagaggggaaaggggaacggaccggcccaaaggaaggaggccaagcgcgggagggagtgggccgacggcccaatagagaaaaaagaaggaaaagaaaaagaaaaggaagaaaagatttttcctgggatttaaaattgcactttggtgatttttaattggttaaaattatttccaaggctctgaaaattccactaaaaatcttcttaatgcactggagcatggggaactcaagaaaaaattccaccacgctaattccaattattaattgcatttattaactagggattttgctctaggttaattaagataatttcttcgggcaatttatttaaccaaaaaagggggggaaacttcagggtgtgacaggaaacaacttcagtatgagtctttggttcttgcccttcttgtgaaggatcatcaatgatagcttccatctcaggctagcaatataaagataagaaatcacaaatcacattacattcacataaatatgtaagtgcaaaagataaaagaaaaatataactcacaataacattctttacaggctcactaaaacccatcttgctgttgcaatggcactccttgaaaacataaattgtagtgggtggcagtgtggcacgtccttatacttagtttgcttctaaaattacatgcaaacagtttgtaaataaagatgccatcactttctgaaagttttttcatatgcatatttagagtgctaaatataacatgccattagtgtaacgttttcttatccataatatgtcatccaatgttttaacaacctatggctgctaggtgcttatatccaccatgttagaaccacagcaacagattatgtagttaaagtgcagttggctagataaaaatatttagggtgattgtacataagtattactaactcctagaaaatgcatgtctagtttctgtggatcacacatgacacatacaaactcaaaatctgaaaaaaaaatcaacttattatacacataacacataattaagttacaaataagagtacaaaagaaccgacacattttattttgtatcttaccacatggcattgtgcaatgtagctccgagagcatgtcctttgctagtactgagcattctcatggttgttatgtttgttttacagacacttctcctatagaaagggaaacactagtaagacaagtagcttatttctatcacatatagataagacaactgtacacaatattttgatagtacgttgtattggtcaatcacatatggtttgactggtcagaagtaaaaacatatttagattcagatcagaaaataatatacgcgtgttagttgtaccacgaaaattgccagtttttacaaatatgacatgcatgtgagcttcaggtacaaacaatatgctagcttcctcttgcttttaaatgtttttcattaccatatatatgatttattcacttgtttctcttggaatgtaaacaaatatagagaaaagacatactatgattttttttactagaatatgagacttgacaagttaacagcaggttctgaatttgaagtcaacaataggtaactagttgtcattaaaccatggtcatagtttttgtaccagcaaattaacccaagatacaaaacaagtagatgcggcatcatgattcatgtagccaacactgtgtaagatttttgaaataatgccatgatttccaataacattcaagtctataccttatgctttggatctgaccacatctctactattgcttgccattgctcacggtcatactcttcagcgatgatgttgttctcacttcgttttctggtgtaccatcaaagaaaatattcttcaacttgtacctcatttgtcattgtctagacttgagcaaatcagcacatgcatctttgaccgtctgattattttcatctttggcaaattggccctaatcaagagcatggataaaagaaaattagcattaaaatagaataacatacaacatgataaacctaatgacaggtgaataaaaaaataagtaaaaatctgcataaaatagcaagcaaaatgaacgacatagacaagaataaagttatacaacaagtagcatgtgttcaacttgggagcaaataaagcaatatgaaagaaaaacaaatagcttctaagacttagttgcggatgttcaacttctccatttaaaattcagattagaattgtatagatccaacatgggcatagaaatgaggatgcaaaattaatcagagcccacacaataatttgtagaaactaggacataattcatcttatacatttgcagatactcacataaagcaacccatgaacatactgcaatacagtgaacaattaaaatttaagagtgttgctctattaggaaagaattgatctacttacaaccactttatccatatagtttttaagttgagacttgccattcttatactccttccagtgagtaaagattggtatgtgctgcctaagtacaaccccccactctgatgcttgctttgcaaactacattggtgcttctggccttctcttcccttcaacaatgcgcaccatcttaagggtgtgtttggttgctcgtatctatcaagcctggctcatctccgtcatccaggttgagttcgtcctagttaaggcgatacatatgcagtcgtttggttgtttgcattagtctggcctggctactacgagatactgtttggttgtctgcacgggggatacggttcagatgagaatttgtttggttggttgtatgaaccgtatgtatgaggatattttttcttgggtgagattaccgcttataaatttccactatattagagttcaggtaacctgaatttatttttttcatatatcaatcttcttttgttagtaaaacaactcatcaattgaactaatgtagtggagtacgtaactacacagtaaatcgtatattagtgactaattacgggattagagaacggggatagtagaaaaaggaaaaagaagaaaaaagaaaaagtgctctcgcatctcctcacactcctcgctgttggtattttttaacgacattacaagaaatataattcccagcaatggcgcagaaatactcctggtatattatggttacagagttcatccgcaagcgcacggatataccattgtagcatttcacccgagagtattccaagggtatcgtatttattttatctcgtgggaagatcatgtagagagaacttgactaataatttatatattacttgtgataatcatattctaagcaggggttaagataatccaagggtagagtaacacacaagcactaactactcattcttatgatatattatctaagctaagtggaaagaaaagaggaagaaaatctattcctatacttctaatatacatagtatacatacattctagttaaccgacatactagctaataccctctatccgatgccctcctggtacttcgagaagccaccccagactgccgagttccgtacgacagcccgttatgaccatataatcggggctaaatacggaggaataccctccccaggaaattaacttaggattatatacagacgcggaggaatacccgtactgagctgtcaccatcagcggcccacctctcatccgcagcatataaccccaaataatgatatcccgtaatctagacaacacgtctaaacgaccagatcctactctaatatcatcgtcatgacatagagtaattgcataagcaaacattatacccacaccaaagcatctcccagataagctagccgtatatccagtataacaagaacataatgtaaagtagatattcatatacttggaaagtatttcaataccataaatgtatatagaagagtattctaacaaaagtacaaagcttacaaaagaggaaaggaaagctattagagccatacccgaactcttccgaaggcttccggactcctgatttctactctattcctattccaccagctagatactactaactaaacttgagagaaatgagcgagctcttgcttgaggtgtgtgagtgaagtgagaaggtgaagtccttatatagaggtagttatgacggttgtggaaggggaattgtctgaagtgctctccaaccgtcattgggatgcaatcttggatgtccacgccgaaccctgcatccaacggtgccaggatgggtaccaggttcggctgaagcatcagctgggccatccctgcccttcttcggctggcggcctcctctattgcttcactttgtagacttgtgaatttttgtcaattctgagttcttggcccattcatacatcagtctgattctcgacatcgtctgattgatttatcgtttgatttgatgtcgattctcctctactttatggttattctctgcaaaaggttagtaaacctaatactagtggaatattattattctaacatgtttaagcattgcaagcatcactagttctcctctattttggaaatattgacggtcgaaactgatcgataacgaacatcaacaaaaccccccaagcttgaacctttgctcgtcccgagtgaaggatgaaaggaaacaatgacttggttgttgatcaggagttgctactatgctgcatatctcaatgatataggtgcaaggtatatgtaccctctctcagattaaataatcttttgcacggtggcttactcttacccctgattcccacgagacactgcttctccttgccttgggtggttgaaagaaagaacagcaattagagcaccaatcacccaacattcattcaactcttattccggaagttttgaaatgatttttgtaaaagaaagccaagttcctcaagtgattcgctcagactctctaagtgtatcaatatgacttcctcaccagattttgcctttttgattcctactttaaggttttaatatgtggagctcggtagagatcaaacatggcatacttgcattcacatttattactaagtcaaaaacttaaactaaagtagataattaaaacatactaaagatcaagatcgtgcaatgtgtgtgtggtatatcgtggaaatggcacacgaggaaaaataaagaaaatgcttctcctttgtgcttactttcttctcccaaaaaatccttcttttattgattaggagagggcatggctatttatttattttttttcaacatcatgctcatgcttgatggagcataactttattttttttcttttcataaccatgccttttccttcttctctttttttttcaaatggatttttctttttaggagaagaaagcatatgaaaacatggagaatttattttgttggtaacatggaaatggaatggaatatttgcttacctcccagtgtaggagtttggcatgtgtgtcgacgggggatacccgtagaccggatatagagggtattggtgtccgttggtacaaggatctacgtagtacgacatcaagcaaacaaaagaaggattatactggttcagggcccttggtaggtaatagccctaatccagttgatatgagattatatgatggaaaacacagattacaaagggaataacagaactcgatgataccgatgagaccgtagtcgagttggtccgactagatctcccggcgacttggctcctgcatgctccggctctgtaggctatagtgggtgtgttggcggtgatattcgatgccttaggtcctgcccagggggttccttatataccgcgggtcagttgatctctaagtaggactcggagatatcgaacccctcatgatatggtaaaaacccagtcttgtccgagtagaactccttccatccgtagataccatccctatcccgtgatagatttccttaatgtatacggaaactatctgtatacgcgtgggtatattgtatcagtatacaacgtacatccaaggatagagggtataacttatccgtaaccctgacaatgtgcatatatgtgggtgtatgatcttgatcatagagcatgagaagtatctacacaagtcacaagagtttgacaaagttcaatggaatggcaagtaaccaaaatgtatatggtttaatcatgatagcacattttttgctctggtaggaatttatatcaaatgaggaactttcaattttatcattttgaaaaacagaacattcggaatgtaagtcaaactaggatcatgatcatagtaacacttatttactatctcatatcttgcaacaacttagactcagattagcaagtgcagctcatttacctcaggttcctagataattgttggctacttatatttaacctttgagagagcacttaccatgaacccatatataagagatataaaacagagcaactattcatcatttcaacaaagagaactggcttgtcttatctagcatgactcaaacctgtcgtatccttttggtattttctactttgcaaatttttatattgttttcaagtttataagatgcaattggaaagcaaacatgcaattgaaaagggaaatatgcaatgtgatacaagttaccgcagtggggggagagacatctctccccccaagcttggctttcgctcagggtccttgacaaggattgaaccgttgaaagcggtagtacatttgaaggtcatcgtgctgttgctgcatcatgttgttgaagtttgcgaactgagcatcagcagattgttgccattcttgcgtttgtgctatgtgttccgtgaggttgtactggatctcccccgtctgcatataaagggtgtccattctcctagcgatttcacccaagccccaacgagaggaactcgagcgccattcacttcgagatggaggcacaccacttgatctggaaggttggttattcccccaatgtatgtcattaggcgcatgccatcggtcctaactggcacttgcccagtttgagactccgatgctatggcgttgagcttgggtccatccgggtgcatccccagttggttcccaacctgcctcatacatttgcacgagtgttgaggatgatgaacttccctgttcatttcttgccatgttgcgcgtctccctgtatgctccacctgcacgagattcttctatggtgtgcaggggaatggttagttcacgacagttgtacaaatgataccccgcatttggcaacgggatttcatttatacaaccgggaaaaaagtaaattaaagatccatcttctccatgtttcagaatatgcccttgcactagataagtctcatcaatacatggacaagcggctgagataaaagcaatttggtcgctaatgaccactagcccttttgctatccgagtaatcagagaagtgcactcaacaggagcagagaactttatattttctaaccattgccttatcatacatttcacaggagcaattttgatctttctaaccatggcaaacatgataatcaattcatcccccataatgggtctaagatcacctctaggaaacaaagtcatagcaatccatttgtgcctaagcctaagtgtaggattatggatatcattctttccaagtttcttgcaaattggagcaccagaaatatcttcccaaaacctatttttctcgaacccagaaattcctttctggagatcgattttacaggaatcgtgaaaaccaagagatgtgcttaagcctttccatgtgagtgtatactccttatggaaaaagcaaaaggaaatttcatcttctatttctttcaaagtgcatagaaattgcaaagaaagcaaacgagaaccaggctcatctaccacagcaaatctctgccaaccaacagctttccaaatagcacgaaattcaacatccatacttatctttttaagtagttccagtgagtattctcgcgtgtgagcatactcccggtcgctcagcatgtagtaggcttgtttctcccgatcactgacaaggtcgaggtcggtgttgttcaggagtcatcgcggagcttcggcgtcttccatcaagacatcggttgatgaacgagccctagactcatcatgacgacttgattaagagccggaccccttgaacagacgagacagtcgcctcctcattctgcacaatggagcaagagtggactaactcggcgggggttaggaatgacaaaaatttcacccgacggttagtttcaccaaagcaacttgtatatatgcaactaagtatttgaatttgagggaaactatcaaagcttgaatgaacttgagagcaaactttgaagaaggaatgaaaatgtgttgaaatggggtggaattccctctctcggccggctggcttttatagggtacccacaacggtcagaaatgacatgtgggtcccactagccgttaccctgccaaaagtggcaggtaaccgttgcctggccggttcggccgaacccctggtgggcccaatcggccccactttcggctgttggattccaacggtcagtgcggtcgtggcacagtgaattttcgttaaaaattttatgttggtttgcactgaacaattcatttgaaaaattttctcaaaattcaaagaatcctaaatgcagttttgaaatgcaaacatgtgttgatgcagaaattcaaattggtgaaaataaatatgcgcatacataccaatttaccggttggcgaaggtcacgtcatttaaagtccgacgtgcaagtctgtacctccttccgattcagtgcgtggattttccacccatctccgaaggtgatggagcgggcgtctttcgcttctccttccacaccttccttggctttgatgcggacggcggcttcctctgagccgactgctctagctttttggccgatagggttggttttaccggcttcctccaataacggttcctgggcatcgttgtttccttctccaggaaattctgcatgaacttcaccaggctgtccgtcttgggtagctccatttcgaccacttgaatgttctgtgggtttggcccgtacttgattctgaccatggagcattgttccgtccttggttgaaactcaaactttttctccttcccgttgatatgaaaacggatactccctgttcccacgtcaatgttggctcccgcggtgctaaaaaacggataccctaggatgagcggcgtctccttccccatgtccatgtataacaccacgaaatcaaccgggatgaagaaatctcgtatcttgactggcacgtcttccgctatccctgacgggtaacggactgacaagtcagctagttgtaggcacatcggtgttggtgccaacactgtgaagttgagcttgtcaaagacgtcctttggcatgacgctgacactggctccaagatcgcacaaggcctggtcgaactgctgtgccccgatcgaacaggtgatcataggagcttgtggagtatgacattgctgcagtgctccatcagcttgaccacctccgttgttgggagcggtctcttgttgttgagtatgtccttgagataacgggcatatgttggtacttgcatagcgtccaacaacagcatgttgatgtggatcttctggattacttcaacaaaacaagcgaattgctcgtccactgacagtttcctactccgttgaggaaacgacagcagccgtgtgtcgcagtactcctgcggcacggtcttttctggctgatcttccttgtcagccgagtcactagatggcgcttcttttgcaatcttgttaattcctacaggattaggatacggcggatcacaagtggacttaccttccctcgtcgtgatcgctttaacattttcaaggaaggagccgggttgcctcggaatcctcccagtttcattttcaaggactaaggatgctaactgagctagctgggtttctattatttcgttaaagctcagctgattttgaaaagcagaagcacaaccatctaacttgacatttatgttttctaggatcttgtcattggcagcaagctttttgcttagcgcatcagtggttttagcttttgcaaaaactagatccttcaaggagggctggttagaaaagttaccgttgttgttacctccttgataatatgggcgtggctggctccatccctgacctccttgtggacagtacccgttgtttttgttgcccatgtacatcgcctcctcacgggtttccaggcagtcattcccagaatgacccgtgttgccacagacctcacacgtaatgtgcgaatccaaggccttgatggtgccttgtggtcttttctcgtggtcgtccaatcgcttcatgaggaggtctagcttggcagcaagcagttccgtctccttgacggtgtgcatgcctcgctgacgggtctggattcgttcctcgctccaacccatattggagaccatcttctccatgaaccgttttagagaagaacactcctctagctgccgcgtctaggtgatcgcgggacgtgggcgtgagtccattgtaaaagttctgcaggattagcgagtcgtccatcccatgatgacgacaggcggccacatattcctgcagacgttcccatgcttcaggaatagactcgtaccttgtctgctggaaactggaaatccttccacgaagggcattggttttgcccatcgggaagaatttcgagaggaatgccatagaacatttgacccaggtattgacagtagcacggttggcatagaaccactgcttcgctctcccgagaagggagaacagaaacagtcttaacttgacggcgttgggactgacgcccttgatggtgtacgtgctacagatctctaggaactgttgcagatgagcattggcatcctcattaggcttgccatagaacgggctagcctgcgccatagtgatgaggctggacttcaagtcgaaatccacgactcccatgttgatttgcggcccaatggccacattgtcagcagagggagcagcgaattcacagagagtcttgttagccatagtcttgaaggtcggtggcgctggtatggctagtttctctgacggtagagttttctatggagcagcgactcgcggcctaacgctccggaagaaagctactggatttttctttgaagttttccggcaagttgaaaccagttatgcactaccctgttttcacaacaaaagttaaaacaaccaaggttagactgcaaaggaaaatgattatacagaggtaaatataaaatattagttcaggtaatctctactatgaatcttccctggcaacggcgccagaaatgtccattggtatttcttaacgacattactagaaatataattcccagcagtggcgcagaaatactcctggtatattatggttacagagttcatccgcaagcgcacggatataccattctaacatttcacccgagagtattccaagggtatcgtatttattttatcccgtgggaagatcatgtagagataacttgactaataatttatatattacttgtgataatcatattctaagcaggggttaagataatccaagggtagagtgacacacaagcactaactactcattctcatgatatattatctaagctaagtggaaagaaaagaagaagaaaatctattcctatacttctaatatacatagtatacatacattctaattaaccgacatacaagctaataacctctatccgatgccctcctattacttcaggaagccacccatgactactgagttccttacgacagcccgtcatgaccatacaaccggggctaaatacggaggaataccctccccaggaaattaacttaggattatatacaggcgcggaggaatacctgtactgagctgtcaccttcagcggcccacctctcatccgcagcatataaccccaaataatgatatcccgtaatctagacaccacgtctaaactaccagatactactctaatatcatcgtcatgacatagagtaattgcataagcaaacattatacccgcaccaaagcatctcccagataagctagccgtatatccagtataacaagaacataatgtaaagtagatattcatatacttggaaagtatttcaataccataaatgtatatagaaaagtattctaataaaagtacaaagcttacaaaagaggaaaggaaagctattagagccatacccgaactcttccgaaggcttccggactcctgatttctactctattcctattccaccagctagatactactaactaaacttgagagaaatgagcgagctcttgcttgaggtgtgtgagtaaagtgagaaggtgaagtccttatatagaggtagttatgacggttgtggaaggggaattgtccgaagtgccctccaaccgtcaatgggatgcaatcttggacgtccacgccgaaccctgcatccaacggtgccaggatgggttcggccaaaccatgggctgggccatcccagcccatcttcggctggcggcctcctctattgctttactttgtagacttgtgagttttggcccaattcatcgtgtcaattctgagttcttggcccattcatacataagtctgattctcgtcatcgtccgattgatttatcgtttgagttgatgtcgattctcctccactttatggttattctctgcaaaaggttagtaaacctaatactagtagaatattattattctaacatgtttatattgcaagcattactagttctcctcttttttagaaatattgacggtcgaaactgatcgataacgaccgtcaacactcgctgcgagcatggacctcgcttctcgcagcctgctctgcggagcttggctgctcgtcgtcgtcgtagtcaccgcatccatcgctctcgctgatactcttgctctaccgctcctctagccgcaccgctccctgtcttcatcgtcatggggatggtttgctgctgctgctcgccttgtcgcgtcgtggcggctagatccaacggaagcgccggagtagttggttgcaaaaggggttattgctgacagcggcgacatggaggaacaaatggggggcgacattggcgacggcgaggcaagggcgacggtgagcttcctgatctagaatcctatctcattcttgtccatcctcccgctattctccttcttcccgaatctggctgaggccaagtccggcgatgagcagtgcagtagcaacaaacccatgccttttcgttttgggggagaaatgagaaagggacaggatggtgaccactgaccccttcgcacctcttgcacgcgcgggtgcaacgcgtgcacgcgcgggtgcagtgttgctgcacgcgttgggccaggacaagcagcgaagctcgattcggccattcctgctcagcctggctgagggggctcttttgcatctgctcggcctggctctagcacatctgcaggcaaccaaacaggctgcaagttgcatccggagatacgaaccaggctgatacagccaaccaaacacgcccttagtgcataaacctcggattatcctatccagatatcttcccatacttcttcccctattccattgatcaatcatgccttttggttcacctgaaaatcatgaaattttcaaagttataggaaataatcaacattttttatgcaaatgtataaaccatattcactacaacaaagtgccaataccaatacatgcattctccagatttgataattgagttgatgctttgtggaccactgcagttctatccataccaatgcgatacaacacttgttctagaagagtatccattaagggtggtcccatgcatatttaataatatttttttgttattaaaattgcttatctgataatacatgatagtatctactcatgttcagacacaatggcccaatacacgcatgcaatctatgatatttaaaaatatatatagttatatcatccagtctacagaacagtcaagattattggaattatagttactactggtgaacttacatttcaatataattatataaaatattgctaccagaatacaaattatgccttcttctacactgatatatttattaagaccagtgagtcctcctatacaggcttccaggctatattcaactcatctaactatgggttgccttctagcttattttgatatattagttgtgtttaaactttaataaaaaaatatttatttagatgcaaaagcaagggtaacttggtaaaaataatacgatgttcagatgtaaatgttgtcaataaagcaagtgttggcggttattaaaatgccgattctataccaccaacatcttcataaagtccagataataaaacatccaacatagtgatagttgttaaatctcacatactccacgagtattggtgtatatttgtatgaagatgataaacccagaagttgggaggaaaatcagactaaagtgaagaaggaaatatatccatacaaggatgggctttgaactttatcaaaatactggagaatcagcccaaaactccgagaaatggatgaagtaggactaggggaggagacgggccaaaggccaagctagcagggccagtccaggtttggccgaaccctgaccaccaccgttgatactgggatttggtagggacggtccagatgcactcctgatggcagttgcatggcatttcggacaattccccttgtcataaccgttgtacctgtcctataaatagacttcactttcttcacttttacacacacacttcaaagcttgagctgaattataagaggctctattgtactccctccatttcacaatgtaagactttctagtattgcccacattcatatagatgctaatgaatctagacattattatatatatggattcattagcatcgatatgaatatagacaatgctagaaattaaagtcctacattgtgaaacggaggaagtactatttgtatactagaattaggacgagaatagagtagaagaagtcagaggaattccggagttgtcggtaatcttgtctcatttcttttatcttcccgagtaatttagatttatcttgtgagaattatctattggctagttcctaactagcatacgagattattgttcactataatcaactaaaatatagtgattgctttggtgagttataaacactaaaatagatattaattgcttagacgtggtgtttaggtaattgttatccattaattgctgtgtatcccacggtacgtttgaggtaggtgtagaggtggtgacagtcctcgagatcagttaagtcctccctatccgggtatgtagtagagcgacatctgggaacagcgggttgccagtgcctgaagtattgcgttaggattaaacttaagcttgccctagacacagtttctcactagtaaatcctctctgtcctagcctatcctttgcttggtgcccttggatgaaccgaagggagatctgatcacacacgttcccttcgattcgatacccttggaatactccgtaggggaagtgctacatcggtatatccgtgcgcttgcggatcttatctttgaccgtaagaataaccaacgcatttctggcgccgttgccggggaacggttgttgataatttccgaacctagttcatccgtctatctcttttcattttttattctaccttcacccctgctgccaagagaagtattccttttaaattcttctcgaccatggagcaacctctctttgagctgtctgctcctaagggcgaattctatgagccacctccttcatcggagccaatttatacaactggctatgaaattcgccccaaactaattagtatggttaggaagaatccttcttctggtcttgatctagaaaacccctaccatcatctgcgggactttgagcaagtctactcatgacttaacattcgtggcatgaagcaagaaactgtacgatggaaattgtttccgttctcccttcaagagagagcgaagcaatggtacacatctaccgtaggatgtgtaaacggtagttgggaaaagccgcgagacaaattctgtcttgccttcttcctagttactcgtattactgcccttcaagtataaatcctcagtttccagcagatcaataacgaatcaatcgttgcagcttggtccagattcactaatttagtgcattcaggacaaaccttgtccttacccgagtatgtgcatctgcaacattttcatacgggtctggataaggagtctgcattctatctggacataaccgccggaggatcattcgtgcaaaaaacaacgtcagaaggaaaagtaattctagaccgcattctagaaaataattacttcatgatgcaatgcgatgaaccccagctggaggcatctgtatccaagataaaggagccttcaaccatcgagtcacaatctgaaacatccacttcgaccaactcgattgatgaaaaagttaccgaggcaccataagttgagaatgaagaaattcagactctggatcgtgccacaattctgttcagggatggttttgacgaagactacgccaacaccctgaactatttcagtaaaaagaaaccaatcgtccccttgccacctcgcgatcctatggaactttggttcctaagggaaaccgtttgggagctgacatccataattgtaacgccccgattttcgtttgggattaaaaatcatttcataatgcatttcctagaaattaaataaaaatttaagctatttattcaagtgaattaatgggagaattaaaattctcccttaaaaatcattgtccgagaatattttgtaatattctctgtgccctaaaatactctccggatttttccgtgaattttcggagctcaagaaataattttaaagtcacaaagttcattaaactaatttaaataaaaagaaaacaaattaaaatcatccttcctctctttgggcccctttcggcccaatccctcctttcccttcctcgccccgcttgcccctctccccttcccctccttccccctcccgggccgtcggcccagctcgctcccgttttcccctccctctctctctccgacaggtgggacccgaggccccacctgtcatccccttcctccggctccaaccggcggcatggccgcccgagccaccccacgatgccgctgtttccgcccttctcctccaccccacgcgcgtgcccgccggccgtgggaccccgccgccccacgtcctccttatcccccacctttcccctccaaaaccgccgcccacaccccacgctgccggcggttgccgtccacgctgccggcagttgccgccctgactccgcctctcccgggctcggtccgacctctcctcccctataaaaacactccccgcccttccttctctcatttcccccaactcccgagcttccccgcgcccgaaatcgcgctcacgacgcaagtccgagctccgccgctcatcgccgtgctccggccgccccttgcggccagtcctggccacctcacgccgcgcctctgcatccactgcgttcgccgcaccgcgtggaacctcggccgccactcctttttcccccttccaccccgaaacaccgttcccaccgtgcacccgagccgccaccaccttaaaccgcctcaagccgctcactgccgtcgcctcagccatcgccgcactgcgccgccgccaccaatagcttcgctgcgtcatgccgcacccggtccaccgctccccttccctaatccattgccgaaacgccgccgctacattcaccatctctctccgccaccgtcgccaactccaaccgcttcccgtcggcgagcaccgctttgcccgggtgcgccactgcctcctccacattcgccgcgccccaccgcacctcggccgccgcttttcatgccgttatcccaccggaacacggtattcacgccgctgggagcctcctcaccccctcctaacctctacctcatcctccccaggtccttccggccgccgtcagccggttcgcgctcgcggaacgccgccgggccgccgttccacctttgtcccgaggagcgccgctgctgagctcctctcgtcgccgcgtccttggtgagcaccgctctcccttctgccgtttcccgcgccgccgctcgccgtcaatggccgctggccgtgcgccgccgcctctcagccgtccagctgtgagccgccgctgcccctttggcagtgcaccaccaccgtggactcagtccatggtggaccaactcctttgacccgctgatgagtaggccccacgctttgtggacgtggtccgcacccctcctcttgctgacgtcagcaaccccttttcctttggaaaaataattaataattgcgtcataaatagtatttaattatagaaattcatttaaatggctcaaaacttctaaaattcatatctaattcatatgaactccaaattgggccattcaacttgcaaaattcatctaaaattgagctttacatgtttgtttacttttgatgcactgtttgcttggtctttattagagtttttccttgttttgcgtgccagcgtgtagaatccgtcgtttcggaagtccgcggtcgcgaggaaaagagttcggaagattgtttgaagaagcaaggcaagtcacacattcccgttgagcattttgatcctactttacaagtttttaccgtttgcaaataaatatgcatcgtttgctaattacatgggaatagagtttccctatctgctcgcttgtgccatgtttacttcatatttgttctttgtcaaccgtgggtgaaaattcgactagcttgtgtcacttgtgttgatctagctagaactatatgcttagccatgcttaattaccactatctcagttgatgggataattgcagtattagaccttttagtatcattacaagctgcgtgctcgagacacccgaacatgtttcattggtcgtaattatccaactaaaatgcgactgaatggtgggctgtgggtgcatggttttgcgagtcgtacccatggcaattaaggtccggttcacgggaaaccatagaaccggtggcgagagtgggcgtgatggagttgggtcggccggggtgtccggttgtccagctgctggattcaccacggtgcacgaggggactgcctgctgccttgcgaggagtgggggtgaaaccttagcgtggtgtggatggttaggggagagttatatgaagggtcttgtcacaatcactcgacgtggtgacgtgttcatcatgggtgcatgatgacgcggtgacatgccggtgaattgtgtcttgtgggtacggttgtgcacctctggccagagtaaaactatttgaatagccgtgcccacggttatgggcgatcgaccagatttaccgtgattactctcacacttaataaatcgactcaatgcactgtagttcaggtgggttggctgggcctgttcaacatggtgtagtgttgatcagtggagatttaatattaccttaattactcaactgttttactgttttgctcaataaaatgttttacaactgcctttaagcaaatagccacaagccattcttgtatccccttgcacgtctgcatcgttggtgtggcttgctgagtacggtggttgtactcagccttgctatttcccccttttcagaagtgttgtgcttctgagctgaagacggagttagaggaccaaggctcagacctcagttgagttttgcctgtggagtggagctgaagccccgctaggatcgccttttgccgctgctgctgctttcatttcggtgtgaggactaagtgcctcttctgtaagtattttatgctttatttacgtttggaactgtttattacttatcgttttgtgtaccctggttggtcctggacagggatttaatacacaaaatagtctagacatttgggctaaatttttgggcgtgacaataatgagtgacgaatgatcaaggtaagcagagatttcatccgaagtaattctaataaataccgctccccgagttattccttgtcacctagaagggaacaacgttggtattctatacagtccaactgtcggggttaatctcgtctcggagtcatttgcattcgcttacctgggcaataaagctataaccctagcaaacaaattcttcaagcacccgaatggaactatcattgaaggatttgggattgtgcaagacgtacctgtctgctttgaaatccaagattttgacattctaattgggcctccaattgagcaactcctcataaatacacctcgattggacagcctcaagataactttgggagggaacgaattctcagttccattctcacgggcaaggatcaccttgaccgacactctcccagagaacgagtttgcagaggaggttatggcagttccccctcacgagtctcccgagacccttctggaaaatgaagtccccaacttcatcaaacaagaaccggagcccggtgagactgacgaacttccaatcatggaactgccgcctcgacctccacttgagcttaaacctctacctgaaggcctatgctatgctttcttgcacaatgacaaagaagcccctatcatcataagttacaagctttctgaagaggagactcaacgtcttctgtctgtgttagaaaagcatcgcgctgttcttggctattccctctagggtctcagagggattaatcccgcactttgcactcatcgtatccctattaagcccgagagcactccctccaaggaacctcaacgacggctcaataatgcgatgcgtgaagtcataaagaaagaggttctgaaactcctgcatgctgcgattatttatcccgtttcatatagtgagtgggttagcccggtccaggttgtgccgaaaaagggaggaatgacggtcgttgcaaatgctcgaaatgaacttatcccgcaacgaacagtaaccggatggaggatgtgcatagattgcaggaagcttaacaaggcagaaaaaaaagatcattttccgctacccttcattgacgaaatgttggaacggctagcgaatcattctttttctctgtttcctggatgggtattccgggtatcgtcaaattcccatccatccggaggaccagaccaagactacgttcacatgtccgtacgacacctatgcttatcgtaggatgtccttcggactgcgcaatgctcccgcatcttttcaaagatgtatgatgtccattttttcaaacataatcgaggacattatggaagtattcatggacgacttttccgtctatggaaagaccttcggtcattgtctactaaatttggacaaagtctttcaacgatgccaagaaaaagacctggtactcaattgggaaaaatgccattttatggtccgcgaagggattgttcttggtcatcgagtgtctgagcgaggaatcgaggttgatcgtgcaaaaattgatgtgattgatcaacttcctcctcctgtgaacatcaaggggatccacagcttcttgggacacgctggcttttatagaaggttcatcaaggacttctctacaatcgcccgacctttgaccaacctgcttgccaaggacgctccctttgggttcgacgatgcgtgcctaaaatcctttgaaattctcaaaaaggcactcgtctctgctccaatcatccaaccccctgattggacactacccttcgagattatgtgtgatgcaagcgactttgctgtcggcgcggtcttgggccaaaccaaggattaaaagcatcatgcaatctgttgtgctagcaaaactctacccggagcttagttgaattatgcaactgctgaaaaagagctgctcgcggttatttttgctatcgataagtttagatcttacttggtgggagcaaaggtgataatctacactgatcatgttactctgaaatacctgctcactaagaaagatgctaaagcacgtcccttgagatggattttgctgctccaagaatttaacttagaaattaaggataaaaagggagtagaaaattccgtagcagatcatttgtctaggctgcagattactggcacacaggaacaaccaataaatgatttctcgagagatgacatgctgatgacggtgcgcgactccatcccgtggtatgccaacatagtgaactacatggtatcaaagtacataccaccgggagaaaatcaaaggaagctgaaatatgtgagccgccatcatatatgggatgagccatacctatacggggtctgctctgatggactgttaagaagatgtgtgccaactgaagagggacttaagatcatagaatgatgccatgcctcgccttatggtggacattatggtgcattccacacccaggcaaagatttagcaatgtgatttcttctagctgacgatgtacaaagattcaaaggaactcgtcagaagatgcccaagctgccagaggcaaggaggaatcactgctcgcgatgcaatgcccctcacatacaacctacaagtcgagatatttgatgtttggggtattgactttatgggaccctttcccaagtcccgtaattgcgagtatattgtggtgatagtcgactatgtctccaagtgagttgaggctatgtcgtgcagcgccgcagatgcgaagcatgccaagaagatgttcacataaatcatcttcccaagatttggtaccccaaggatggtcataagtgacggaggttcgcactttatcgacaaaaccattcgagacctcctgggagacatcgcagccaaacacaacgtggccacaccttaccatccacagatcagcggtcaagcagaaacatcgaaccaacaaatcaagaacattctgtaaaagacggtcaacaaaatgggaacaggatggaaggagaaattgccagacgcactgtgggcataccagacagcatacaagacacccattggaatgtccccctatcagatcgtctaccggaagtcatgctgactccccgtagagcttgagcgtagagcatactgggccatcaggaattggaacatggattttgagggagtaggagaatggagaaaaatgcagttagcagaactagaagagtggagagaaaaagcatatcacaactccaagatctagaaagaaaggatgaagcgctgccatgatgaaaggataaaaattaagaaattcaagccaggaggcaaggtactgatgttcaactccagggttaagctgttcggccatggaaaatgacgaagcaaatgggaaggaccgttcaatgtcatcaacactgcttcgcacggagcaatcacacttcgtgatgactcaggtaacatatttatggtaaacggtcaacgtttaaagactttccttgagccgaatgaaactttagatgaagaagtggttattattgaattaattgattatgattgatttcctgtatgaaactttaaagactttctcatctaaagcatgcttaatttcctgtatagttgtcatttttgtgcttagcttaggattgtgtggggccagaagaaaattggtggccagccggactcgtctggttctgccaaaccagggtggcgcccgtttggtcccattttcgacaggttgtttccaacgcgcacttgtagtctattgtgaggcgcattcggaggtacatcgactgtatcaaagctcagaacaccttcttcctcctttcctccacctttgcaaattcccttctccaccctagctcaattccttgagttccactctcaactcactaatggctggcaaatctttgatgccctatattggctcttcttccaattccacttataacctcaacggagagcccactccggccaaccaactcatccccatcgaagattacaccatggaaggattgaatgctgtctggacacaacccctcgcgatagtgctgggctcccctgcaaatttgtagcccattggcgagcttcctgcaaatttgtagcccattggcgggcttcctgtgggcataccggcagcttcttcgtgagggggattgtttgtgccatctgggcccgtcgggtcaggcttattgaacatcggttctgtgcccgagggagctttcttgttcatcatctttttctttgcgcgttcttcaaatggaacaatttgaaactcattttataattgatatttcatacaaatccactaaaccaacgtaacgccacattaacttcgtattctgtgatggtttgctagacctctatctcgtacctacgtttgcctcgtggacagacacatccacgttcaacaaggctagagctgatgaggtctcgacctcaacgttaatatcccacgcgaacgggctatcgttgtcgctatctgaagatacttaaaatgatagccagttcgagtgggatactgatggtgaggccgggacctcatctgccccggcctagaggaacgtggatgctacacatctgtcgatgaggccgacgcaggtagaagacacgggcaaccaaacccccaaggtatcttatttgattatagacaattgcactgaacccctaacgataacaatattttagacatatctgatctgaacgaaatgttctagtttccaatgtgtaattaccgcctcctaaaatgcacctacttgtattcaccgaattagcctaatttaataaattgcatcaataataaaatttcatcacaaattgcatctcactaattaaatcctattcaaccacatgtgtaactcagatcccctaacatcacaattccatctcatatactgtaaattaacaaagtccaattaattacatcataaatactctaaaatgtagcactcacaattccatcacaaattccctaatttaacaaagtccatttatttactctaaaagcacatccttaatatcatcatcatcttaacattacaaattaacattcaaaatcgcatctcgcacaaataacacatatatcacacattgcatatttcacatattacatattgaataattttaaaaagccaaaaaaggcttaccggcggccggcggcttggggataaggtggctggcggcttggggaggaggtgaccggccgctgcttgaggccgatgtggccggccgttgcttgggggcgaggtggccgacagcaggttggggatgaggtcggtggcggcttgggggagttggtcggtgccagcttgggggagtaggctgtcgtgctcagtgaaaaggccggtggggtcgtggaggtcggcggcgcgggggacgtggtcggtggcagttcagggagtagatccgcggtagagaagacggcggcagaggcggcgagggggatggaggagagggaggcggcagcggcgagagggagagagaagagggaggtggctgacggtggcggggaggggggtgaggaggcgcacggcggcggtggaggaggtcgacgagtggaggaggtggcagtggatgccggggaggaggcggaggagaggacaaaggccggggagggggaggaggccgagagttggcggcgggatggatctggccggcgtcgagcaggtggcagccgggaacaaggaggagagtaggcagcggcagcgtgggcgagaggaggcgacgagggggtgaggagaggaggtggcagcagcaatggatttgggcagcctggtggcatggctccgaaaaatttcaccaggacttaaaaattttcggagcccgcccaagcatatgtagggcgaggaggggatttttccgtgtgcgcgacatagccaacccacacggaaagatattttcccatgcgggccatttatcccacccgcacgggataatatgttgccctaaaaagtaattatttaaaaaattattcaatcatacttttataataaaaaatcacaacttaatcacacttgattttaaattgttccaccatatgattaattaaagaattagttaaaaaattgttcaaccatatgggtaattagtttactaaatatatttatagttaattaaagcacaacttaatcacacttgattttaaatcgcatctaactaaatataatcacaaataattaaccacatatgatttttaatcgcatataattcaatcgcttgcatattgattaaaccaaaacttgaaaaatcaatataattattcacccatataaattgagaccgacatatattagggataaacatgcatggaaccgcgcattcattcggaaagaccataagtttgttccattaatcgtttacaaaataagttgtacacaccaacatatgtactaatgtttaacaattttggaaacatcatccgtccgcacagtcgagaacttctcttcgtcaagggttgtctcaactcgcttgatccggttaggaagatctatgaacaatgggacatcgtcgtattggttgtaatctgacgtgtcttcaatgttatcaatgccaatgatgtgttgctttcccggtacagcaatgaccatcttatcatcagatgggtccttcacatagaaaacctatgcaacacgctcagcaagaacccatggatcatccttgtgtcctagcttgctacgttctacaaccgtaaggctgtagttatcgatggatacgcctgttgtgtctcttacccattggcatcgtagcaccggggtctagatgttaaggccatagtcaggctcctaatgtcttttatgatcccatagtaagacttcttctagcctgatgcgtcaaacgcctccacccgaactccgctattctgagctacgcttttcttgtccttacatatcgtgtaaaacctatatccgccaatatcataccattgccatgaggtcacaaggctagttgggccatttgctagcatgtgcaatgttttttcctcgagcaattcaccgaacgacagctctttctccttcaaccatttaggaaatttacatttctattccttagagatccaagtggccgtccttctagggttgcaggctcttatctcgttcatgtcttcctcaatgtacggctcgacgatggtgagctattgcaacacgctgctatgtgcttccactacagcattgtagtcctcatcatagaaccttttcttgcctacaaacctcgtcccagctaaccgaccgtcatgtacaggggggttataccaatgggttcagcgtccttcatgtagtatatgcagcattcaaccacctcctcagttgtgtaccccaccatcttttttcctaccctcttgttgccatctcatcaactcggcatctgtacggttcgaaaatagccacttcaggcaatctttcacaggcgggtaccacatcaccattctaggaatctttttttttcatccaccgatgcatcttggtcgaccacctctccatcggaggctccgttgcccgtcttgtaccgactcgtctcacatgttgggcaagagtctaaatccgcgtattccttgttgtacagtatgcaatgattttcacatgcatggatcttctgaacacctagagataatggacatatcaatttcttcgcttgatatgtgttccttggcaggaggttcggcttaggaagcataactctcagaagatccatcaaatcattgaagctagtgtccgaccattcatgtatggccttcaatctgagaagttgtcacgcccagaaatttagcccaaatttccagattattttgtgtattaaatccctgtccaggaccagccagggtacacaaaacgacaagtaatatacagttccaaacataaataaagcgtaaaatacttacagaagaggctcttagtcctcgcaccaaaaagaaacgacagcagcggaaaaaggcgatcctagcggggctacagctccactccacaggcaacactcaactggggtctgagccttggtcttctaacttcgtcttgagctcagaagcactacacttctgaaaagggggaaataatagcaaggcttagtacaaccaccatactcggcaagccacaccaacgatgcaggcgtgcatggggattcaagaatggcttgaagctatttgcataaaggcagttgtaaaacattttattgagcacaatagtaaaacacttgagtaattaaaataacattaaatctccactgatcaacgctacaccatgttgaacaggcccaaccaacacacctgaactacagtgcattgggtcgatttattaagtgtgaaactaatcacggtgaatctggtcgatcgcccataaccgcgggcacgactattctgccagaggtgcacaactgtacccacaagacaatccaccggcatgtcaccgtgcccggccggacacgtcaccatgtcaagtgattgtgacaagacccttcatctaaccccctctaaccaagcataccacacctcaggtttcatccccgcccccaacaggcagcgggcagtcccctctcgtgcctaggcgaatcagaaagccgcataggccgtcgcagggcccatccgaactccatcacgctcacccttgcctggatgcgtcagccagagaaaagctatacttcaagtcatgcaattacccattcccgcttgtggcaagcgttgtatgtcttctagtgcatcccgcgaaccggtccttaattgccatgggtgcgactagcaaaaccatgcacccacagcccaccattcagtcgtattttagttagataattacaaccatgaaacatggccagatgtctcgagcacgcagctcatcatgatactaaaaggtctaatactgcaattatcccatcaactaagctagtggtaattaagcatggctcagcatatagttctagctaggtcacataagtaacataagctagtcgatttattacccaatgttgacaaaggacagatatcaagtaaacatggcacaagcgagcagataggtaatccctgatcccatgtaattagcaaaacatgcatatttatttgcaaacggtaaaacatttataaattgggatcaacatgctcaaaggggaatgcgtgacttgccttgctccttcaaacaatattctgaactcttttcctcgcgaccgcggacttccgacacgacggaaactacacgctggcacgcaaaacgaggaaaaactctaataaaaaccaaggaaacagtacataaaaagtaaacaaatatgtagagctcaactttagatgaattttgcaagttgaatggcccaattcggagttcgaatgaattagatatgaattttagaagttttgagccatttaaatgaatttctagaattattatcgaattattgcgcaattattaattgttttttcaagggaaaaagcactgctgacgacattaaaggggaagtgcgcgccgacagtggaccgggaccaccgaggcggtccactggtcagcgacacaagggcgccggtccacgggaaccgacggcccagatcggtccaaagacgatcgggcggccacgaggcggcgtggttggggcacagcacggctcaggccggcctagccgagcgacggtgcgctgcagcgtggccaccgacggcgacggccgccgacggcgcgggaagcggcgacgcacacaggcggcggcggcgcacatgcccagcgaagaggagggaggaggggctcaccgagcgtgcgggctgacgaggcggagcgggaggtggccggtgacggggagaggcggcggcgctagtcggggaggcaacggcgacggcggtctggcggcgttccgcgagcgggaaccggcagacggcggctgcaaggacatggggaatgcaatagtatggttaggaggatgggagaatgcatgagacaacgggaaacaccggccgaaggcgaaggaattaggagagctcaccgacgcgcgaggggagtggagccgaggacctcctcatccttgtggagccgagggaggcaacggcgcgggtcggcgtcgaccgaggtggcggcgcgacgcggctggagtcggcggcgacggcatatggtggaggtggcttgggatgcacggtggaagggtggttgcggtgatgaaatggggaaacggagcggaggccggggtgcggcgaggcacggcgaagccggcagtgcaagcggcgcgacgcagcggtggctagggtggcagctagaggcggccggaggaggcaaaagcagcggcggctcgggctgcacgtggacacggcatcacggcggtggttaggggaaataaagtggatgccggggtggagcttgggacggcgaggctagaggtggtggcggcgcagcgcggcgtcgtctggagcggcgatggcgtgcggctggaagcaaggcggcgagcggtggagctcgggctcgcgcggagagagcaggagaaggcgcgatgggctcgggaaagagggcgaaacggaagaggagagcatggggagggtttatataggctcgggagggtgaaatcgttgccgagaggggtgggatcgggcggcaaccggccagcgacgtgggacgccgacatgggcaaagtggagctcaatttgactccaaaaattgggggaaaagtgggggaaaatgtggaggagttggtggggaaccggtttcactcggtttgggtgcgagggcgcgagcgggagggcgccggatttggcgggacgtgggcggcaaccgccggccatggcggcttcggcctgggaagctgaaggtaggaggagggcctgacaggtggggtcgccgggcccacctgtcggggagggagagagggaggagaacccagggggttatttagactttgcgcgaggggaaggaagatgggtcgacagcccaaggaggaaggaaggaataggggaggggacgggccgaggggagggaaggagggctttgggccggaagtggcccaaagtgaaggaggcgagatttaattgtttttctttttattaaattggttaaatgaactttgtgctatttaaattatttcttgagctccgaaaattcgcgggaaatttcagagagtattttagggcacaaagaatattacaaaatattctcggccaatgatttttttaaaggaaattttaattctctcattatttcacttgattaaattgctttaacatttatttaatttctagaaaatgcattatttaatgatttttaatcccgaacgaaaatcggggccttacagaagttcaagcacagagcgcaacaccatatagttcttgtcgcatcctttcgcttcgtcgtgaagaagttccttcactattttttccagcgcttcctaattgtccaaccctcgtcttctaccagttaggacctctggttcaacatgacgcaacatatgttccagatcaaaatcaatatttgtatcgtctataccagagccaccacattccaggatcgttccctgtgatatgtcttcgattataaattttctgcatcatcaaagcaggaatcttcagcctctttgttatgaccggcgacttccccatgaagagtccatatcttgtaacccttcttaaatcctcgctctacgatgtgcgacaatacatctttcggtatttgcagcaacatttcgttcttgcaatctttgcatgggcctcacagcatgtgcctttgccagcttaacaaatttggctgcttccttcaagaacgtcggatgagctctttttgtgttgtacatccatgcccgatccatgacctagaatatatcttgtcatgaatacatctgtgcccgattcaaaaacgagtgtatttaaatggagggaattaagcaaatagtaaattaaagttttacggacaatttaaacaagcgtacacgatttttaatcattaataaaatattgtccatttctaaacaatgaaaaaattcatccttttatccgaaggaaaataaatttaatggaggcaaacccaacttttcaatttgggtactaaatacttttaagaacatgtaatggaaacattatatattagctaaaaaataaaaaaacacaaaatgcatacactgttccatttaaaaagtggaaatttctacgcattgcaccgatgaaaactgacaaaaatggaagcaaatgaaggaggagaacaagctctacaccttttatacagaacccaatcaaaaattcgagatccttccccctaatttgtgtatgtttaggagagagaaaacgccggaaaaaatgggattgtgtcgggttgagggctatatagcccaacgaccatcgcatgcggtcggcttatgttgcccgcacaggataatgcattatccagtgcggccgacagcccgacgccgatccacggattttactaggcagagccagttcgcctggaaactaccggggccagtgtccaggaaaatcaattctgtagtagaggtagatatattcttgggtttttttttttttgtcaagttcttgttgaatccgagtaggtctcctgcagcctttttgaagtaggtcatggccccccttgtgtgattctttacttagagtagtcttcctgtagatgtacaggttctatatggatatctagcattaccctatgtcacaagggtataccttatttttatacaccaacagtattgtacgaactctcatgtattattatacagttgagtgaacacttatatgcctaaattttatccttttcatatatgtgcatgtatggcatcctagttagcatctatctccccaggattagccatagcttatcatgcatgttgggcttttgtttgcatatggtgcacaagttcatgcaatggaaatctagagactacaacagatgtgggctttctggatggatgccctatgacaaacatgaaatatgccattgatctataatgaattcataaaaaaaatcatcgtaaaattcaccctcggccaattctaatgataactggatatcttgggcataagatatgttcactgtgacaaacatgatcgtcataaccgcaaggattttatcgttagcagttggtaatgaagaatttatgaagaattctaaaatttatgtcacaggtaatcacgcggtaatgaagaacttatgtcgcagataaaaagggcattgtgatgttggcctaagtgtttagactagtgagatttggggcgttacatatatgtcgtggatcctgatcggtacattataatgttggatgataatgcggctgataaatttatttaatacaacaatttctctaaggatattattacagcatagttttcatgggcttgtttcgatctttttttaaaaaacaaattaccatttgttggtaagacgaaatttggcaattctaaaattttggtaagatcaagatatgaaggatgtgtttagtttgatactagttttatgagtacgagtttctgtaattaccaaatgttgggggggatttgaaatgttgtgatggtgacgtctcgtttagtatattgccttactaaatattggcaatgtgaaaatttgatatggttgaatttagcaacaaactgaacaagccatatattaaaatatttggcaagatgctatgcatggctgcctacatgattaatattgaaggggtccagcaccacaataatgcgtctatgtatattaatgcaaaaataaatatttaacaaataactaaaattaaccatggaaatatatatatttttctcgctcttatctaaattgctaaatattttatttgcatatcaataccaatttttagctataaaaggatcaaatttctctctttttcctctcctaagtaaatgttggaattaaaagttaagccaatctatgtctttttttcctcccctattatttataaaaacatcatatttatactagtaagggatgagtgcacacattcaacaaggatgccctatacaaatgtgatccaaattgtgctctaagttacaaaaacgaagatagctagaaaaccatggctacatagatccttcacatcgaaccatagctagaaaactacataaccaaggtagcaaagtatagatgtaattttggaaaccaaaagccaccaaaagtttcaagttcaaaacattactagtatattttgcttattttagaatagagaatgttcaagcgaaatgaacagctatcagggaaagaagaagaatttatgggtctattttagtaggtgatcagcttaagacgccgcatgcggtatctgatcttcttaggtggtcggtttaaggtgacacctatcgtaatgtatcttcataggcggcaccttaagtaggccacctatggtaatttatcttcagaggtgtctccttagacatatcttcgcagttggcctgctataggatcccccgtccacaactacatagacatgcgtttgttgctggcctgccttagaaaaatagatctcgcggtcaaaaattattttcctattagaggttataactttatgagatccaaacacgtataaaaatctcagtgtatcaaagtcatgccatcacgtatatataatatgcaagcaggatcctacgtataaaaatttccagagttcaggctatgattcaatgccatgtgtgtatcgggttgtgtcaggtgaatgggacatttcgatgtcggcctaaatgtttaggctagcaagatatctaggagttgatcatgattttggtacattgtgatgttggacagggatgtggtgataaatttaatacagctatttcttaagacaattattggagacaatatatctttatgttaaaaaaaatggtaggatgcatggcagcctagctagatgattaatagtgaaggggtccagcaccacaataatgcgtctctacatattaatgcaaaaatatgtacactactaagggattagtgcacaccttttaacaaggattacctaaacaaatattatccaaattgtgctctaagtagcaaaaatgaaaattttttatatgtgtacatacatatgtaacatattttttacggtaaatacatatgtagcatacatagatccatcaaatccaaagcataaaaatgctagaaaactacaaaagcagggtaggaaagtatggatattatctttgacgtcaaaagacactacatattcgagttcaaaaagttcctcctatatattgcttattttataagagagaaagctcaagctaaatgagcagctctcgaggaaagaaaaaggcatcatagatcctttttagcatgcagccagccaccataagccgccgcctacagtaactgatcttcaaaggtgactggtttaaggtgatgcctgcggtaatgtatcttcgtagggagcacctcaattaatccacctacggtaatttatctttagaggcgaaacttcaaatgtatcttcccaggtggcccttgtccacaactacgtagacgggcgtttgcggccgaaaatttgaccagtcatgctgagtaaaatagctcacctagtcgaaaatcatttttctatcggtggttgttactcctcggagatccaaacatgcataaaagtctgtgtctgaaagtcatgtcatcacgtatatatcacgtatacatatatatatgacatgcaagcagaacacggggtatacaatttagtgttgtgatcaaacatatacgaggcactagctagttagatcataaggacgacagaatgtttgcccctactagaatatatgatctcgcctcatcttttatttgcaccatgatactgccggtatagagcatgatctatttttgaaaaaccatgtattcctgtctttctgaacatcccaactgatcaacatgatcgccaatgttaagtccttctgacattctatctcagctaattgagtcatcactatccaccatttgaaaaacatagtgtgtgtatgctaattacctgtttcaggcgttgttagactatacaattgtttttccatactatatatatacactacggttgacaaagacatcccaacaactaaagataaatgacaaagtttttttccacaatcattactctctgtatatggcatcccaacaattgaagataaatgacaaaccaataaaccatttgtttttttccaccaatcattactctctgtatatatatagccttagtccgtatggagcacttgataagcttgtatgctaaatctccttcctcttccaacatgactcttgccaacattcctgagataatggaatctcttcccgtagagacgaggttcacagagtttcccttgcgacaatatggtggattttggttattggaggtcatgctcaatggcgttgctgcagctgaaactagctttcaaccgagaccatccgacatcctcctttcaagctttcctaagtgtggtaccacctggctcaaagccctcgcctttgcaaccctgaaccgttcgacttacccaccatcggatgaacatcacccgctcctcgaacacaacccccatgaccttgttgggtttcttgagatttaccccaagctcgagttgtacgagtcactcccatctccacggctgctctcaacccacctgccatattcgatgctgcctcatcgcatcagggaacaagaaacggggtgtcggctagtctacatctaccgggacccaaaggatgccatggtctccatgtggcaccagaacaagaaggagaagaagaataggttgacgttcgaggagatgttcgacatgttctgtgaaggacggtgtgttgtcggcccgcagtggtgccatgccggtgagtactgggatgagagccaggcgagacctgagaaggtgcttttcctcatgtatgaggatcttctgcaagatactgtgggcaacctaaggacgctggcggagttcatgggctgtgggttctctcgccaggaagaagatgacggtatcgtgcaacaaattgtagaactgtgcagcttgaacaacctgaagaacttgaacgtgaacaagagtggaactacccttctagggatctccaaagatggcttcttcaggaagggaggaaccggtgactggagcaatcacatgtcaccagagatggcagcgaggctggacaagatcgttaaggagaggctggagggttctggacatccaattatttccaggatcaatgcgaaagcaacaacttcgatcggttcatccaaccatggtgcttctgaagccaaatacattaaggagtaacaactcggctggctaattaccgtggctcatggtgctgtggattctgtgaagaccaggatctgattgctttttcattatcatttcagtcctttgtattccttgtgtttcaagtgtaatatgcccttcttttgggagcttctttgcaaaatcaactgtaccctcagttgctacttgctatcagggtttcccaaaccgctggggccagggttaccgtgtcccggcggtaagcacggttaccgcgcggtaatcgtggtaaccgtgaaaaaccgtacaaaaccgtgtaaaatttatcaaaaattcaaattattttttaaatttatttgaatttaaggaggttaccgcggtatttatattaccgtacccccgtggtaagcccggtaaccgcggtaaccgcacgtttaccggcggtaaaggaaaccctgcttgctatcgaataaatgtactgctgaggctgttgcctcagtttatgcttcaagaaaaaaaaaagaagtggaggtgaccggatgagtcaaccggttactgtacttgtgttttatagtactctctccgtttcacaatgtaagactttttagcatttttcatatttatatagatgctaatgaatctatacatacatatagtctagattccttaccatctatatgaatgtgagtaatgctagaaaatcttatattataaaatggtggaagtatgtaataagtgtcggactatagctatttatgtaagaataaattaaaatacctcaaataaaaaaacaattatctcaatgttgctttgttagaatggtttgtactcttgaaaggagactatgagaatgcgaaacttttacgaagtgtacaagaacagtgactacgtaaaaatttcacgttttgagtaacctgttccatcaaatttaaaaactgtttaatcagccttccgagctaaagaactgggggaatatgtggaaaattgctatgggcctatgtgcaatatatatccctatatacatgatgattgataggcaatccacaaagcctatcaatcatcagtgcaaatatatcatggtttaaatcaatagtttttcattttaaaatatatcatggtattaattgttagacacgacgtgaccatttgtcaacttaaaaaaattagtgcaaacttgtgcttaacccatcttcaatgataaaacaagtccaaacaaaataactgacacttatattgttttcttaaaagaaacaaatggttaacgtcgttaaacttcattaattactttaaaagcgtagtcattcttcttcactacctttagggatggcaatttcccccgcagggccgggtcccctgcggggacccgcccctacgggggcgggggcgggggcgatttttgacccgtgggtgcgtcggggacggggccccgcatttgggcggggaggggacgggggactgatttcacctgcgggtgacccgcggggccccggggagtacatatagacctcaaaatatagatcaaagaaagcccaaaaagcccagcccactaaaaaaatccttaaccctagcagcactgcagcagtgcagcacatccctcagtctctctcctccccacatccattcccctcccctcccgtcatccactcatcccgtgcggctgtggcgtgagccgcgtgacctaggcggcggcgcgcgctcgtgggcggctcgccggctcgcctctggatctcgccctctcggcgtcgccggcgcctgccagccgccaggccaccatctcctct

SEQ ID NO: 72092 - DNA, 6706 bp, Oryza sativa
ctctccccccccttgctagcttcacatcaaagctcactatcgctcgacggcgacatcgacgatgagcgagacgacacggccggcggtggcgcgtcctgcttcccggaccacctcctccggttcaagtggcggtggtgcctctgcggttcgtggccgagccggtgacggtgaggtcgtgcggccccgccgacgccgacgcgcgtgacctcatcgcttgcctcttcgccaaggaccccgccgcccgctttggctcccgccgcggcgctgccgacatgaagtccctaacgttcttcaagaccctcaacctcgccctcctccgttcgtcgcggccgctcgttgtccttggcgccggcgccgcgccgctgcaccggtcgtagtcgtgcaaggcggcgccgacgaagctggcctgcctagagtacagagagaagataaagagaggaggaaagagagaggaagggagaggctggcctgctgacgtggcatcctgacatgtggggcctacactgactcagctgccatgtcggacaaaaccggagtcaaaaccgccgagggacataatttacactggttttgtaagtggggggacacgttgtatctggttttgcggttaggggatgattttgtaatttgatgacaaattgagggaccttgggtgtacttttggaggcagagtcggcggagtcgaagagatggcaacaagggaccgctccggcaccaagcgagaggagggcgtcgacgaccacgacgccgatcgcgaggtcctcgggcttggggtcgtaatagacgaccccatgaccacccgaggcagctctggcgctctcttcccatccttggtatcttcctccacatagccgttgccgatcattgacgcgtcctcgttgggttctgtcccagcctcagcctcatcagctccaccccgccgctccgcccatccctctgctccaccccaccactgtcccattccgctgcagctccatccaccgcgccgccgtcccgcatgctctggccgctgctcgtctcgctcagccagccgctacgccctgcccgtcgcctgctccaggggagagagaggatagagaaaataatagattagtgaggctgacatgtggggccacatgagccccaccatttttttttgatcaaattgccacgcagacaccacgtcagccaaaaccggggataatactgctgagggacctcatttgcatggctttgtaagttggagggtgcgttctatccggtcttgtggtcaacagacgaatttcgaactcgacggcaaattgaaatgaacttaatcctaaacttttcctagtacagaattaggcggccctagaaccgtggttggggtggtgggccggggtgttacgttaatgggccgcatcacctgtaaaggtccagggcgtgaggcacggcgaaggtgcgtgcgtgcgtgcgaccgacctgaaaatccaaagcactcgcgtcgccgcggcctctccctccctcctccgatcgccgacgatggcgcgcgccgccgccgccaccgccgcggcgatcgctccgcatctggttccggtgattcggggcgccactccggtgagttaacttggtcgtcgatccgtcgttttcttccggcagataaaccctaacccctaatttttctttttgtgcttgtcttgtacttgtcgattcgatgcagttcgctcccgccgccgccaccgccgcggcgatctctctgcatctggttccggtgattcggggcgccactccggtgagttaacttggtcgtcgatccgtcgttttcttccggcagataaaccctaacccctgaatttttttttgtgcttctcttgtacttctcgattcgatgcagttctcttccgccgtcgccgctgccgccgccgccgcctccaccccggcacggtcatcctccgccctcacccagacgctctctttcccgatccaagctaccagggtaatattactgctctaattgccatgtctatctgctacctccgtcccctaatccaaaaatataggctcccttatatttcttttttgggacgaatgaaacaaagggaatcgattctgtcacacgggtggatttgggtacagtaattgtaaaccaaaccctcttgctattctgatttgctactactgctctattgagttgagttgatactagtaattggattggatcattttgttattgttgcgtgtgcttgcctattttgttgaacaaaattcctggttattgctgctgcactattcctccgttaaatgcgcctaacttgttgtttcttgttcagtccgccgccacctccaccccaccatgggcttcctccgcactcgcccagccccgctatttctccacaagagctaccagggtaatattactgctctaattgccttgcctatctgctacctctgtccccaaatccaaatatgagggattttggctctgcattcgcattgccaaaatcccttgtatttcttttcggggacggatgaaatcgattctgcatttgcatccacgcttcctaactggatgagagaggagtgacctggagaagctacctgtgacgctggaagttttacccctgttttctgtccctagaagttttgcccctattttctgtccctagaaagtcctgaagttacctaaagttgcattttgatctctctgtggttgaagtcttgctgcgctgatcatctgtccttcttgccacacgggtggagtctgcttttagtatttgggtacagttcttttctgattaagattcagattttatccgcactcaccctgtcctgctatttctccacgcgagctaccagggtaatgttgctagtttaatattttatatcactattttggtgtgatttgctgaaaaaaagttgttttctgatttgctacaagaaactatttgataggattttctaaagtgatttatattgctatgacactaaaaatgattgtttgaactagcttttatctgacaacatcctttgatttgctgaaccctagtttaaagtgccaattagtgcaaagatatgtagtgttgagtgaaaagtttggtttggcttttgtaccttgtgaagtttttatgaaaaattctaagttatttgcacatgtgcatatgcatgtgttgacgctgttgtcttcgcatggttactcgcatcttcaaacaatttcttacaaaaatattatcaaaattatgtatgttatggccgttaggtgcttgcgtgattaattttgtatgatgcagatcatatattaaattttatatgtatgactgatatgtggatcgattttaattatggcctttatatattatgtagttagcaagcaagaaaatgatatttatctgaagcaaacagtttgttcttgcatggttgttttggcacatcaagaaaatatgccgtttgctagtttgacgaagataaaaataggaggatgggaggaagcttactggaagctcaatctcagaattgaccatttgaatgctgtgatgaggtactacattcggctcgaaatatataacttgtgaagtttctcgtgtggcttgtgaatttgttataggtttagacagtaacaaggaagtatgaagagaaactaaatgcgagatgatcattgtcggttgagacgagaaagtgggtggagaatttgctaacattgcattttttttttggatttgtatattccgacagggatgggcaaggtatgcaagtgcatcgggaggtgctcaaggtcgtgtccggtggtgtctgtatattttttattgtggtcactattcgtcatctgaaggagacgtttgcccgtcgccgtgctggactcccctctgtgatatctgatgggcacaagtgctagtggagagggcaaaagtgactaggagaagacaaggctacgaacggaggtgcagactaaaaggcggcgtgtattgcgagtgtgaagagggactgtgaaaacaagtgctgcgggagttgtatcgaacgaatttgagaagtaacggcattagatgggttggttaccagtgtagtatttttgttgccacggtgaaaagcaagtttggaggcccgctagagatgcatatgtttgtggcattgaaaaggtttctatggcgcccaacaaattcctttgcaacatgctcgtcgttcgcagaatccctcgtagacacgttgctgatcgagcggactagtgtatccgggcatttacctgttgaggtgttgtcgccgccgccgccgctgaagaaggcgatgcgttcgtcggcggcggcggcgccgcggctggcgaatatcaacgggcctctgaccttgaatctcagtgagcagttgcagggttcctgctcatagcgctggagcatcagtgaatactaccattgaacaccccggaccatttcatgtcatacctcttggtgagtccttattggcctgcaaatgaagaattgtttgaagaattcagtaatgcattttccacgattttagaggtatccttccctacactcaacaattctaatgtagacacgttctcacatctagcttgtgattccagactagtagatgggtccactatcagtagctcaggttttatctctcgaacacctgtttcttctataaagcttatagagcattttctgccatctcctggcaaaagaaacaaggggacaaacctaaacaaatgttttcttaatgctatagcattcaacagccaatggttgtataaattctactaacagatcgaatgtagcgtgctctttgtgagttctactttgacattttagttctgcctgttaatcatttgcccttgattcttctttatgacgaattatcctttttggttggagaacaatgttcttcaccctgcaattattaattggtagctacaaaatgattgctagtataagtgaatagaaagatagatctgtcttcaacatttgttcgtacgtcttacattggttgttcactgcacataaattgttttttttaatgaactgataatttcaagtttagggaatatgtagcagaatttgagtttgacaatgtttttcttgctgatcttgacaaggtggaagaagagggataatttgttgaagtttgacaatgtttttcttcctgacgaagcagtcgtggaagaagagacggacgaggccggggccattgccggggtcgcggaggatggcggcgcggacgacgttgcggacgaggtcctccgccctggggcaagtatagttgtagtatccgacctgcagctgcgcctccgacaaggacaacgacgcaatggagaagaacaggatcgcccacgctatgatcaccggcgagccgtgacgacgaacaccgcgtgctgcgctgcacatctttcactgctataccgtgtgtagctttgacgatcgcagtgaaactgaccgatgcgtcggtgttgatcgatgcagtgtgtaggagtagtagtgtagtggtgcagcaaattaaagcaggagctaggcgtgacggtgatttatatacgtggatcgatggtggatgtgcgtgccggggtgaagtgattagtgacagatggagaggggagcagagttgacctggaaggtactcgtacctcggtaaactggagacgtcacgttgattacatggctttcccacccgttgccgcgacctctatttagcaacgtgttttaacctttcgccgctgagccatcgtcgtggtagtaatatcacgttgtaaaactgtaactagaagcgtggcgtcgtaacgatttcgaacgaagagacgccgcgtcaaagatagtcgttgcgccactgagaggcgtgcaccgctcgatcgccacgacgaggctacacgagacatgcagcccgcgcttcgtccccagccgtcgtgtgcgtcgcgtcggcctcgtccctgtcgtcgttgataccggtcgggtgattgtgcatcgtaattcccaccctcggtcactaattttggattctgatacccttcgatcgtgtaacggctagcgcgcccgcagttccccatccaatccaagctcgcacgttgttcactagccaaacgtacgcgacgcatggcccaggggccagtgcgggtgccgcaaataacactctatgtgatttagtgaattccagcacaagcacacaattcttcctccaacacttgatacacgagtatttgggatacaaatgggagaaatggaatcaagactgagaattagcagtagattggagaagaagagatagccagggattgaagagaagagagatacagaggttgaagaagagagagcatcggaaggaagaactcaggtttcatctattttgttcgatccccccatctgttggatctgctccttttgtaacggcttgaatgattggcttatcgcagcggattgagcctagctagccatgggctcaatatgtataccgattcagcccagttacatgacaatccacgagtactaaatatgtatgggatttagtctatgcactaacagatgcaaaatcagggacaaaggtagtaacaattcataacaggtaaatatatggataaccacaaatacaaatactttatattatactggagtagtcttttttttccgagtacaaggttttctgtattttagaacgatgagatataacaagaaaacatatggctacgaccacatcgtctgcatgcatgtacgtaaccccctgcataagtggccgaattagctcttgctgtggttgatggcgccgcagggctgcagga

SEQ ID NO: 72093 - DNA, 774 bp, Oryza sativa
ttttaaaagaaacatttaaaaatgaaaaaaattcatggaaggctttacctcggccttcccgtggtttgggcctggaagggcattacatgggcccctgtgtcttttttgggcctctggagagttatgattgcaagacaattagcccaagtaacagaccaggtgcagtgctctgtttagtaccacaccgtcagttttcagagaaaggagcatcaggagagctataataccagggttagtatcacgcaacaactcatacctttctcggccttttggctaagatcaagtgtagtatctgttcttatcagtttaatatctgatatgtggaccatgtgcccactttgatattaaatttattttttatgggggagggctcacaatagtggcttgccactaggtccctcaagcgtcgtttaggcgttgcactacagcctaagcctggcgcaccccaaccaaatcaatttcaagtgttagcacgtcaaagaaaattcgcatagaaatttcagctgtcagttattgttcattaatattaatttgaagtgttgcaattcaaatatactacttagcaatttcagttttcattggcaagtgcacagtttcggtactgccaattttaagctgtgcattggcagggtagttatcaatttcatacccaaatgaatacataggataaaggccaaaaggctaacggggcctcgatcgctgccagcgatcgttttattcttcttttctcttgttagtaaggggtaccgagctcgaattcgccctatagtagtc

SEQ ID NO: 72094 - DNA, 2212 bp, Oryza sativa
ggcagcactgcaggaatctctgcagaaaaagaagaaaagaaaagaaaatatcttcagaaatctcagcaggatcaacgtcagctaaagccgcgcatgtcatcattataattaattaatcgatagctgatagccatgttatgtatacacatcaatcgaataagaaagctggaaaaggaaaaacaaagcagtttatgcgtattgttgcagcagaggagaaaaaaaagacgatgaacagtactggctagccggccatgcgtgttgtcgcctttgtggaattttggtttcttgttctttctgccttctgaattttcaagaaatgttattattgtaatttggagggattcgatatccagtcaacgagttaggagatttcgtcatgaccaagaacaaatcaatcagcttgagccagtgaggcagctgggaagattgcagcacactagattactatgtcaacctgaaattgatccaacaactacaggtgacctcactttcatctgacgtctgtaatctagcattagaaaacgtctagtagcataatctatagcttgtctcgcaagggtgagtgaatgtataattgacccttacctaatgaaatactattttccatgggttttgcaagctcataagtgagcagagaaggccagtcaaattcagtttggtcagaactctgaactctaataagctaaagaagttggctagccaaacgaaggaaaacatatccatcatccaagctgaaagcctcaaagacgcaaccaagttttttgagtagcaaagctacccatttgaagtagacttctgaataatggctttgcttctctctcattttgtgatatctataatccattattaagttggaatataacctcattttctcaatgaccatcagaccatggcaccatgccgtgccaggtcattgcgtttgtgtgagaatggtcaagccaacttctgttttaaatctccacttcacgaccgtaccaaaccactcattaaccatcagttaattaggtagtcctactcgaactaaagcttcaatttgacacacacccatgacatggtaaagagacatctcgtcagataaaaaattagcacaatggcaagttggcaactagtgctatagatcaatggaacagtagtacaaacttaagctgaaaatcaattagcgaaggatcagttcagtgcttacgtttgaagaggtggttctcgaggctgccatgctccatgtactcgtagacgaggaggcggttctcgtcctcgcagcagtagccgaccagcttcaccaggttgggatgccgaagctggccaaggaagatcacctctgcctgcaagcaacgacgtcagaatcatcagaaatcaggtagtagtagtagtagcagcgaatcagcagcatgatcacgtccatttcagtggcactgttgcattgggcagcatgattagatcactggaaacttatccgaccgtcgccggaaccgtcacatcgtccaactacccctcccttgttctttgcctcgcacgtcctaatcgtgctgcttaagatatttttaaacctgtttgattatgttctagatgatcgtgtgagtagtagtagtattagttgatctgaaattaaacaatctgtaattaattgtttaggccaagcgtttcagaaaccgggtttccgaagctactggcccctgacagttactgaattttaccagataaaatttcagattcaatttttttaatgaataattggtagttaactagtcataagtcgtaaaagttcaaaattttcaaatataaaatttgaataatacagtcttttaggtggtaacctctagtcgaccgataaccaaactaattaccgctgatcagtctctgtttgatgggaaactaaatagcattaggaaagaaacgattgggtaatttgactgaacattccctgttgctacaggagaaacgacacaactttgcttctatgcaataaataaaaggaaaatcgacactttcccaaagaaaaacaataatattaatttaaaaaacaaaatcaacgatatctcatatctctcaccctcaaaaagaaaaaaaaaatactgttcctcacctgcaaatttcagttatctagagggttactcaatgccctaggatattcatatactgggatacatatatttgagtgatccttgcaaggcaactactactctaccaattaagctatatttgatggccactcttt

SEQ ID NO: 72095 - DNA, 1638 bp, Oryza sativa
atcatttatgccctccttgagaagtaatgaaagcaccaagacatagctcattgcatcccattggccaactgaattttcaattgtcatattaacattccatcagcaaagggaacagattagtttgacgctcccttacatagtagtggggcatatagaaatatttgcagattgtatttcaaatttaagagaaagtagagtgtattctcgcttctagggaccaacatgaaactgtggggcttgggaatgtcaaaagaggttgtgaccaataagattcaaatgtcgcaacccagtctgcttgagaacaattaaaaggcatttatggcaatagaattcaaacactacctagtggcactttaaacatcatgagaataatatatgaaaggttggttacagaaaacatatacattgtcaaagtacaaagaaatttatcgctcaagttaaatattctaagaatttttaagaaatcagtgtgcccaacaagctacataatcacctgaatagtttatatagagtggagatttagattgccatttgatccaagtaaatctgatgtttaggaagtgataagagatcacatattagactacaaactgcagtttcacctccaatcggacacctataggctggaggtcacaatcaaatgcctataaaccctatcaggacggacattaataaaattaccaagaatttaatgaagcaatagacaaacagtataataactacttgatggtatacatttaacacagtaaaacaggtacgagaaatttagatagatatagattgtatggttgacaggtcctaccgaaattccatcacggaagttaaatgacttgtcaaggacactctgcaaacagcaaccagtagcgaacttctcaatcataaacactcggaagccaggaagctgaggaaaacaagaaatacatgacattatgagtaatgcaactgcccaagtactagatagactcttcaaaacatgacataagaagaactgaacacaacaataccttatcttcaatttcagagctactacaccagtctttgataaggttgacaaaagtctgtacgcatgtctacaaaacaataaccgagtataaaatagacaattctatttaaagtggagatggagaatgtaactcgcttaaagtggaaataagaaattcaagatcaattaaaccccaccttccgatgtgatatctctttatggctgcatgaagtaatcaaaagcaactgcattatgttctctagataatgcctacaactaggagttaggagaactgtagacagatcatgtgttgctatatgaagcaagaatgcgtaaaatctcttttccagctcttgcagctcacgcatttcctgcaatgaacaaaattggcatgaatacagtatacaaggaactacgcaatccatgaaatacctgtaaaagcctggctacatagattagccaaattggcatgaacaaagtagacaaaaggtagcaattcagatggggcctactagctgatgaagaaccaagccagctacaaacaatagtgtgtgactaactatgcaataagccaagaacattatcatatcaagatgattgccatatatgtagcatggttgttaaggcggtaaggctatagcagtaaaacgctaagg

SEQ ID NO: 72096 - DNA, 1855 bp, Oryza sativa
tcaaattaagcactgaattctggatgccattctgttttcttcagactacatgatggtggcctggtgtcctgatttacgcggaggaaaattcgcagtaattttgatgccacaataatccccatttgttcatgaggttcagttgaatggcgaatcgatcgcacggcacaacatacagaaccgaatgcgatgcgcgacggtgtaattctgaacgaagatcaaacgtcgactggctggctagttcaatcattattggatttgagctgaaaataggagaaattttcaagctctgttatctttttctttttttcagatttcagatacagttggtgtacgtttcaccatatagtactactccccccaatgtatactccatttccattaaatttgtgggatacagcaacaagttttcatttcatttcatctgctagtgaacccctcatgctcttattctacctacccttgatcatctcaagaacattggtgcatgataaatatacaccagaatgtaccgaaacagcagtgcaactagggttcttggggcatgcccatggccgaaatcggtaagccaacctggagcagaggctacaaaattcccaaatctccatcggcatcctgaatttctctgatcaggggcaggccccccggccggcacatttgtgtgtgtttgtgcccaactttgggaaaaaaaggtggccaggagtggctgccaagcaacattctacacctttggcaaatgccgatgtgccattgaatatatatgtgatcactactcacttgtgtgtgtacatttatgtactgtatcttatgttcagatgtactaatatatccatatatgtactctactagtagactactagtatgctaaaatacattggtactcccactatccaataatataagagattttgagtttttacttataacgtttgaccacttgtcttattcaaatttttttaaattattatttattttatttgtgacttactttattatctatagtattttaagcacaactttttgttttttatatttgaaaaaaaaattgaataagatgagtggtcaaatgttataagcaaaacctcaaaatcccttatattatgggacggatggagtacttgatttggatgattgatgaagaggcccttttctctcatgagacatttggtctttgttagatgaggaaggatcctagggatccacaagatgagagataaacttaaataggagctatgcatgatactatgctggtagagtttgttatcaagagctaatagtccagattaatgtgcattcattaatctctgactcttgaagaatgtctggacagaaaagaggcacccatcatcattcaccgttggatcgatgaacaaaataaaagtagtacacatctgggtgtgtgtggagttctagaatgaaggctagagaagcagcgagaagctgccgcgatgtggtcctgaatcccgtgtcgcttttcggctagaaaagaaatgcatatatatctgaacatgcggtttctgaatctacaccgagcttagatatcatcgcattgcatgcagtcctatagattatctactactaatctatggtgttagggcacccacaatggttatctataggctctctataagagattcatgtcagcatattttcctacttggaatgtattaaatgaagagagagagcaaagctatctactaacttagagatagtctatagagaaaaacgagacaatgcatgagagagctatagataccaatgtagacatactattaaggtggtttactattaatcgagtctattgctgagatgtacatgttttatagatagcaccttactttaccattgcgggtgctct

SEQ ID NO: 72097 - DNA, 1430 bp, Oryza sativa
aatcataattggcagcacaaaatagcattgatatatctgaagcatctgacatgaactggcatcgcttagtgcaaaaattctcataacgtacgtcttaacatgcaagaagtacagtagaaaacaaactaatcaagtcttcttaacgcaaatagcttgagacaagaaacgactactacttcagattaatagatctcaaaaaccaagaagcagaacaaaaggcagggccaggaccaaaccctaggcggtgagcacgacggcgccgccggcggccttgatcttcttctcggcgaccttggagatgagcttggccttgacgacgatgggcttctccggcagcagacccttcccgagcaccttgaagtagccgaactgcgtcacgtccagcaggggcgccttgccggcgccggcggcctccgccgcctgctcggcgggcaccatcgaccagagccgctccacgttcaccgccggggagtagaacttgttgcggagcctgtggaagtagcgcatgccgaccttgccgaagtagcccgggtggtacttgtcgaagaggatgcggtggtggtgcatgcctccggcgttgccccggcctcccgggtgcttccggtgcttcccgatgcggccgtggccggcggacacgtggccgcgcttcttgcggttcttcctcaggctcgtcgtcatcgccgccgccgccggcttaccttggggacgtgttcgggaatgggagggatggaggcggcgaggcggagttggtggattggataggaggaaaccttaggaggcgaggaatggtgagcttgatgggctattgggctggcccttgctttttttaggcttgtttctctcttggtttgttatgctgggatgttgggctgtggtttggggttttatcgccattttggtccaagaaggaaggagattttttttggaagctaaaaagaaattagatttttgtttcttgatgtgttgtcctggtgtttttgttgtggaatctccatgtagatgaactatgcaaatgcatcacaaggggatttgctattttaagagtcccatgtcacaccggacacacggttggagccctaaaggaatcacgtgacatagatgaaataggagaaagttgtctttcaaaccactatagtaagccagacaagtgtcgataaatatttttttcttgttaaaaaacatcattggttttatgtttaacattttggcagtaagattgccacatcccaatggatagaaagttagataagagacaacaaagaaaggggaaaataagagaagagaagcgtcttttgaaccattgtaagaactcggaagtggaatgtgttaatcacttgacatggttcttttctcgtcgagtaatatcactactattagtttatcttttcaacacatgtgtttgatgagaccaatcagataatatggtaata

SEQ ID NO: 72098 - DNA, 1482 bp, Oryza sativa
gtaatacttaaacatgttttggtcgaattttctatatgatgagaaaaatctaatacgaagtatgaaacacactggagtgtatggccatgcttgcttccatccatccatttccacgatacaaaaatgaacaagaaaaagatggacacaattaattagcacgctagtctttgcatgtcgcaatacaaggtaggtaaaggccgggggaagcacatcgcaccatcaccacatataaaaatcgtcacatcaacctcatccaaatttcgcatcatcacaaaaacaaatcaaatcccctccaaatttataacccattaatcaaaattaaaaatatcccccaatggtcaacacacacacaaaaacacacacgagatgatcaaaggccattccatcccgccctgacaggtgggccccacctgcagcctctcgccttcgcctatatatccactcgtgacacacacagccccctctcgcttgccacgcacaccaccaaatcgccaaccaaaaagcaaacccccgcgtcttctccgatcagctccgctcgctcgccgccgacgagctcgccccgccgccgacggcgacggcgcatgctagctgcgtatagcccgcggcggagatgaggtcatccagcgattgcaaggttgtggcggcggcggcgaggaagaaggagaaggagcggcggcgtggccgtggtcgctgtgggggttcctcctgaccggctgcctcggcggcggcggcggcggagggaagaagaagagcggggggaagaaggtgcgtccccgcggcggcggcggcggcggcctgcggcggctgtcgttcacggacctgacgggggcggcggaccaggacctgtcggtgtcgctggtggggtccaacctccacgtcttcaccgtcgccgagctccgcgacgccacccgcgggttcgtctccggcaacttcctcggcgagggcggcttcgggccggtctacaagggcctcgtcggcgacggcgtcaagccggcctccgcccgcaggccatcgccgtcaagctctgggatcccgagggcgcccagggccacaaggaatggctggtacttcacccctccacgtgtcccttttccacttaatcatcaaaaaaatagaataaaaaagtgatatgatttcatttgattaattagacatgcacgcgttaatcactttagttagttaatcatttaatgcgataattaaatcagattgatcgattatgtttgtataagattaacaattaagcttggagtaattaatctgagatagtgtaggccagcttccttggaagagtccctaaatctaatgcttgggggaaacaacattttctcacatggtttcttatagtaaaagagtggccatcaaatatagcttaattggtagagtagtagttgccttgcaaggatcactcaatatatgtatcccagtatatgaatatcctagggcattgagtaaccctctagataactgaaatttgcaggt

SEQ ID NO: 72099 - DNA, 3617 bp, Oryza sativa
ccagtagctaatgcccatcctgaaccaaatcaagaacccctgacactgaatttttccccctatcttcttgtttctctgatcaaaccaagaaaccatgcaatgcatttatgcatgtatctagagcattagcttgtttagtagatgataatgatagatgctttagggtcaaaatcattatcttaaggctgcggttgtacctgccgaagtgtttatcttcaggtacagagaagaggagaaactagtaacagtcaggaagcaagaagtgcatattgcataggaaagtaagttcagaaagtatgcatatgacgtagaggtcgatgcttagcagtttggtgaggagtctcgtgacatttgatctcttcatggaaagagattgcaaacctacccccgtatctcacgaagttaacctgtccttcacaagtgtttctagaacgtgtcaatttcatcaagctgattaatttcaggtttattgtcattgaggagaaaactaattctaattagatatacggaagatcatgtacggactaatcacattttctttccgaggaaagaaacttacagattgtttttaaaaacgaacttattatgttttttaatagataaataaagctttattgaactcaatgagaactaaggttgttaaaatcatgatcctaaatcagaggtctctgagtaggatcgcaaataaaaaatagtatatgtaggaattgtaaaatcgtggattctatctactagaatcgtagaatcaggttctttaattaggattgtaaagtcgtagaagtgtagagctgaatcaagatttttacaatcttcctgaaaatacttagtaagattgttttgtatcaccttattgtaattggttgaattcaataattatctcattatctaaaaataagtgtctcgattaactgatcacgtggtacatagccaagttgtttctctgaatcattttggctgacagagatcagcatccactgcaaaagtcaaagtggatggaaggattttatattgtatctctgcacacgcattgcaagcattccaaagcatatgcatggaacagttgactgtcatttctgaagcgatggacttctgctacgcttcaccagctaccggagaaaaacaagaaagtaacacaatctatacacaaaaacggcttcttaattagttgcatggctaatctctctttgatcatcgtgtgtacaagagccgccattaattagacgtcaaaactcaaaaccgagttttttttttcaaagatcctgaaattaagaaggtcgtcactgcagagttggtgcagatgattgatttcagaaacaatatagtacatatttgcattcgaagctcttcagttcttttgttttttcttcaccttgcaaagcacgtaggcacttggtttgatggtttccagaatgatgtttcttggaagcaagtagtccttggcaaataatctgttattatcatcaaatgcagattacaggattacccttaacctaaccccagttctgacttaatcagttcctactcctagtgtttgacaacctactgcagcaaagaggattacactaattaaacatttgatccttgcctgaattcatgcagcatgcatgcgtgcttgcacggccgtctcatcaggtcatgtactaatcaattaacagccattgacccattgtgcatatggttttcccactggacatatgtaactaaccagtaattaatttcctgattagttcttgattgggcaccaagaattagctaagtagctaaccaagaaccaggcttcaaaatttcagttttgaccatttctattgggggcaccgatggtaccgaaatttctaaatattttgatccgaaataatttaaaacttgaatagcttcttatcggatgaattcttttttgataagatatatactcgattacatggttagagtgtccctatcttcccatggccattattcagaggagcaactcgtggtacatgcatggcaattcctgcgccacatgatcagtggcacgattagtaaatcataccgacatcagatccatacatgagaagcctctttctctgtcaccgagcacacgtactttacaatatatactttccctctagaaggaaaaggaattgaaaatgaaacgagctttggttatgttctcacttggcttgtttggggccacatggtttgtttttaattactgtaacttcagttaaaaatgttaacagatcaatattgtttgaccctctttgacgaatttaatttcagtgtaccaagtgcgtgttctatttacatatgcttgaaagttactgaggcatacacatacccattgaaacacaactctgattgttgagctatagttggtatgcctaaaaaactgaacaagcaaactaaaaaaaaatacaggtaaaacatttatatttgtatcattaatggttctagaaccaatgctaaaaaaatagaccatggctatggctcggctaataagccaacaatctcctaaacttgctgggcaccaactgtaaggttttgagagtagaagatagagatgaaaaaatatctcgttttttacgtgcacgtttcccgaactactaaacacagtacgtttttctttcaaaagaattctatatgaaagttgaataaaaatcaaattattctaaattttaaatttaaaataattaatactctcaaatactgtactatctaactctgcatttgctacatttggaacttcataaccatgttgatgtcgtgaactcagattcccagcaaggtgttctcatctggatggtgcatgcagatgcagtcgcaggtcgcagctggatgcccggattccagtggtggcaacgatgaccaatcgacaacgacctgcacacacagacaaacgtcgttttggccgccatttgccaccattaagagcatgtccaatagcatactataaaccagctgtaaatatattttaaaaagataaatgaggagaaagaagaacagcgggctacagatttgtagccagctgtagcatggactccaagacttagtgtgtgtatgccatgtgggaccagatattaatagtgtagtatatatgtaactattatatgaataagctattagattgcctatagatgaattgaagctagtagtgggctatgctattaaacttgctctaagtacatcacatcgatgctgggcagcagcttgcacgcactgactgatcgacgaatagtgatcaaaatattcagtcagatcgaccaagaaacctccaaaccgacgagaatattggcatctcttctcgcgattgggactcttgcaaacacctctcgatccatccatcgtcggctcatttcctcttcctcctcctttgcttgttccgagtcaaaaacgcgtatgcatggactggaatcaagcgacctcctttacggcgcatttcttttttttctctgaaagtctgatgcgtttgcttgcattgcaacagacggtggtgttgcttttctttctttaatttgggggcagttaatagtttgagttggtgatcactggatttttctttctctctttctgatgaattggtcttaatttggctgcattgcctgaagctgggttgatgcgttcctttgttcgcgttggtc

SEQ ID NO: 72100 - DNA, 17668 bp, Oryza sativa
catataaatgattagcaacacagtactatatatagccaccacatatgtaacaaagcatatatatttcagtgggtctcacaagtcagtaaataacaggggcatggcttaaaaaatgtcagatatagtgagcactaatcacatttgtttatgtttccatcaatccaaagaacacacatgtccatacagtggcatgatagttatggcatatgacttctaactcaatttaatcatgttagatactaaaattagttgcactgcagactctggcaatgtcctttatttgaagaaattatgaagttttggtaactatacatgctagcagaaaactagataaaatagctctgcattttacatggtgactttctttactttaaatacgacttgtaactatatgtccatacatttgtacaggaggaacaatcaactctgttactgttgaatggctggagcaaaccacgacaaaatcaaacaagtgatggctagaaaagctagtttcgacaacaatgttacaaactcattagtttcagaacttttagttttatcagacaacttgtatttcagcatttggaaatttaacatactcatattgtcatcattactttgggtatctgaaatatattatgtcttattcgcggaaatatcagacatcataattcttgtgcgcatgagttgcaagggttttgccatttaacatatatttctactcatgttgcaatagtaccaaatgatccatccaattactgatgtaacacaatttcttttctataaaagctagaagaaattcatttcattgtaataatacttattgccacaaaaatattttagtggcaataacccatatgatatattgccacgattaatgctatgtggcaataacatatattagatattgcaacgaaactattttgtggcaagcacaactaatgccacgcacgaagtggtggcaataattatttgttgcaacgatgttaagtgttgcaatatgtttttttgccacgattattttgtggcattatcaaagtttgttgccactagataaaaattgttgcaataacctattgctactgtttctattgccacggctagcaacggttttaaaatggtggcaatatgtatctattgccacgattttagcattgttgccacgatttttttcgtagcaacaaatcattttcctagtagtgatagagaggtttacattttaaaagagagcgattaactttgcaaataaagtttaaatccaagttaaaagaaattaagagaaggcaacatcacttcaacagaagaatcgagaagagtgcaactaaaatattttgcaaaacattttccctgaaaatttgagtctgtcaatggtggagaaaccctttgtagtcccggtttataacccccctttagtcccggtttccaaaccgggagtaccaatccgggactaaagatcgctatctttatctttagtcccgggtgaaataaccggtactaaagatcgatcttaccaaccgggactaaagatcgagctgacctttttttttttgcatggccctgtgtacttatacatatatatgttatgcaaatgcatatgtatatatacaaacaaatttactatatatatatatatatatatgaccaaaatatatttacattatagaaaatgtgtacacatgcatatagaaacatatgtagtcatgtattaattacaatccattatatgtcctagatagctacgatttcgacgtagtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcgcacacgtaatagctgcacaagttagttccctgcttttgctttgcgcactacaaataaatgacaaacaacgagagatctaattaatatacacttgtatgtatttgaatcggagaaatataaatatagagcatgtgtactcacaggaaatttgaacttccgcctaagtctttctctccatttgccgcggaccaaatgacggaatcgataccaagccctacatggagtttaaagctatgattcgtagtagcaattaacataacaagattttcttaattaacagaggaacttatgacggtacctgtctataagttcgaaaaaatagtcaaacgtagactcttttttatccattaagtcatatacgttgacggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattaaactaactctatgttgtacggcaacagtatgaacgtcttgtaatgctgcgccttcaggagatggacgagattgtcctctgtttcttgtggatattggtcaagcattgtgacgtttactctccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcataagaatgtcatcaataaagaccaccacgaacttgtctaggtattccataaacaccttattcatcaagttcatgaagaaagcaggggcattggtaagtccaaaagacataacagtacattcgaacaacccatatctagtggtaaaagctgtcttaggtatatcttcctctttgattctcaactggtgataccctgatcgaagatctatcttggagaaaacagtggcacctttaagctgatcaaacaaatcatcaattctgggcagcggatacttattcttgatagtcacatcatttagtgcacgatagtccacacacatcctctgggtatggtctttcttttccacaaaaataaccggagctccccatggagatgaactcggtctgatgtatcctttctgaagcaaatcgtctacttgccttttgacttctgccaactcattggctgccattctataaggtctcttatggatcggagttgttcctggtcccaaatctattctgaactctatatcccttttaggcggcataccaggtaaatcatctgggaacacatcgggatactcccggactataggaatctcttccaaagttatttggttcagtcttgaccttaaggactcagaagacaatgcatgaacagttacaactcgaccatcattgctggtgagagttacttttctgttggcacagtctatcacacctttatatctggctaaccagtccatccctaggatgacatcaaggtctttggattctaacaggataagattggccagaaatggtactccttgaatttctattctgacagagaggctacgttgcaaagagagtgcttgattacttggggtactaaccatcaaaggacgtctaagatcttctacttccatcccatgatttcccgcaaaactcatagataagaatgaatgtgtagcaccagaatcgaaaagcactgttgcaggaactaagttaacaagaaacgtacccaaaatcacatctggagcatcttgagcttctgcagcagcgacatgattaacacgggcctttggcgctggtgcggtagagttgctctgagcagggacaaccttcacgcgtcggggcttcggacacttgtcagcgtaatgtcctgggtctccacagttgaaacacaccacgggctttctgccttgctccctcttggcaggttgttgctgtgtcgaggctgcaacagggcgtagagcttgattgcggatgttgttgccagcattgttgttgaagaactgacgctgcggacgaacaacagacgaagaacctccctgtggcatggactggggtcctaaagtaagacgcggcctctgactattcccctgttgtgtcttgaattgagcaatccgacgtttcttctgctcgatgcgattgtacttgtcctcctggcgaatagccttatccactaacttctagaaatcaggataatccccagtcatgagtgggtaagaaagctcatcattaagtcctgccaagaacttttcctggcgctcttcatcagtgcgtacatcttccggagcataacgagcaagacgattgaactcgtgcagatactccgtaacagagcgagatccctgagtgagcgacctgaattccttcttcttgagagacaccactcccgatggtatatgcgtcttccggaaagcagcggtgaattcaagccaagtgataggttcagcagtagtcctattcagacggaagtgatcccaccattcagaggcagggccatgcaactgatgggatgcaaatgagaccttctcctgatcagtgcattgaagcaaatccaacttcttctctatggcatggagccaatcaccagcttcaacaggattagtggtgctagagaaaataggcggcctcacacgaagaaattctgctaacttgttttggggaggcgcatagttatttccctggttttgctggttctgaagttgctgcatcatcatgttcattaactgagtctgttgagcaagaacttgggcaagtgtgggattctctccattgttattgttattgttgttgttggggccattcccgttgctgcgagtgagcaccatctggcatggacagggcacaagaagagaaaccgggggaaactacttaggacagagaattactttaacttttattgatcttaactgagtttcattattacaaaactgaagactctcacaccactaaactgtcacgcccggaaattcactagtaatttccgaactaatttgtgcataaaatcctcgtccaggaatcagccgaggtacacaaactgacaatttaatatacaaatccatcttaataataacgttacatacttacaaagaaaagaaaacagcagcggaattaacggtctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacatggattccaaaggatggcataatataggctcatttgcaaaagcagcatttagcaaagatttaagataagtaaaacagtagagtagttaatcatcaattttaatcaacactaaacagcacatccatgctgctcaggcctaaccaaacctgaacaaccaaccccggtcgtacagatcaaacctccaaaccaggaattatccattccaaaccaggagtcaaattaattatcacattattaacattgatgagtagtgtgagactaatcacgaaaaacatcgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaataccctctgcacaacacaactcaaaacagtgcaccgttcctggatcataatcaccccctctacaaccagaggcatggactccccagcgacccccacggacttctcgccgcttctcagtctggcactccataatgaatcatgctatacaaaagataaagccgttgcccacgctggcttgtggttggcacgataaatgtttcacaacagtagctcgcgaaccggtccttaattgtcatgagcacaaccatcaaaaccatatactcacaacccaccttaaccaggttttaattatcaattaattaacatcacacgattaatcatcgtgagctaccattaaatataaccataattaataagaataatataatataatttatatttaatcccctttaattagctaatgtttctaagcatggctaagcaaacatacatatagcatttaactgaaccaaaccaatatataaggttcatgctaatcaaattataacccataggaaaataagatcatcttcggccattaattaacggggaaaggttcaccacccgatgacattcaaaaataatgcatagttaaaataaaataatagctttaaacgggttcaacatgctcaaagggttgtttgggatctgtgtgacttgccttgagcttccgcaaacacttccgaaccttgctcaacgaaaacgctctcctccggaacgtcggaaactaaagcgaaagaataaaaatcaacaaaacagtacaaaaaaaagcataaacagtatatgtggatatttttaacatgtagatcttgattttagaaaaatttagcaacttgaaccactcgaaacggatctacagttatttagttatgattttccgaagatttaatctattagaaaaacgggaaaaagaaaaaaccgatgatgacatgatgacatcaccaaaggtggccggctaggatggcaagctcgccggagattggatgatcggctgcgaatttggaggacatgtacgcgtagaggacgatgagacgaacccaacggtactcaccctcgagccaaacgacaaacgacgacggccggcgacgaaggggcggcgacggcggctcgggataaccggcgacggcgagctacggcggccggagacgaaggaggaggtgcggccgagcttctcgtcgctcccacgcacctaatggcggtggcggcaagcggcggcgacggcggagacggctgctcggcgcggctgcaacccggccggcagtagatcttgattttagaaaaatttagcaacttgaaccactcgaatcggatctacagttatttagttatgattttcagaagatttaatctattagaaaaacgggaaaaagaaaaaaccaatgatgacgtcatgatgacatcatcaatggccggcccgggttggcgacctcgccggagattggatggtcggctgcaaatttggaggacatgtacacgtggagaacgacgagacgaacccaacggtactcacccttgagccaaacgacgaacgacgacggccggcgacgagatgaacggcggcggcggctcggcttgaccggcaacggcgagctacggcggccggcgacgaaggaggaggtgcggccgggcttctcttcaccttggcgcacctaaaggcggcggcggcaagcggcggcgacggcgaagacggcgactcggcgcggctgcaacccggccggcggcggcggcggactatgcggcgtcgacggcgggctacggtgcacgggagaggacgggagagggggaaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccgattcttgggggagaggatagaggaggataagaggaatatttcccctcaacaaattttgcaaacggagctcgggatgtggcggatttaacggaggaagcggcggctgcacagggcacagcaccggcggctcggctctgtccaagcttgaagatgaatagtgccagggaggcaaactagactttcggctgggcttctacttccaaggactgattaaaggagggaaataaagcagacttcgggaaagagaggaaaagggctgcaggctgagaggagactgggccgagagtgagaggacttttcctaattcggcccgaaaaggaaaaggtgaactttaattacttttccaattaaattaatcactgaaatgatctttgaattgttaaaaatacttccaatgctcaaataatttcaagaaaaatcttgaaaatacttggacactcaaagtacttaacaaaattataatcagaccatttaatgattaatttaatatttaaacaattgctgaactgctctttgtatgattaaaattaacaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctaataataatttattaaataatctataaatcctgaaacaaaaatcaggatgtgacaacgatgacgtcagcgatgacgtcaccaccggcggcggcggctcggcggctcggacgcgcatgctcgcctgcgaacggcggcacttcggcacgaacggagggcaccaacgggtagagcgcgacgcggcgaactcaccgatgaccaaaggagcggcggaagaccaacggacggcgacggcgacgaggttgaaacggcggagctcttcggcttgacgacggcgacggtgctccggcggtcttcggcgacggcgaaggggcggacgaggacggcggcgacttggcgaccacgacggtggtcttcccgagcgacggcgatgaccggaacggcggcggcgcacggctggagcgacggcggcgacggcggctcgaggctactcggcgctagggcgctacggacgacgagaggcgaaggcgagggtagcggcgggtagagaagagctcgggggtccttttaaaggggttggagggcgacggcgaaggcccacggcggccggcgacgagaaggaaaggtcgggctcggagagagaaaagccgatccgattcgacctcgaatcaaacgctttccaagccgatttagccgatgtttccaaaagggaaaaggtagaggagatcccgaggatcatttcccctctatcaattcggccggagaaggaaaggagcggccggatttggaaggagacggcggcggcgcagcgctagggtttcgggaggcggccgacgcgaggaagacgacgacctgacaggcgggggcgcgcgcgcgtgggcggctgcggactggactgggccgacttgggccgaggagagagagaacggtttttgggccgactttcggcccagagccaaaagagactctttaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttatatattttgaatttttcagggtgtgatatgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttcttagtctggtgctccgcaatgaatcatgctatacaaaaggtaaagccgttgcccacgctggcttgtggttggcacggttaatgtttcacaatagtagctcgtgaaccggtccttaattgtcatgagcacgactctcaaagccatgtgctcacaacccaccattatcaagttttagttggcaagtaattaattaaccaatcacgattgaccatcgtaaactatcattaagccatcattaaataataataagtcataagttatcccaatagtgtgctaatgtttctaagcatggctaagcaattacatctaatatctagctgaaccaatgtataaagctcaactagtctagttataataacccaaggtatcaaggaataaagtaatcaatgcaaacaggccataacaaaggaatagattcacaccacccagtgacattcgaaaataaatgcacagttgaaataaatagagaatttaaatataggatcaaaatgctcaaaggattgtgtttaggatctgtgtgacttgacttgcaatattcggtctacaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcaaatgaatttattacgaattttacaagattaaatctaattaaagcccatttaaaaagaattaaataaatttaattcaatttatggataattttaatatgtagatctttattttacacaacttttgcaacttgaaccacattaaactgagttacaatgaattagttatgaatttttaaagattaaaccggattaaagcatttatatggattttaattgaattattacgcaataatgaactatttttcaaaaggaaaaggaggattattgcgtcatcaaaggcagtccgggtgcacgggacggtctaaggaaacaaacggccgagatcgatcctatccaaaacggacggccgagatcaacttgatctaccgcggttcacgggacaaggcgacgatgacgtcagcggtgacgtcagcgatgacgtcatcaccgacgacggctcggcctcgcacgctcgccggcgaacgacagcgcgacgacgcaaacggaggacaccaacgggtagaggacaacacggcgaactcaccggtgaccaaaaccacggcggaagagcaacggacggcgccggccatgaggaagaagcggcggcggtcttcgggtcgacggtgacggcggtgctccggcggtcttcggcggcggcgaagcggtggacggggacggcgacgacctcgcgatcccgatggtggcgacggcgaccgacgacggcggctgcaacggcggcgcggcgcggctgaaccgacggcaacgacagcgacggctagggctacgcggaggcggcgctagacgcgacggcgggctaagacaaaggtggcggcggatagaggagagctcgggggtgcttttaaaggggctagcgagcggcgacggaggcccacggcgaccggcggcgagatggaaagctagggttggagggagaaaagtcgatccgaatcgagctcaaatccgtcgatttccaaacgaaattgaccgaagtttctataagagaaaaggaagaggagatcgaggagattatttcccctcaaacgatttcaccggaaacggaaaggatcgaccggattggaaagcggcggcggctagggtttcggccggcagcggcgcgaggaggaagacgggcctgacaggtagggcccacctctcagcggctgagagagaggaggaaggggcgcggcggactgggcggactgggccggggagggagagagaaagagagaggggttttgggccggctttcggcccaaagccaaaaggaggatttaaaaacatttttctatttaaattattcatgaaatgcaattccatttattaaaaatactttcttggctcaaataaatcccagaaaaatctaggaactaaagattcaagagaagtatttaacaaaattttatctagcccaattttatattgagatttagcaaattaaaattagatcttctcttttaggcttttaagatcatttctaataattccttttaaacaacaatttataatttaaggatttttaaacaagaaaagctcttaacacttataattagatcattaattgattaactaattactgaactgttctttgtatcatttaggaattgagctccgaaaaatccgagaaaatttcagagagtagacttaatcatggagaatttaataaaaattaaatccatccatgctttatatttaggaaattttatttcctgtcacaccctgaaaattcaaaatatataaattgttgtttaaatggaatttttagaaataattttaaaagcctagaagagaagatctaattttaattaataaattccaatataaaatggggccagataaaatttcattaaatactttgcttaattctataattcctagatttttctgggatttatttgagctaaggaagtatttttaatgaatggaattgcatttaagaaataatttaaattgaaaaaggttttaaaaagtctcttttggctttgggccgaaagtcggcccaaaaccgctctctctctcctcagcccaagtcggcccagtccgccgtcgcgcgcgcgcgcgtccgcccgctgacaggtggggcccatcgtcttcctccggccgaaaccctagtttcgcgccgccgccgccgctttccaatccggccgctcctttccgtttccggccgaattgatagaggggaaatgatcctcgggatctcctctaccttttctcctttggaaacatcggctaaaatcgtttggaaattcgtggattcgagtttgtttcggattcgattttcccgaactttccttctcgtcgccggccgccgtgggccttcgccgtcgcctcctagcccctttaaaaggctccccggtgtctcctctacccgccgccaccctcgccttcgcctctcgtcgccggaagagctctagcaccgtgtgccctagcgccgccgtcgccgccgtcgctccagccgtgcgccgccgccgtttcagccgtcgtcgtcactcgggaaggctgccatcgtggtcgccgtcgcgtctccgtcctcgtccgccccttcgccgtcgttgtagaccaccggagcaccgtcgccgccgtcgacccgaagaccgccgccgtttcttcgtcgtcgccgtcgccgtccgttgatcttccgccgctcgtttggtcaccggtgagttcgccgcgtcgcgctctacccgttggtgccttccgttcgcgccgccgtgccgtcgttcgccggcgagcatgcaagcccgagccgccgagccaccgccgccggtggtgacgtcactgctgacgtcatcgtcgccctctcccgtgagccgccgtggacccgatcgatctcggccgtccgttttggatggatcgatctcggccgtccgttcgcgtgaaccgccgccgtgcgcccggtccaccgcgaaaccctagtcgctgacgcaataaatcctcttttccttttcaaaaataattcattattgcgtcataattcaattaaaatcaatttaagtgttttaatccgatttaatcttcaaaaattcataactaattcatctttgctcggatttagttggttcaagtctctaaatttttctaaaattgagatctacatgttaaaaatatccacatgtactgttcatgcttgtttatgtgctgttttggtgattttgctcttttctgcttagattccgtcgtttctggagagtctgttttcgccggagaagagtttgaagagttccaaggccagcaaggcaagtcacacagatcccaaacaaccctttgagcatgttgatcccgtttaaagctattgtttcttttcaactattgcatttattttcgaatgtcattgggtggaattaacttattgtttgttatagcctttttgttcttgattaccttattccttgataccttgggttattataacttgactagttgagctctatatgttggttcaactagatgtattagatataattgcttagccctgcttagaaacattagctcactattgggataactcatgactcactattatttaatgatggcttaatgatagttcacgatggtcaatcgtgattgattaattaatgtgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttttaagggggtgattatgatccaggaaggtgcgctgcggtggattgtgttatacaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataattggtaataatttgattagctcctggtttggaatggtacaatcctggtttggagatagaactgtgtagccgggatggttgttcagaatggttgggcctatacaatagggtatgttgtatagcgttggattaatattgtttaatacttaactgctttattaaattctcaaatgtttgttaaatgctgcttttgcaaatgcaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacatttcccacatttaacttcacttgtaaattaatgaacatttaatataaattctaataataatttattaaataatttataaatcctgaaacaaaaatcaggatgtgacagattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgttctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctaggagtcgcaccaattccgtagtcaataattacatactaattctaattacaaataaagtaatcttatattaaaactcaaataatattacatgctaagactgaaagagtcatgtatgctaagtgtaactgtcgtatatgctaagtctaattaagactaaaattgtcaattgctaggagtcgcaccaattccgtagtcaataattatatactaagtctaattacaaataaaataatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataattacatactaagtctaatttgcaataaaataatcttatattaaaactcaaataatattagaacactacacaatcttatatgctaagtctaattacaagtctaatattcttaattgcattacaaatataacaatcatttatattattacttcacttgcctgcacgaattccttctagggctagctcttccactccggcttgagggacgactccgacaacacgtcttttctgcaagatacaaaaaatatgtattaggataaatgcgaagtaacatatatatattgcatttcacgttcacgttcgttcgctcgttctcattcacgttcgttctcgttcacgttcgttgtcgttctcgttcacgttaattcgttcgatcgttctcgttctcactctcgttctttcgatcgttctcgttctcgttcacgttctcgcggcaacgtacattgacgtgttcgttctcgttcacgtgtcgttaacggcggtgtggtggcatcgggccggcgcttggcgcggcggcgtggcggcggcggcggcggcggcgttgcgcggcggcgaaggcggcggcgcggcgtggcgtggcggcggcggcgttgcgcgcgcggcggcgaaggcgcggcgtggcgtgccggcggcggcgtggcgcggcgtcggcgtggcgcggcgtccgggctttggatgttttgtggtgggtggcgtgaggagagagagatcgagatagagatggatgaagggagaggtggtggcggctctcaccccagagatgcggcggcggaggaggaggcggaggcggcggcgaggacgacgagctcgagacgacagcgagatatggcggcgtcggcgcggggatttgccctaggcagtggcagcgaaggagagaggctgagagagatcgatcggccgaaaacgttaagtgttggtggagaagacgagggcgcgcatcaggaatatatatagccctcgatctttagtcccggttgatgagaacaaccgggagtaatcatcaaccgggactaaagatattttcccactatttctaaattctttttaaacccggttagggttaagaaccggcactaaagattatagcactgcatattattttcgcttacatatgtgtttctaaaatagaagttaatgcattaacattatttaaattacaaagattaatgacaattacttcgaaaaattatttttgtctgtaataaattaagtggataaatcgtaataagcaaatatatgacttaaaattaataaaaattccaataatcatatatacttagcatatgaatgatattattaaattggtaaaaactctaattaagatttgtatgtacatactgcatgatttaaaattaataaaaattgtaatcatcatatatacttagcgtaggaattatattaaattaaatgttaaaaactctaattaacatatgtaaatgccacatgcatgatttaaaccttttaaaaattcgaatagtcatatataagtagcctatgaaagatagtaaattaaattgtgaaaaactctaattaacatctgtaaatgccgggctgcagga

SEQ ID NO: 72101 - DNA, 2952 bp, Oryza sativa
ctgttattaaaatatctctccccatggagcattattttgctgtatacatggtgtgcatcttcgttgggcactcccttgttgtcctcaccaccattagggtggtaatatagttgatgtaaagcttctggtttagcctatattctgtaatgatggagcatccgaagctctattcatacacctttcaatatcagtaatcatacctcgcattattgtgaaatctgacctcaatgcatgtttcagtgtagtttatgccagtggcacataactgatgaaaaattacccttgtatgcttgcagatgtatactgcgggaatatttttaccgagcctggctaccgtggcaaagttccttgatcaaggcatgttagtgagatgcaggggatacatccccagagtttctgctgtgagcatacagggtttcattatgtttgttttgatatttctctggaagtgatcattgttctgctccgagcttgaaattttttgtaaggcgattcgggtgaagctaaacagatgggataggcaaaagagtgatgtgtgggccgtgtttttcctgacagaaactgtcacaccgcctgttgtcgtgttaccaaattttggcagtggtttttcacccctttgttagctggggtgctgtacagattctttaatatagttgcgtcgttcgcattaataagtttccgtggtcaccttctcgttaccctgattatccagtgacagaagaggcatgctatgctgactgcaatgtaagagttcaactttgatctcttctccttttgaggtagtggaaattttctttttacccatagaggtcggtatttttgaacggtcgaaatctttcatccttgtttttgcccattctgtgactttcgtgcttgttcggcttcctttcagaatttggataaatttgctttggattagaccacgtaacagagtctagtcactgttacttgttaggcaggatggatatggctgtgaagtgaaggccaggccatcaaagttgggtttgatcatatcttctgttcttgttcttgtgatccaactatccaaggacttggccaggagcacatcagcgtgctagagacggacataacgatattgattgtctagcttatatgactgcacatagaggcccatatttgtaggttgacaagatgtttatggctttatggccatatgacttttgttgaaaatttgcttgcctgctgttggtgcatattatcaaatttgtcatcgaattctttcgcacgtcattggaatcatctgcaaaaaaatgttgttccctatggtggtggctccatgtatcttgcgagacccatccacgtagtcattttttatcatcttctgaaagtcaatgctaatccaatcatgcacattccgcaccgcacgaggaaatatggggttttaatttggaactttggagccaattttcgccctgcccatatttggtagtgtaacagtattggcaaacattgttatcaaactaaatattttttgtgatattattttagttaccaaaaaatttgggtgagcaaaagttgactctaatctaaaccatggtctgcttcctttcatcaagaatccccacattacagaagttctaaaatactcgtatactaatttggaggtgcagcaaagagcatgaaaagtgatttcactgttctcacaattttttgataatttctggagcttctacacattgaagcactaacttggtagtgaaagggagtgaagacctcccaaaaaagggaagggaattgaagcactggaattggattgttcatctgcactgcacagctagaaagggatcctgacaaaggaaaatgccacacaaaagaatgggacagttgcaaagtccaatagagaatgtagcaaaacaaagaacacaaatgccaaaagagttgacaaaaaaaaaaaaccctgcatcatccaaaatacacaagagacaaaagaagcactcaccaagatgagctaaccatgctcatcaactttttcataccactttagctgtttttcttggagggggcacttggaggttggaaccaagtgctctcacccaagagtagtaaaatatggccagctaatcagtttgagaagactagatatttgaagacagattaactttcttgtctatttggacagtagtttaatttgtctatgccttcaaaccctgttttaatcacacctaccatgagagtttgttgatcagcacacatgcctgctgctggtctaatgtccattgaaaatgtgtgaagacaaaccacttacttagaaagttaacaatgctagttaaagtaatgactacatatatgttaattgatggttgatattggagcaaggctggttaaaatgcctatattaaaagaaaagctatctgcttttgacaaagataatcaatttgattgcattatcaagtataagatagttatttacgactagcctggtgacttggtttttctgtagcggcatagacctgttttttcttcatttcaaatgtcaggtaatgtgtccattgaggaaggcagcattcgtattcaaaaggtgtggttagtattcagttcagtgtacagaatgggttgactaaatcaagctaaagatcgtctctaattaagaagtaatcaagctagtagctagatgttctctaattaaaaaatgattaagctagctactgcataacatttgcttgcttgtagccgacaagttgtgataaattaactaaatcctgcaccaatcaacaggcctgtgaagaatgcattactccaactaagattgatgtgcacaccaacagcactgcaaatccatatggatatatacggaagaaacatcagcagaacatcatcttaaagaattctgattgggaatagtgctcacgtaggggagcaagaatgaacaaaaccagtagctaatgcccatcctgaaccaaatcaagaacccctgacactgaatttttcccc

SEQ ID NO: 72102 - DNA, 1989 bp, Oryza sativa
tattagtcatgttagttaattaagtaattaattaattgagtagttagcgattaagcagagggacatagtagttgctaggaaaatactgggtttgaaactttgacgcacgcatgcagcgggattggcctggcaaactatgtcctgcagtctgcaactggagtagtagttttcttacatgcaaatgtcaccattgacttgcagcaggagtattactggccaggtgcatctatctgcttacctatctctacagaaccgtaccatattataatgttttgttctctctatctcttgactattgtctagcttaattcactaacatctatataaatttaaatacatatatagatagcatatatacttgagataaagtctattttccttcatcgaactagttcactagatcatacaacccctaaactattttttccctcattatataacctatacaaacggtacacgttactctataatggtatttcttttttttctctccacattgtcatggttatggattgcacatacctaatagtagttgactaaatctcggaaggacccaccacatatcatgtcctatacggaaacaacctgcggatatggagggagttccggataaggaaagacaaccagagttctacatggaaacgacaaggactactcagattgtatccatattggtttcccacgttctacttgtacaaggggacacctatgggtataaatacaagaccccctaggaggagaggggagaaccaccatggaagacacccatgacaatcaacacacgcccaccagaagccacaacatacaagcctacatacgccaagacacgccgccggatatcgacttcagggataggcatggctattcccctacggtgtctccggataccgtcaggagatacgaaagcgctatctctgatctcgccgggcacggattcgagaaggaagactaccctgttgtcgactacgagtcagaccttcagatcaacatgtggacaacagttagatatgctgcccacatattgtactggtgtgattatggtgaataaaagcaactccggctccggccaacaggatgtagagttattacctgacagctcaggggcctgaacctgtataaaaatccccgtctccgtctcttttacctcagtctcgcgtatatcctagcaccgacgatccccatactgtccaaataccgtagtcgaaacatcaaacgtcgacagtggcgcgccaggtagggggattttggtacttcaggatttcgacgagatgggtttaagagatggattctccaacaacaagctacttgacgacttccgaccaggaagattcaacccggccagagtacgtctcccaacgagattggaatcatcgtcaccatctattcgatccggtgagatcgaccaagcttcgacacgtcaccacggcagagggccatggtgtcagcggcatctaagactgatccaacaccaatccctcgacgcgtgggacatcgactggcgtaaggcattggctgcccgagtagccaaactcggctggcgtgaggcattgatctgttcattggcttgtagtctaatcggagttgaggagttcctgtgattgcactagaattcaattcctagttggcaatcgagctgctcattctggtgacgtaagccaaaagcaaatagatcaactaaacagccaaaaagccgcagtacaaattctaaggtaattagtaagattaatttcctaattaatctactaatttcgtagatatatccggcatatatctacaaaggtacgcaatattttatatataatttaccgtacctattttcagattatacggcattgtcagatctataatttattatgtttacctagagcatgttctttatacagtatatatcgcgcgagcgtccccgatgttaggccaactgcggtctaacgctggagcacgctctgttttcctctgtataaatcatgcttgtttacggtttacataatg

SEQ ID NO: 72103 - DNA, 681 bp, Oryza sativa
taccgcactatttcttgctatgtatacagtaaacactttgttgacaaggtatacaagaataatactcctatttgatttgcaaccatattaattaaatgtatgtgtggccaatttatttatccttgctaaattggttgtgcatgtagccttgcttcggtccaccgaaacgatgggtatgtcgccctcctcggaggtgcttgacgcaccaccggcccccaagactctgagccttcatctgctgcacgcaagcagcctccatggccctcaggttcggccgatcaatgaggagagccaaatttatgattttaccctcccacaccttattttagtgggcaagtatacccctccttaatttactaccactaattaaactggtagtatgaaaaaatacaatcccttggatgaaaaaagatgaagggttgaaataaacttctactaccagtaaagagcaccatagtatgattcttcccatagaatgcaagggcggtcttactgccgttgtgtggccgaatagactaaagggtgaactatggtgtttcggcagtcaaacccagcgtcaagtccaagtccaattaaaagagttctcatgtttccttacttgggctcgaggtttattgaattctaattgatctctaatgcaaataggacatggaaaaggccctctgaaagcaaaaccaaccc

SEQ ID NO: 72104 - DNA, 5278 bp, Oryza sativa
atccgaaacaaaccaatagaaactatgacatctgtaattgttttgttacccttgagtgaccactatagtctctgtaaacactagcaacatgtggtactccatattttaactttcggtttgatagaccagtcgttcaaaatagtttttaaagttaaaattagttatctgaaaacacttgttgcaaacaatggtatttgataaactaatcattcaaaataattttaaagttccaattctgttatgtatatcatgacctatgaactgaaagaacacacgaattaaagcaatggcaatttatggtacttgattaaagcaatgacaagcacacgaataacaggaacagctcctttcaggaatgttacatcgtccagaaacatcagcaggatgctcatagaattttccttcagactaaaacatatattagcaatgcccagaaacaactccacagctggagttgtcagagaagctacagcaatttgcgattcaatgactgaatcgacaggaaagttgcaagatgacgaacagtatagtagtaacatttagaatgcagaggaactaacagctaatataaaaactgatcataatctcccgaccttacatcattaggaacatactttactcttttcactttcaggtcagctaaaacaaaagcagcagcaaatagaagaaaatcaagaagcgacgggcttcaaagctgcagatggcagcctagaagaagtgtgcaggaacacagatggaactatccccaaattatccacagaagaattttcggagtaaaagacaacctggtttctacctcaaacgaatcggaatagctatacaacatttgacagttttttggatgaaaaactttcatatgaatttatacctcaatgccatatgaattagcacacgagcttaaaaacatgtgcaaattcaattaaatttctgtcacggcctaataccatatgattttaaaaaggacaaagttataattgaaagaaaattttatacacagtaaaatttatgagtgtgtgtactccctccgtttcacaatataagtcattctagcattttccacatttatattgatgttaacgaatctagacatatatatttatctagattcatcaacatcaatatgaatataggaaatgattgaatgacttacgttgtgaaacagaggaagtattacttagcaaccctgtagctgtatctcgtagaagagtaaaccgaacgccagcaggtttacacagctgaggccgaacatgagccagaagaagcaatccagccgtcatcgattgagatcgtcgggaatccacccgccgccgccgcccttctccggcgccgtcgcccacgcgaccaccgcgacgatggcccgagttgaggtagcttccggccgccacggcgacgaggctcaccgcggtgcacaggctctttatggtgtcgggcgcctggtcgtagaagaactcgagcaggccgacgctggtgaacacctccgccgcgcccagcgccatgtacgacggcgcctgccacacgatgctcgtcgccgcgcgccgccggcggctcgcctcgagcagcgccgagtacgccatggccagcgccgacagcgccagcccgacgccgagccgctgcagctgcgacaggccgcggcggtcgccggtgacgcggcgggcgagcggcatcagcgcggcgtcgtaggccgggacgcagaggaggatgctgaccacctcgaaggtggacagcgtcgccggcggcacgtcgagcgggccgacgcgggtgtccatcgccttcccctgctccacgaacgtcgacgacatctgcgccgtggcggcgaagaagaacaccaccgtcggccacacggtggacagccgcagcagcatcttgacctcctccacctgcgtcaccgtgcacagcatccacgggctcgccatcgccaccgccggcggcgacgccactacggccgccttgtccaggaacgcgaactgattggtgtgctcgatgatccggtagtcgccgtcggggagctgatgcaagagcgagctgtcgcccggaagctccacgccgcgatttctgacggcggcgacgaccacctggcagagccgcgtgagggggctccccggcggcgtgtggaacgcccggaggccgcacagggtggagcagaagaagaaggcggcgagcgcggcggtcatgaccgccgccgggatggcgaagccgagccaccagccggcgcgctcctgcacccacacaagcacggtggccgccagcagcgagccgacgttgatgcagaagtagtaccagttgaagaaggacgccctcgccgccggcgccgcgtcgtcgtcgtcgaactggtcggcgcccagcggcgaggcgcacggcttgatgccaccgacgccgagggcgacgaggtagagccccaggaacacggtggcgcggaggacgccatcggaggatgcatcaaggtgtggggttgcgaacgacgccgagactgtgagcgtgatcatcccctgtcacagattgaaattttataacgaaatttcagaaatttttcgttctttattgttttttcagtccactggtgaagaccatcaaaataatttgtgaaacaaaaattaaatcttaaattttgattgacctttaagaaattcttgattgccataagaagatgttcttttctaaagaacttgtgaaaaaaaaacataatatcttcttaatttttgcttgacatttcgcagaaattcttgattgccataagaaatttattgttctctctctttttcagtccctgtaaagcatgaagaccataaaaaaatttgcccaaaaaaaatcttcttaagctttgcttgacctttaattccgaaattctctattgtcatatttgatatgcttttgtttgttatctaaatcttgttgtaaaaacatttcattcacaaaaatgtctgaataatgaaaattgaataaaggagtatgatatattttcacattaaaaactaagaaaaatctcttcaaacattcagtttttcgcattaacaaaaaacttgtttgagcatacttttcttaataaataaaaaagtataccatggagtagatggagaggaagaggaggatggtggtgcggcgacccaagaaggagtcggcgatgaatgcgccgacgagcggcgtgaggaagcaggtgcccgtccacgccgacacgtccctggcggcggcgacattgctctcccctaccacgccggtgaggtagctcaccaggttcctcgcgatgccggcgaacgccaggcagtcgctcagctccgtccccagtatcagcacgcacgccctccacccaccgccgccgcccttgtcctcctcctccttgccgccgccgccgttcggacgaagcagcagaggcctcttctcctcgtcttctgctgctgctgccgccgccgccgccgccatggagattttgcttccactgtgtctgtgtgtcttgctaggagctactagctcatggacttatgtcatatcgtatttccgagtgaatatttaagaaattttgatgagaatttagtgggggaaatttagattggagagaggagttaggtgtatgcacaagctgcaattgccaaaattgatttttgggatttgactcaaggtagtgtacatgccaacttattaaaaaaaaggatttttgttacgattagcctgttgtgttggttaatctagcgttgctgaaatgatggagtattttaagaataaaaaaaaaattctaaccttatatagattatttttttctttcatctaattttattattggtctatgattacatgagaggagaaatggggttctatactatagagttgcactcatagaattgatagttgacgttttcttttctttcttttttttttgaaatgtgtatgtagtactaatatctattgagttatttgttagaatctggtttccttatcggagattgaactagccattattttagctaatgtatttttcctttcagcaaagaaagctactctacaaaccttattaatttcagcaatgatagaggcaacgcatttcaattatctttagaaaaaatgcgcaagctgcattcgtagaatttgattggttcatgtggaaggtggggtttggatccagggacttaactttagtccctgtctttagacactaatttagagtattaaatatagactacttataaaactaattacataaatgaaagctaattcacttgacaaattttttaagcctaattaatccataattaaagaatatttactgtagcattacataggctaatcatggattagttaggctcaatagattcgtctcgcgaattagttcaagattatggatgggttttattaatagtctatgtttaatatttataattagtatccaaacattcgatgtgatagggacttaaaagttttagtcttatctaatcagggcctgaaatctgagccacgcaaaccaccaaccgcacgacaaggttaattagggcctgttcactttgatgccatttccaaccttaccaaattttgataaagttatcaaaaaagtggctctatttagtttgctgccaaattttgataactatataagaaatcctaccaaaattttggcaactatgccaaaattttggcatagttgccaaaatttggcattgccaaaatttggtaaggttttttttggcgtcaaagtgaacaggcccttaatttccatgtctccatcacactcacagtgccagcggttatactgggcagactagtcattcctctgttcctctttccacgttcatctgtaggatttaagggcctgtttagttcacgaatttttttttaactgtcacgtggcatgtttgaccggatatttgaaggggttttcggacacgaatgaaaaaaataatttcataactcgcctggaaaccgcgagacgaatctttcgagcctaagtaagccgtcattagcacatatgggttattatagcacttatggctagtcatggactaattagactcaaaagattcgtctcgcaatttccatgcaaactgtgcaatatgttcttagacagaaaaagtaggtagtagcacacattaattctagatgaagaaaaaaaaaactatgatatctctcattaaataatatgtggtgaataaaaatattgttgggagtaagaccggacagaagttctaatgattgtagctaacatataaatttataaaaaatgttggtcaaagctaaaaagtttaataagtataactaaaaccacgatgaatttaaaaggagaaagtacacaattaat

SEQ ID NO: 72105 - DNA, 5972 bp, Oryza sativa
  unsure (1)..(5972): unsure at all n locations
ggtacttattatggcggagcctagtagcctagctacgtgtttaagatgagttgcatctatttgttgtgtcctataccatgcacggattagaccagacaaataatggcctagattatacatggatacaatggattattctaattagatatgtcatgttgggctcttagttataccacatcttagaaactctagtatgtgatacatagatgctagattatcatatctgatatctaggtattgggtcgaatacctaggtaccaggtatgaaacctataaatacaagatctgatgctgagttatccggcctgatacctataagtaccggatccgataactaggtatcgcgtctgatacctgagtactagattggatacccgggtatcgggtatctgatctcatacctatgagtatttgttccaatatctatgtgtaacgggtcggatacccaggtaccgagtatgatacttatgaataccaagtctgatacctaagtatcgggtctgatacctatgagtaccggattcgatacctaggtcaggtttgatacttatgagtatcggatccggtatcgcgcatgatacctatgagtatcggatcggatacccgggtatcgggcatctgatcttatacctatgagtatcagttccgatacctgtacgtactgggtcggatacccaggtaccgagtataatacttatgaataccaagtctgatacctaagtatcgggtctgatacctatgagtaccggattcgatacctaggtcaggtttgatacttatgagtatcggatccggtatcgcgcatgatacctatgagtatcagatcggatacccgggtatcgggtatatgatcttatacctatgagtatcagttccgatacctgtacgtactgggtcggatacccaggtaccgagtatgatacctatgaataccaagtctaatacctaggtattgggtctgatacctataagtaccggattcgatacctaggtcgggtttgatacctatgagtaacggatctaatacctagataccgggttgatacatattagtagaggatctgatactaaatatagggtgtgatggtacgagacttcagatgtgataccactaattctaatatttatgggttatatacttctattcaacaatcaaataaaaagatggaccatgcatagctaggccagaaagtacaaccaaacttgctcacatgccgctgacatgctttgtttaggctcatgctactagctctagtgcttaattctaactttactagttgaaccaggtgtcagacccatatggacctaaagaggtgtagaagtagtgctgtattagagtatttcatagctattttgtactgtaggagaaaagagacctctcgtcagtcatcactagtcggcagcctccatgtgaaaggacagcacacgacacgcttttagagagaaaaagaatcggtgagtgattggtaagtataaattataaactataccgttgagacagtacaccgtcccatagtttaatttggaatcaaaccggcccactaacatacgagaaagactggtacattggcccgcaaatatatgggccttttatctgttcatctaggcctacccaatctcggagtttttcacaaaaacccctgatattaactctagcaacatataggtcctgatcttttctaagaagccccccttttcagtccagatatttgcataaatatcccttattttaaccgttaacatcctcagcggtcaggattatagcataaaagcccttgatactgctctagagtcccccccccccccccacgacgccttcagcgacggggtgcccatccgactccgacgacgttttttcgcctcgccgccgatgatccccgccgggcagccatgtgttctaccctacccacccaccagcagccgattgcacctgccactgcggttcttccctcaactgtagagtggtcagcggagatggccggcagacggcaggggggcaaccttgcctggggaccgcgcctggcgccgtgcttggagacgacggtcacgtggttggtcgccgtgatgaagcggcttctcgacttcaacccctgcgccccactggagtcccagcagtacacggggcaaggccccggtacattgttcacccctcgcacatgacttgtttgttgaattgcctgagtggaaatcttacgcttacctgacctgcgctatgtgtttctttgatgattgagttggtacatgtgttctcctatttcatcatactttgtttcaaacttatactccatcccattttgcaaatgagatatgatgatgacatgatgtacagatgaaagaacgagctataagctggactgctagagagctggatggagaaggtcaaagcgcacaacaaggaggagctcttgcgcaagcagagctctttgctgggcactgatggtaaaccggaacaaagtattctcgaggcaactatttgaactcattggaaaatttgtcaaccgtttttctcttgacaaacttcggccaacgaacgcatcgccagcccagcaaaaagaatgaactgtcaagcattctaaaatcttaaaaagcccccccaaaccccccacctcttttacacccccctcttaaatatttggggggggcccccttttttttttttaaatatctagggctgttangtcccacttttttcttcaaactttcaactttttccatcacaattcaaactttttctacccacaccaaactttcaacttttttcgtcccattcatttcagatgggattgaggcctncaatntgacggtaactaaacacantccttaatatgtggtagagatgctacagtcaatanggtattaaagatttgattggaatgaaaggttttttgaaaaggtaaatgttagtcttctgtttttgcgtgcaagggtactgaggatttcagcttattgaagaaccaaaacttcatcatgaaagcaatatttttttagctttgtaaatcctaattgtagcaacagaaaaatgcactctatacgagagtatagaagatatttgcttcaaaacaatcttgatcacatatgaattcattttatcttttaaagtcactgattccttagcttagtagcccgttcatacccaggctaagatttaaagtggattttagtgcagaacatactaacataagacagccccactgactatttgcatagatacacattgttgatgtgttcctgcgtatttctgcctactgcaatcctttgtttttctcaccgggccggcctacttccatctccacttgggcatgttcttttacattgctgatttatcactttatttttgtactttgattatagtgaacttcatgattgctggcgtacttttaccatcatgttctcccatacaacttagactgcgcagggtgcaatgctacgattgattttcttttttaccttttgaatttaattgtacaatgaattggatgaatgcccaaaaagcaattggaagttttctgcagccagtcttagttttagcacgattagatgtgagctcatgaaaatttcgtcttttgtgatctcaactgctcaaggttcttttgctgccttttctttggactcaactttgactaagttctttgagctactgatgggcattgatgtttttcttggtgcaggatacttgataatgtaacctaaaaaagcaggatggacaatgaaactgaaagaagcaaagttgtgatgatgagatgagttaaactactggctgataacaaagttgcagtaatttctatgatccccctcatgctcctactctgtctttatatctctttatttgttttttttttcctttgcaactgtgcccttgctttggaacaaaactttgataaccatttaacacaatcgtcaaagcagaaggaaagcttatttgcaattcccttttggaactaatgacatctgtttaagtaacaacgaccaacctcaaaacttctgctgcaacattgtgtactttgttgctagactggatgaacatctagctgatgttctgttttagcattgctttacttgagacttgagagagcctgctaccagtttcacttaaccattcgtgtttatcttcccaggatttaatatgctggaattaggaagtctgaacaacattttgtggaggctactttattaaactgcggtgctgctctgtccaaacttgcgctaactgcgggagagaaggggggctagcgtgaaaagaagaggtaaagaaagagaaaggcaaaggcgcgacatgatgcctcgtccaagctttttgttgtcacgctgccaaagaggacaaggatttggccctgcttctcttcttcttcctcctcttcttgcggtaagatcactactactattaccatcaccatcaccgcatcatttgccaaaccatggaccagcttgcctttttccaggttgcagctgcctgacgcagtttagccagccactgtaaagtgcaggtccatttatctgacaaatagagtatgtgagcttaataattgtacagttttttcaaggtcaattttaggggagtaaaacacaattagttttggaggggaaatagcttttgacattgctgtgagatgaggggttggtttggtctgtggcctaaataggtattaccaaattttgtcaatgccaaattttggcaagttttggcatgactaattttggtaagtcaaaattgtgtttggattgaagccaaaatagcctaagttcactattgaaatggcatattttcttaagcatgccaaaatttggattcaaaccaaatagacactaaacactgttgaaattgacaaatattggtaagtctaatttattcctcaaaccaaaccagcccgagatggtttgtgtaggtgaactggtgaacagtttggcctgcatctgcattggtaggggcctaggagcagacaagaacagagcaaaagtgaaaagtggaagcatccagtactgtcaatctgacactggcgccacagctctcgcgaccactcctcatctcacacttaccgaagcaacaataaaaccgttctatcctcgcttcaaaaatcgatcaaaaaattcaaaaatcaaaagtgaaagaaaggaaagcacacgatgcttctcttcacccaatgcagatcgatgggggtcgtaccagtagcagagatcatggctgtgagcctgtgattgagtgatccctttcctccatgccaatcttgaatctttctagctaaaagaatcatctgtgctcttgtgctcgcagctagctgcacagtggtgacaatggcgatgctgctgttgttgcgttctttggagttcttggcgatcatggcggttgcatcgagcttggcaatgccggtggcggcggcggcggcggtgccacagccggagccggaggtgaagccgagcgacaccgacgcgctcaccatcttccggaacggcgccgacgcgcacggcatcctggcggcgaactggagcacctcgaacgcctgcgccggcgggtggatcggcgtcggctgctccggcgacggccgccgcgtgacgtcgctgtcgctgccgtcgctcgacctgcgtgggccgctcgacccgctctcccacctcggcgagctccgggcgctcgacctccgcgggaaccgcctcaacggcacgctcgacacgctcctcctcggcgtccccaacctcaagctgctctacctctcccacaacgacatctccggcgccatcccggacgccatcgcgcggctcctccgcctcctccgcctcgacctcgccgacaacagcctgcgcggggccatcccggtggccgcgctcgccaacctcaccggcctcctcacgctcaagctccaggacaacctcctcaccggcttgctcccggacgtcaccgccgccctcccgcgcctcgccgagttcaacgcctccaacaaccagctctccggcagggtgcccgacgccatgcgcgccaagtt

SEQ ID NO: 72106 - DNA, 13311 bp, Oryza sativa
ctgacagctagctagtacccagcatgcctaagtcatgcctttgatactagcctagctagtaaataaaactggaggtactactagcttgttgtgcatgccaaatccctgtaatagctacctacgttacctagatacggggatacggatatggatacacgatacgtcgatacgggatacggcattttccaaaaaaacaaggatacggggatacgcttttatatatatatatatatatatatatatatatatatatatatatatatatatatatatatatagtaaatttgtttggtgctccatggtgcccgggcaccattgttgaaattgagtatatacccaattcaaatgagtatgaaacttttttaattatttaggtattaacattaactacttttactaactagttcaaagcaagtttgaactgaatttgaacttatttttgttagattttgattctaggtatatagcatccatacatataattagttaggtatgtaatcatggattgtgaaataaagttaaatttgagttgttttgttgataggtataggtacgaatcaaattcttataactaggtatatactcacaattagaaaattttgaaaaatttgagtgattttgtgcatttgaaaccatggtgcccgggcaccatggtgccccatatgagtgtcctatatatatatatatatatatatacacaaaaaaaattaaggaaattgcatttatatataaaaaaaatacaaaaaatcaaggaacttttataaagaaatagcgatataatactagtatcagtgtagcagattccatatcaatattctgcaattttctcttctataagcaattcaaattaacaagcgattaagatcccaaaaaccacatattaatagttcaatcatatatttcttgatgactttgcatcaacattagaagccgcactaagcagtaacctctaggattgctagatgcactagcacttgtatctaataaaaacgatagtactttgtcctaaggaaaacaagaaaggcacagcagattcaagcatgaaacttttgaagataatggattacccggccaggcagtcaagcgaagaaagaaaaagttgctccgtgcttcgatgctactagcctgccactggccaccgctatgcccggcggccggcgtcggaggaagtgcctcacgcagtcacgcggcaagccggcaacagttctggcctcgaggttggcggcaaaagaggtgcgccaccaccaggctggcggcggcggctctgccgtctcgcgtaggggacgttgtggccccgcgcacggcagcgacgcgcgcggctgcagccggcgtccggcggcaacgccgggcacgcacgagaggcatcagccatcaggttggaagctcgtgaggtggcgcatccctgatgcgagcgaagacggaggaaggtcgtggcgtatcgctggcgtatcgtgatttatttatttttttggaaatcgcaaatatgtgggatacgtacgggatacgtatcggagcgtatccgatacgtatccgtatccgttgccgtatccgatacggatacgtgactatgcagccgtatcagggtaacccagatagctactagtagacctgtaccctagctatgtagggtacttattatggcggagcctagtagcctagctacgtgtctaagatgagttgcatctatttgttgtgtcctataccatgcacggattagaccagacaaataattacctagattatacatggatacaatggattattctaattagatatgtcatgttgggctcttagttataccacatcttagaaactctagtatgtgatacatagatgctagattatcatatctgatatctaggtattgggtcgaatacctaggtaccaggtatgaaacctataaatacaagatctgatgctgagttatccggcctgatacctataagtaccggatccgataactaggtatcgcgtctgatacctgagtactagattggatacccgggtatcgggtatctgatctcatacctatgagtatttgttccaatatctatgtgtaacgggtcggatacccaggtaccgagtatgatacttatgaataccaagtctgatacctaagtatcgggtctgatacctatgagtaccggattcgatacctaggtcaggtttgatacttatgagtatcggatccggtatcgcgcatgatacctatgagtatcggatcggatacccgggtatcgggcatctgatcttatacctatgagtatcagttccgatacctgtacgtactgggtcggatacccaggtaccgagtataatacttatgaataccaagtctgatacctaagtatcgggtctgatacctatgagtaccggattcgatacctaggtcaggtttgatacttatgagtatcggatccggtatcgcgcatgatacctatgagtatcagatcggatacccgggtatcgggtatatgatcttatacctatgagtatcagttccgatacctgtacgtactgggtcggatacccaggtaccgagtatgatacctatgaataccaagtctaatacctaggtattgggtctgatacctataagtaccggattcgatacctaggtcgggtttgatacctatgagtaacggatctaatacctagataccgggttgatacatattagtagaggatctgatactaaatatagggtgtgatggtacgagacttcagatgtgataccactaattctaatatttatgggttatatacttctattcaacaatcaaataaaaagatggaccatgcatagctaggccagaaagtacaaccaaacttgctcacatgccgctgacatgctttgtttaggctcatgctactagctctagtgcttaattctaactttactagttgaaccaggtgtcagacccatatggacctaaagaggtgtagaagtagtgctgtattagagtatttcatagctattttgtactgtaggagaaaagagacctctcgtcagtcatcactagtcggcagcctccatgtgaaaggacagcacacgacacgcttttagagagaaaaagaatcggtgagtgattggtaagtataaattataaactataccgttgagacagtacaccgtcccatagtttaatttggaatcaaaccggcccactaacatacgagaaagactggtacattggcccgcaaatatatgggccttttatctgttcatctaggcctacccaatctcggagtttttcacaaaaacccctgatattaactctagcaacatataggtcctgatcttttctaagaagccccccttttcagtccagatatttgcataaatatcccttattttaaccgttaacatcctcagcggtcaggattatagcataaaagcccttgatactgctctagagtcccccccccccccccacgacgccttcagcgacggcgtgcccatccgactccgacgacgttcttccgcctcgccgccgatgatccccgccggccagccatgtgtcctaccctacccacccaccagcagccgattgcacctgccactgccgtttcttccctcaactgtagagtggtcagcggagatggccggcagacggcaggggggcaaccttgcctggggaccgcgcctcgcgccgtgcttggagacgacggtcacgtggttggtcgccgtgatgaagcggcttctcgacttcaacccctgcgccccactggagtcccagcagtacacggggcaaggccccggtacattgttcacccctcgcacatgacttgtttgttgaattgcctgagtggaaatcttacgcttacctgacctgcgctatgtgtttctttgatgattgagttggtacatgtgttctcctatttcatcatactttgtttcaaacttatactccatcccattttgcaaatgagatatgatgatgacatgatgtacagatgaaagaacgagctataagctggactgctagagagctggatggagaaggtcaaagcgcacaacaaggaggagctcttgcgcaagcagagctctttgctgggcactgatggtaaaccggaacaaagtattctcgaggcaactatttgaactcattggaaaatttgtcaaccgtttttctcttgacaaacttcggccaacgaacgcatcgccagcccagcaaaaagaatgaactgtcaagcattctaaaatctaaagccaacactacctattgctttatatcttagggctggtttagttcccaactttttcttcaaactttcaacttttccatcacatcaaaacttttctacacacacaaacttccaactttttcgtcacatcattccaatttcaatcaaacctccaattttgacgtaaactaaacacatccttaatatggtggtagagatgctacagtcagtagggtatgaaagatttgattggaatgaaaggtttcttgaaaggttaaatgttagtcttctgtttttgcgtgcaaggtatacttaggatttcagcttattgaagaaccaaaacttcatcatgaaagcaatatttttttagctttgtaaatcctaattgtagcaacagaaaaatgcactctatacgagagtatagaagatatttgcttcaaaacaatcttgatcacatatgaattcattttatcttttaaagtcactgattccttagcttagtagcccgttcatacccaggctaagatttaaagtggattttagtgcagaacatactaacataagacagccccactgactatttgcatagatacacattgttgatgtgttcctgcgtatttctgcctactgcaatcctttgtttttctcaccgggccggcctacttccatctccacttgggcatgttcttttacattgctgatttatcactttatttttgtactttgattatagtgaacttcatgattgctggcgtacttttaccatcatgttctcccatacaacttagactgcgcagggtgcaatgctacgattgattttcttttttaccttttgaatttaattgtacaatgaattggatgaatgcccaaaaagcaattggaagttttctgcagccagtcttagttttagcacgattagatgtgagctcatgaaaatttcgtcttttgtgatctcaactgctcaaggttcttttgctgccttttctttggactcaactttgactaagttctttgagctactgatgggcattgatgtttttcttggtgcaggatacttgataatgtaacctaaaaaagcaggatggacaatgaaactgaaagaagcaaagttgtgatgatgagatgagttaaactactggctgataacaaagttgcagtaatttctatgatccccctcatgctcctactctgtctttatatctctttatttgttttttttttcctttgcaactgtgcccttgctttggaacaaaactttgataaccatttaacacaatcgtcaaagcagaaggaaagcttatttgcaattcccttttggaactaatgacatctgtttaagtaacaacgaccaacctcaaaacttctgctgcaacattgtgtactttgttgctagactggatgaacatctagctgatgttctgttttagcattgctttacttgagacttgagagagcctgctaccagtttcacttaaccattcgtgtttatcttcccaggatttaatatgctggaattaggaagtctgaacaacattttgtggaggctactttattaaactgcggtgctgctctgtccaaacttgcgctaactgcgggagagaaggggggctagcgtgaaaagaagaggtaaagaaagagaaaggcaaaggcgcgacatgatgcctcgtccaagctttttgttgtcacgctgccaaagaggacaaggatttggccctgcttctcttcttcttcctcctcttcttgcggtaagatcactactactattaccatcaccatcaccgcatcatttgccaaaccatggaccagcttgcctttttccaggttgcagctgcctgacgcagtttagccagccactgtaaagtgcaggtccatttatctgacaaatagagtatgtgagcttaataattgtacagttttttcaaggtcaattttaggggagtaaaacacaattagttttggaggggaaatagcttttgacattgctgtgagatgaggggttggtttggtctgtggcctaaataggtattaccaaattttgtcaatgccaaattttggcaagttttggcatgactaattttggtaagtcaaaattgtgtttggattgaagccaaaatagcctaagttcactattgaaatggcatattttcttaagcatgccaaaatttggattcaaaccaaatagacactaaacactgttgaaattgacaaatattggtaagtctaatttattcctcaaaccaaaccagcccgagatggtttgtgtaggtgaactggtgaacagtttggcctgcatctgcattggtaggggcctaggagcagacaagaacagagcaaaagtgaaaagtggaagcatccagtactgtcaatctgacactggcgccacagctctcgcgaccactcctcatctcacacttaccgaagcaacaataaaaccgttctatcctcgcttcaaaaatcgatcaaaaaattcaaaaatcaaaagtgaaagaaaggaaagcacacgatgcttctcttcacccaatgcagatcgatgggggtcgtaccagtagcagagatcatggctgtgagcctgtgattgagtgatccctttcctccatgccaatcttgaatctttctagctaaaagaatcatctgtgctcttgtgctcgcagctagctgcacagtggtgacaatggcgatgctgctgttgttgcgttctttggagttcttggcgatcatggcggttgcatcgagcttggcaatgccggtggcggcggcggcggcggtgccacagccggagccggaggtgaagccgagcgacaccgacgcgctcaccatcttccggaacggcgccgacgcgcacggcatcctggcggcgaactggagcacctcgaacgcctgcgccggcgggtggatcggcgtcggctgctccggcgacggccgccgcgtgacgtcgctgtcgctgccgtcgctcgacctgcgtgggccgctcgacccgctctcccacctcggcgagctccgggcgctcgacctccgcgggaaccgcctcaacggcacgctcgacacgctcctcctcggcgtccccaacctcaagctgctctacctctcccacaacgacatctccggcgccatcccggacgccatcgcgcggctcctccgcctcctccgcctcgacctcgccgacaacagcctgcgcggggccatcccggtggccgcgctcgccaacctcaccggcctcctcacgctcaagctccaggacaacctcctcaccggcttgctcccggacgtcaccgccgccctcccgcgcctcgccgagttcaacgcctccaacaaccagctctccggcagggtgcccgacgccatgcgcgccaagttcggcctcgcctcgttcgccggcaatgccggcctctgcgggctggcgccgccgctgccggcgtgctctttcatgccgcgcgagccagccccgacgtcaccctccgtcccgtcgtcgccgcagtccgtggtgccatcgaacccggcggcgtcgtcgtcgtcggttgcttcgtcctcgccggcgttggccacaccggagtcgcgcgacggacccggcaagggggggttgagcaccggcgccattgccggcatcgtcgtcggcaatgctctcttcctgttcgccatgctgtcgctgctcgtggcgtcctgctgctgcagcaccggcggcgagagcggcggcgagccacccaagaagaggaaacgaggcggccgcgtcggcctggaggatgacgacgacggcgggatgttcggccaaggcaagggcgtgcagccaggccggccaggcagcgccggcatgcgcagcgacgacggcggagacagcgacggcgcgcgcagcaagctggtgttcttcggggtggacggcggcgaggacgacgacgacgacgacggaggcggcagcgacagcagcgccggcaggagggcaaccggcggcggctggacggcggcgccgcaccagcctcacgggaggaggagcaggttcgcgctggaggagcttctccgcgcgtcggcggagatggtcggccgcggcagcctgggcaccgtgtaccgcgccgtcctcagcgacggccgcatggtcgccgtcaagcggctgcgcgacgccaacccatgcgcccgcgacgagttccaccgctacatggacctcatcggccgcctccgccacccaaacctcgtccccctccgagccttctactacgccaagcaggagaagctcctcatctacgactacctccccaatggcaacctccatgaccgcctccacggtacacatccatgtctgatgtctcctcctcctagctgtgaatcgccatgagagtggcacgatgagctcgatctcgccattgattgtgtttgtcagggcaccggatgtcgggggagtcgccgttggactggacgacgagggtgaggcttctcctcggcgcggcgcgcgggctggcatgcgtccaccgggagtaccgcacgtcggcgatcccccacggcaacgtcaagtccaccaacgtcctgctcgacaagaacggcgtcgcctgcgtcgccgacttcggcctggcgctcctcctcagcccggcgcacgccattgcccgcctcggaggctacatcgcgccggagcaggaggacaacaagcggctgtcgcaggaggccgacgtgtacagcttcggcgtgctcgtcctcgaggcgctcaccgggaaggtgccggcgcagtacccgcagccgtcgccggtcgtcgccgccgacgccgccgcagacgcgcagaggaaagacaagaggtgctcgacggcggtgagcctgccggagtgggtgcgatcggtggtgcgggaggagtggacggcggaggtgttcgacgtggagctgctccggtacaaggacatcgaggaggagatggtggcgatgctgcacgtcgcgctggcgtgcgtcacgccgcagccggagcagaggccatccatggccgacgtggtgcggatgatcgagagcatcccggtggatcagtcgccgttcccggaggaggacagggacatctccaccatgtcgccgtcgatcggcattaccactgacgacggagatggtcgtctcagctgctagctcatcatcatcctcctcctcattgatcttcttttctgaattctgaacaactctgcctgctgcattttttctgatttctgaaatgatgctctgctcgatcttggcattctgaagtctgaaattgctactgcagctggtattatcttgagctgcttttcacttctgctgaaatgtcgaattgtcgatgtgcctgtgcttggaagatggtgcttgtgttcttgtaagataattttggattatgatgtcgaatgcatgctcctggagaacgctggcagttgctgctatactctgtttgcgtttgtcatactcctctatttttaactttgacacagtcttcgagatactagtttgatcaataatatctatataaaagtaaaatattttaaataaaaagtaaaatgttttaaataaaaagagttgtatattgttatagtttatttaatgataaattaccatcaattacattattgatttttttattttttttgctattaatagtcacaattataaatatttgacttgatatatgctaaaaatacttacttatttttggatgaaggaagtagtcggtatggttgtttctttgtttctattagcgaatgtcgttttgtgacatactaaaatgctataaaaatgagaatatgggcaatcttctactactatcacatcatcattttgttctttttttttctttgaagcggattgcgtatgttgtacaacattttggggtgtgaagttcatggcatgctcacgccagacgatgactgtagactatagtactatttcggttgaaaattagcatttgcattattattctattagttagcctgtgttcttcttgaggaggttgggaaccatccctctacacgcaaagtggtgtgatagagtaacgcatgattaaaaagaattaatatgatttttaaagcaattttgttataattgtttttacaaaacatactattaacacgaaacggaaggggtgagttgagaacataagacagatgctttccgaaagaacgattgagctaccctgattaatcaataccagtagcaaaaatgaccagcaatcctgcctcataaaacaatgacatataggtttgctaatgccaactgctaagccaaatacaaattcgtatctgttctagaagactaaaagtagtctattggaaacagaacaatccggtcaaacagaagcatcttgtatgaaaatggtagtccaggacgaaaaagaaaaaaaatgagccgacaactacgttgacatcgttaggtaaacgtaaacaaaattccttacgaaaaaaaaaaaacaaaaacacatgtagacactgtagagaccgatcagtggtccccacgagaccacgaagaccatgtccattggaagcgtagaagaaaagcggaaagagtttgaccgatgcatcggaacacggcccgccacgctggcaccagacggttttgatgggccggaccagtctcggcggctcggcccaccaccacccatccatccatccatccatcgcggcgcatcgtacggtccagagctaacccagcggcgggtccaaacccgcgtgcggcgcggcgcgtcaccatccaccgtttattcgcagctcgttttatcactacttaaccctttcttcgagatttcccttttcttggaggcgccacgtttaaagggcggagtcgctgtaattagagaagaggatttaaagagagagaaggccattctctcttgattgcttggagaggaagaagaacaagagccgccaccgccgccgttaggtttttatttattttttttctcgatctgatccgaggaggagcgaagcgaagaagggcaagatgcattcgacgaatctgctgctggaggagcccatcaggatggcatccatcctggagccatccaagcccgtaagttgctcgaatgctttgatttcgcttcagatttgtttggtttttttttgttgatgaaccctaaattcgattgatctgcggggaaaaaaatgcacagagcttcttcccggcgatgaccaagatcgtggggacgctggggccaaagtcgcgctccgtcgacaccatctcctcctgcctcaaggccggcatgtcgggtaaccaatctgcttgcttcgccatctcctgctcgatcgagctgttcttaaccttcttgtgttggtgttggtgttgtgtggtgcgaattgcagtggcccgatttgatttctcgtggggagacgccgagtaccaccaggaaacccttgagaacctcaaggtcgccatcaagtccaccaagaagctctgcgcggtgagcccccctcctcaccgccttcagatttactgcaattcgattcgatttgattcattcacggtcatggtctcttagtgtttgcttttgctgtttttgcatactgacattttgggtactctactccattggcattggcaggtcatgcttgacacggtcggcccagagttgcaggtggtgaacaagagcgaagcctccatctccctcgaggagaacggcactgttattctcacccctgaccaggggcaggaggcctcctcacaagtgctgccaattaacttcgctgggcttgctaaggtaatactccctttcagttcttttttttttccgaaatcttattacgctgtgcatgaatggttgcaagcgcataggtaggagtacctttcagtgctatttatgcaaaatcttattatgctgtgtatgaatggttgcaaatagataggtccttcttttatggaacttgctattttgtcactgcgatttccagcatatgctctgtttgatatataaaaaatgacttattgttttgtttgcaggctgtgaagccaggtgacacaatatttgttgggcaatacttgttcacaggcagtgagactacttcagtttggttagaggtaaaaatattcggcatactgcgcttagcgttctgcatttttttttcttatgtcattgtcagtaggatttgctttgtgcccacattttccgataccaaaactctaatttgtctggtttaggtttctcaaattaaaggagatgatgtggtctgtgtgataaaaaacacagcaactctggctgggtcgctcttcacattgcattgctcgcagattcacatcgacttacctaccctatctgatgaggacaaggaggtaaggaactcatttcagaatagtgatatgtatctccttatgtatttgtatttgatgtcttcctttatggaattaagtaaaatgttgtatatttttccttttggagcaccttactcaaaatctgtcctttatggaattaagtaaaatgttatatatttttccttttggagcaccttactcaaaatctgtccgatgccttaaatgcttatgagcatgtactgctttcaggttatcagaaaatggggtgccccaaacaagattgacttcctctctctttcttatacaagacatgtagaagatgtgcgacaggtaatacatttttttctcaacgttcccggtgttttgtccttggaagtaaccattcattgaaaacatggcattgctatatccaaatatgtgatctcctgtatgttttcatttggtacttgaaaaggaagttctaaacagtgctgacatctttcgtttcaatacaggcacgtgaattcctctcaaagttaggtgaccttagccagacccagatttttgcaaaaatcgagaatgtggaggtatttacaacatgcacttttaacatctctgagccagcttctgtttgttgtacagcctatcaaccccctatctatttttgcaggggttgaataattttgatgaaatcctccaagaagctgatggtatcatcctgtcaagaggaaaccttggaattgatcttccacctgaaaaggttagtatttctagcttacgtcgagcacatcagaaggcactgcttaattgtacatccgctacacttagtaccttattaacaagaattgtagttttctcaaattatggtgcaatacttgtctttggtttagttatactttatttattttgctctttgacctttgc

SEQ ID NO: 72107 - DNA, 4201 bp, Oryza sativa
catcggtcttttgcattctgtattgctcagtttcacgagtttgtagtaaatatctcaatcccattggtcagcttggggggattgttttgatgtttcctattcaacctttgagaaaattcttgatccctgtttggacacaaggttacctacatgtgtgtcagtagtcactatatctcaattgcacaaactagatagttttcactcacttctcttgaaatcatttccaaagcatagtgttctgtaccaagaaatatagttattgcatatcttcatctgtattattggaggcgcttagtgcagaagcataatgccataatatggtaatggtgagtgcaacatacagttcataagtcaaaatgtacaccaggaaagcaaaggaagcagcttatgttacttgagtgatgctatcttgagaatgtaaaccagaaaagcaaaggaagcacaacatgaaaatgtaacgatttgcttctgcagcagccttacaatatgcataacttattaatttgccactcaatcaaagacaagaaatatccatgaaatgtaacaaaatttacctcattgtcctgttcaagagtatctatatcttcatctgacgatacattctataatatttatactgaactataaatacttatatttttccgttctgtgatttgtctacatcacaagtacaacataagatactgtactaatcctgatctcaaggtctccctcctacatcaaagaggttaccttgggtgtttttacttatccagtcaacattccaccttatcttgcattatattatgcctacttgaatatgaaagacactacagtaagattttagttgccacaaaggcactaattgaaaagtttcaatattagatattcagtgcaggtatcctgtaataggtgcacattaatatcttccactagatctctctgtcttgcctacatggtcttttttgtttaaacagaaaaggggttacttgtttgtttttcgcatacaaagtcagggtcctaacaatgattgttttgcaaagttgcactatatgacacttcctactttgtagcatccattgttttatctgttcaacctctcactggtttttcatcaaataatccattttgcaaatgcaggtagcgagatatgctacttcaagaatgggatatgccagggcactgcttttgtggacattcctggagggcggtactacccagctgcgtcaatgtatacactgcctgaccaaccaaactgtcaagtcaggttcaactttggtcccaattttgagttcttcccagaagattttggaggtcgattgattcctcgaccaatgagtgacgtgccttatagaccatttgagctggcgaatggcgggcctgctgaaaatggtactgctgaaaaaaacatttaactgcagtgaaaattctgctttagttatgtagaatagagcataatcatgtaatccggttaaagagcgcgcaggctgattggttagtttgtctggttattaaatattttatcacctgaggttcttctggtttggccatttgaccttcgtgtagcaacgcatggcttcaatctttcccatcaacgcatggctttaatactgttaacacaagatttcgtcaataatgtttgacagaatctgatacgtcaaatatttatgacacgcgcggtccgctctgtgtgtgtatctgatacgtcaaatatttgtggcaatacaaggataacagcatttatgcttgacgatactcaatctgggcttctggggtagccaggtagtttggagaacctttgaagaaaaatatatcgaaatagcaatatcataaatgataacattttggacaccggtgcagtctccaagtaaagaaacacaatgtttgcaaagcaccggacccttaattttcaatgtttcatatcttaatcttaaataaacaaatacaacaaccagcttcatcattctgcgagataacagtgttgagcttgaagacaagtgattttcaaacataaatatggaatttgaaaagcctatgctgaagcacactcacaaattacaaagtaacaggtgactttttgcatagttttaaatgcatgtacataccaacatgagagaaataacttcaacttgagtgccatttgattttcagatggctacaggccagatcgtttttcactctgctcaatgccatatctcgatgctgcagcaatgaggtcatgctaggttcactccttttgcgtgccattttccgggagatgttcttccattttgattcaaattcacaggctgcacacaaataattcagtaaataggaattcttacgtagtagtgcaaacttgaaaagggaaacattcatttcatttcgatgcaaaagatgcagatggcacctgagtatctaaagcacatagacaatgttaatgtttctctgtgcagaaaaagaggtaacaataactaaatgtttctttatgccaaagagtcaatgaacatagaaaccttgatgaaacactaattatataatactaaacaaaacaagaaaagaagtgaccagtacagacagtcatgttgtcaaattgttttggtatggctaaataaacatagcttcctagggtaacatgtcagaaaagtaccaacctatgatacaaaataatttcagaaaaaatgaaatgactccctaaatcaagtgaaaactggaaaggaaaagttgcacttacaagctagagcactatatggctatacgcaattctagtaacatctcaaccaagtctgaagctgttggaaaatgatggttacaatcaataaccttcacttctgttgacaaatccttcaataaggcatgcgagattccatggccttccagcagaggaagctttggcaccaccttttaactcaccattatgttgtctcaggctagaaataataaaaatactttcatcaacacacgattaccatttcaacgtggtacgactaaagatgtactttctttgtttcataatgtaagactttctagcattgtccacattcgtatagatgttaatgaatctaggcatatatatgtgtctatattcattaacttctatatgaatatgggcaatgctagaaagtcttacaatctgaaatggagggagtataaatttacttctcatctttgtactttctaagttctaaccatgttaagtgctatgtattccaacaagaaccgatgatcaacacacaaaaaaaaaccccatatattgaagcatgtatacaagcctgcctgagcaagacaactacgagtagaatatttcaaggcaactacaattttatacacgaataaaaggacaagctttggtatgcccaacgagtaacacagttctgcttgtaaatcacagcgtcataaattgaagataggtagaaacaagagcaggcaacagcttattcagtagaaaatattatgcatgtttaacatacattgctaaaagtagaacaaattaaggtttaatccatgctcatttttttttgaaaggaatcaatccatgttcaattatcttcactaaagggactgaacaataacctgagcttcatttgttttcccaagtcctaaaaaagtactaaatatatgaaaatcgcaaggatttcagtccaattgtcatccgaatcatgtaactttcaggcctaatatcacatctcatagtgttaacaaaacaatagcgataaattgggggcagtatttcaatcactaactggcggagccaccataacccacagaatcttctgaaacagctctagaaacagtgaatcaaagggattcggggaatcaccggcgagggaaatcggtggtgacgccgacgtaggtgcgggagatccgggaggaggcgatgaggtagacgcaccagcccaacgccgccttccccttcgcggcctccgccgacggattcccgggcgcgcacgaggccgaggccaaggcggcggcggcgggctcgccggatttgggaggaagagcgcgagggatcttcgccgatcggaaggtagcggagagattcatctcccacctcgccggcggaggcgacgacgccgtggggaaattttcgaattgggctatttttagcacgtgagttttagagggccgtggggcgtgttggacatgggccgaatggacaaatgggccgtaccgaaatgtgagcctaattcgacacggccattttaagcctggaaaacgtggattttttcatttttaaatttat

SEQ ID NO: 72108 - DNA, 5335 bp, Oryza sativa
acaccgctggtcaagaaccaggcagtagtcgtaactggaccacttaaagtggaaatagtgggagaaacgctacatcgctggtcgagaaccaggcagtagtcgtaactcgaccacctaaagtggaaatagtgggagaaacgctacatcgctggtcgagaaccaggcagtagtcgtaactcgaccacctaaagtggaaatagtgggagaaacgctacatcgctggtcgaggaccaggcaatagtcgtaactcgaccactagaagtggaaatagtgggagaaacgctacaccgctggtcgagaaccaggcagtagtcgtaactcgaccactagaagtggaaatagtaggagaaacgctataccgctggtcgagaaccagtcagtagtcgtaactcgaccacttgaagcaaatgtacgagagatcactacgatcaactggttgagaaccggtgagtaggaatcccttgatcacatggagtcgtggtacgaggaccgctacgctgctgtagtcgtaccttgaccatctgaagttaaggtgcgagagattgctacgtactggtgcgagaaccagtgagcgagcagaattatctctcgaacaccaatggaagttgcggtgtgagagattgctgcgtactggtgcgagaaccagtgagcgagcggaattatctctcgaacaccaatggatgctgcggtgcgagagattgctacgtactggtgcgagaactagtgtgcgagcagaattatctctcgaacaccaatggaagtgctagagttggtttattgcaagtgtatctcatgtggctagtatgactcacgtacccaacttatagcatatccggatgtccgttcgcaatcatgtcgggtgatcaggccgacgacgttcgcgaggaattatccgttaacaaccttttctcgagtagtctagccatggcagatgctatgagatagggcgtcggtctttgttggtaggttgggtgcgataactccgcatttgtcgaaaatgttctcgataatggagtgtactcgaccataacctactcgagtgctcaattgttcctgaaaaatattttttagaaggcaagatatatagcagataatatcgagtatgtactcaaaaaactgcatggatcttctagtattatcaggatacaacaagcagatgcaaatattaagcattatgtaaaccgtgaacaagcatgatttatacagaagaaaacagagtgagcccccagcgttagaccgtagttggtttaacgtcggaaacatccgcgcaatagatattgtataaaaaacatgctctaggtaaacgtaataaattatagatctgacaatgctgtatcatctgaataggtacgataaattgcatataaaatattgcgtacctttgtagatacatgccggatgtatctacgaaattagtagaccatttttaaaaaatcaatctactaaatacctgatcacgggcggccgttgatttatctgaataatcaacacgttgcaatttagacagccatgttggtcttctttgcaggtacacgtcggccaactaatgcatgcatgcctaagcacgtactgagtccatgcatatgcatgtgtacacgtcaggagcaagcatattagttggatctttgtcttgttgttttctcgataccttggtagacatccgtgatcaataatccctggaacacatgatgtcgggatggatgttctcagtatgcgtcaggggtccaaaatttggatcctaatcggggtgtgagaacgatccaaatcccaaaagaatccagtgaatagatcgagatgttgattttggttcctcgatggccgggtttctgagcaggcagcagcattaccgaggttaccaaaaatcagttgatgatgtcgcttccgaagagatggagatcggagacctcctagttgataatatcaagtcactgttctctgtggcggtgacgtcttgaagtttggtcgatctcgagagatcgagttgttgacgacgatggttccgatctcgtcgagagacatactctggtcgggttagatctccccacagcgaagtcgtcgagtagcttgttgtcggagaatctgtcttttgaacccatctcgttgaaatcctagagcaccaaaatccccctacctggcgcgccactgtcgacgtttgatgtctcgactatggtatttggacagtatggggaacgttggtgctaggatatacacaagactgaggtaaaagagatggagacgagtatttttatacaggttcgggcccctgagctgtcaggtaataaccctacatcctgttggctggagccggagttgcttttattcaccataatcacaccaatacaatatgtggggtagcctatctaactgttatcgacatgtcggtctgaagatctgactcgtaatcgacaacagggtagccttcctcctcgaatctgtgcccggcgagatcagagatagcgctttcgtctctcctgacggtatccggagacaccgtaggggaatagccatgcctatccctgaagtcgatatccggcgtcttgtcttggagtatgttggcttgtatgttgtggcttctatgtcgattgtgttgggtgttgattgtctcgtcatggtgggtgttgatcgtgttgatcgtctcatcatggttgtccccctgtcctcctaggggggcttgtatttatacccataggtgtccccttgtccaagtagaactagggaaaccaatatggatacaatccgagtagtccttgtcgttttcatgtagaactctggttgtctttccttatccggaactcctcctatatccgcagattgtttctatataggacatggtatgtggtgcgtcctgccgagatttagtcaactactattaggtatgtagtatacataaccctgacaacgaacggtcaaatatatttaaaatggtcaacggcgtcaaacatttagggatggagggagtagcaggttaaccttccagcctggtgggtcttcatggccagcccacttagggcccaagcccgtgacagtgtgataatgtgaaatgagaaggaaaatgatttagttgtagattaatcatgctaggttaaaaataataatggaggtgatgatgtagcttaatagaaatatcatttattacacttgttgggggccaatgacgttggcgttaggattcaaccacccataatgtgcccattcattctaaaattaattggaggtttctaccgtcttgaaaggtaaatgcattattagtgttaacggggaggtgttatgttatgcaatatttctagaacaatgaggtatggagaaactttcaatgactttaaagtttattcagttcaataaaatggtcattttggttctttactatccaattatatttattggtattatcaataatttcgtaggacatcaatattgatttgataaaagaattggcttcaatccaaaatttagccaaacattattgagtagaggatcaattagtaaggcacattttgatagctatccagaatggtccgtacctcacgatacatatcaactcagctaatatagtttagttttgctatgataatcctaaaaggaagacttagtatcctgatctaacattttttttagaatatgtcattaggaggggagagtttccccacctgtatttcattgataaaagggtgcctagaagtacaagatcattacaagatcgttacagatttagagaacgaaaggaggaaaagaggagatccttccaagctgaaattacaagtctattctcgaagtcgttcagcccagagtagcatccttatacacttcaccaaaaggcgatgtaatgatagtggttcatttctggaaaccacaccatgacggtggttcgagaggttccaaaagcagaaaagcagagaagatagaaacacatgataatgcctcttttgctgctgacttctgggagctactgaacatcctgatctagcatgccaaagtaacgagtgttatctgatagtatgatccctcaccatggtatgtagtggagtggtttacagcatggtatgtatctgtgagataatactgatacacgagcttgggttgtcatcactttcactattcttgcgtgtttcctaatgcatcctaatcctaatccctccatgtcaatgcatggacagagttaccatgagttttagattttgcgcggagagcatatgctagtatgcatcgcgtctctctctctctctctctcttatctatctttgctccccttaattgtcaactcatttctacaaatgttgaggcgcatctccttctattatttgccaacaccactacttatatataattaaagactagaaaaatacccgtgtgttgatacgggaggaaaagaccgtggaagcgggcgtcgttctatggcagagtccgcaatgtcaacgaaggagtaatcatggcggagctggtggaagtagtgtccagacaccttggtggttgatggcacatcgccgacgaagcttagtgcggccgactacaggagctcttgccggcatggcaaggaaaagcttgctggcggcagcaagatgacgacacacggcttgggagggacagagcggcacggaatgaaacaattcacgtccttggtggcatgttttgaaagtgttgcgaattgagtggcacatcctgaaggtggtgcagcaaatcgaatggcatcttctaaaaattctctcctaaaccatttgtaatatgtgatagtagaaatgccggcatgtttgcaatggaaaaagatacaattgcgtatgtaaatcgggacatgtttatatgtgtttttaagtgagaccgtcataaattttaatatcgattcgtcagttccaataaacatattgtcatgggcggatcacccaaaaaattcttagcctaacacataaatatacgtatgtgaaaagaaacttttgaaaaaacgaagaaaaaaggctcgtttttaatatattatgatgcatatttgatccatttatacttttagctttgttatatataagttggatcacccatataaaagttcgagatacgtcattggtattgttaaatctattattaattagtcattttcatttttaagggagtattgtttccagtttataaattaattacatttgaggtcaaatagtagtatttttttacctcaacaaattgatagagaaatgagaaaaataaaaggaagagaggtctggtagggaaaaaaaataaagaaagaaagcagagcacgagaacagataagtcataagtccccattttcactttctccttcactttccccaaatccatccgctctcatctcgtgtcctttactcctgtctagctg

SEQ ID NO: 72109 - DNA, 10636 bp, Oryza sativa
ttcccaagtagtgccttacaaattaacaacagattatttaatgtacaacatagctgcgagcttctcgagttgaccgtgagttcacaacagcttgaaagcttcagccggaacagctcagaccttggatggtggaggatcctgaataccgcagagcaaattcgcgggcacggctacatcgatcatctttggataggccaagttcaagtctgcaagtggacagagtaaacgatccagatcttgtttagtgtattaaaaaagtggaggtaagatttgatctggtaagtgcctacgtgagcagaagtataatgaaaatggatattcataaattgatgcgagaagaaaaggcacatatccattgttaaagactctgaaacttactgtccataattttcttgaatgtttcctataaacataacaagtaaattaatatcagaaaaaatatagcttttattagttagatgggtgtaaagaattagccaaagtagcatgtaccttatcctttgttagtcgagcattatacgcaacctcctcttcaacagtacttacctgcaaaataaaatagtcaagtgcctggtaccttgattagtgagctttaagaaagtgagcacttactgtgaaacctttgtagtcatggccaggataaagcagggtatcctttggcaatgtgaaaatctgataaggataaaaaagtcagctacctacccttcatattatgtatgaagatgatgtgtgcctagtttcaaaatattatgtatgattgcctaaaaaaagtggtatgctattctataagctgatgtgtatttagtcttaaaaaaaggataatgcatacttgcctgcgaatgcaccgactcatacagctcatcagaacttcctccctgtaataccagaaaacaaaataaacaatctatgtttaaacagaatttctctagaacatgaattctgagcttccgtatgcaagcaaacttatgcttgactaacagacagaatacattcagtccctattaatttaattaaccacggtatctttagatttcaaacagaacagttcctgatcgctaagccattaagaagtggcagtggtaacaattacctgaaagtctgtccttccacatgcacgtataagcaaggcatcaccagtaaaagccattcttggtgaaggttgatcatcgccttcacctgttacataagtcacacagccagcagtatggccaggagtagatcgtacctaaaaagcaattttgccatttctgatatcagaaaatttcatcatatccaaaatattacatgacggatagaacaaagatgcataattttcaatgctgttttattcagcagcttggttgacagtatacgttttcttattcatattatatctgtcatggatatgctataaatacctaaagccaaactttcaataagaacacaaatttcaagaatcaacatatccacaaacaatggttgcacagctgagaaaatatttaatatcacccaaacaccatatctccataaacattcacattacctcattttgtatgaaccaagggaaaatacttttaaatttgttatacaagtctaacctacaaaagtgcacagtttttaagtcctgaattagctgtgtggacaactgtttatcgtcttactgacaaacaccgcaaagttaaaatgattaaggaaacaaaatatacatatatgaatagatcacataaattatgtctctgaccaccaccaccacaaacagaccactcagatgaccatatacagaaaaagcccttttataattagaagtagacaatccgttcatatttgcagcctgtatagagtgagattctaggggaactgctgcaattgccatactccataaaattcagaggggtgggggtggggtggttgagagttcaggattaatgtttattaagttcagccagagagctcaaaaggactagtttcaatagtccccataaattatgtcagtgcttactaaatgaaagaagaaacacatagccaaacagctaattaaaatgggattatacctcaaggaagaggttaccgaagtatattttgtccccatgctcaataaaatggtctgcttttgctttgcttacttttgcaatcacggactttactccaggtaacttagtctgcaagtacattccatcagatgaccatgttatgaccaaagagaacaaagtatcaagactatgaaaagaaaacatatcacaagatctcgagaagttcagaggttggaactatttacctttattaatcctgttccagtgacatgatcagcatgcacatgggtattcatagcatagactagcttcaagcccaactccttgataagattgagatctctatcaactgttctgtccacagggtcaatcaactgataacacaaaaccaaggacattagggaggtgatcaacaaaatggaagcaactatagctaaacatcaaatctacaaaaacagcatcaatatttttttctgatttagtttagtgcttattgcgctagtctagtctgtcacatatatagagaaaaaggttacattttttttcattttggctcaatcaatacgataattaagaaaacaaattatttgaaaatacttaagcaaaaccgtggagaaggttaagttttgggattcttgaacaaattagcgagattgcgcatttatgtaatgtagtgccaagtccaagataacatgaatatatgtaacccatcagaatgatatcaagtaatttgattatctttcatagtttataaatgcacctcctgaactggataattataatcaccgtcactgattgcaacattgccaatatcttgcgtactgtcagacattaaaaaaacgcaagatgatctttaaattagttagggataccacaattcacaggtaataatcaattattccagtcttatacctatttggagtatttagtttgctatttaatttatgttggtatctacatttctgcagtagccactgaaagagtaatcctgcttacggtatccataaaagaggcttccatttacccaactgatacccagaacaacgaacagatggtcaagagcatcaactactcaccacggcgggtttctcggggtccccgacgtcggcgaggaggtaggtgtaggtggagctctccttctcgaacagctgcctgaacagcagcctcctcccctccgcggcggagccgctgctgtaccccgccattgcgagcaccaccggcagcagccgcagtccccgcgagatcggcctagcccgaggagcgcacgacgatgacgacgacggcgcggcggcggcgcaggcggacaggtgcgggatcaggcggcggcacgagcgaagcagcgccaccatttggctcttccgccccgcccaggccagcgctatataataaggcggaggtacgcacgcgagtgggaggaggaggaggaggaggaaatcaagacgcggaagcgaccgcgcttggcttgggtgttatcggcggcggtggacctcgcggtgattagctcacgcgccggaataaacaaatggggagcggagcggatcgggtcggggtcggggaggggaggcgagtaggcgacggcagcgatgatgtggcgacaggcgaggtccacgaggtcgccggcggtgccgtggtttagctcgcggtcgcggcggcggcgggtgaggacggaggacgagatagctaccagatgggggcaggggatgttggcagttcgccggtttccgctaatgtatcagcggatacgctaatcaggcttcagaatttgttcagatacttttttttttttttgaagaagttgttcagacaccaatattacatgggacgactatttttttcttgctaaattcttactaacactgatatgtcattctataagtgcatctagattttatataactttcatctacttaaattaaacggttcagatgattgatagtaaaagtttagtaagaaaaaattagtacgtgtacaaatcacggatcgggctgttattataggttgaactaatcgtgtaccactaccactccagctaacaactactactacttactactaataacgagcaagtgatggatgacctcatggattacataatgcgaaaggaacgggggaataaaaagtgggggttctggaactccaaatatttaaaggcgtaaactgatgcagcgatgcgtgcgcgtgttttgttcgtagtacgcgcgtcgggaacaagttgatcgcttatcagttgcgggctgcactgcactagtctgacgcggacgttccgattgatagggcaaccaacaacaagctagccgcgtaatcaagcactgggctcaggtggacaccggcagtaaaaaggctctttggattgggatgtttggtccgacaatatcccgcggcaatataatatcctgttttggtttgttatagcactactaaaatattggttcgataaagttgatgggtatagaattggctgcacctgtggtacagctaacatgaacaataatctgtgttagcaatacagttctgcagtgctaatattgataatgtcaaatttatagcggaatgtttggtttgctaaacgcaacacaaatttgggtaggaaagagaattaaaacaacccttacctttttcctttaaaaatatataaatagtattattaaaattaaggggacgggacggctcgtagtatacaatcaagacgccgatattaggaaaagacttaatatgaaataattagaaggggtgaggttttaaacccatatcgtctagcccactaccttgtggagctagctagaaaacccctaagcatttatgattctccttatctcttcatcctcgtcccgctcctcatcccatagataccgcgtagtttcatctcgcgtgttccaccctgctcactccgtttgtgcgcgttgcgccatcccaccgtgtgctctagatcctcacgtttgcgttgcacaccccacgcgtcagggtggaaccagctcatagccaccttcaactaaccattgttgaacacatagtaaaaaaaaaatctaatctctatgatacatggtgttgttttaagaatgtttggtttgctaaacccaacacaaattatgggtaggaaagagaattaaaacaagccttacctttttcctttaaaaatatataaatagtagtatcaaaatttaggggacaggatggctcgcagtatacaatcaagaagctaatattagggaaagacctaatataaaataattagagggggtgaggctttaaatccatgtcgtctagcctattactttgtggagctagccgaaaaacccctagacatttatgattctccttatctcccgaggatgaagaaatcgggccagaacatcattagagttctgaattgctaaatttgcaaagaatgaagaatgtgcatcgaaaataataacatattaagactgtggtagtattactagcacggcaattgttcgatagttttcttctaaactgacacgatgatgcccaatcacaccggaccatctcgtgggctcgtggcaaatgttcaaaccggcccggttggatgcagcattaggccgacatgtaaaagctctgtatgcttgtagcccacaacaaaaactcctcgattacgagcttacggctaactccattcggccgtggacacaacggaggcctctacaagaatccaagacgcaaatgctcaaatggcctaatgaacaaagaaagggacaaatggcctggtgaccgagacaatcaggcagaacacaggagaaatacccaagaatcccttctctagaacagatcaacgccatcaaatatactccacacttccacagatcgacacgcatggatgccggattcgacactctttggccgatggtacgagctggatttgcacgcagcctcctgctacatttcgtctgtgtcgtctgtgcgctgcagtgcctgtgtgcccaccacgtactctccaactatacatgcaaaggcagccacacgtacatacactgtagtttcacccgctggctacgcccacagtttccaactcccattggacccatgggaaaagacaagcttttcatggtttctgctttgtactgatcatacagaccaacagtgctaccactgccacagtagaacaaatccgtttagccattgtaccgcaagcctaatgcggacaggatgagtacattataatctctgttagtatagaccaagcaacaattagccacgccgagtttactgtggcttagccattaaattactgtggcgttgcccatttgtagcctcatggctcggtcactccctccctctctctctctctctctcttcacgggagggcagtgtggttttggtcggattccgccaagttaggcagcacatgcgctcgccttcccctgtttgtccatagttccatacacctgcaaacaacgccctcctttccctcccttaattgtcggggcgctctcgccgcccgcgcgccactgcgctgctacacgctacgggataagccaagcttgcttgctttcgtagtcgctttgctcgatcgctcctctcgatcccatcctagattccactcggttctgcttctgctccttcgatgggttcccgcgacggatggcggctactcctcctcctgctcggcttcctgctcgtggcgccgacttgccgcgctcgggaggcgcagccgctgccggtactggaggaagaggaggtggtggcggacgcggcaggagggcgtggtggcgcgggcgctgctgccggcggaggaaacaggcgcgcgccggtgcggcacgagctgtcgctggacttctacgccaagacgtgcccggccgtcgaccagatcgtcggcaacgtcaccgcgccgcggttccgcgacaaccccgccgccggccccgccgtgctccgcctcttctaccacgactgcttcgtcgaagtacgtacgtgcacaatgcacagcccatgcacgctgcaatgcgcgcatacattgtgcgcaaattctctcgtgcaaaagcacctagatagcacaccttgaatattacactgttttgttaccgccacgtacattttttcttgccacgcatcggtgtccaattctgatcgatctttgtgcgttgtcatcttctcaggggtgcgacgcgtccatactgatcgcgccgacggccaacaacggcggcggggcgccgagggtggagagggacatggaggagaaccggaacctgccgcaggaggcgttcgacacggtggagatggccaaggccgccgtggagaaggcgtgccccggcgtcgtcacctgcgccgacgtcctcgcgctcgccgcccgggacttcgtccacctggtacgcacgcacgcatgatgcttcacatttctccaattctgtctttacaaaaaaaaatacacccaaaaggctcgttctttcacgagaaaatccgtgcattttgtggcgactgtgaactaaacaaccaaaacaactagtaactgtgcaagtacagtcctatacaaccgaaagcgccaacaaactgaaacgtaaggtacatttcagtgagaaaaaaaaatactagcaatgccagttactcttagtaattactgctgaaatgtacacttgtacagtacctggatgtacagtacagttgtacagtaatttgagagagacaaaagagagaaaaatgtgcgtggcaatacaactcccaactgtcaaagactcagagttagtgtacaagttaggagttaggaccatgtatgtatgcgagtccggggaaaagaactctgctttgctttcgcatgtggataaaggcgcattccccattccgccgatgggcggcatgtgatctgtgaagccgaagccaacgtcgtcgtcaggaacagggactcctgcctcctgcgcatgctcggctaattaactaactactagtagtagcttatagctttaaccaactcatgcatgcagctaataatcatgcatggtttttctcggcagcacgtacgtacgggcagccggtaaatttaatcaaaggtgatcagcttttctgttgcgccgaatcgatcataaaacggtagcaacagtgcggtcggtgatctattgctagctagttgatgcactggggcgcctaaagcaagcttaaatttgtggccgtgcatgtgttaatagcaggtcttggttttgttagcatcttgcctctgagacgagcgattgttaatgcaggtcactgacattgctagctgacaaaagcgatcgagtacgtagtttgtttccgtgactcgttgcctgatccatggtgacagagtcgatacctcaacgggtaattagctgctggggattcgatactcgcttggatcttagtaatggtcaccacgcagagacaaggcaccagcaggattaagttagtcaggatcgtgtcaagagcagcagcggattcggtggtgtattgggcacatggacatggttttgatcagcgtgtgtgtgcccgacgtctgtcacggcgctgcccgtgtatactctgcctctgcgtctttctgtagttaagctagctagctagatagccaactaacaagttggtctttggtttgttgtccgtttgctcgcctgtgaagcctacctctgagcaagtcaagtgtcgtgttcttcccatctctctgcctctatcgtttgatctccccagtgatgatgcctgtgggcaatagtcaagcctgcttctgcctggctggcgcctgctttgttgggtagcacggtctctcttctttgcagtgttggttgtgcgtctttctggaccatttacgcctaggtagggagggtttcacaactcacgaaaggctaaaatcagaaaagcgaggtctttggcaagtagtactgtactagcttttgttcagagtactggagtggtaatatggtgtggactgtggagtgatgagaagcatggaacaaaagcagttcatcccaacatgtcttttcctacggatctagcagcatacttaggaacttctgtttttttagagagaagcatatagacttactacatgtgacggagtattttactactcatttttcttcattcattcagagtcagttaatttgtgtgaaatctctaagaagtattacaaacaaacccttaaaaatacaataaaaacaacaattttaataacagcccaggagaattgggccggtgagactcatcatggccgagctgaattagaacagcccatctatgctaagaacttatttcagcctattacaaggcccaacagcccaaacctaaaatttcacctattttttctgtgaacaaaacttgattttctttctttgttctttgtacgcaggcaggtgggccctactacgcggtgaagaagggtcggaaggacagcagggtgtccctggcgggcaaggtgcggggcagcctcccgcgcgccaactccaccgtggacgagctcctccgcgtgttcgccgccaagggcctcggcgccggcgacctcgtggcgctctcgggcgcgcacaccgtcgggttcgcgcactgcgcccacttcctgggccgcctctacgacttcggcgggacgcggcagccggacccggtgatggacgcgcggctggtgaaggcgctgcgcatgtcgtgcccctacaccggcggcagcgcccgcgtggtggtgcccttcgacgtgagcaccccgttccagttcgaccacgcctactacgccaacctgcaggcgaggctgggactcctcggctccgaccaggcgctgttcctcgacgcgcgcaccaggccgctcgtcgaggggctcgccgccgacagggagcggttcttccaggcgttcgcggccagcatggacaggatgggctccgtccgggtcaagaagggcaggaagggggaggtcaggcgagtctgcagccagcacctgtcctgaacgtgtactggtccaaactcggacgatcacactgtctcgatcactcgatcacacttggcgttacaggagttatcttttgctgtaaactgccacatttcggaaagtattagtagttccgttcttttttttttcttttgttgggtgcactagtgctaggttgtgcagggattgttaattttgcatggtcactcgcatccgcagtgtgtgaggcttcctatttgtctgattggattggattggactggattgcagaagagagggtggtcagtgtcttttttctttttacttcaggttttatcggaagctagctcaacttaattttttaatttgtttgggacaaataagacattcatggcgtgctacggatgtactatgctgcacttcttttaatatatcgacgtgtaaagcatttacgtgttcgtttaagaaaagatgctcctatgtcatattcttgaaacatgccaacaacacaacatccatttaaattagttcttagtaattcaaaaacatgatcaaagcattaggttgtgtttagttccttccaaagttggaagtttaggtgaaaattgatacgatgtgactaaaaagttatgtgtatgacaggttgatgtgatggaaaaagttgaaagtttagggaagtttggatctaaacacagccttattgatatggccaggtcatggaggaactagggaagaagttgttctccaagactgtgtttagttcagcgtaaagtttgaattttggttgaaattg

SEQ ID NO: 72110 - DNA, 10112 bp, Oryza sativa
tcttgcttctagatcacaacatgaactagaagtttccacaaaacaagcaatatttgtgggttctagtgtcagcgatactatcaaaacatgtattgccatgggaaatgaacgagctgcactcaaagtgaagtcagagttcaaggtattgaaaatgccttcaaaaagaaaattgtggctgatgaataataatattgtaatctttctattgtcctatgctgcataggttcctgataagaggtggtactggctcaaatcatgtgctttagctacagttgggaactgggatgcgttggaaaagttttcgaaagagaggaggccaccaggaggtagatttacctattatgtatcatctattcatgagaatctgattggagaacaacattcatggttcttccgcagggataataaattcacaatattaattcatgtaaagaaatatcattaatatgttttagtatgctgatattcggtttccttacaggctataaaccttttgtggaagcatgtattgatgctggtcaaaaaactgaagctcttaagtacattccaaagttgacagatcctcgtgaacgatctgaggtatattttacacttagttcacatattacctaacaatctttggtatattttagttaacatattactccctcggtcacaaaatataaaggattttggttggatgggacatatcctagtacgacgaatctgggcaggctcattatccaaattcgttgtattaagatatgttccatcgaaccaaaatcgcttatagtttgggccggagggagtaccttctaagagttctagcagagattaagattgaagtgaaattagtttgatgcccctgagtatttaactcattaggaacgatcacacccagtgatgcaacgagaaatgcagggaatcatgaggtgtggttggattgagaaagtagtacactagtactctagaaatgcttactgcccaacgaaatatttgcaaacaaaaaaataatttgtgatagtacttttatatatgtgttcttagcgatataaaaacaaaggctgcaaaataaactttttcgatgaaaaaaccccaaagtcaactccagatgtaaggttgaaaattcaaattttgaacataagcgaaaagatgaggttaatatttgtggacagagagagtataacataacatttgctcaaaacaaattgaaaaagaaaaaagtcgaagaactcatcctagtattctttgtcttctctgaacatgtatttctctccgttgtttgtttcaatatacatatgattttaccttggcgttgttgttcaggcatatgcacggatcaagatggcaaaggaagctgcagaagcagcttcacaggtcaaagatagtgatgagctatttggtcgcctaaagcttacacttgcacagaacacagccgcggcttctattttcgatacattgcgggatcgactatccttccaagggacatactgacctatacgtgtttggccatgggatttgagttttgtgcacccttggtacgtgcaattgcgcaatcagatcgtatcaattcatcttgatgtttctaccattttcttccttgtgtaccgactccacagtgtgaatacccccgtccacactccagctatgtaaaatgtgtagacgattttgaagcgcgaatgtggatcagaggctttttttttttgtagatgcctctttgttgatatgccatgtttaaaaagaaagagagagcatgcattgtgacaaatcaatctgcacgtccatccgatttcggcttaaccattactttttcagccttcatgctcatttgcaagtattttgcaaccataattacaagtattttgcaaattaacacaaaccctgatgagacagttaaatcgttatgcactcaataattttgtgcgccaaagaaccgatctgcgtcagcctagtacacgaccaaaccaagcagattatatatatcaaacaccaagcaagatttaagtctgccaattactaataacgccatatgcataaggtttgccaagcatgttccaaacgataaataagtatcaaaatgctcaaagtcttttgcgcatcaaaactttcaacaaacgaaaaactttccaactcttgtactaccaaacaaagatccacatcacttcgtaaccaatcacatgaacaggtttggcctcgacgccttgaacgtggtcttgagcttcctggttggcggcctgaccttgcggtacacaagggggaacttgatgctcccgttgtggaactgcttggtgttgtccctcttgcagagcttgaagtggacagtggcggtcttgatgatctggatgcaagggaatctcacacggtggcgagaagccatctcggtgtacatctgttccacggcaccattcaatgtagtgtcacggtactccttgtacatgttgtggtaaccggttctgctctggtaacgcagccagatgccatagttcttgatcgtggttgggttgcgctcgaagatctgacatggcagaaattgtgaggggtagagaagaaagtattatatccatgcaaaaatgtgaaatcatactagaagtaaagtgtgatctagtgttcaaaaattaatgtctccatgttgggtaaaatttctggagaaagaagtcatcaatcagtgctagagtttcaaacatcattcaccataaacatcccaagtcccaacaagctacattagatcaaaacacagctataaggactaatacaagactgctacatgagtttaaatataattatatatataatgagggtcatatctgattaatgattttgcttttcaccatttactggcatctatccacagctgatgtgtgttctaaagatgtattatgttaaggccaattcttacaagtataaaatggtttaacccctacaaagccatgatgcagaaatatgaaaaactcgtttgcaaatgcagatggtccccctaccccaacacaagtgaaataactagtgaaacgaagatgacacacagcaagctcctaacaaaacaagggaacactagtgtgtggcaatttgaataattgacacaaagtgagtacatgcaaatcgcacgtattataacaccagtaaagagtgatcactaacagtgcagtaacaaggaaacaacatacgagctggagttaaaaaaaaatgccccacatttggaacaggtgtcagtgtcacttattagcggtcaatcagtatgattaatatctagaactaggttacaaatgtcagggagcaatcagggcgaaatacaatacgtttgaatttctagtacctcgttgatggcgagcatctggccgttgctcttcttcaccttcttcagcttcctcaggaagtacctgcacaccgggcaagcgccccaatcagcaaaccgcacgagataagatgaactaaaaaagaaaacccacaaaatcgcaagaaaatgacgagatgacggctcaccagaacttgctcttggcgcggacctcattggtggcccagagcttcatccggtagatcttggggtgctcatcgccgggggtcggcagcgcgcgccccaccacctggtactgatggaactgcacgcacacggagaggacagatcaatcaaacgcacggaggcggccacatccaccgaagcaacggctgcttaccctgaaggccaccatttccgcgagctcctcgaaaccctagcctagcctaacctacgggaggatgggggagagcgcggaggaggcggcgggcgaaggcggcgtcagtgggatggcgaggagcgtttataggtggcgagtttggtggtgaaccctagtgggcctagttggcgttgtaatgggcttttgttacaactagtacttgggctttgttttttattttcctcaaaaaacatggtgcatgtcagcaactcagcatttgtgatttcaattagagaaatcattagcagcctctttttgaaagagagagtttgggagttttttttttcggagattgatttttttttattacaccgaagagacacatgtccacacatgtgatgtaagtgcctttctaacacacaattaaagagacaaaagacttgcccaaaaaaaaatagagagacaaaagactagcgacaaatcactgatgacactaaattcgaaaattggtggataggtttacacccaagactccctaccgcactgtggaaatcatgtaaatgtcttgttttccaaattaagagtaatgcagaatataaaacatggatcaccaacggtgggaattaattgaacgaactaagcgttgtttgcttcaacgtctttcaaagactaattaagattgtgttaagcatctaacattataattcgtacagaaaaatcactgataacgttgcaggctcttgcagcaaccgtgtaaaacaacaattttgtacaccatccttcatcaggtaatcacactacaaactgaaatacaaagctacattcacatcaaaacaagagaccggctgtcaattacaactgcaggtagtgccgttcgaactgcagctggccgtccacccgatcgtaatgagctcgatcatcgccaacatcgtctctgcgctgctcatcgagctgctgctgatcatcgccgccggtcatcaccatggccggatgatcgcactcgtagcgcggaggtgcagggccaccgccgaggtacgacccgcgcatgatgaactccctgatctccggcatgtcgatcagcttccggcgagggctcgggcatggaggcggcggcgtcggcggcaagggaggcgggaacggcctcaggatgtccttcagccatgggttgagctcgatggactcctcctcggtaaaggtggcggtcaggccgaacaccctccgcagccaccacgaaatgctcccgcggtcggggtcgtcgtcgccgccttcctgctggtccggaggcgcagccgccggcgacggggacgtgttcggctcctccggtggagatgatggtactacacggtggcgtctctggcgccgcggcggtgaggcgatgtcggtggtggacagcttcctcttgtggcgggacatcgccgccgccgtcgtgggtttcctggcgccgggcgcgcgcgggctgaagtagaccttgctcaggaccagctgctcctcttcgtcgacgtcgaggctgagctccaccatcagccacccggagcggacgcgctggccgtcgtcgtccttggtgatgaaggagaagctctgccggtgccccaggcggcggccggaggaggcggcgagcacgggcttcgcgccggcctccgagtgccagcacccggcgccgtcgtccaccgtgcgcgccttgcggccgcccttgagccccctcacggcgctgaagaagtaccacgcctcgtcgccgctgctcctcgccaccgccggcgcgaaccccctcgtgaggtcggcggggtcggcggagtacacgtccgcctcgtggatgatgaacccgcacgacgacgacgacggcggcggcttgtcgccgggagacgacccgtgggcggagctacgtctcgatgagctcctgctcggaagggtggacgtccatctcgtcgtcgtccaggcggcgcggcgccgtgcagcggctgcgggggaggagctcggaagggtggacgtccatgctgccgcctccgccgccgtcgagacggcgcggcgccctgcattggcggcgggggcgggaggcggcacccatggcggcggattggcgcgagggtatcgaatgatgggtgggaagctatcagagtcgcaagcggatacgaatacgggatcgtacgggggatgaagtcttcccggtttatatcgagcccatcgcgttttctcctcgtgttgtgttcggactccgcatccgagtcggtgtaggagagatcaatagatgatggcgaggcgggtttccaaatttcttgtttcgccaggtgagtttgagattgtgttcctctgggtttccaaatttcttatttcgcgttccatattttgacggctaccctgggccgaatgatgggccagccatgttcgattttattgggcttgacttcagatttccagcaaaaaactatactaatacatactccttccatcaaaaaaatctaagacctatttctttttcattaagatctaggagcaattaattcattcatcatgttataaaaccaatggacatacaaccaataagtactaaaataatttcttgagtttcgatcaacaatttaattcagcacatagtaactacaaatagaacttagacttttggaaaaaccaaagaatggaatatgtcttaggccctttttagatcccaccccaaaatttttcaccccgtcacatcaaacgttggatgaagtattaaatataggcttaaaaataactaattgcacagattgtgactaatttgcaagacaaatcttttaagcctaattgctccatgatttgacaatgtggtgcaataataaacatttactaatgatggattaactaggcttaacaaattcgtctcgtagtttacaggcggattttgtaatttgttttgctattagactacgtttaatacttcaaatgtgtgtccgtatatctaatgtgacacggcaaaattttttaccctagatctaaacacagccttagacttttggatagagggagtagaatttaaggttaaaaattagtaagaacatgaataccatcatcagaatgattttttaaataaatacttcctccgctttgtattataagactttctagcattgcccacattcatatatatgttaatgaatctagacatatatgtgcctaaattatttaacatctatataaatgtaggcaatgatagaaagtcttataacctgaaatagaggtagtaataaatatgacgaatacatcaatacctacgagaatataatatgatctacgagaatacatcaatacactagaaatatatatcaaaaagcaaatatgagaatacaattccgccgtcccacactgtcatttctatgtatacatgtacaacccagaactccacaaagtaggggaagaataggcatttacattacggtaagccggttcaccaaatctcttctcctcttgtgacaccaagcaggatagcaatggcagcaagcgaagcctgttcgtggtaacaaaaaaaattcaaagcaaagttaggctttctgctttcaattataaagaacggaagaaacttacaatttcatgattagtagatatcaccgtgaaattttattttaccatttctacgccatgcttatcaaattttatgcacaagagtatgtataattattagtcgaacaatatggcaacacacggatatgcttccttactagtatcacttagtagcttctaaaatttaacggtaaaggagatttccttttcagctattcatctatttgcattcaattccacctatgcagttgtggcgtttatcagctttgtggcttgtgcttgcataaactgtcaaaataaatctgacacagtagctacagcctaagtctcagaacaattaacaatttaacatgtaaaggacttaaaatggcccgtaggccacagcaattttgaaattacagagcattgcagtggtgtaaaggacttaccgcaatagtgcaagcaacatatcctggtttctccctgtaatcatgtactcggacgcatatcaaaacaaaagctccaatataccatggaatggcagcgaggaagaagccaatgataaaccttttccaaacagtagaaacagcagtttctcagcgctcaagttcagaaaggtaacgcatgatgataatgttcagagaaacttacaggaaccagcccatgccaaggccgcaaaatggaaggcgtcgcattctcacaggccttccttcaacaacgggaatgtaacctaagaaacaataaacatgataaatccataaggcaggttaggacaatatttgattcatatcaatggaagtatcgaaccttcataaagcaaaaaatgctgaattcactcaagcagtacattgcattcttagataatatattcctgtgatgaattactcagaagaattatgtttcacacagagatcacatatagtactaaagagttccttcagaaactagaatttaatctctaattaatagttctgaagtatgtttgctctttgagcatttgtttacttgtttgttctagtgaactacagaaaattaccaacctcacaatggcatggccaaagaatgcaaatgaaaataccaaggaccaattaaagtttgatcataaaacagcaatgccatgtgtttcacacatggaaacaccagcaaaactacctgctcataagtgaatgttcggcatgagcaactgttgagcctaaaatcaactaaatttgaggtgccctcccttttggcttggcactaggaagtcgccaatccacaaatgaaacaaaacagcaaatgaaactacaagttcaacaacagagatggcggatatgggagatgcaagttagaaacacatatatcgccttctgatataacatgcatttcagaaatcaaaatggttcaggagatgttaacatgctctgttaccccaagtgaccacgtgagcacagatcacagattctaagagaataaggtacggtctatgtgaacgaaaagtataaaatttcaaggctcgatctggttcaatcatttttttagttcaacaagttactcatcatacaaacgaaaaaacccaacagggcttctctactagtactgatttcttcaaaacaggcagcttgcactaaatcaacagcactacacaaattcactaaaaatgcttccaggttctcatagacagtgcatccatcgtacgaaacggcgatccaagcgtatcacacataatcgaaattgcagggctagggtttcccgtaccttgcacggcctggtagcccagggcgtagtacggcgcggcggccgggtacgtctgcgggggaagcggagggtagaccgcgtaggacggcgggggcggctgcgggtagtgccggagccccggcggcggggccggctgggggaacccgaccgccggctgcgggacctcaccgggggcggaggacggggccccgaacgtgccgtactggtactgctgcgcctgcggctgcggcggcgccgacggctggaacccggaggaggccgagcggggcttgccgtcggcgtcaggcatctcgccggccatgccgcggtggtggggggaaggtttgctcgcgacgcgggagagacgagagagactttggaaatatgatttagccagctctctcatgacactgatctctacttatatttagcttaaattgaaaaaaaaacggcgtttgaaattgggaaaagaacgtggggctccagcctgtaactgtaagatctgcgaaatttaaaccaaaatttatacaggcaaaacgcgctaaatcaacagtaacagcatgtagttagaacggttctttgcagctgtttcacaaataaaccgtgctggttactgcctggcgaatggcgatagctaagcgacaaagcatttgggttttttccccttatttcaaccttctcagataaaattccatggcatgtggaataaatgattttttttctaagatgctgatcaaggtcacagaaaaatgacaaggaacaaaacgtgtttcgggcgttacatcaggctggcgtgttcagaaatcatttacttaggtgtgtttagttttacgctaaaattgaaagtttgactaaaattggaagtttgaagaaaaaagttaaaaatttatgtgtatagaaaagttttgatgtgataaaaaagttagaagtttaaagaaaaagttaggaattaaacaagggctcctataatctttatacaaactactatttctgtcgcatgaagaatcaacctagaaatgaatggaaccctaaacctagaaataaatggaacactaaatctgaactagtgtgtagtattctccaatgaagtcaaaaaagggaaaacgcatgattcgttcaagctgcaaaatctgtcatctttcgcgtgcacaaggtacatcagaatttgagaatgatgccacaattcaaccgactttcgctgagagctttgtatagcacaagacaagaggcaagctagcctctgtttattattattaccgttga

SEQ ID NO: 72111 - DNA, 11700 bp, Oryza sativa
acgctttatttacgtttggaactgatattacttgtcgttttgtgtaccctggctggtcctggacagggatttaatacacaaaatagtctggaaatttgggctaaatttctgggcgtgacacactctctctctctctggcgagcggcgcacggggcgcggtggcgagtgccgcgcgaggtggacgacggcgacgggcgcgcggggtggccaacgacaacgggcacgcagggtggccgacgtccacctcgcgccaaatcccatctccctccacctgtcgtcttcgccgtggggtcgtcgtctagactttctccgctctcggggtcgtcgtcgtcggccatggacgcgcgagatcctccgccgtcagccatggatccgccgccgtcgaccatggacgcgcctcctccaccgcgacgacctcgccgagggagagaccccatggagaacgtcgtcaccgacaactttgccgctccaccgccgcggcggctcaagaacggccgctcaacctcgccttggatttctgtgttcttgatttttcttgtgtgattttgtgtctcttgatttttcttttgtgattttgtgtgactcttgtgtgattcttcttgtaacgtcgccgctgcgatctgtgttcttgattttgcggacgagagtcggaggcaggaagaggagattttgctatggcgggagtggatctggagggcgtatcggggatcacgcttgggtttcgctggcgaggtcacgttgtgtctggggcacgcgctccacactgcgcgattccttgccgcgcgtgggtttgcaagagaaggaaccgcgtgcctcagcttgggggcgaggcgctctggttggacgcgagctctcgctccatgttcacacgaatccaacgtggaggggcgtagcaccggtccagctcaccgcactgtgaccggccgaatacactccacagtcaagcacaacatcccacacgcacgcgtgtgcgtccaacacatgtatctataggctttgaggacctaaagcctcctatgtgcgggaaacacatagtcccattgaacgcactcacgtgtgtgtaccctatacctaattaactaagattggactatgctaatccaagggaaaaggggttaaaaccccgtgcgacacccggtcgatcccaggatcgaacgtgggtggtaggctagccaccgttaggcagatttaccactgagccacaagctcatccgcgggaatgctaataattcgttaacgctggaagatcatatttccacaatatttgcaacatgatagaaaactatttatcctcattctttgttccgttaatatctcccaaaaaaatttaggtgctcaattaactactacttaaatgatctttacgaacagtcaaaacatatttttgcaaatagctgcgtgacccgcatacctcgaggtgtctgcgaaaatcggtattttcccaaacaggtggccataaaaccctagctcccatccgtcctagccatcatcattgtcactgcagtctgccattgttgccgaggccccgccacaagcccgcagtccgttgttgtcgccgaggcctcggtgctcccaaggccgaccccgccgtcatggagccacataatcgttgccccgtccccgctacgccatattaagctccttcaccaccgggcctcccaaccccttcgccgccagcgttggatccggccatcgagggctggatacgcccaccgcagggctacagacgctacctcaagaccgtgctgctcctccagtgtcgtcgtggcctctcccatcgctgccccttcagtgtcgttgtggttgcttccaccgccatcgtcatggccgctttcgtcgctcctggcgacaatcagtagagggaggagaggggagtagtgtggagtgaggagtggggtgagaaaaagtttttctaagagaggacataaaataaaagaagagactgggtagctggccaaacgtgtctcttaaccgtcgcttgtgaaattttgtttatttttgtaagcgggcatgttaagaggcccttatataaaatttgatttttgcatatgggtcttgtccttctcccggaccaacattatcacaggcgaacgccggcatggcccacctcaaggctggaggggggcttgtctacgaaaactgtttctatagttatgtttattcctctaaatcctctccagtcagattatttggaattaactgaacaaacccttagtaagcagcaaccacaataccaaccgcttattctgcttgttgtcttactgcaaccaaaatttgaattttaaaacttaaatttagagtttttttaatgtagtttatttttctagccttggctttcaaaccgctaatatataaatattttacccacaaatcttgtttaggaaaaaaacttttacctataaactattttttttcctcaattcagtttttactacagtttaccagccttatctcaacagatcgaaactaagaaacctgctgtttgctagctgaaaattgtttggcaaaaatgaatttcactaacaaggataaaggattcgagcaggaaaaggcattgcaaatatcgcagggaatcatgtatctttgggagaaggcgatgcgctttgtgcagattatattccaccagagatctcccgcaccggtggctcgaggtccccggcccctcatacaagcgaaggcacaactgcatgcgccacgccatcacgagaacaccaagttgcaccagtttcacgagacaatcagctggacacgaaggcctccacgtcgtcatctcattctcatctccctgtagagtagagaccatgctgcttttggagctttggagacggagtaaaatcttccatgggcgctggaaaatctctcgtaattccatgggcctcgcgtactgaacctaggagcgagatcatgcacaggatggacaggacacaggaccatggataaagaaaaagcatcacttcatggcaaaagctaaattcccccttcaaaggacatgggagttggagatggtgagatccattcgtttttttgttggatggtcccacgggtattttactagtctgaatttgtctttgtcaaagtgtaggttgcatttggggacggggaatcgccaacacatagtacatattaggtacacgtgtcttctacttggtcataaatacatgatgtttaggatagtattttattgaagttttgaaattttgatcatcaagaacttctcaatatcgttacaaaatttatgtgttttctatttggtactccatttcagttagatattatcaggaaggatatgaggatttgttccataaaagtccttttatttattcttgtagactcattgcccctatgtctgttgacagaggccatagatatgaacaatttctattattaaaaaaataaattcttaaatgtttagttaaataaatggtatgtgtatttttgaatactcataattgttaaatataaaattgatgactagagttttaaacattttagtcatacccttgaatgtcaaatatttatatccagtgggagtatatacacctacctattaaaatgtacatctctgcatttcttttgaaattggtgaaagttagagccaaaatctatggcttgaatctggtaggcagagtacacactcacactcaacagtcctaatcatctgaatccggtttcttccacaaataaccgatgcagatacacggcaattattctccacatgcttttgtagaatttgaagtaaacaacttgtattatacccttcgcaggagtacatgcaactcccatttggcttcccttatacgaaggacctctgttgtcccctccctacaatgtaaattctctttctcacgtgagtcagcaagatttcctttagtgttcattgctggacaataataatgcacagggcgccaatgctggcatcaacttctgtggtaacttacatagttacatgcaattgcacaatgttgctagtaattacagtatatcacttttaagttatctgttagaccttgaaccaagtgtgtccctcaaagcaatggtcctattgtcataaggcagcaccgaggggcaaaacatattttcagttttcaggaccagtacgtagacagaacctctcactgcaaggcaggctacaaatgcagagtaacagctaacaagaggacaaactgcacagccttgtagaacaagcactatgtggtctacaatttttatcctgagattcaaaggcccaaacgtacaatgagcagtaaggaccaaagaacaaaatccaattccatcttccgaggtcctgccagccaaccggagatacttattctttggtccagaaagggctccaaaccttgttcaacccatgctttggcacatattctaccaatctcgttggtgcagcccagatagattgaactcgaggaggccatggcaaaatttcctgtagattgtttccctgctactacatatttcaagactagctaagttgttttaagccttcatttacatcagtttttatttttgtaagtactcaattcatgtcatctgctcattgttctaaaaaaaatcatgtcatcttctccagcatatttagctgctatccacctgcatctgtgaaaaaaggttgccagcattaaataataaccttaaaaatagaattgcaaactgcattttctcaaatatccggcagtacacagcagcacagtagccgcgactgtgatgcctacactacaccaattaaatgcccacattgatatactgcatgaaaggtcaattacagatttcttcacaattatataacagtaaataccagaaatcatatgatagtaagaacttatgcatattaaaccactcatttagtaagaaggctgcttgtttaagtcctttaggacatacaggtcagtaactagaaatctaaaatgagtaacttaaattagcagtgcatctatgagataaaaactagtagaatgactaacaaagagaagtatttatgtaactctctcaccaccaatactagcacagtgtcctgatataggtgcatgaacctccgtccttgggaagcatatccccagaaacccagaatgagaaacatcatgcatgctgaacccagatgataattgcatgcatggcatttctagcaccacacaaaatatgattcatgatgcctagtggcgcacatgcatgcaggtccaacaaattgtctccctcctatgcaggaagagggtgcaggcatgaagcatctctattaacaccactagctttgcatatatccatgagttaaccagctgattttaccactctatcgcatagacatcttctgcagttatttgttggatgtccatcagtactataatgttagctagctatatgaaaattagagcatacatccaagcatccagctagttatcacccactaggccactactgcctactgggaaccctgtaacagtgtagctaatgggcaccaccatatataccttgtgacttcaaaagataaaataattgctggatttgtcatggtagatctgataccttaatatcgtgacactcccaatcttatcatcatgttctgtgtggttacaatgtaatgacattatatatcaacaataaacaaattttaacaaaacaaaaaggggcggtggagcttagttaaatgaaactaaacctcaggagaactacttcttttacaaggatataattttcagtcttttccaataactaattacgtattaggctaccactcaccaccagtctaccactacactcttatttatcacctattctaggttccgtaccctacagaatggttaacgtacgctgtgatcactcaacaattaatggaaggatctcaataatggtacatacagcatggtgcatttgacatttttattcgctaggcatgtatttttttagacggaagctaggcatatatttgagatattgacactgtgcaccatcagaatctacatttgaaagaaagcacttatatctcggaatcggcagagatacgatatatacccttcccttcttgtgggtcctcaacagagagcatcagaatctcactcgcctcccaatctgcaagccaaaaagtgtgtacactgttatattttccatatgagctacagctcactgctcacacaaccgcaccctcatgaacacgagtacagccggcgccccaatggcctataaatagctgccacccaagcagaacagatatcatatcaaaacagcagaaatctcttctgaagagaaaaaaacttcagtctagctgcacactagctagctagccagttcacttccaaagaaagacagtagtccaatccaaggatgtcttctaggtcaagcagctcctcccgcaacagcaacagtgtcaacatggactcagagtggagcaaaaaggagaacaagctgttcgaggaggctcttgcctactacggcgagggcgcgcctgacctctttcacaaggtgtctcgcgccatgggaggcaccaagacagccgatgaggtgcgccgccactatgagatcctcgaggacgacctcaagctgatagaggcaagaagagtcccgttccccaagtacaatacacagggagcatggaactgataggtaaccagctgggaaatattcaacctaattcaatcctctcgcgtctagtaataaacacgtgttgctaccttgctatgactcttcaaagctagtcatctcacgtgttctgataagttcagaatcggctgcttagcaaaacaatcttcagttgcaggctagcttgtaagctgatagctactgtcacatctcacacgaacacatatgcagggatcattagatgtcagccatgataatcatgccctagatgattgaacttgaacactgctagggtagtcagttgtcgtttcatttgcagttatacttttcagatgcagtgcaacatcagagtatctgcactgtactgtaacagataaatctggcaaaaccaagagctcataacttgagcctgtgacaagccatcatgcacacataatttgcatgcagtggtatgcacgatgcaccattttgtgattattggtttgcacataggctggtaggcacaggagttagccctaatttatgtactgatggtttgtcccctagttacaattattcacgtgggatctagcaccagaagaataatctctctgctaccaaacaaaagaaagtttgaatcttgcagtcttaccccttgagcagttgtgcttaattcagttccagactagcagccgacaggtgctttaaacatctctttttcatgtcagttcatctggcaaattaaaaggtgattgccttctttttaagaggcacaagtgtgatgtgtctataggaaaaggcaatttattcaaagttattctatgctctctcggaagggagcacaaccattgtaaccctagaagagggagctatgcatacaccattcttctcaaaatatattttatagatagataagtaatctctgagacccaataaaccacacctagaacgcctacatagaaagcaaattaagataaaacggcgtctgaatatctcctattcaaatgcaacattatggcgccctgaaatatatctattttttatcactgctaagataaactcacagttcatctttccaatttattttccaggggtggaagcatctgaggttccagacaacaggaaaaaaattccaatataaattatattccttgctagctgtggctaagttactgaaggaatcaaggaagtatattgatattgttattgcctaagaagattgtggtcgcttggttataaataaaagaagaaaagacttgtttgtacatactctaggttgtaaagcaaatcagtgtcgatcttgcagaaactagcctgcatttggcattgtgtgtggttgttaaacattccagctaaattatgtagtaaacatcagtgatgtaagacttctgtacttgtgtgctagtgattataaagttgtgcttgctagaatctcacttcctcattggaccaactggtttcagaattttgaatttgtgatgtctacatttgaactatgaatgcttcaatgtcccttccaagttccaaccaagatgtaaatgcaatgtagatatgacgttaatttgctcagtgctcacagagttctcacctcttgaagtagctagttatcaaccggagtataatgaaacattatgtattacactgccagctactctgaaagtggatcaagtatttgagctattatcaggaagaaagtagcatcttgctagcttcacacaggttgaaatgaagaaatacacaagtcattttcaagaatatgaaaaaaaaagcaaataaactaaaaggccagaagtatataccatttagacagttctacaccccaaaagataccatccgacctgtttaattgattttaagcctagtaatagccacagaccactgtaccaaaccttctgatcctggtacgacagtaaccaggaacagctagcgcctaggaataaaataaactagcatgcttaactgattttaagggtttttttttctatgaaacaaacattgatagtaccgatccatctacattcttgagatttgagacccagcaacacccaataggaatcgactcatatccgaaatatttcctcagaagtgtttggtaaaccattccgatcgtaaatcgtaatacataggatcagaattgcatcaaatctggccctaattatgatttcagtgttcaacttcaactgcggaactgtatggaagaagtaacacacaaagcatatagcaatcgccaaattaatttaccacacccttatctctctacacgcagtaatgaattaaaataacatgtagtaaatgcgagatgtagaatgcgaacccagtagccatagcactgacctagttttgccggttcgcggcgttgccctccgatcgcctctccgtgaggcggcgggaagcttgcccacgcgccccccgagtggccagccgccgccgccgccgccgcggctactcaccatcgcctcccctggttcaagcgcgacgaggccgcgggcgaccggcggtggcggtggcggtggcggtggcggtgcgccccttcacctgcggcggattcgcccttgccgggacgacttttgagccgcccaaccaccgagcgcccaaggcctgatgggcttatttctcccaacggcccatataccttcacgggccgtcctgcttcggtaggcccaaccgatagccttccgagcttggcccattgacacagtggcaacactgtgttttgtgggggatttcctttaactatttaccacaattaagaaacgtcgcaatgtatgacacagggagtcctcatatatttattgaatgcgcctacaaatcaggcgtccgatttttttttcaaaaatcggacgttgttttaccaagtagatcgaaaatatttcaatcttttaaaacgctgaaacacaaccaaatcacctcatgaaacattttgctataacgtatgaaacaacgatttttaaaaaatcagtcgttgtttcaccctatataaaaacaatgttttaacaaatagcgaaagaatgttttaattcttaaaaaaaagtgaaacatggtcagattgctagatgaaataatttgattcaacgtatgcaccctatgtacatcaacaaaccacgtgtctatcaagatgaaattattaaacagtagcaaaatccaccgcaacatttgatccatacatagcgaaacatcacgagtacactagctgaaacatcgttggtggaacaaataatgaaacggatccggtgtttctgttatatccgggcggctattgcaatgggcacacgtggtgagggcgcggaggcgtgacgcggcacggcacgggcgcccgacgcagaggattcacgatattcatggcatgtgagtccaataataaatacttaattatcacttgtaaaacattaggaatggtaaaaagttaaatatctcttcggcggctgttcgttgcaagcgcgcgcaatgtaaaaagcacgcgagcgagctgcgggagagccgaggacgtcggcggtcaatgtcgacgcagcggcggtcacacaggaagcagctggggcagggtcccccgccgggagagacgggctcaaaactgagatgatatggtgtgcggcgggggtgcagctggaccaccggatgggtcacgtcgccggccccgctaaactcggtgacggcgacaaaagctcctcaaaggatgccatgggccggggtgctagcttgccgacaacgtacgtaactctagccctgctcggctgcaaccgcaaactttttcatgtgcctcttgttgtgaagcaaagtgtagtgaactgataaaatgcaaaacaaatacgctcatttttcatctcaaaagaaaaaaaaaatatacacacaacttgcatggaacagcaatctgtgataggagtacatgcgccagctaggggcttgcactagacttcctagttaaggccactgagtacatgccctaacgaccgtctcgttgtagtgtctttgtgtgatgagcctccccggctttcgagagttaagagatccagcaacgaatggttcaaacctagagaaacgggacgaactcaggggtgcctatcgctttccaaaagatggcgatatagcctcaccatcctctctaatcaaagggcaaagagaggagtactatatgagtgaggccgagctagctaggcttcatgcatcccagatacagtagtgcatatcccaaacccaaccaaaggacaccaatctctaggcttaactctggccgtgtcgggagcaactttttgaacgacgatctcctcggccggattgcctgccccagccatcgcaccaaacacacaacacaacgctagtactcgcagccgtatactgtttggtgctcgtgctcctccccttgttttttctcccgtcttattttaacacttccgtcatgcggcgacagatcacacggagcacaaggcgtacaaacccctgccaagctgagcattaagctgctaattaaacaaacgtttattcagctgctaatccactgcacacacaccagatcaagggaatggtttagatactctgtgcagtgagcacgcaggcgagttttcgtctgctgcatatgtggagatttcgtggatataattacagtaatacagggaatggttgggctcgcaatagatagagacgagaaggaaacaggagccatgctttggttaaggtcgtgtcggcgctttggccgttgggcagcagcatacggaatgatgggctccacagcctttcgctttctctggcatcgctgcctcctttgacttggcagggggaattacgcagcttataaacatcaccaaaggaaaaggaatccagagaagaaaagaaaagaaaagaaaagcctctctggtgatctggctctctctccccctcagactcctcgtccgatgggcagtgacatgtaccaccaccaccactcgcaggagaaatgatcaggcatacagtcgcggcgcgccgtatcggatccccgtggcgttggccattgccattgccatcctgggttaagcgcgcgtggaggttggtgccaaaaggcgggatcttctatgcctgaccgcgactgttccttggaccgatgatcggattcgattcgacgggggactttatggaacttgggggagccatcatggcgagcccgattatcatcacgacgtcgcgccc

SEQ ID NO: 72112 - DNA, 3509 bp, Oryza sativa
atatcactccactgtgaatggcttaggtgattctgagtttgtcgcaagtaaaacaccatcgtatctcctaagttttacgtactatatatttatagaaaacgagataattaatgtctaccacatctgaaaagtaaactatgaaaaatatttgataatgtatgtaatggtgtttatttgatatatcacaaatattatgttttctctataaattcaattaaatatagaatagtttgactagctatgcatgctgactagtcaccagtgaagcagtgacaagctgaaagctacagagcatcgcacagcaacaagagggacatcgagctactatagctctagctgcaggagccgttgactggtacgatcggttgaacaggcacatcgactagtcgtacacccaattcagtccattcgatcacgtacccacccacgatcgagatgaacgggcccgttcagtttatcgccaaaataaatctgattaaattttaacaatatcagaattttgataatttaataatattatcaagttttgggacgatttttttatgtatttactagagtttggtaaaacactaaaagaatacacatatttaacacctttataaaaaacgatatggtttgaaatgacgacaatctgaacaaccgagctcgacaaccacgcccacatatgaccccagcggaacgaagaagctcacatgctgcaatcgtccgtcgttgcaatcatgcacgcaacatactactctctagtagtacatcccatttttctcctcgtcgtctcagctaaacacacacactattttacacatgcatatgagcaaaattatttgcaaagaggaagaccagcactacatacgagtctacgagcctgtttaggggagcttaaaattttaagaagcagctgctgaaaagctagctggtgagaatctagagaagctgcttctggcttctaatttattttccaaattctacaactatagtttctcagaatctggacaaaaaactagactgtttaggagagcttatagcaattaaagattctagaagaagctacagctgctacaagcttggaagctctccaaacagaccctacgactacgaggaaggaggtaagctagccgagatagtggcgccaatgatgcaggggatttgagtggaggaatcaggcaggcagcactgcactgcatcagaagacgaagctctcgtgcacaacagagaagcatgaagtagtagtggacttggccaagatttcccaatgcaccaccactaacgcatgcagttgtaacgcagaggataggagacctggcagcttctgatacacgtgtcacctgcttgttctttgcatgtggggtgtgtgggccccacttggtggtgctgtgtgggccccagagacttctcgcactagcttgtatgctcggcttcgatgtcctctccgcggatgcagagcaccacagctgcaatgcctgcatgctctgaatactctgatctgaatctgctgccaacttcgtgaaattcagatcgcaatgcactgtttctcaacgcaacggggacctctgctaaattgtaacttgcttctgctcatttctgaataatactgatcgttttatctgatgaccaatgttggaaactggtcgagaaatgcatcaagcagtgcatgaacttcaaatctttaatcatgtttggtataggccaggagtaagcatacaagggggcccaagaaagctattttctcctccatttcaggatgctagttgctgcaaaattccaaccatatccagcgcatcctcctctggctagcaagctagctcagatgttacatccgtgaaacggctctttgtggaaacgtttttagactttctagtgaaagaggactagaggagtgttctgttttcagggatcagacaaatccaagattagtaaggattgacaataagcgtaccgtttgccattctgttctttgttttatctttcctttttcttgcgttggacaacgcatccctctatcactgaatattctttccttgcacacagatacacagtagtaggtttttggtagggtcggaaagtctcataatagaaaattatcaatgaattaactatgtttaatagtcctacaatttgatataataggatgttttttattttctaagtcaaactttttaacttgatttaatctattaagaaaatatagcaacatatataatatcaaattatttcaactaaatatgccattggttatatttgtatagttttttcttgaatactataaaactatatccaacaacgaattttattaaactaatatggcattgttgatgttgttacgattttttagaaatgggacaattttttaaaaataacttataacaaacaaaaaaaacacttgtagtataaaaattggatgaagtaaggtcattgtctacggctgattataagatataacggcatattagcgataaaaaataatttatagaactttttttactatatcctttgtgacttaaaaactaattacaatgcttgaaaaaaaaactatgttgaaaaaattatcaaaatttaaaatttaaaatttagcattgctttatatgtcacagatcaaaggaagcttttaaatcaaaagtatgctaccaccctaatctgtatttactactatggcctggtttagttcccaactttttctttaaacttttaacttttctatcacatcaaaacttttctacacacattaacttttaatttttttcttccaacttctaattttagtccatggaaggcatatgttcaagacgaaattggcagtttgtttgcctgtgttggcacctacacaagtgtgaaccaacaaatctactcgtgttttgtaaccacgcggccgactaacaaccttagctagtgcatgggtgtgggcctgcctgcttacttccatcttgaattaccaatattaatcaccttctgtggtctgctgttaattaactaacctcagacgacgtctcgttaatctgagttgctatagctttacgaaaggccacacctcggattataaatactacccagctcatggcaccaccacactcttcagtctcacacaaacccaaaaacccaaagcttagccaagctactagctagctcctcacttcttccagcttcttacactaatacagctcgagccacttcgtcttctcctctcttgcagcatagtttaagtttgagataggattggcgatagatatgaggccgactggtcgtcgttcttctccgccggtggctgctgctcttgccctgcttctcctcctcgtcctcttcttcttctcccactgcgcctcagctgctcgcccactgccagcatcagcagcagcagagctagtgcttcaggatggcgccaccggcaatggcgacgaggtttccgaggtgagaattaatcgaacaccacacagtagctccttatacaagaattgatcgaagaagcacctagtggtagcttgctaagcttgatgtgtgttttgtctggggctgcagga

SEQ ID NO: 72113 - DNA, 626 bp, Oryza sativa
ttcctgcctgcctgtgacctttgtctgcctctgaacaaattttatattactccatgaccatacaaccttcctagtagctcactcactgaagaacagctactactactagtactgtagtatttgtttttctttaaatttctccaagacaaccaatgcgttcgatctgtcaccctgtctacagtgctagctaagattatgggctttatttttttttaagttgcaacaaatctgttccctaagattcgataccatgatgatccacatagagatgataaaaagtcaacaccgtgcagaggctacagcggctttgataaatctgaccctgaccatgaaaagagagacaccgaaagatgctccctcacatgccctgccaatgattcacacaccataccaacagtaagtatatagtactcttactatcccattgcaaactgtaattaagtatcaaatcaaaataatcataaccatgcattagctagggtaattaagcttttattttctgacagagatatgtcatatcgtatgtgtatctgtggtggtagctagctgagaaagatctcgagccttgagtagtcaaactgatcatagatactcctactgtctaaactaaacaccaagctcggtta

SEQ ID NO: 72114 - DNA, 11560 bp, Oryza sativa
gctctccgcgcagaatctaaaactcatggtaactctgtccatgcattgacatggagggattaggattaggatgcattaggaacccggcaagaatagtgaaagtgatgacaacccaagctcgtgtatcagtattatctcacagatacataccatgctgtaaaccactccactacataccatggtgagggatcatactatcagataacactcgttactttggcatgtagatcaggatgttcagtagctcccagaagtcagcagcaaaagaggcattatcatgtgtttctatcttctctgcttttctgcttttggaacctctcgaaccaccgtcatggtgtggtttccagaaatgaaccactatcattacatcgccttttggtgaagtgtataaggatgctactctgggctgaacgacttcgagaatagacttgtaatttcagcttggaaggatctcctcttttcctcctttcgttctctaaatctgtaacgatcttgtaatgatcttgtacttctaggcacccttttatcaatgaaatacaggtggggaaactctcccctcctaatgacatattctaaaaaaaatgttagatcaggatactaagtcttccttttaggattatcatagcaaaactaaactatattagctgagttgatatgtatcgtgaggtacggaccattctggatagctatcaaaatgtgccttactaattgatcctctactcaataatgtttggctaaattttggattgaagccaattcttttatcaaatcaatattgatgtcctacgaaattattgataataccaataaatataattggatagtaaagaaccaaaatgaccattttattgaactgaataaactttaaagtcattgaaagtttctccatacctcattgttctagaaatattgcataacataacacctccccgttaacactaataatgcatttacctttcaagacggtagaaacctccaattaattttagaatgaatgggcacattatgggtggttgaatcctaacgccaacgtcattggcccccaacaagtgtaataaatgatatttctattaagctacatcatcacctccattattatttttaacctagcatgattaatctacaactaaatcattttccttctcatttcacattatcacactgtcacgggcttgggccctaagtgggctggccatgaagacccaccaggctggaaggttaacctgctactccctccatccctaaatgtttgacgccgttgaccattttaaatatatttgaccgttcgttgtcagggttatgtatactacatacctaatagtagttgactaaatctcggcaggacgcaccacataccatgtcctatatagaaacaacctgcggatataggaggagttccggataaggaaagacaaccagagttctacatggaaacgacaaggactactcggattgtatccatattggtttccctagttctacttggacaaggggacacctatgggtataaatacaagcccccctaggaggacagggggacaaccatgatgagacgatcaacacgatcaacacccaccatgacgagacaatcaacacccaacacaatcgacatagaagccacaacatacaagccaacatactccaagacaagacgccggatatcgacttcagggataggcatggctattcccctacggtgtctccggataccgtcaggagagacgaaagcgctatctctgatctcgccgggcacggattcgaggaggaaggctaccctgttgtcgactacgagtcagatcttcagaccgagatgtcgacaacagttagataggctaccccacatattgtattggtgtgattatggtgaataaaagcaactccggctccagccaacaggatgtagggttatgtcacgcccggaatttctatccaaaattccaaacgcttacatgtgtgtgaaccctcgtcagaaatcagccgaggcacacaataacaaattgataatagagtacaattattactctaattaataagcgaataaaatgtcattacagaggtagatagttcatctcaatcaataaagatctaagcagcggaaaaaaaaagataaacggcgcagacgactccactccacaggtagcttgaccagggctacacctaatcctccacaccatcaacatcactgtagaactcttcctctgatgaatgattgcaaggtgagtatatgacatactcagcaagccacgcagcaaatatgcaagtgcacaggataacaaaggatggcacagtggggtttcatttgcataaacagcatttaataaacatttcagaatttaataaaacagttaagtaataattaaacaatattaatccaacactatacaacataccctgttgcataggcccaaccattctgaacaaccatcccggctgcacagttctatctccaaaccaagaatataccgttccaaaccaggagctaatcaaattattaccagttatagcatcttttattatgatgagaagtgtgagactaatcacgaaagacattgttagacccgcccataaccgcgggcacggcttttcgaatagttttactctggccagaggtgtaccactgtactcacaagacacagccccacaacatgtcactatgtgccttaataccaccacggtacctcggaaaggagctatgacagtacccctcgcacaacacgatccaccacagcgcacctttcctggatcataatcaatcaccccttataaacaaggcatggactccccagtgacccccgtgggcttatctccgccacttctcagtctggtgctccgcaatgaaccatgctatacaaaaggtaaagccgttgcccacgctggcttgtggttggcacggttaatgtttcacaaccaaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaagtaatagtgaatcataagttatcccaatagtgtgctaatgtttctaagcatggctaagcaatcatatctaatatctagctgaaccaatatataaagctcaactagtcaagttataataacccaaggtatcaaggaataaagtaatcaagaacaaaagggctataacaaacaataggttaattccacccaatgacattcgaaaataaatgcaattgttgaatagaaacaatagctttaaacgggatcaacatgctcaaagggttctttgggatctgtgtgacttgccttgctggccttggaactcttcaaaatcttctcctgcaaaaatggactctccggaaacgtcggaatctaaacagaaaggagcaaaatcaccaaaacagcacataaacaagcatgaacagtacatgtggatatttttaacatgtagatctcaattttagaaaaatttagagacttgaaccaactaaatccgagctaagatgaattagttatgaatttttaaagattaaatcggattaaatcacttatatggattttaattgaattatgacgcaataatgaattattttttaaaaggaaaagggaattattgcgtcagcggctagggttcgcggtgaaccgggtgcacggcggcggctcacgaaaacgaacggctgagatctttccatccaaaacgaacggccgagatcgaccggtccacagccggaccacggaagacgacgacgatgacgtcagcggtgacatcaccaccggcggcggctcgggtgcgcaaactcgtcggcgaacgacggcgcgacgacgcgaacggaggacaccaacacgtagagggcgacgcggcgaactcaccggtgaccaaaacaatggcggaagatcaacggacggcgacggcgtcgaggaagaagcggcggcaaccttcggcttgacgacgacggcggagaggtggacgagatcggcgacggcttggtgaccacgacggcgacctccccgagcagcgacgacgaccggagcgacggcggcgcacggctggagctgcggcggcgacagcggcgctaggctacacgatgctagggctctaccggcgacgagaggcgaatgcgagggtggcggcgggtagcggcgggcttgggggtccttttataggagcaaggaggcggcggcgaaggcccacggcgaccggcgacatgaaggaaagtctagggttcggaggagagagatcgatccgaatcgaactcgaatccacgatttccaaacgattttagccgacgattccaaaagagaaaggtagaggagatcccgaagatcatttcccctctattgatttcaccggagaaggaaaggcgtgagcgaatttggaaggagacggcggcgcggctcagctagggttccggccgggcgacgacgcgaggaggacgacgagtccgacaggtgggccccacctgtcagcgggcggacgcgcgcgcgcgagcgggcggctcgactgcgggccggattgggccaggagagagagaaaaggttttgggccgactttcggcccaaagccaaaagaggatttttaaaaccttttacaatttaaattattcattaaatgtaattccatttattaaaaatacttccttagctcaaataaatctcagaaaaatctaggaattatagagttaagcaaagtatttaatgaaattttatctggccccattttatattggaatttattaattaaaattagatcttctcttctaggctttttaaaataaattccaattaaacaacaatttatatatttaggatttttagggtgtgacaggttattacctgacagctcaggggcccgaacctatataaaaatcctcgtctccatctcttttacttcagtctcgtgtatatcctagcaccaacgatccccatactgttcaaataccgtagttgagacatcaaacgtcgacattcgtcttattcaaaaaatttaagtaattattaattctttttctataatttgattcattgttaaatatacttttatgtatacatatagttttacatatttcataaaagtttttgaataagacgaatggtcaaacatgttttaaaaagtcaacggcgtcaaacatttggacaataagggagtataaacgaacagggagacatggcaaaaggcatcgatgaactgaaccaaggaacgagcctctccttctccctggatgcttcctcttcccaaaatccttttctctgaatcccaacctagctatttttccctgtctaattcttctcccagtctacgaacctgtatctcccttcaccacttggtatcttgtgcgatgaatgaaggattaaccctgagttatgctccaacatatcatagaaattaacccgctgattgagaggagcgaagatatcctgttctaataaatgaaattgacgctggttgatttgttaaaaaaacaaaaatacagaggagggaagagagctaattaaagatagggttaattggatccatgccactacaaatataccaaattagaaaaatgtcactacatttcacgatatcagctgagtgccactcgaatttggggaaattggaaccgtgccactccgttgggttttccatccactccctgttaatttcccaactccgacactcggcctcgatgcggcggcgaaggagctcggcgacggtgccatttcccaactccaatggcgagaagagttttggcaatggcggagttcctgcccctctttctcctcatgaactcgtcgtacttcctctttgcttcctcttcttggttccgtccacgtaggtgctgtggaagctgtgcccgcatgccgggagcacgccgccgtccgccagctctgacaggcagatggcacactccacctcggcccacccgccgaccatcgggactccgaacgccgcgccgaccgccctgacctatcggtgttggcgtcgtcgtcggacgccggcctaggtggctgtggttgcgcccactccccggagtcgcgccaacgggcgaggcagcggatgaggcaccgcgcggcggcgtggaggtagaaggcgaggagggagacgcgggcgaagatgatgaggatggtggccacgttggagaagaatgcacgcatcgacagtgaagtgtgaggtgaggaaccacgaggacgacatattgttaacgaccaaatttggtaatatcagcatcggaagaggagactagatcgaggtggagtcgaaggcggagattgattcgagaacagagcaagaatcgactgaagtccatatcggctacgattaggatcggatgggtctaagtcggactaggtaagccgatgcagccgattccgacagtataatttggtgtatgacatcgggttgaattgaggtgcttcaagatgattgccgcacatggatagagtcctgagaaggcaattgtatctattaattaggatgttttatgtaacttccttagagatatgtttgggcaaaagtctaccgcaaagacttatggtatcttagagtgtgttagagatagtggtcgtgtccggtatggacatatcttgtaattcttgggtataaatagaccccgagccctatgtaatttttaacacacacgttcaatacaatttcggcgcatcgccacctttttgctttagttttgttttcgacgagttcttactttcgggttgagctgcatcggttttgatcttcaacaagaggtaaaacttgttatgacgacttgtgttctcgagattagtgcttccatctttatgacactctaatcttgcctatataattcgtcgagttattatatatcttacattagctttggcaatatcgtcatctaacctacaatcggctgacatctgttaatagaaggcagccgattaggttaaatagcgatgttgtcctagattatataaaatatctaccactttatgaaacatccagcgtcttgattgtctagatattgttcttcttttcatacttaatgttgcatcagttgagtttgatctattaagtcgtgcttagaatatcaatctctagcatgtcctctggttgccgattagggtagtatcggagtttcagccgatcttatctgatttaaccatattcgatctatgtgcctaagtgacatgttaaatccgccctttatgtcaagatcttactgcatttaagtatattaagcttttgtttggtatattatacttgttttgatatctttatgtagagtagtatcggagtattagccgatacatgctagatctatctgatcggctatgctataaacatatataatcatgttattaatatatatttcgatctaagtgatttatactgtctcggcatggtgaccgatctatcccaatcacttgatttaagtatatattaatataagaactatatatcgttaatatctacagccgatcgaatagatttagttccttactgtctatttataaccgccgatcgattcatatatgacatcggctcaaagataaatgatatgtcatcggcacctagccgatcggctattatttatagatttaaccacgaattctttgtctctatttcttgttgattacaggatcaaatcaactggcacgctcatacattcgaaggtgagctttggacctgcactggagttaagcagatctcccaggcctcgtgttttctgtcaacacatatggaggtcttgacgacacgggagacgacgaccgcgcccctatggtagaaatctacggcagagacgagctccccaggtagcaacacccttccctgccgctgatcatctccgtcgagtggagcagcggtggcggcagcagcggcgacgtccatgcacgggaaagagaaggcgtcgacgaagttggcactgtggacagggagtggatggaaaacgcgaaggagtggcatggatctaatttcccaaaattccagtggcacccagccgatatcgcgaatagtggtggcatttttctaatttggtatatttgtagtggcatgaatccaattagggatacatatacacacatgtgtgcacaacttcacctcagattttacaagcctcataaaacccaaaccttatggcaactttggccatgtaaattggtggattgggatgcactaggaaaatacaacaatgctgaggtgatctcctacctcgtcgtctcatagtcagggttagaaattttggaccaaaatttcggaaattttggtcatttcggtgacccccgatatgatattaattcggctgaaatttttgaatttttcaattttttcatgaatttggataatatttgttcaaattcaactaaattttgtttaaaattttagaaattttgaaccgaaatttctgaaatttcaggatttcggtgaccccaatagaaacccctaaaccgatagagtgaaccctgctcgtagttaggctagcaccttgttttcggccggtgacaaacaagaaagtatcatccacggacaattggcgtgagactacagctgtgttccgacttccggcacgtgggaattacaatcgaaaagctctccacacaatcaacaattgcactcttttttttttagaactcatgattttatttaaggctaatagcacgttatatgatgagttgatacaacttccatagagtaagaggagagcaagcccaaaaaagagaagctgacaagtatgcccacaagcatacgggctggtaaacatacagcacatattgcaaaagaactcctaaaagatagaaaaatgcaaaagggcctagaaaaaagcaaaggacttctaaagataaggaaaaaaaaaagcgatctggtccttgcgctgcttcttcctctaatctggtgaccaggacaacgaaaccgacatcaacaacgacggcgaaagcaagggagactgtaaaatagagctccaagccgtaaaaccatacggggctttcaccacacaaggcggaagttgacgcacgacaaaaagaataggaagaatacagtcgcacattgaagaacgtcgacagcaatgaaatggctcaccacattagtagcaactttgccggagttggttagaatggctggcatcaccttcaacagaaacaccaacctgcttgccggagaagcagacttattgcccttcaagcagcgaacaacgtgagagcaaacctggaagccacccaaaagcaggcaacaactaaggagatcttcagcagcaccttccatagaggaccaccggaacaagggagctcgacgccggtgaatcccttgcactacacacaaaaggaaaacggaatgaaccctacacggaatatatccgaccatcctatcgcctaagggtaaggaggccaacccctctccctaccctcatcagcggcgaaccaccggatcggaggaggaggaaaaggggtcaagaagaaagaggaaaaactctcaatggatctcagagtatcgcgagagggatagagaaagtcccgccccagctgatggcttcttctactgctctactacaagtgaactcgtatatcgtatcccatgtcatggatggagccctatcccagtcatggatggagaaccaaggagatataattagaacaggtagcagctaatcataggagaagtcatttggtcctccggcgtaatcttctactccttacattccaaaatataataacatagaactggatgtctcatctaataccaaattattatattttagattggagatagtaggaaatatcaacaaatatgctggttgtgtttgagattgattaaaaagaagatgaagtcacagcaagcaaaacgagaaagacattagcatatgattaattgagttttaattattacaaactaaaaaatagatttatttgatattatatatatataaacaccgtttattagttttaaaatcatgctaacaacaaccgagaataaatctatttctgagcggttacgtgtttgtaacttgaaagactaagctcggaatatgaatcgtatcattgttaacaatgatagagaaagactacacaacggtataccgttgaacagtataccacttatccctcatgccgcggccccgcgtgccggcttctcccgagtatgtcgtgtgctgctagaattatcatcacgcaggtttgttgtggtatcaaggtatagtcttgttcctgacagctagctagtacccagcatgcctaagtcatgcctttgatactagcctagctagtaaataaaactggaggtactactagcttgttgtgcatgccaaatccctgtaatagctacctacgttacctagatacggggatacggatatggatacacgatacgtcgatacgggatacggcattttccaaaaaaacaaggatacggggatacgcttttatatatatatatatatatatatatatatatatatatatatatatatatatatatatatatagtaaatttgtttggtgctccatggtgcccgggcaccattgttgaaattgagtatatacccaattcaaatgagtatgaaacttttttaattatttaggtattaacattaactacttttactaactagttcaaagcaagtttgaactgaatttgaacttatttttgttagattttgattctaggtatatagcatccatacatataattagttaggtatgtaatcatggattgtgaaataaagttaaatttgagttgttttgttgataggtataggtacgaatcaaattcttataactaggtatatactcacaattagaaaattttgaaaaatttgagtgattttgtgcatttgaaaccatggtgcccgggcaccatggtgccccatatgagtgtcctatatatatatatatatatatatatatatatatatacacaaaaaaaattaaggaaattgcatttatatataaaaaaaatacaaaaaatcaaggaacttttataaagaaatagcgatataatactagtatcagtgtagcagattccatatcaatattctgcaattttctcttctataagcaattcaaattaacaagcgattaagatcccaaaaaccacatattaatagttcaatcatatatttcttgatgactttgcatcaacattagaagccgcactaagcagtaacctctaggattgctagatgcactagcacttgtatctaataaaaacgatagtactttgtcctaaggaaaacaagaaaggcacagcagattcaagcatgaaacttttgaagataatggattacccggccaggcagtcaagcgaagaaagaaaaagttgctccgtgcttcgatgctactagcctgccactggccaccgctatgcccggcggccggcgtcggaggaagtgcctcacgcagtcacgcggcaagccggcaacagttctggcctcgaggttggcggcaaaagaggtgcgccaccaccaggctggcggcggcggctctgccgtctcgcgtaggggacgttgtggccccgcgcacggcagcgacgcgcgcggctgcagccggcgtccggcggcaacgccgggcacgcacgagagc

SEQ ID NO: 72115 - DNA, 1088 bp, Oryza sativa
  unsure (1)..(1088): unsure at all n locations
caatcagcttcatcgaaggagaacaatatatcccgttctgtcgtgcttctgcaaactgtgctgctattaaattgcccgactgtctgtagcagcnaattcttttgcgaaaaaactttgtatgaattgctctttatgcatgtaaccaggattctatattatcatgcctccaccgtgataatactgaatgctggtagctatctaaaactacttcgtctgactgagcattaccaggtttattcaagcatccagtttagttcacattcatcgacccaggatatctgtgcgcttactgaccactatcggcctgctttcaggaaataaaagttaatcaccatccagatactaaacctgaatatatgtttcttccatacaaaacatctatagaccataccacaccgctgtatagtacaaagaaccaaaacacacacacacacacatacagacatacatatatatatatatatatatatatggtattgaatgctagggaaattcacccatcaaccaactccatactgaaacaacagcctacgcattctttacacactccatccacaccatcgcttgcccgtacatgctgcctttgaagagacatgacatatttgcagcgagatgccatacagcacatcctattatttctatctctaccacacttatcttctcctcttcgccgctacttgcacctccccaccacatatctgctgctcttcgccttcccgtcagcaagaacagctttcacaagctcttcagcctccctccccaggtaacaactgcagcttattatcttcagtaatctccatatgttcattcctatccctcctctccctatacagaagtgggtcagatccaaacatctgtaatagaacaatataggaaagtattagagcaaacaaactaaacatttttttgatctctgcaatgggcacgcgttaaccaacaggtcttctatttctttcctagaacactatggaggcccatcaagataaccaccctagccagagacaaccacgaccattgtcttatggcagaagccgcccacgggtagcgacaaaaatttcaagcccggagaaatttcacaggtatttgcc

SEQ ID NO: 72116 - DNA, 2224 bp, Oryza sativa
atgatcttgctggagcattctcaaaggtttgttttttttttaaagcatagctttttaaccacataatatacacaaatgtgatctaacagaaacatggtgtattttatttttttttttggtagaaattgcagaatgtagattatagataaataaagttgcatattactgttgtatacctatttgtatgcttgcattgtgttgttcttttttaactgtgaacttatttgttgatttctccactttcagttgaccagaagcatcaatgaaccaacacaatcgggaataattagtcgtgggggttcaatttctagacaaagtgagtgggtatttgatttattccatttttcaaggatatatgtaagattcgttacatctggccaatgggatgaacatatccattaattttccattgttagaatgtgaatttcaatacatttttacagtctttgttctcttgtaggtttagggcccctttgatttgtaggaaaaatgtaggaattttggaggatttcaatcctatggaaaaaaaatcctatgaagggctttgaaacaaaggattgaatcatatccaatcctttaaaattcctatggaatgggtaatcctatgtatattttggaggaaagttagcaagaggtctaacctcttggaaaatttcctctgagtctatctctctcatctgattcctgcgtttttcctctggtccaatcaaatggtcattcctgtgtttttcctgtgtttcacaatcctctgttttacaattgtattcctgccagaatcctctgttttttcattcctacgattcaaaggggcccttatatatggtttctgatttattaacattgtattctaatgttaatgaattcaatttgtgtaggttctactctggactgggcacaagattcatattggcctacacagcctatatttggagctgaaccagggctgaataatgaaagccggtggtctcaaccacctcatttagcccgctttgctgattctagactgcacagaacatcctcatcgccgcagcaagatgctcaatacaatcctaatgaacatattcttggagcaatgccatctctgttgcatagaacttcatcatacccacaacaagagcctcaatacagtcacacagaaccaattccggtacctaaatcatcattcattccgtaccctccatctggtgcagtatcccattcttcgccaggtcaaccacataacatgaacatgccatctcctcccacttcattccaaatgcctgtatctgcacaaaatgagttacaccatccccagtttcctcgtggtggtatgcctccagggccacttggtcggagcatggctcatttggattcagcaggtttatcaactaataatttgcaacagaatgctctaaacagtgggccagttcgtccaaatggtgccatgcttacaccaggtttggtgcagcacaatctgcagcgtccaaatggattggtcccacctcaaatgctgtcacgccatccacaacatggaatggccccaattcaacactctccgccacaattctcacagttccatgctcagatgcttggtcctcggcatcctccaccaaaaggttgtcagatgtacaatcctcagcgtccatcacaaatgatgagtggatttgatgcaaatttggcaatgcctgacttgagtgatccgagagcaagagcaatgctgcaccatggagtgcatggccagcattatctcccccaaggttttgagcttgctggtatgaggatggataatgggtggccgcggttcagatccaagtacatgtccacgcctgaaattgagaacattgcaaggatgcagcaagctgctactcagatcaatgatccgtacattgatgattactatcatcaagcctgtttagctaaaaagtcagcaggaggtcaactcaagcaccacttctgtccgaccttgattagagatccatcatcccgtgcacggagtaaagatgagccacatgcgtatctccaggttgatgctcttggaaggttaccattttcttccatccgcaggcctcgtccgctcctcgatgttgaacaaacctctgaatcaagtgatgacgttactgaaaaatctgcttcaaaaacacttgaccaagaaccaatgctggctgctagaatcacaattgaagatggcctctgcctactgcttgatgtagatgatattgatcgcttgctgcaatttagccagcag

SEQ ID NO: 72117 - DNA, 1192 bp, Oryza sativa
aactctaagaaattgcctttgttgtatgaatcacttgattcatcatggccccgaaaaggcaaacctagcttaacaacctcctagcaacattaattgatccatttaatcgaacaaaatatgcatttttagtagcttcgctttgcacttgcatatgtatatcgatgtgttgggctctttgcaacaaagcatcacaatttttcatggcttgattatgtaagctaccaacaccactaacatgctcttttagcctactttttctatgccaaccattccaaccatcaaccacaaaggctttatacccatcctctttcttattgcgatctctaaaacaacattctctgtcttttgccttgtatattcaagccaacttccaaattcatcaaaccattcctcaataaactttctgtctttacctgagatctttgtaaccggaaaagtgaatagacatggttggcaaggccctttctgcaagtatttccttctgactatatccctcttactaggatggtaatcatcaatctcttttctcaagcctggatcatattcaatctcgttctcccaactaccatcatcgacttgttctggacaagaattccgtacagctgcattattggaactatcgagcgctttcctcaaggtacttgtctataacctgtcaattaaatagttttattatgttagactataagtgcactgcacaatagaataatgtacacccccaaaagacaaattatttagcaattatgatggtgtcacagtatgcttacaattttactaagtgatggttgatgccttgatggactgatgactacaggacaacagatgtccttgtcccttccagagaaactttcagttcttccctagcttatataaatcattaaatctggataattgaaaaggtgctattaacaagttagaaatcaaataataggattaaaaataagactagaactagaatagatgataaattgaaattctctggaactagttaaaagaaaaataagtacctatcttttactctttagtctcttgcttgtgcttgactgcttgtgcaatgcagtttgcttgctcggctgcaggttgctggttgcctgtaggctgtagtagtagtactccggctgcccgctgggcgctgccgccgtgccgttgcagacctgcagtgctgcggtgctgccggcggctagctagggcg

SEQ ID NO: 72118 - DNA, 7739 bp, Oryza sativa
tttttgagttccagattctatgtagtagtatggtgtcatgaatttttgtaatcaaaacaaacgactgaagtcgttgttcttgcagttaattttatagccaccttgttagacagtgattagggtctaaagaatcatgcaagtgacctgactcactgaaccatcccacttaactagatctttcgttcactttcaatacactgccttgcattactataaaaagaaaataattaggtgcagtggtgatttctttaccaatctgaaaaaaattacccgactgcccttatgtaatgtctgtattgtagacttgtagtagtactagtcttctatatcatattttgttgtaggagtatatacatatcacaagctgttgatccagaagaacagcgtttaaatggtaaacactaaagtgctaaaccaaggaagttttggaaatctaggattcatgctctccttacacttaggggaagtggctattggtactcagatccattgtagtcataggaggataatccatgcccttttggctgcatttcaagtcaagtttgcagaatctgtaatcatgtcaaagcaggaagtgataaactgattgattaatagaaatcttcttcttcgacctagaatgagtttttgcacacccgtgggtctggctaaaccagagactaaacctggccacctaagtaccagttttttgtgcacttaataaaaatccccattttttttactggtgtggccctgacaccctgtcatctcttgcactgctccactaggatgggaaccccccactgataaatcagatgcaactaaaactacttccggcattttagggttttagggagcaagtcaatttggctaacctaattctcccttattttcccatgcagagaggagaaaaaggaagaaccagagacacctaggtatcgagatcgtgctaaggagtgccgtgaagatcaaaaccttgactatgaacctacagagcttggttcatttcatgctgtggcacctcccggagcagatttaaggtaacagaccacaggtctcatttggctgacattttctttgcttggtttattatatgctcttctggaactcaacgtctgcaatttttcgtattacaggctagcagatgtacacaagatatctattgagaaaagcaaatatcttggaggttggtagtgcaacagtgttatactctttccttgtaagaaaatgcttttcatccttttgggaacaatttatgttgtgacttgtttttttaaacacttcatttatgtatagacaaatgctcatagatctgcacaaacggttaaaattctaacatagtttggttatgacatctgtggaaatgagaatttgaatctttctttggaactgttttatgtccacaaacttgtcgcggtttcaaatagctgcttgatttttaggttcctttttaatttgaaatatatagagctatcatatacttggtattttgacctagtcagtcagtagtatgcagtcaaggaatgaggttcgatagctcaaaactaaaggtggatagttcagttggacatgttttttaagactatgatatattgttgtagatttggagacttagatggctggcactttttctttaacttttttttgtctttcttctgaactatcatgttgattgatatttaatttcactttgtgtcttaaaggtgatttggaacatacacatttggtcaaaggtttggactatgctctacttcacaaagtacgaagtgaaatagaaaagaagcctgatgcagaggatgggaaggatacacagacaaggtatttcccacaatactgcagttttagtttcataccatttgatcatacctttttcctggtagttttgtactccctccatcccaggtaaaactgaatcctagaagcccaatgcagttttagtccaagcaacaaaagaccaaaacaccctcatcaagtacaaccatgattagcacttttcataaaaaaagttcctgcgaaattcgtgcccaactacttcctcagcctcccttcactggagatgatgcgttgatttcatttttttaattcacccggtgggtggtggacaacacaacacagggaaaatgataaagatgcaattagtgtttctcgatctctggcataggaatcgatttattgtgggacaaatgatcgaccctaggaatcaaatttttgtgggacggagggagtagtcatatggattaaggacaagctgtcagatccatgcttcatttcaaatgctgtaatatattacagtgattatcacttgcataatttttaagaaagtggggagttgattccaataattattatatgacacaacaaattgtcaagcttttttaggcctagtcctccttgtaactgtgaggtgaagttaagagatatccatttttcttttgttagaattttagtaggtgtttttatggtggatggtttcctattttctttatgaatactgtcgggcagaattattctgtgcattggaattatttataattttgctatgctttatagtggccgctggatcattctcagttaaacatgatttcctgtacagtattaaatctggatttgtattatcttaaaaaaatcaggactgtcattggaataatacaataattgtttataagcatttcatgatttgggatgtagcactatgaagtttggcctcatgtccttcatccttgtctggatgcacatcgtaagttagtatttaactaggatacacatatttgatatttaacctgtgaacttgtgttgtacaggtcaacaaaagaagatcaggcagtctcattccgcactgcaactgcaaaggtggatttccttttaatttataaaagaattggtgtttgcttcttctattatcgaccatgtaatggacactaaaagcaattattggttcattgcagtctgtctataaatggatcataaagccacaaagcatcataaagtagaatgaaatgtttcttcctggtcggatggcatttatttacaacatggtacctccttcaaagttccccattttagtgctttctgtatgttaattacttttatttttgtggtggtggtgaccattttccttaataaaatgatatgtatattattttattttcatcactcatcagaattcatccgtactaaacatgatgctactattttgtaaaaaaacgttattgttatttcaatttctaatttgtcaactctatgctatgttatcagctaatttgtcaatttctactattttatcagcttttataatatgcgtgatgcatgcctatgtttcatgatatattattgtctgtttctctgctcatcatctggagtacagtaatcaacatgctcaagctctcaattaacttcgcaatatgcaaacaagagaagaaagagaggaaggatgaaaaaaactcttccaatattatattaatagactatatagtattgctgttacatgcttacatatctgcaatgatttttatgttgtgcacatttaaattgtgattgtgatgcatcacagcttcaatgattactatatgcagaaccttcattatgaccacaatccaacttacatgtctgaattcatcactagatcatatttttgatgctaatggtttcatttgctggattcacccttccaaatgattttctgagagtaagagtaatggtgtttcatcacctattctcatcatctcgtagcatgtccagtactattgattgatgctatttgcaaataattttttccatcattcctgctttgatttgaactatgggttttagcggaagagtaattaatttcattaatgaaaccaggaggatggacttaccaatgatatcccaacaactcttcacaggagcaaagctgattgcgctgttccagaggtattatggcaatacatcatataccacattgaagtttcccgaaacttatcattttcctcagtattcttcttgcttctgcaggagatggtaactgtcagtgtggatggttctgtacttgataggattgctaaaatcatgtcataccttcgacttggatcatctgggaaagtcttgaagaaaaagaaaaaggagagggacacaaaaggtatgttacttgaaaattgaaatggattttgtgcagtggaagttgactgaaaaactaagtgacatcaggaaaatataaaatgatttgtttggaagctgagcacttacattgtgaaaaaatagaaaagtattatttggtactttttgccacaatggttgagtcttgttacaattgatttatagtcttctgtcaataatttaagtttgggtatttaagttatgaccatatgttacacgtttactttagattctgaacggattaattagttcacttaatgtatttgcatgtatgtactctctcatccatatctgcacttgctttgctcgatgaaattagattatcctgattcttgttatgcttgttatattgcagggaataacagtttagcaagtggtgactatgatgaggtagccagacctggccaaacaggttcttctctgaaacatcaatttcaaaaggacatgccgccgccgccaccccctcgaaataataacttaagcaagaatgaggaacagtctattcctgttgctagagcagatgaagatgacatttttgttggagatggagttgactattctgttcctaacaaggaaatgagccatagccctgtctctgaagatatggatgagtccccacataaccatcaaaagcagtcctatttcactgaagagaaacctgtctatgggcccatcccaccatcggaccctgctcaagcttggccacaaacggtaatccagctagtgtttagtaactccggttccattgtgcttaaagtaaaatttgagctatgcatgtccaatgttcaagacaaactaaattttttttttgcccatagttgtaccttctactgaaatagccattaattattagtatgttctattcttgacctgtatttcctaaaagttaatgcctcttatgatttcagaatggatacgatgctattcaagctcaaatggtagctgctggatatcaaggggagtggtcaggctatcagtatggtgaacaacagatgccttatccagaacagtacatgcaacaaagcactcaggactatgatgtattagctgatccaaatatagcccaggatccaaggttgatgactcaagcagataaagatagaggtcttggttctgttttcaaacgtgatgatgaaaggcttaagcagctgagggaaaaagattcacgggagaaagatcctaattttatctcagatagttactccgagtgttatcctggttatcaggagtataatcatgagattgcaggcagcgatgaagaagatgatttgtcgaagatggacatgggtggccgggtaagtgagagtactgtattctgaatgctttttttttcctgtttcccttcacaatagcagacataacttgcttttgcggaattcttgagctcatgtttactgtactttttaaaaaatattttaccatctatttccaaattcgttataatatatttttcttttatgtaagaaggtagagccagctctacctcatagccatttcattgatagaaatgaacggttacagagttgcctgaagaaaggtgaagcaggaaaaaaagaaaaaaaagggaaaggagatagaaggaggaaaatatacaaaaaattacaagaagctaaaattacattaacctcatctgattgtctcagaccagagattgatttttgctctggtgttgggattggcccggttactccatagttctagagcatcgatgatttgttgaattatgtctgaaataccagtttgccatctttaaaaaatcctgctgtttcttgatttccaaagtgtgtgcataggctgcaaaccaagtgggttctatgccctgattgttatgatagctgacagtaactttctccaagaaatttggggctgactctgccaaattacatagatgtaaaagtccaaatttctcctataagcttgtagctgccttgcatctcttaggatgatatggtccttgattgactctgccaaattcattctaatgtatgatactatgattcctttgcaggctaaggggcgtcttcataggtgggactttgagacggaagaggagtgggccaaatacaacgaccagaaggaagcgatgccgaaagctgcattccagtttggagtgaagatgcaggatggcaggaagacgaggaagcagaacaaggaccagaagctcacgaatgacctacacaagattaacaagatacttgcgaggaagaaaggtgacaaagatggaggggatgatggtgggcattatgatgatgatctacctagtggcaagaagcagcgcgcctgatgcaagccactaatagtttatcctgcgagaggtgtaaaaatgtatttgtactaggaattacagcgccatgaacaaacgacagttgtaatgttcagcgttttggccggtgcagaagggaataagaatggggagctggaacggtgaaaatatgtagtttgtccatttttataacagaacaatcggtaatttgctttgttctactatgaaaagagaaaacatcaacgaatgcccaattttctgacaatgtacgcgttaagtcatatcctttaaaatggaaaagtgatttcatccctcgaggggatatcccctcatttcgtgcatgccacctaagggtgtgtttagttcgcgaaaaaaaaaatttttgggtgtcacatcggacatttagccagatgtcggaaggggttttcggacacgaatgaaaaaactggttctaggactggtagccatcctccagggcctgcttacctgagcatctccgcgctggcttcgactccctggtgctcctagtctcttggcaactgtggaaggaacataaccatatgtggcttggtcatatgtggctttagctagtattgctgcttttgggaacttgtcaggagtgtagcgtggctcggcccattctcgttgtttggagtttgtgtttagccgccgtagttttctaagcttcagccttttattttgcattttctcccttcctctggcataagccggtctggctgattgtgttgtgtaactataattgttttcttctaatatattgacgtgcaatccttctgcacgttcgcgaaaaaagtatttcacatcaacctgttaactgaacatcttagtgtcagactcggatgaggaacagcgaggatacgatccgtatggtttcatccacaaaatgctcacactgtaatgcagaggcaattagcgcccaattatctttcatgctgcgagtttgcattccacatttggaaaaactttccagggttgctttgcctaaccaccctctgattaacactcacctagtgcctaattcttttgcccttcatgacaacctaaaccccagcttcagagttggcacaaacgagtcttctccctacacgtaccagaatgccatttcccagctagtatatgcacggtaatttggcacgtgcaacctctgcaatataatcatccgaattccatcacgtagatttctgatttatcacatattttcacacgtgcgaagcatgccggaattcattttctacgcacgtttttgatttttttttttcatttttaaatttatttttttaatatttacagaaatattatatcagcggaaagatttacaaaaatggaccttgccgccctccat

SEQ ID NO: 72119 - DNA, 2073 bp, Oryza sativa
cgcccctggctgcaataccagatcaaatttaagatactacacctctctttatatacaagtgggctgagcaagaagagaaagggatatgcgtctatcatttcatagaaactagctgatgagaggaacgggctaaagagaggacaaaatgatgaataacaacatacattttgcatgtacaacttcaccacaagttttacagaccacacaatctaaactttatggtaactcttgccatacacattttgtaactaggattgggatgtattaggaaatacaactatggctatagcactgaaaccttacgccatttttctatggaaggtagtgtatgtgttggagacttgacgtaaggtttcagtgctagtagccggacaaccaaggaaggcgataacatccctggttaatatggttgtatgggaaatatagagagatcaaaatatcggagtgtttcggaggagaagtacatgcttaggtgaagtgtcgttgtgagagacaggcatagagcagctagggcttgagtcttaggcttacctctaaaatcatgtttaattaaattctctaaattcaccatgcatgtaaattttggacattaaaaaaaatattagttgagcctagtttaaccttagtcttaagaaatttttagcttcgtcactggtgagagacctacaagagctagagcagctaacgttgaagaaactagaaagtgaactatattttggtcctccggcataacattgtcaaaataaataattttgtgattatcatcatatcttttagaacttaatgatcgttggatcgagcttgacattatccgcagcaacacacacacaaaaaaagggtctctggcatgatccgcgagcggataatccgacccactaaagcatgatggggttgactaattaattgtgctttcttttgcaaggtataattgtgtatttgtgtagctaggcaattcagatgttttcggccacaagtttctctaacagcttacctacggtagacatgagactatttcaactttttggcaaacggattatttcacatcagctacttgatgattcgttactatgaactttctacaagtgcagtccctttaattacatcaaccgcacgtctattataatatgtacttttcacatgaacacaatgccgttaaattcaacatacaactctctctttcatctttatcttttcctattataaaagtttaagatgtttttgccacaaatttcgtacgtcgtccctgattgtgtctgtatccgtatgagtttatcgcatactttggccaatgcacaaaagaatcacagatccgattcaatttgacacggagaaaaaaagtcaaagtaatcctaagtccgcaccaaatcggttccgatcaggattttacataaattgggctaaatttaaaccggttcgtgttacactaggacaacttgcatatatacaacatataaaaatacaaaaattggttctaggaaaaatacccaatttgcacaaaccctaaattccaaattttcctcgaattagatcccaaatccaaataaagcaaaactccagccaccagaatcattctcaccggtttctatcttcggccgcacgtcgcatgatttcaaaaccctaaaacgaaaaatacccaaatttagaactcaaatttctgggtaaatccctaagcaaatcagattgatggcttaccaatttggcaaatcaccgccatcatgtgatgcgagcacagaattagcaccaccatgcacgcaccctagccgtcaccctgaaccggccttgcgcctgcttctcatgggccacgcaaggtcgaggctcgctgtcgtggccttggctgcgtgcggaagagaaccaggaggcggccgtgcacggcatcagacttggcttggaagcagatcatcaccgtcgaatccactccacgccgctgccgaggccactccgcccccgtcaactacttgagctgagctgcagcccagatgcataaccggatgccgccaagagaggaagatggggcgcaacaggtagggaaggagctcaaagattgttgtgtgtgtggggggggaggggggggga

SEQ ID NO: 72120 - DNA, 8561 bp, Oryza sativa
tgcgccgccgccctccgccgggcgccgccgcccgccgtagcgcgtggccccgccgccggccacccgccgcggtcgccgccctccgccggacgcgaccccgccgggcgccgccccgccgccggccggcccgccggatgggaaggggaagccggccgggaaggggagagaaggggaggagaggaggaaggggaggagttggagaagagagttagagaggatagatctgaggagaggtgtgagattcgatctgtctaagttgtaactgtggaggagagggtaagggatagggattatatactacgtgtttaattttaatcccggttggtactaccaaacaatctttagtcccggttctttttggatctaggactactgtggattttgccggaccgaccaaagatggtttctccaccagtgggactaattacatgtatatctcaataaacacattagtcccttaaccttattcatcattaatcaccaaaacccactagagggataaatgcaacttcaacgacctctcagggttataatcttacatttttttcctgctctaaatatgaactttgtgttttctagtgtgagttgttaaaaaaaaacccttcttttgcaacagttactactatatacagacatactcactccgtgggtaaatgtaaggatttttttggttatttatcaagattaacaataaaatgaaagatttgtttttctcaccccatcggtcaaaatttttaatttttaattacttcctccattaaacaccagactgattaataaaatgcttggattctcgtgtattaaaatcagtgtcgtacaaatgtttcaactgtaaaaatacatatacgtacttagaaacgaagggagcacacggtaaaattgatgtgagctcaagatcgatcaacaagctgagaaaatatttcaacctgagaaaatttctcaatcatatcatttctataaccataattttctcgaaaacagaattaaaaatgttcaaaccggccaaagcaaaagcggtaccgtagatatcggaaaatcgagaatgaaactatttggtatcaatcgaaaccaataataataccagaaacatcaactttgtatgaatatataatatgtaaaacaaattcaaggttacactaggtatattacaaattgtctatctttaaccttgcactcaagttaggaatttggttgaggaattgaccgacctctaaactatgagccaaatgaaaaaaaaatggaccatagatattgacgtatttataaaaaaggtaatttctataagaacatgtaacgtttccattttcaatttcattgtatcattttgttttcatcggtaaccattttcacatggctcaactagtaaaagttaaaaaacaaacttcggttacttttcatgattcttttcacaggattaaaaaaaacgtgtgtacgaaaaatgagagagtggagctgggaaagtgttgcaaagaacacagccgaaggtacatgcattgtcgctcatggaacctctgcatgtgctactacatgctcagaatgtcataaccgacatggtgctagctgctagtacaatatgttagtaatactagtacctatagtaatatatagaataacactacagtagtgtacacgagaatatatctcatatacacaagttttttgtgcacaccaaccaataaatatcatggaaaattaaaaaaaatagacatatacttttaataatattgcacatatctgcaaagtctcatattcaaattcattatattttagccataacaaaaagagtgaaaattttgatagtttaaagagtaaaaacctctccgaattttatttttttgttacgactaaaatataatgaatttagacataaaatttcacatatacgtgtaatgttattgaaagtatgtgtccaattgtttataaaatttcttatggtatttgctaattggtgtgtatggagtgtgtgtaggaagtttttttttagagaagggtttttttttacctgtcttctacatccagttagatatatgtaggttttttaaatcaaaaatttagcctatcggaaacttagccctcaaataatctaatttgaaattcgctcttacgtagatttaaactcagaaccttgatatgctactcaggtcactgcagccactaggctacatgtccttttccttcaaatttcaaaccatacattgatattgtacagacatatatatatatactctccgtgaatgtataaatgcaccatacatacaggttactgatgagaacataactggatgtttgtcataaaatttagtcaaagtgaaaagaagttataggccatgcgcttcacagttttgttgtaactaaaacctagtgcatgcatgctccctaccatctactcattcttgaccatgcatgttacttggagcggagtacttacttgttcagggagattcctgtgatcgtctacatggagctgcttgcatggatttgacgtgtccggtcacaacgctctcgatcttaatcattggagggtttttttcccttttcttttggatcatgtatggcggggaatgcattatttggtgtcaggaatttatagctggatccacaggaatttaggcaagttgttcaattgcatgagtataataatgcagtgatcggaattaatatatcctttgtaaaaaaaaatctaactctagctacacatgttcgtaatcaggaatggatttttttagatagagggtgtatattcgagcaacttttgctgcttgtggtgaggcagcaggaatcgcctataaaatagtactaactggctttcttgtgttcaactctgcaaccaccaatcaagccgttctccgtatagctacaagagcttcaggacatgggctgttttgccaccttgttgacaaggcaacaagatgcatatagatcagcccagctcatacttcagtgccaatgaagtgactagtgaggaaaaggaggaaaatatatactagtattattttatctttggttaatttgagagccgcataaataagtaaataaataaatattctctgtcccatattagtaggtaatatgatacatctcatttggtttatattactatattttaggatgaaataagtataaattgcaaatgcagatattatatagagttgcgacttgtaaaacagtgagaaaaattggcatgcgtgatgacggcatgccaaactttagctcaagattctctctcaggccgagtttagttccaaattatttcttcaaacttttaaattttttatcgcatcaaaactttactacacacataagcttttaactttttcgtcacatcattctaatttcaattaaacttctaattttagcgtgaactaaacacacctgaattaggaagtgaggaagaagagaccgtcctgcagctgctgcaggccaaggcaaaggtgcatggaccatggtgatgcgagcacacacacctttccttataattttggcgggcacatacaacagtaggtcctggatgatgagatgttgggaggagtggccaaccaactgcacggaaatcgaggagtagcatagcactccccaaaggtcaaaaaagggtcaaagagcatatcgcaatccaacgaacaaaagccaccaaaaccatattcttcggcctctgctctattttgtctccccatcacctttttctcctcatcttttagtccaaactgttccaacaacaacaaacatgtcacagtagtgtcatactggatactattagttgcagagtggtgccagtacaaccgtagtgggagtacttcatccgtattaaaatagggtattaaaatataatgatttttagattatttaaaaaatattaaggttagatcaaatgatatatttttaagttgtttcatttattaattcttgaattttgaattatttagattttctttttaataatctattttactttaaaatttcaaaatcaatacaggaatactttatattatgatattatataaaatatgaatcctaaccttctttatagagtattttgttagaaccataaaggagtattatgtattatcagggggtgggcatttggtctgaccaaaattttcggtcacggtctttggtttttcggtcatttcggtctttgaaaagtaaataccgaattttgacgtaaaaatgtcaggaccgacaaattcaatctcggtctcggtctaaccgaaattcagttcatatatgcaaagaaataatggaaattttcaacacaaaaaaaaatccgtaagcacatatgagtaaagactcttattaggttgcatgcctagaagaagtatggatgtgaaaattagagtttaatgctattaaacttagtggatcgtaggttacatttagacattttttttgttaatttagtatattcggttaaccgaggagactaactgaattgactgaacaaaattcggtctttcactgcttatgaccgaattgatgactgaatttctgagtctcggtcttttagttttggttttttctgcccacccctatgcattatactttgttgtattttgaaaaacgagtcctaggatgggtctaattttattgtagattgctatattttgaggagagagtatatgaggatgagtcctaccccatattcctatagtacgtattactaggaatatgaaccgtattagaatacgtctaattttgttttagattgatatattttgatacggtggtctatgagatgagatgcctttgtcaaaggtccacgacggcattcatacgtgctagtactactcatgggcatgaatggatgctttcacgtgatgggtcaaacccgtagagaatcttaaacagtgtcacggtagttttcgtcaaactactaacgttgtcaggcgataaagatatactagtataatgctcgtcaccagtactataatattgcacggaataacagtgtgtatactggcctggtggcatttgggatcggctacaggcataaaaaagctggacgctggaacgagaattcatggccatatgatgcagatgtgcccggctcctgagaaagttgactacggctagttctttttggagggttggttgttcagtagtgacttttgtgtactaacgacacataaaaattgaccttagaatacacgtactgagtatctagcagtgccggtatctttagactagtttattgatcggattatctacacctaacataaatagcttaaaacaaatggtttaaatactagaaagaaaatactccctccgtcccaaaatgtttgacgccgttgacttttttaaacatgtttgatcgttcgtcttattaaaaaaaaattaagtaattattaatttttttcctatcatttgatttattgttaaatttacttttatgtatacatatagttttacatattttacaaaagtttttgaataagacgaacggtcaaacatgtttaaaaaagtcaacgacgttaaacatttagagaagaagggagtatatttttcaaagctagaaatacttcctccgtttcacaatgtaagttattatctagattcattagcatcaatataaatgtgaaaaatgctaaaatgatttacattgtgaaacggagggagtacgtgtcagtatttcggtaaaatagttgaaagcagctgtgcttgtttacaaccacgagaccacacggagtaataccgagcatcaagccacatcgcacaatgcagcatgcgcctcttctgtacatgccgctgctgctgctgctggctcccctgcctgcgcgcatgtgtcgcgtcaaataaccgcgagaaaagcaaagcagacagccactcacccagtgtcctgcatgaaactcggagcgtagcggacgacgaatcttgcgtcacagatcgccccccaacagcaacagccacaccgatcccccgccccgtactccactatacgtaggccacccatctcccaacccggcgtcgcgtgggcgtggctcgtctcggcgccggttgcacacacacggtggatggatgattggatgatgtgctgccgacgaggcggggagggcgtacgcgcgtaggaggatggtgtacgtacgcgtggggtgtgggtgggggtggcgggttgtcgagcgaggcaggcacatgggccggctgctggctgcggctggtggagttgaatggatggggattctgtccgcgacgcatatggcgagacgcgcgcaggcaggcaggcagaggcagggtttgtccttggctgagactgggatggatgggatgggatgaggaggggccagcattccgatgcgcggcctcgaccaaaactgaccgcctcctgtacggttctttagtgctcaactgcgcaacgtcaagcatatcgtaccagactactactcctcctcctacctatagaagcagcatttttcaaatcaaatcaagcgaaaaagtacttgaggaacgcagggcttgccgttactctaatggaccactagtattttcgtggagcatttgagaaagtttagaagtaaataccgctataatatggccctgtttagtttccacacaataaatttataccctatcacatcgaacatttaacacatgtatgaagtattaaatataggctaaaagaataactaattgcacagattatgatcaatttgcaagacgaatcttttaagcctaattgcttcatgatttgataatgtgttgctacagtaaacatttgctaatgactgattaattaggtttaataaattcttatcatcgtttactgacggattctgtgattagtttttttattagtgaccgaacatcccatacgacaccctatataatactcgatatgtcacgccaaaactttacgcccctgatctaaacacccctatcttcgtcgtaaaatatcttaatctagtaccgtgtctgttcagatttgtactgtatctaatatgttacgtctcatgctagattaatttattctgagacggacggagatagtagttgccattaccatctttttcctaaaaattagtttatttttcacacatctcacatatatcaatacaaaaccacattgattaaaatacctctactttatcaaattgcaataccataatttctcattttatctactctcaatataattatattctattttgcacaaactcctatgcaataattaatttgaaaataaaacttattttatgacaaatgaaggatgctacaaataaacttaatatgagactgcgcaagtagtgttgtcgtaatagctttttttactctccctctctctctttgtgaacttaatactccctccatctcaaaatgtttgacgccgttgacttttttaaaaatatttgaccgttcgccttattcaaaaaatttaagtaagtattaattattttcctatcatttgatttattattaaatatacttatatatatatatatatatttacacatttcacaaaaaaaaatttaataagatgagcggtcaaatatgtttaaaaaagtcaacatagtcaaacatttagggaataagggagtatatctatcttgcttcttgcagtattgtataggagtagaacaatctcttagtatatggtactgtagtcaatactttataattttttaaaattctcttctctacatagcattatagttagcttataatagctcactactacgcctacgttatccttgcgtttactataataaacccgtctactctatactctggtctcgtctctcatgtgcacgatgaatatagtaggattattattattattattattattattattattattattattattattattattattattattattattattattattattattattattattattattatgtataggggatcatacttccgggctatacatagccgtctcatggtaggtataatccgtcttcaagtcaaaagacacgagtgacagtgagtgattacccgtgatactcactcactcatcccagatcattccatcccgtgcgtttccagccttttccttttctccgcgcgctttccgctggccttcgctactccactttgcatgttataattgggtgggtagcggccgacctctccgtgtcggtgcggcttctcgtgtgcgcatcgatcgaccgatcggcacgcgaggattccgggattcgcacgaccagatcgcggcgccgcactcgcgctcgcgcctgtgaatcgagatggcctcccgtcccgtcccgtgccgtgcgtgccggcggccgatcaaagcggtgaacggcggcacatggacacgcacgcggttgagcattaattgggtccgaggctccacgtgacaacgagccaagcaacgacctgtgatgaatgctaatccgggaagaagaagaagaagaagcagggattgatcgccgattggccgtcgctgtcgatcggtcgatggtgaggtccaaatcagcgtcgttatccgccgcacctccatctccatgcacacacaggaatcgacaggtttgctgggctccgcgcgagtaatataatccagctttccgcttggatattttgcacgcaacgcaaacgagggtaaattt

SEQ ID NO: 72121 - DNA, 25538 bp, Oryza sativa
ttctcatggttaccctgcaacacttttagtttttcacccctaattatcaccgtcaacgcccgctagacggggcagggacaaccggacaagacaaccaagcgtaataatactaccaaacaacgaacatgcagagataaaccaaaattaagcggagtctgctacatgtgcgctcacaaatgagaagtcagaaccatatgcgtcagcaaacaaattcttcaaattacatagtagtacacaactgaaacaagctgcccatttcgcagctgctatatatttacaccaatcattctgtatgaaacacacaaatcaccgtcataatacaggctaagctattgttaccatgaccggatatacacttggatgtagaggttgcaatgattttcactatcggaaaaaaaaaaagagctactgttacctttgcccagctcttttcgctaacctccgcaattgaaaatcacagcacagtggtgcagcttaacttcttgccaaccaaactgtactaatgtactaccaaaaatgtgtcctccccagctcagctacctagcttatgagttatgaaagctttgcttcagtaagagaggacatggccatccagcagtactcctttggcttttatcacccagtgttgagtcttttagctcccacacttgaaacattgtggggcatcaccatctttcttctcaagaacaaggcatagaggagttcattccatgcatcagggacaccaggcaggcaccagtggctgcaatcctgcctgtgatgagatgcaggccctgaaggactcaggtacaccgagaggtgcccgtctttacgcagagctgtcatctgagtcacattcagtatatccagcccgacaagcttggtcgtgatgctgttccccagtacatgatttatgggttcaagcaggtcagcccacggttccagcgatttaattggagttacatctggtagagtttccaagtggcaggtccctccagtcttccagtcaccacctctgtaagaaatatctaatctagttaaagaaatagtttgactgaatatttgaaagatactatgatgtttgttcacaagtccaacaataaataccatcagcattgtttcatgatgctaacaatatattggcacaattcacataaaacaatgaaacaatgtatggtcaaaagcatctgatatcattcgatacaacatacacaatcaatcaagactgtcaaataatgtttgagcaaggaattaaaaccaagggaaacactcactatttgagtaattagagttggtgattcacagacctgaaatgcacaggagcatatgtacggaagatgatctgggtcttgtttgtgttaacttcattgcgaagccaatgaaacaatgtctgcatggatctttggtaagcatctctaacagtcatctccattttgacctcgttgccttcttggaaataggcgccactggtgcaagacataacagtaagaatagcatgatctctcagccataagacattaagtagagaatgctgttcagtcaatagaattcaaacatttatgcttaccctttgattgttttctcatggttccaccagtgccccgtgttaaagatcaaaagatcagcatccttccacttaccccggccagacatccaatccatggcatctactctaattgtatattttacgactgcaggggctccagctggtgcacgaccttgaaggactatgaaaggagacctgtaatactccacagtgcaattgtactctctaaacttgaaaattaagaaacccatgtgttttgtaataggattcccattaacttcaaagatggagctcttgtcaggaacagcagcagcgagcatacaaagcagagactcccattggtttcttgcaatcgaatccccaacaaatacaactcttctgtttctgagtttctctagcatatttctggcattaaatctaagaaacagaaaaggagacgaaattagagtgagacaccagcattgctaatatgggcatttgaatttattgataatggtacatctcagtccacaggtatcaagggagtaccatacaaggtcacaaaataatgaacttacaaggtcacaagcatgctctttccttataaaataattcactgagaaatcaaaaggcatgcaatacattaaaaaacataagtacaacgagattatgcttctaacaaaaaaatgcgagtccttttacatggtactatgtaacacatccctaatgttataatattccacctttgcaaaatttcatacaattagcacttatgaaggatgacaaacttaccctccaagtatagctactgacatttatggtgacaagaatcaagattaaatattcttttcaaaaggtagaaatctaatcttggaaccactttacttttccaaattgaatcaagcaaccacttaactgcaacaaaggcagttagaacacaacaaaacagagccctcaacaattaacaggacaagaccacctctccatcgaaggtaaagatgattgcaacagcatgacagtcgcagatcaagtaaacaatactgatttaataaaatatatcttctgcaggactaagcaataaccatacgggtaacattgtttcctacttttgtaatcatgtgggaagcaaaagggcatcgaatttccaatcgtggcgcacagttccaaagtggagttggtcgttgacagcatcatgatcatcccatgttccaataatctaattttaaccagggtgaagattgtaaaatgcacgcccactgatccaatctcagcaagaatatcccactggaagattgaagtcagaagcactaacccaaacttaatcctcatcatgccagcagagcagcatgtttgggttctagattcaacccaagtttatttaagtccgtcttaatttctttgcctttataagttaacactcaagttgtagaacattccagcagacaaaattaagtagcacggtctccaatccacatctccttaattaatttatactaatcaattaatcattcgccatctccgcaccgttctagatgcttggattgcagcaagagatctcattaaagatttcttcattgatcttcgtcaagctctcgaagtaaacatttactaaaatcgatttctatctaaacctccaaactcgccaccccaatccaacaatggaatcaatggaagcataatatgcaagagtaccaaagatgagaggaagaagtagaaatcgatggaagaggaggaagcaaacccaacctggggagatcgcagcgggaggggcgccatcgccacttggtgtaggagtcgtcggggcggccgttctcggagcagcggaagccgacgtcgaggaaggggcaatccctggaggcgtagagcgggtagccgtcgtcccacacccactccccgtcgaacaggtcgcactcctcgcctccgccgcctccgccggcgccgccgccgcggggctcctcgatggagaccccgccgctgaggagcttcttgggcgccgccagcgccgagccgacggcggccgagcagcggagcgaggcggcgcacacgagcaggagcagcgcggcggcggcggccagcatcgcgaccagccccgccgccccggccttctccagcggcctcctcatcaccccccgcgccagccgcttcgccgccgacgtcgaccccaccatcatcgcatcgatcgatccccccaccgacgaagcagtagcaccggcactagtagtaccactactactacctgtatactacctcgccatggccatggagcttacgcgcgcgggaggaggggagacgagacgaggtggcggagaggaggaggagacggagacacctcgagggagaagacgaggaggtatttatgaggaggtcatttgaaagggaaatgcacggagtttggctgcttccaattggacggaaagcaatgtgattactatttccctatttcataatatataagttattatagcatttcttacatttatattaatattaatgacttacattgtaaaatggagggagtagtactcctctccatcctataaaaaaaactacttaacctaatattgaaagaaaaattttctaatacaacaaatcagaacagatagaaactcatccaatactaaattatttttccaatacaacaaatcagaacggatagaaactcatccaatactaaattattttttttaaagtagaacttaacctattactaatataatatcgtttcgattcaggaaatattatattttatagtagattaatatatttttgagacgaagtaagtacaaattagtagtgtggtttgtggcaattgtgttgtgcgtgtggagaggggaaggaagaagtggatgggagggggagggttgaagttgaggtgtggggcctataaattcggctgtgtttggaggggttaagtatgagtcaagtcaagcacgatctatccctcggtcatcaaaaaatacttgctttaggtcgagcgcaagttaaatttgattaccatctgtctaatataatgtcaaaagatgtactggtattttattttaaaaaaactttgtttaattttaggccgctaccttttaaccacatcgatcattttcgatcggggcagttgctaaaccattttcacacaagcttcattgtccttgttggcttgtgaaaaatctagaactctattttttgactacagagagtacgtctacttgtgtgatggtaacgattccttttggtccttcccacgttttgtttttaactgcgttgttagactgtattgcgtatagattgtgacaaccatcgagtttgtaatcaaagataattgattttggtggggattagtagtagtagtgtgggttggggcaaagaatgatgcatcgaaagatgatgagggtgttacgaaagcaaggttgttggcttgtccttgtacgcaacgcaaacgcaatcaagtttaatccacctggtcatctcgataacagcaaatacactactaaacgagccatgatccaaaaccaatctttttttttttttggaataagttcaccagaggttcctcaacttaacaacgagattttttaaaatccctcaattacaaaactagaaatattcattcctaaactcactcaaaccgttcaccggaggtcccatgacagtatttgcacctggttttattgacgtggcatcctagtcagaaaaaaaataataataatatgtggggcccacatgtaagtgagagaaaaatgtggggtcaataatccagtcagcaatcttcttctcagtcgccgttttctttgccacggatggggagcggtagtggctcgcggccggaggcaggcggagcggcgggcaaccgcggcggtggcgggcgagcgacggctctgggcacgggaggagcaaaggggcgggtgagcggcgaccgcggagcatcggcggtggtaggcgagcgcggctgcggagcatcggcgttggcggcggcaagcggtgggcaagtgtggcagcgggcgagcggcggctccgggtcgccgccatcagagttaataccgagggagaaggagggtacgttgggagcctcataacttcgccgttgctcctcccggcggcgctccttatcgccgtcgctgtcggagtcgatgccgagaaagaaggatggcgcatcgggagcctcataacgcttttgttcctcccctccattgccgccgtcggtgaggtgggactcgtcgccgtcgccctcgaaatcgatttcggcagaggggggaccggcggcggacgagcgcgatagaggggagagcggcggcgagcaagcgcggaagaggggggaccggcggcggggcggagcggccggaataggccggcagaggggggacggcggcggcgcctgcgatgcctccgccgactccgcaccgagtcgagcgtgcaccgtctctctcccctctcccaccatcgccgcccctactcatcgccgtcgccggcgtctgcatcggcctcttatccgccgccgagctcgccatcgcgccagccgtctctttccccctctcccgccgccgcagcccctgctccgccgccggccgcctcacatcgagtctaccaccgcgcctactcaagagaaggagagaagagaagagaaaaagaaaagaaagagagatgtggggctacatcattttctctcacttacatgtgggcccccacatatttatttttttattttttgctgactaggatgccacgtcagcaaaaccgggagcaaatactaccatgggacctccagtgaacggtttgagtgagtttaggggtgaacatttctagttttatagttgagggatctcaaaataatctcgctgttaagttgagggacctccggtgaacttattcctttttttttgggccaaagccttgtccctacacaagcctagttagttagcctaggaaaagtacaccgaaggtccatcaacttgtaatcgggttacaaaatcacccccaaccacaaaaccgttcattttaggtaccgttcattttaggttcctcggtggttttgacccggttttatccaacgtggcggctgagtcagcgtggggaggaggcctgcatgtcagacagtccacgtcagccacttcttaccctccctttcaactcacttcctctctcctctcctctccacgtcgatggccggcggagagcagccagggcgcgacaggacagtgtgacgagcgcggtcgtcggtgcaacagaggagcacgtcgcggtcgagcgccgccatggcctcccttgtctctgacgcgccttcatcaccgctatggcctcccttgtcttcaccgcgtagagcgaggagcgtgcgggcgaagtgatgcacgaggcggtcactaacctcgccccgagggccggcggcggcaagcacggcatccgcgacacggcgtgccccatcgaagtccccccggtcgacgaggtcagagcacgcgagctctgcagaggttggtcggctggtggggaggaggcctgcgaggtgaggcggaaccgtcggcgaagtcctgtaagccatcgcagcccaccaccgccacaccctcgctcctgcacgcggcaggacgctcgtccgcacggcctgccaggacccgaccagcgcgaggatgccgtgcagttgctcccctgctggacgccgcccgctgcagatctggcgcccgcgcctcaacggcggcggtgttggggaggccctcctgctccggcggcgtgggaggacgaggcggaggcggatggcgccgacggggagaggaaggatgccgccgtcgtcatccatggccgcacgtggagagacgatggaggctggcggtgtgggagggcaagcacgggttgacgaggcggaggcagatggcgccaacagggagagggaggtcgccgccgtcgtcatccatgtccgcacttggagagacgatggaggctggcggcatgggtggacgaggcggaggcggatggcgccgacggggagagggaagtcgccgccgtcgtcatccatggcgacacgtggaaaggcgacggaggccggcggcgtgggagggcgggcgcgggaggacgaggcggatgcggatggtgccgacggggagcgcgaggacgtcctgctcccacatcgtcgcggctgccgccggtcgccggcctcccgacatcctcctctcctgcctggcgccctcgccccgccggccgtcttgctcggattgagaagaaaaggtgagagaggaggaagggggagaagaggtgaaagagagtgatgacgtgaacaacctgacatgtggggcccacgtgggtcccacgctgactcagccatcacgtcggacaaaactggggtcaaaaccaccgagggacctaaaatgaacgattttgtaagatgagggatgtcatatatctgattttgtggttggggacgattttgtaactcgattgcaagttgaggggccttcggtgtactttttccgttagcctactcagacccagtcacttctgggccaggccgtgataccatagccttcttatgggccgtataagcccaaacactgcctcctcgtgggcctattgggctaatactccaaggcccaactagctcccactccatcagtccacaagtcaccatttcaccaaccacctcgagtaggtaaccggcggcggcagtttgacggcgggcgccgtgccaactccggcgtcctcctgccgccaccgcagttcgacacctccgcccatccacgacgagacacaggtatacggcgctattcctctccaccccagtaaccacagattgggagcagatcacacgaaggaattgtgtgaaaggactggacaaatttgtttcttcgtcaggcttgagagttcagaagcaggtgagaacacttgtatagtttctacgacctcttcttcttctttaccggaatcatcagggatcaaggattttgtctgcatcacggctgtacattgatgaatccaattgcactagtccatgtctctctaaagtcaggccatgaaatgccatcacgcttgagaatctagcaacttttgctttgctagctatctatccagtccagggtacgtggagtagttggttggcctttctatcatcttttaattcgctgccatgacggttgaggtagacagcattctatctgcacctgcattattgttgatccctttctcgtcgtttttttggttttgttttgttagagcaggtaaaacagcaaactataaatcagatataaccacatatcaaaaagaaaaaagaagagagagaagaaagcaggctacagatttgtagccggctgcaacacagacttcaaaacgttatgtgtgtatgagaggtaggaccgggcattaatggtgtagtatatttttataattaactattataagaatagactattagattagctatagatgatttggagtcagtagctggctatactattaaacttgctcttatctttctatctttttgaccttttagcagccagttgaagctagacatgttcacccataagcatgtgaaaatggaaataataaattaaacaataggactaatgtaaaggtgtccaattataaaatgatatgcaaaatcatctaagtttccgtaaccgcagccaccttggaagaatcgtggactaggaatagagtatttgtctgatttggactttggaaactatgggcacatataccgttccacgcatagttcccccgagatgatcgcataagatgcatcgtccaagtatgaatcaagaacaaactaattagagccattttggtttgaagttaaaatacacccctaccaaattattggcactttaaatagtattttggttagtgtttggttttgctactaaaatgtgacaataacatatataacttgccaaaacttgggccataacaaaagtttgcttaggttttggcatggtggcaaaccatgcaaattctaaggaatcacattaaagaggcttagtgctccctgaaaaggtgctcacttcattctattttacctgttgttttaggacatgttatatacgttaatttgatcattgtctttttgactatatattcaataaatattatataactgcatgaaaatatctttattgataaatctttttttaatgaacgcaaaagatttgcttccattaagcaaagacaaaaaaaacagtcttctgataaattatgtcatgtctttttcacatattaatttttaaagtaaatttcacaaaactacagatatttgactaaattatcacaaaactatagatttaaggtgatttatcacaaaactacagatttaacaataaatttatcagaaaactatagattttaggctaagtatcgctaaactatggatttactaatgaaattatcacaaaactatatattttgggttcaaatccttagcactaatgctatgtttgagttatatatatctaagttttgtgattaaattgatattaaatatgtaattctgtgataactttgttactaaatatgtagttttacgattttccacttaaactgtagttatgtggtaaatttagtgttaaatctatagttttgtgatacatcatgttaaatttgtagttttatgaaatttactctaatttgtaatattgaaaatatcaagagtttactccttgcgttttatgttataagtcgctttgacttttttaaagtcaaacatttttaatgttctatcaagtttaaaaaaaatatagcaactttcatatcactaaattagttttagtaaatctagcattgaatatattttgatagtttctttgttttatgttaaaaatattactatatttttaatataaatttggtcaaagctaaaaaaagtttaacttagaaaaaaaattacaatgacttataatagaaacagaggtagtagaaaatatgcgacgttaaataatttgataaataaatagagaaattttatggttctggagaggtaccaaagtaccaaaaattttattgtaaaattcagtaccttcttatacctagttagtaagagataccaaaatttacatgagaaattttatgagaaaaaaatacattacaaatgtggtaacttcttaagggcagtaaaatcacttgaataaataggagtaacatgttgacaagtgcatgacactcattgggtacgtgtgagttggcaattacagcgacaagattctttttgttttcttgtagactgttttctaattagttgtgcttcacttgattctagcaatcgccttctaggcgatagcaactgaaatgaatggagtaatatataactctaggtgtgcttcttgccaactttgcttgcatgatttcaactcagataaacagataaagtattgtaagataattacagtgcatgtctttctcatgataaggaaagggtgaaaacaatagtgctgtgtccaattcacaagttactagtactggcataagatattttgctgaaaatttcattctgaaaaggatgtgataaacccatggtctgatcaaaatacgctacttaatcgaatagaagaatagatatgcaaactattgctgacagcgttagagatgcaaagtccagcccacttaatcgaattttaactaaaggtgacaagtccccatgcatttgagcaatttgcagaacatttcaatgcatttggatcagctaaagaaaaatccccttcgcactgaatcacatggttagattctctctgcagtccacgagtactgcaaaataaaaatcagcaaatctgtgggtctttaccagtcttatctaatcctgtgtgcgcccattggtttccatttattaatgaaaaataattctttgatcagtattcagtataatgtatagaccttatgttagagagagatttaaacacagatacattgaaaaattggacatgtttcttgaattgtagtcaccttgctacctactgcaggtgctgaattctgaattgctgactaggtaactattgtccatttagattagtcatgatgatatttttttagagtaaattgcactttggtccaccttttattatccacgtttcaatttgaaccacccttaaacctatctttttaatttggaccgggtaaatttatcattgttgcgatttggactaccatgaacaactttttctcgttatgtctaaattccctttcggtaaacatatgagccatacatagaggagttcggccgtatatcagagctgatgtgtttaaggtcgtgctgaaaaagatcattcgtggtggtccaaatcgcaacaatgataaatttatttggtccaaagtgaaaagatgtgtttaaaggtggtccaaagtgtaattcgctctttttatatttgaaccttgttctgagccaaattaatacagttgttaacgaaaatttgtcattgccaaatgcttgaccgttcatttacctgtcatgtcaccttgtcaaatccttgccagttgtcaatgattatgtactcgttggtgacccaagaatattcttcagaatttctttttgttttgagcaatgaacatggcgtctgatgttggatgccactcgatctagcaagctgggtttgtttgttactcctttttcttaaacataaatgtgactatcagcatatatcatggcatacgtaagcttgctcttacctagtactcccattgattaaattacttacttgagatcaaaataatggagtatttaattactttagataaaaaaatggagtgttaaattgtctggtgcttacgatctacagacatggactgatagtgatggataaactgaatagaccaaacacagtgaatttatctatccctttttcggtcagtatttctagtgcggtggtaaaatttagtgaagaattacaatatctccggttgttaatactgtacctcaaatgataatgcagcttcctctaaatcacaacaaatggcagcttcacttaagattcttattaaacttcggcaatttattaatagagtaaattaatatattatataagtttgatgttaattcttttctaaggaaaaatgttcatacatacaactgctaattaaaagaacacgtgtagcaaatgctggtattaccatgctttattcagatagtagtgagtacgaagttagtatgtttgactagtgccattaattttcaggtctattgtactattattaaaaaacattgatgatgacataaatatatcatgcagacccatgtgttattaaattaactccgtcaggtttttttccccttctaaaaaagagaagcatgagctctgctagtcactaaaggtagaaagtagagtaaggtttgcagaacttagtgcccttatctctgtgaaaaagtgttgtatctgttgatttgtttgctaacagaaaggccatttctttatacccccaccctttctaaaaaaatattgctatctaatagtataatattttcggatgaagggagtaatttttacatggaaatttatgcacattgtttcacaaatttatcatgttcccgcagtgtggttctatccatttctttctctaaagctcgaaacccttaacaagttgacataaataataagagcaccgctacatgttctatttttttcttactaaatttttactaacaatcgtcttaaccgtttgatttagatagatgaaaattaaaaaattctagatgcaattattgcgtgacacattattgttagtaataagaatttagtaagtaaaagtttatatttatagcttttccccataaataatggtggattcttgaatcttgattccctgccgtgattaagaaattaatttggtttctcgattttcttagtgcgagcacccacaatcacacataatcagtggcacctaattaacggaactgaaagtctgagatattagatgattagtgtaagtcattgttatgacaaagcattgcatggcaaggggttgccttaatggactggatgaacttggggttccacgtcagtcgttttctgcagaacagtgtggctacttatgtccactaattggcgtgtggatctgaatttgtcatcggctgcatttacaattgatcaaccagtaggggatgagggatgaaatgagtagattacttttgattaagcaagtaactaagagtcattatcaccttttatctgtataatcacataaacatcttatgtatctttctttgctgctcctccttgattgaacaggcatagctgccattaatattttcgacagagagaaaagagtcattgtcattcagatatatctaatcacggaattagggagggaaatcttcgtagtgagactctcctagtgattggtcacatactgaattcttttctgaaaggtataacaagcgggtcaacatcaagagagaacctaatctagagcattattgttgtctactccgccaaatctggtgtgtcacaagtttttgcttgtgccaacaagaccgggccaatactggatttcttttttttctccatccctttgcaaaatacggtacaaacacaagcgtttatatctacgttcttttatgaataagcgcatataaagcttatccctataaacacgtttataagattgggttggtaatatcttaatattaacaaagttactattgatatctcatgatcacatcaaccattaaaaattaattaactgtaagctagtggatggttgatctcctccagaaacgcagcatcaatagtcactcggatgcctcttttgcgctcaggatcttgagacggcgaaccacattctcctcgactgcgtgtttgctcagcaggtctggctccgtgtactgtcgtcttctggatgggttgccctctctccctcgtggcagctggttctaggactggtggccgtcctccagggcctatttacctgagcatctccgcgctagcttcgactccctggtgctccttgtctcttggcagctgtggaatgaacggaactctaaggttttcgactttgcactattttcagtcaccgtggttctggagtccatccactcggagggtcatatgtggtctttagctggtgtagccgctttttgggacttgttaggagtgtagcgtggctcagcccttcccgctacttggagtttgtgtttagccgccgtagttttctagcttcagttttttatttcgctttttctcccttcccttggcataaactggtctggttaattgcgttgtgtaactataacttttttcttctaatatattaacgtgcaatcttttcgcacgttcgcgaaaaaaaaactgtaaatacgagcattgcatcggtatactctcgatatttgagaatcggtacctatttaaacatttcgaagacaatctaaaactgcacccttcgaggaagaaaaaggcatcaaagtaaaagaagaacattttattacttggcgaatggggatgtgtgctgaacaagtaaaatatctgcccaagaggccaaaatggccgttgagcgttttcctggcttgcgtgttgttcacaataaatcgcaataaatcaaataaaaataaaactgcacacgatgcatcatccgtcaccatcttcacacctcactaattcattacatgcgtttgtttttctctttttatcatcaatatagctaaccggtctccgtgcacacaatattttctctagaaatttctaggttccgtttcttgtaatctcacatccattaattccataaatccccaattgtccatatatactagcaacagaaagttcagacttttgtttcagaaaaggccataaagttactcattttaatttctccagggaaagaaaaagtaacaaagctctaacttcccgtgtcaaatatgtgcaccaatacccacagattatacaagacatgattagcaccggtaaaaagtgggcattgacacgtccaaatgcacgagaagtttgtactttttttgttgctgttttgtttcgtctatgcaaaaaccaaaaataaaaaggaatttgtacaactgaaatgatgatgaaccacaagaaaagaaaaacattggtgtggtccccacgtaattagcaaaaaaaaaagaaggaaaaaaaacaaaggctttgtggctatttaagccgcttcttctcctccatttctccatccatccatccatgtcgtgttgttagcttcgttttcttcttgtttcatcaatccaaggagtgtggaaggccacacgccaagattatatctatgctaatttgattagcagtaggattaattcagtggctagcgtagcttgattagttggtttaattagttggagagtaaagaagatgttgggagtgttcagcggcgacgtggtggaggtgccggcggagctggtggccgccggcagccggacgccgtcgccgaagacgcgggcgtcggagctggtcagccgcttcctcggcggcgccgagccggccgtgtccgtgcagctcggcgacctcggccacctcgcctactcccatgccaaccaagccctcctccgcccaaggtactaatcatcctgttcctctgaataatacagcttttgattaattgtagctgaatttgcttaagttctactgttcttcaccatggatttctcaagatctaaccaaggacagaatcagtgattgctttcatgtgttcttcctgagtcagagtcatttactatatgcttttactctttggttagtgaagtcttctttagctagtgatgatcaactgatcatgtcataatagctctcaatattttattttattttaaaggggactcccaaatcccaagatccgagtgtctgactaaatcagagaaaaaatagtttcttatcgtaacactttgctgattgtttcgaagggaaaaaaatcacggggttggtaaaacatatgcttagaatgagcgggtgtttgggatgtggtacccatctggggaaaaaaatgatttcatctcaagtaattcagtaacttaaacaggcttttaccacaaaaaaaaacacaaaatggtttttttttctgggtacggcacacatcttgagtcaataattgggcagtttttctcctcatataaaggcaggtttgctttcgtaagacaaactgaacaataaatacaactccataatccatttctgtaggttgaggggccaagctaccaaacctcatattcagttcatagattctcatccgaattatgggtcgcatgtctgagatgataattacatgattaactatggtatagatttgtttgtttcagaagtagaatgctaaacaaagaagaatatgcagagattttttgagaactaaatgcacaaaagtaactatcaaaaatagtagttttgccttggtgctacgatatctgaatctttcttgccatggcactccggtaactaggactctcttgccacgtgttacggtatcctggcatcaaatggttggtgccttggtataaaaaacgagagcagaagaagacatgaaagaaaaaatataatcaaaatgtctatgtcgatgtggacatcatcacatatcaatggaagaagtccacatcatgccaccttccacaaacaaggtgttaattgacctaacaacgaacaagaacttatattcttcactaggaatctaatggtatttcaatgtattagatatagtttaagaaaagggataggccaggatgatctatttccaagtctttcaaaagaaaaaggagacaagatagtgttggttgttggacaacttactaggttgcttatgaaaacctctcttgatttatgcatttacctggtattattgtgctgttcacatggcccagttcatagtagagggcactaactttgcaatcagttgctaataccagaagtctatccagttttgatacccacagatctgaaaggaaaaggctggactaggtgacccatatggtcaatcaatccaccactatgatttgtgggcctggttactctttgttcatatcttatctagtactagacagattcagtgaagaagtagcatccaaggaattccactccattgctccaatttttccagtacaagcatctttgtccttattgtaactagtagtagtacaatcttcaatgtagtacaattcaatgttaggtacatcttacccagatcaaatcattgatgttgcacctaattcttttcactctccaattattcttaaagagtagaaatgctgagcactaatcaagcatactaatgctgttcctgaatgccaatatatgttcttttctcctatgttactattaagatgcatgcatcataatacagtagttatgtccttttcctttctgtaaaaacctttattcctcttaatacaaagatacacaaatcttttgcctattcctgaaaaacagtagctggttgagtaacatatgcagctgtcttgatttgtgcaggtcatttgcagcaaaagatgacatcttctgcctgttcgagggagtcctggacaatcttggcaacctgaaccagcagtatggtctgtccaagggtgccaatgaggtgctccttgtgatcgaggcgtacaagacgctgagagacagagcaccttaccctgctagcttcatgctctcgcagctcgccggcagctacgcctttgtgctcttcgacaagtccacctccaccctccttgtggcctctgtaagttttgttcatcactgaatgctgttgctgcatcacttcacttgcattgtcagtgcctgaagatttggttgattttggttacagattatgacgtgttcttgtgctgtgatttgctttttcaggatccggagggaaaggtgtctctgtattgggggattactgctgatggatctgttgccttctctgacaacattgacctgcttaaaggatcgtgtggcaagtctcttgcacctttcccacaaggtaatgtttaaactttgaacagtaatgcagcgacgaaagatgaagcatttactataaaatttgatctctaactattgatttagttaggcacaattgaccttttctttgtttctgttcactaattcatttcggttgcaggctgcttctattccaatgctcttggagttggaggcttgaagtgctatgagaacccaaagcacaaggtgaccgcagttcctgccaaagaagaagaaatttgcggtgcaaccttcaaggtaaaaaaataataataataattgatggcaacctaaatacttaactgaatacattgtaaccgactgatgtcaaatggtgttttcaaccctttcttgggtcgatgtgcatctcttctttatcaatgaaatgaggcagagcttctgcctttgttcaaaaaaaaaaaacattgtaactgactattttctcctgcatttcgtctgaactcaatagacatttttgggtgcactgttaattaacacttttgatttgatatatgcaggtggaaggatctacaatcctcacagcgctgcattaggagatttttggatctccagctgttgttgggaaaggaaaactctgtagtctgtaaatggtggtgtaacatagtcgcaaggcatgcatctgatctgtatcatcatcttccgtaaagactagtgctgccagcatggttagcacttttcagtgtttgggtgtgtgtatgatctgtatcctatgctgttcaggcggaaatgaacttcaggcccagctgtgtcagttgaatgtagttgtgttgcaaataagtttttcttgtttgttatcactgtgattgtgtcttatgcagttatgcttgttgccggatactattcataccacaaccttaaccactcctattttaacaaaaatattttaaatgtttaaaaatgtattatattattgaaatatgttacatgctaaaaattttctttacataatgatatgatctagtagtaccacctaggaataatatgatcttaccatagccatgtaagtacaccaaaccagatttacttccatattgggcattcaaacaacaagtaatttatggtttccagattccggaaacatagctggtagaaataattatttgaccatcccctaagttgcaaacgatctattgtccatacccgattttgtagcgcaagccaactaaatatctgcattttgctagaacccacgccttccaaatcaactctgcggatggcgacgctatcattccgttgaattgaaactgataagcggattttgtgctatacttcccattggctgtccttttctaaaccatagagttctctactacatctgtcaattctaaagattcatgcgttcgagcccctcatacttgaaagaactctctgagttaaggttgtgacatatgtcatttacccaccttcttgttgcaagggctcctggattgtgtggtcttcctcttggtgcttctgtagaggtctggagctaagttttgaggctttgaacactaatccaatttgatttccaaagatcgcttttcactcatcactatccagtactttggtcgatgctgcaaacaaatttcgaaaaattataggtcaggttgacacgagaactgggccagctcttagtcggcacagaagctttttgggccgcagaaatattttcgtgggcctgattcgccgatcaaagcctagcagaaatttggttgggctggtatatatggaccgctacatccaaattcatgtgagccaacatggcccgcaccttccatcaggcccatactggaataaaacccaagtgaaacaatgggcttttctcaaccagccaaactcgggggaggaggctatgtgggctgtaaggtggccggacagtggacgaatcgggctttaatttgtcaaatgtcgttcatgcaaataggctacagcccttacatgcttccacaccaaaaagaaaaaagaaaaaaagagagagaaaatttagagggagagacattcctccaaacaatttttaacaagaaaaattgtaaacgtgttagagattgaatatgagacttcgatattgaaaccacacatctcttgtcaccaggctttactaaatcatttgggatggggttactaccacctcacgatttgatggttaccgtgctaaccgcgcaattactatgaaaaccgcacggttaacgcgatgtataccgtgattttaaaaactaaaaaggttaccgtacgtgacaaccacgataactatacggttttgtaaaccttacatgtcaccgtactatcatgcttccacgctttctgatgttcgaaaggagcaaaaattttcttcattttctaaacaaaggcagaacccatgcttcattttatattggtaaagaagaaatacacacgaacacagaaagcgttcacgccgaaaacacaccatcggaacttcggaagaagcagaaatttcacccctgaattggagtagtactcttattgatcaaacaaacagagaaaatcgaacgtgagaatggattaccggaaatactagcaaaagctgcgacgaaattttcggtgaatgaaagaaatgatgttcttgatcgacccagctgggctgaatgctcaagtagccgaagatcgtcagcgaaatgggtcgacaccattgtgcacttgcctgcaggttccaatgttcagtaggcctccaaaatatctagccttttgatattctgatctctgaataataccatccccgctttctgacgtctattcaccaccatcagaaatttcctttttgaaagatccagattagtataaatcctctccttgtcttgaaagatccggatcagaaaattctcttttcagttcattattccatacctgccgaatctcaaatctgtgcttagattcagcgtaaatttttttaccgtgtaaaatcggatatacggacacacatttaaagtattaaacatagtctaataaaaacaaattaccgattccaccgatagatatttactacgagatgaatttattaagcttaattaatccggcattagcaaatatttaatgtagcaccacattgttaaatcatggagcaattaggcttaaaaaattcatctcgcaaattagtcgtaatctgtgcaattagttattttcttaacgtatatttaatactccatgcaggtattcaaacgttcgatgttacaaggtgaaagtttttgcggtgggatctaaacagggtctaataccgaatgctctttttggttttgttatttcacttaagatagatttttttttactcctatcattttaattttcatatgtataatcttacatcaagattcgttttcatgtagattcaacttacaattagacttaattataaagcacttacactcaattacaatatatcgaaattagattttatgactgttttttctctgaatttacgatttttaacatgtttttttattcattcaaaacgaattttatctattaattaaaaattgaataagatttaaacccctgaatctatcagaagattaatagatagtcccacgttcttttcctttcgaccgagtttagttacaaaatttttcttcaaactttcaacttttccatcacatcgaaatatttctacacacacaaacttctaactttttcgtcatatcatcctaattttaaccaaatttttaatgcggtgacgagttacagcgcattattacaacgccgtaaaaactgacatgtaaaacgggcaattgtggaggttgaaggtactgtggggcagggcagcagcaaaatggcatgtgcgggggccacccgaggcagcagatgccatgtgacccctgtcgcctcctctcctccatcaagctcagccgttccagcagccaaaaatttccatgctttctcacgagctcatcagagagcagctctctctactgatcaagcaaccgattctgatgcacggtaaactcgtttctatccgacggtaatatttcggctgtcaaaatgcaaactgcagctcccatcgatcaatcttcttaagaaattcttcagtttaatttacgcgtaattttatcattcttaacacttagtaagtatatagaagtaatatacaattttctaatgtaaaatttggtatctttaacattaaaatttgaagtgtaaactttagctacctaaagatttcttaagaaattcttacgtttaatttataggtaattttatcatctttggtaagcatataaaggtaatatattatttagcgtaagatttggtatctcaagatactttattagtatcctcaagtatcaaaattctggtgtaaactttatctaccacaagatatgctccaaccgtaaaatttctcttactttacataccgatgatgtttgtgttctgcttctaaactattgtatgatcatatatggaaggagagctggtgaataataattaaaccagttactagctagctaaactgaagacaaaacaaaagggaaaagatcattgcgtgcaggaaggttcggattattctagcagagtgctctttttactctaaagcagcagtagtagttagttaaagacagccttttctttttctccttctagatcgtgagaatgtgatcagatatattcatatacgtagacatcactttgcaaagtgcagtagcttaaagtatgctaattaagcggcagcatggaggcataatttgctcgatcagtgataggctgatagcacgtgatcgatgctagtcgccatgatttctggtgagttgattactccacactaatactgctgctcaatagtggtttgttcaggctgattgtactgagtacgtactctctctgtttaaaacaaaatcaatctagataaaacgtaggaaaatgaattataaggttatctaaatttattgtgtattgttacatccaaacctactcatgtaggttaatttttttagatagagggaatagtctgttcatattgcttgtattagtagactatagtaagtactttcttttgtgtatagagtagggttctatgtcggctgtaagggttgggttttgagcaatcccggctgtacattctttcttgccctaacggtggccagtcacgcttagcgacggccggtccggtgctagccttctccagggtctgtgtgttggtgttgtcggtgcgtgggtggtggtataattttctttgttttcaggttacaactgaacgcgcaaagatgtagcctagaggggggagtgaataggctttcctgaaattcacaaacaaatcgcagcggtaaaattcagcaggaccaaaacttccgggtgtggaataccggaacttccagtctgctcagattgtccggaacttccgagcaaagaaaaacctgaagatctagcagagacttaaactaatttgcatgaattaaactacaggaagacagagcagatacacaatcacagcagcatgcacagaatcatcacagagaagacaaggggaattttttcccgaagttcggatctttcaattctactctccgttgagatgctccaaagagccgggtctcgattaaccccctgcctcacctgtgcaaagaacccagaagaagtccaaggccttaaacaaaacactcctaggtcattttctagaatttgaatgaccaccaagatccaactcacaaatacttctagaaaataccacaagtgcaagttgttctaccaaggagaacctctgaaatctttgcacaagaatctttactcacttacctcgtttccttgcggaggtgaggaaaaccttcaccaactttcccgggacatccacaagattttggaagctcgcgggcaacacctatccgtctaggagaagatcttcaagagtaataagcccaagtgacaacccacaagatatccaaagtactcaaccatacctagtcttcaaaccttctccaaatcactcctacactctcatctattctctcaatctcacaagaatggctttagatttgagtggaggaagcaaagggatcttgggagaggctagaacaacctaggggatgaaagaactgaagtggaatagccaaaaagtgagctgggtgcgatctggatatatataatggctaggtgacgtctagccgttactcacatttttgaactggaagaagtccggaagttcctgaccctcggaacttccggccaacacttaggcaagtttcattcaatgcaatgtcagggaccggaacttctggccagccttctctgtccggtctggacccatttgcaaaaatggctcccaaaaatattctatcactaagaatccactaagagcactttttatatctcagaaccacacttagaacccctcttaatagtacggttttttctaagactcaatttcaaaaattaaactatcctattgaccttcgagcttcaaatccgcataaaagaatgttgtagggggtctccaagcatctcttgatcacctaagatcaccttgggacactggtggagaaaccatctttacttccggttgggaacccccctttaatcccggttttccaaccgggagtaaggatccgggactaaagatgtccatctttagtcccggttgaaataaccgggactaaagatacatctttattccctaaagagagggatctttagtcccggttgatgttaccaaccaggactaaagagacaatagcggcagtgcagatggttcctttttctttttcttttttcatttttattttctcccgaatcaagtaggcaaatccctaaatcaatccccaaatctaactaacatcccaaattcacatcaccaaatccacatcacaatcataaagttacttatacacacaaatcaaatacatcacaatatcctaagaaattactcaaatacatcacacatccaaacaatgaatcacaaatttctaacttctcagtcaaatacatcacagtgaatcatcacaaattaaaaaaaaagaagctgctgccgccgccggtcgccacgaacgacgagcgcggccccgctgcccgccggccaccgcggccgcggccccgccacccgccacggccgccggcgcccgaagccccgccgcccgccgccgcgcgctgcgccgccgccctccgccgggcgccgccgcccgccgtagcgcgcggccccgccgccggccacccaccgcggtcgtcgccctccgccggacgcgaccccgacgggcgccgccccg

SEQ ID NO: 72122 - DNA, 45874 bp, Oryza sativa
tcaaatatgcatcataatatattaaaaacgagccttttttcttcgttttttcaaaagtttcttttcacatacgtatatttatgtgttaggctaagaattttttgggtgatccgcccatgacaatatgtttattggaactgacgaatcgatattaaaatttatgacggtctcacttaaaaacacatataaacatgtcccgatttacatacgcaattgtatctttttccattgcaaacatgccggcatttctactatcacatattacaaatggtttaggagagaatttttagaagatgccattcgatttgctgcaccaccttcaggatgtgccactcaattcgcaacactttcaaaacatgccaccaaggacgtgaattgtttcattccgtgccgctctgtccctcccaagccgtgtgtcgtcatcttgctgccgccagcaagcttttccttgccatgccggcaagagctcctgtagtcggccgcactaagcttcgtcggcgatgtgccatcaaccaccaaggtgtctggacactacttccaccagctccgccatgattactccttcgttgacattgcggactctgccatagaacgacgcccgcttccacggtcttttcctcccgtatcaacacacgggtatttttctagtctttaattatatataagtagtggtgttggcaaataatagaaggagatgcgcctcaacatttgtagaaatgagttgacaattaaggggagcaaagatagataagagagagagagagagagagacgcgatgcatactagcatatgctctccgcgcaaaatctaaaactcatggtaactctgtccatgcattgacatggagggattaggattaggatgcattaggaaacacgcaagaatagtgaaagtgatgacaacccaagctcgtgtatcagtattatctcacagatacataccatgctgtaaaccactccactacataccatggtgagggatcatactatcagataacactcgttactttggcatgctagatcaggatgttcagtagctcccagaagtcagcagcaaaagaggcattatcatgtgtttctatcttctctgcttttctgcttttggaacctctcgaaccaccgtcatggtgtggtttccagaaatgaaccactatcattacatcgccttttggtgaagtgtataaggatgctactctgggctgaacgacttcgagaatagacttgtaatttcagcttggaaggatctcctcttttcctcctttcgttctctaaatctgtaacgatcttgtaatgatcttgtacttctaggcacccttttatcaatgaaatacaggtggggaaactctcccctcctaatgacatattctaaaaaaaatgttagatcaggatactaagtcttccttttaggattatcatagcaaaactaaactatattagctgagttgatatgtatcgtgaggtacggaccattctggatagctatcaaaatgtgccttactaattgatcctctactcaataatgtttggctaaattttggattgaagccaattcttttatcaaatcaatattgatgtcctacgaaattattgataataccaataaatataattggatagtaaagaaccaaaatgaccattttattgaactgaataaactttaaagtcattgaaagtttctccatacctcattgttctagaaatattgcataacataacacctccccgttaacactaataatgcatttacctttcaagacggtagaaacctccaattaattttagaatgaatgggcacattatgggtggttgaatcctaacgccaacgtcattggcccccaacaagtgtaataaatgatatttctattaagctacatcatcacctccattattatttttaacctagcatgattaatctacaactaaatcattttccttctcatttcacattatcacactgtcacgggcttgggccctaagtgggctggccatgaagacccaccaggctggaaggttaacctgctactccctccatccctaaatgtttgacgccgttgaccattttaaatatatttgaccgttcgttgtcagggttatgtatactacatacctaatagtagttgactaaatctcggcaggacgcaccacataccatgtcctatatagaaacaatctgcggatataggaggagttccggataaggaaagacaaccagagttctacatgaaaacgacaaggactactcggattgtatccatattggtttccctagttctacttggacaaggggacacctatgggtataaatacaagcccccctaggaggacagggggacaaccatgatgagacgatcaacacgatcaacacccaccatgacgagacaatcaacacccaacacaatcgacatagaagccacaacatacaagccaacatactccaagacaagacgccggatatcgacttcagggataggcatggctattcccctacggtgtctccggataccgtcaggagagacgaaagcgctatctctgatctcgccgggcacagattcgaggaggaaggctaccctgttgtcgattacgagtcagatcttcagaccgacatgtcgataacagttagataggctaccccacatattgtattggtgtgattatggtgaataaaagcaactccggctccggccaacaggatgtagggttattacctgacagctcaggggcccgaacctgtataaaaatcctcgtctccatctcttttacctcagtcttgtgtatatcctagcaccaacgttccccatactgtccaaataccatagtcgagacatcaaacgtcgacagtggcgcgccaggtagggggattttggtgctctaggatttcaacgagatgggttcaaaagacagattctccgacaacaagctactcgacgacttcgctgtggggagatctaacccgaccagagtatgtctctcgacgagatcggaaccatcgtcgtcaacaactcgatctctcgagatcgaccaaacttcaagacgtcaccgccacagagaacagtgacttgatattatcaactaggaggtctccgatctccatctcttcggaagcgacatcatcaactgatttttggtaacctcggtaatgctgctgcctgctcagaaacccggccatcgaggaaccaaaatcaacatctcgatctattcactggattcttttgggatttggatcgttctcacaccccgattaggatccaaattttggacccctgacgcatactgagaacatccatcccgacatcatgtgttccagggattattgatcacggatgtctaccaaggtatcgagaaaacaacaagacaaagatccaactaatatgcttgctcctgacgtgtacacatgcatatgcatggactcagtacgtgcttaggcatgcatgcattagttggccgacgtgtacctgcaaagaagaccaacatggctgtctaaattgcaacgtgttgattattcagataaatcaacggccgcccgtgatcaggtatttagtagattgattttttaaaaatggtctactaatttcgtagatacatccggcatgtatctacaaaggtacgcaatattttatatgcaatttatcgtacctattcagatgatacagcattgtcagatctataatttattacgtttacctagagcatgttttttatacaatatctattgcgcggatgtttccgacgttaaaccaactacggtctaacgctgggggctcactctgttttcttctgtataaatcatgcttgttcacggtttacataatgcttaatatttgcatctgcttgttgtatcctgataatactagaagatccatgcagttttttgagtacatactcgatattatctgctatatatcttgccttctaaaaaatatttttcaggaacaattgagcactcgagtaggttatggtcgagtacactccattatcgagaacattttcgacaaatgcggagttatcgcacccaacctaccaacaaagaccgacgacctatctcatagcatctgccatggctagactactcgagaaaaggttgttaacggataattcctcgcgaacgtcgtcggcctgatcacccgacatgattgcgaacggacatccggatatgctataagttgggtacgtgagtcatactagccacatgagatacacttgcaataaaccaactctagcacttccattggtgttcgagagataattctgctcgctcactggttctcgcaccagtacgcagcaatctctcacaccgcagcgtccattggtgttcgagagataattccgctcgctcactggttctcgcaccagtacgcagcaatctctcacaccgcagcgtccattggtgttcgagagataattctgctcgcacactggttctcgcaccagtacgtagcaatctctcgcaccgcaacttccattggtgttcgagagataattctgctcgcacactggttctcgcaccagtacctagcaatctctcgcaccgcaacttccattggtgttcgagagataattctgctcgctcactggttctcgcaccagtacatagcaatctctcgcaccgcaactaccattggtgttcgagagataattctgctcgcacactagttctcgcaccagtacgtagcaatctctcgcaccgcagcatccattggtgttcgagagataattccgctcgctcactggttctcgcaccagtacgcagcaatctctcacaccgcaacttccattggtgttcgagagataattctgctcgctcactggttctcgcaccagtacgtagcaatctctcgcaccttaacttcagatggtcaaggtacgactacagcagcgtagcggtcctcgtaccacgactccatgtgatcaagggattcctactcaccggttctcaaccagttgatcgtagtgatctctcgtacatttgcttcaagtggtcgagttacgactactgactggttctcgaccagcggtatagcgtttctcctactatttccacttctagtggtcgagttacgactactgcctggttctcgaccagcggtgtagcgtttctcccactatttccacttctagtggtcgagttacgactattgcctggtcctcgaccagcgatgtagcgtttctcccactatttccactttaggtggtcgagttacgactactgcctggttctcgaccagcgatgtagcgtttctcccactatttccactttaggtggtcgagttacgactactgcctggttctcgaccagcgatgtagcgtttctcccactatttccactttaagtggtcgagttacgactactgcctggttcttgaccagcggtgtagcatttctcccactatttccacttctagtggtcgagttacgactactgcctggtcctcgaccagcgatgtagcgtttctcccactatttccacttgaagttgtcaagttacgactactgctggtcctcgaccagtgatgtagcgtttctcccactacttccactttaagtggtcgagttacgactactgactggtcctcgaccagcgatgtagcgattctcccattacctctacttcaacaaagttggcagcaggtacacaatatcgccaagtgttttacccagagatcccttatcacacgacacctagcgttgaaacctatcgtactgtccctttacgccgtcttgacaaggcctccgaggaacctaagggatcttcggctggggacgcccagagccgataaggccttgtcggatcctgtagagacgaaagaccatgtaagatctggtcgtgtaacagttctcgccctgcgtattaaccaagccgtgtaatcggaaattgagttttccaacttcatggctgggggctaggatcagtgcttattcaaccaaggcaggtcaagggtccaagagccttatcctccgagaatgattctccgacgacaaggctgggggctagggacagtatatgactctacaaactgactgatcgaagtcggtaagagagaagacgctcatacacaaaacattggttggtaaatttaattcattttcaatttaccatacatattataacatgtcaccctttgagcattcgctcgggggctatttctatctaatattcttttctgagtattgatttcaggaaaattctattcgacattatcgaagatcgcatgtctctatggttctacaccaagatcgactaaggcgagtacgacaaatgtcgacaaagttccgtcgcggactctatgccttctcgatcgctcgagaacggttgctagatctcgacaaggaatacggaatgaagagatggtgtacccgccgagataaaatttcttgacttcaatccaaattctcgattacagcaagacgggagacttagtcgtacgctctgtactttctcggtcgacatcagagattgacttagacaaactctttcggtgcccgcacgaggctgacaaaggaagtccaacgttctctctaaactcaccgagaactgtcacatgagctcgataatagttactccaatgtctgcgcagttgagaatatgaattcattcatttgcatcgaagtcgggggctactgtcagggttatgtataccacatacctaatagtagttgactaaatctcggcaggacccaccacataccatgtcctatatggaaacaacctgcggatataggaggagttccggataaggaaagacaaccagagttctacatggaaacgacaaggactactcggattgtatccatattggtttccctagttctacttggacaaggggacacctatgggtataaatacaagcccccctaggaggacagggggacaaccatgatgagacgatcaacacgatcaacacccaccatgacgagacaatcaacacccaacacaatcgacatagaagccacaacatacaagccaacatactccaagacaagacgccggatatcgacttcagggataggcatggctattcccctacggtgtctccggataccgtcaggagagacgaaagcgctatctctgatctcgccgggcacggattcgaggaggaaggctaccctgttgtcgactacgagtcagatcttcagaccgagatgtcgacaacagttagataggctaccccacatattgtattggtgtgattatggtgaataaaagcaactccggctccagccaacaggatgtagggttatgtcacgcccggaatttctatccaaaattccaaacgcttacatgtgtgtgaaccctcgtccagaaatcagccgaggcacacaataacaaattgataatagagtacaattattactctaattaataagcgaataaaatgtcattacagaggtagatagttcatctcaatcaataaagatctaagcagcggaaaaaaaaagataaacggcgcagacgactccactccacaggtagcttgaccagggctacacctaatcctccacaccatcaacatcactgtagaactcttcctctgatgaatgattgcaaggtgagtatatgacatactcagcaagccacgcagcaaatatgcaagtgcacaggataacaaaggatggcacagtggggtttcatttgcataaacagcatttaataaacatttcagaatttaataaaacagttaagtaataattaaacaatattaatccaacactatacaacataccctgttgcataggcccaaccattctgaacaaccatcccggctgcacagttctatctccaaaccaagaatataccgttccaaaccaggagctaatcaaattattaccagttatagcatcttttattatgatgagaagtgtgagactaatcacgaaagacattgttagacccgcccataaccgcgggcacggcttttcgaatagttttactctggccagaggtgtaccactgtactcacaagacacagccccacaacatgtcactatgtgccttaataccaccacggtacctcggaaaggagctatgacagtacccctcgcacaacacgatccaccacagcgcacctttcctggatcataatcaatcaccccttataaacaaggcatggactccccagtgacccccgtgggcttatctccgccacttctcagtctggtgctccgcaatgaaccatgctatacaaaaggtaaagccgttgcccacgctggcttgtggttggcacggttaatgtttcacaaccaaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaagtaatagtgaatcataagttatcccaatagtgtgctaatgtttctaagcatggctaagcaatcatatctaatatctagctgaaccaatatataaagctcaactagtcaagttataataacccaaggtatcaaggaataaagtaatcaagaacaaaagggctataacaaacaataggttaattccacccaatgacattcgaaaataaatgcaattgttgaatagaaacaatagctttaaacgggatcaacatgctcaaagggttctttgggatctgtgtgacttgccttgctggccttggaactcttcaaaatcttctcctgcaaaaatggactctccggaaacgtcggaatctaaacagaaaggagcaaaatcaccaaaacagcacataaacaagcatgaacagtacatgtggatatttttaacatgtagatctcaattttagaaaaatttagagacttgaaccaactaaatccgagctaagatgaattagttatgaatttttaaagattaaatcggattaaatcacttatatggattttaattgaattatgacgcaataatgaattattttttaaaaggaaaagggaattattgcgtcagcggctagggttcgcggtgaaccgggtgcacggcggcggctcacgaaaacgaacggctgagatctttccatccaaaacgaacggccgagatcgaccggtccacagccggaccacggaagacgacgacgatgacgtcagcggtgacatcaccaccggcggcggctcgggtgcgcaaactcgtcggcgaacgacggcgcgacgacgcgaacggaggacaccaacacgtagagggcgacgcggcgaactcaccggtgaccaaaacaatggcggaagatcaacggacggcgacggcgtcgaggaagaagcggcggcaaccttcggcttgacgacgacggcggagaggtggacgagatcggcgacggcttggtgaccacgacggcgacctccccgagcagcgacgacgaccggagcgacggcggcgcacggctggagctgcggcggcgacagcggcgctaggctacacgatgctagggctctaccggcgacgagaggcgaatgcgagggtggcggcgggtagcggcgggcttgggggtccttttataggagcaaggaggcggcggcgaaggcccacggcgaccggcgacatgaaggaaagtctagggttcggaggagagagatcgatccgaatcgaactcgaatccacgatttccaaacgattttagccgacgattccaaaagagaaaggtagaggagatcccgaagatcatttcccctctattgatttcaccggagaaggaaaggcgtgagcgaatttggaaggagacggcggcgcggctcagctagggttccggccgggcgacgacgcgaggaggacgacgagtccgacaggtgggccccacctgtcagcgggcggacgcgcgcgcgcgagcgggcggctcgactgcgggccggattgggccaggagagagagaaaaggttttgggccgactttcggcccaaagccaaaagaggatttttaaaaccttttacaatttaaattattcattaaatgtaattccatttattaaaaatacttccttagctcaaataaatctcagaaaaatctaggaattatagagttaagcaaagtatttaatgaaattttatctggccccattttatattggaatttattaattaaaattagatcttctcttctaggctttttaaaataaattccaattaaacaacaatttatatatttaggatttttagggtgtgacaggttattacctgacagctcaggggcccgaacctatataaaaatcctcgtctccatctcttttacttcagtctcgtgtatatcctagcaccaacgatccccatactgttcaaataccgtagttgagacatcaaacgtcgacattcgtcttattcaaaaaatttaagtaattattaattctttttctataatttgattcattgttaaatatacttttatgtatacatatagttttacatatttcataaaagtttttgaataagacgaatggtcaaacatgttttaaaaagtcaacggcgtcaaacatttggacaataagggagtataaacgaacagggagacatggcaaaaggcatcgatgaactgaaccaaggaacgagcctctccttctccctggatgcttcctcttcccaaaatccttttctctgaatcccaacctagctatttttccctgtctaattcttctcccagtctacgaacctgtatctcccttcaccacttggtatcttgtgcgatgaatgaaggattaaccctgagttatgctccaacatatcatagaaattaacccgctgattgagaggagcgaagatatcctgttctaataaatgaaattgacgctggttgatttgttaaaaaaacaaaaatacagaggagggaagagagctaattaaagatagggttaattggatccatgccactacaaatataccaaattagaaaaatgtcactacatttcacgatatcagctgagtgccactcgaatttggggaaattggaaccgtgccactccgttgggttttccatccactccctgttaatttcccaactccgacactcggcctcgatgcggcggcgaaggagctcggcgacggtgccatttcccaactccaatggcgagaagagttttggcaatggcggagttcctgcccctctttctcctcatgaactcgtcgtacttcctctttgcttcctcttcttggttccgtccacgtaggtgctgtggaagctgtgcccgcatgccgggagcacgccgccgtccgccagctctgacaggcagatggcacactccacctcggcccacccgccgaccatcgggactccgaacgccgcgccgaccgccctgacctatcggtgttggcgtcgtcgtcggacgccggcctaggtggctgtggttgcgcccactccccggagtcgcgccaacgggcgaggcagcggatgaggcaccgcgcggcggcgtggaggtagaaggcgaggagggagacgcgggcgaagatgatgaggatggtggccacgttggagaagaatgcacgcatcgacagtgaagtgtgaggtgaggaaccacgaggacgacatattgttaacgaccaaatttggtaatatcagcatcggaagaggagactagatcgaggtggagtcgaaggcggagattgattcgagaacagagcaagaatcgactgaagtccatatcggctacgattaggatcggatgggtctaagtcggactaggtaagccgatgcagccgattccgacagtataatttggtgtatgacatcgggttgaattgaggtgcttcaagatgattgccgcacatggatagagtcctgagaaggcaattgtatctattaattaggatgttttatgtaacttccttagagatatgtttgggcaaaagtctaccgcaaagacttatggtatcttagagtgtgttagagatagtggtcgtgtccggtatggacatatcttgtaattcttgggtataaatagaccccgagccctatgtaatttttaacacacacgttcaatacaatttcggcgcatcgccacctttttgctttagttttgttttcgacgagttcttactttcgggttgagctgcatcggttttgatcttcaacaagaggtaaaacttgttatgacgacttgtgttctcgagattagtgcttccatctttatgacactctaatcttgcctatataattcgtcgagttattatatatcttacattagctttggcaatatcgtcatctaacctacaatcggctgacatctgttaatagaaggcagccgattaggttaaatagcgatgttgtcctagattatataaaatatctaccactttatgaaacatccagcgtcttgattgtctagatattgttcttcttttcatacttaatgttgcatcagttgagtttgatctattaagtcgtgcttagaatatcaatctctagcatgtcctctggttgccgattagggtagtatcggagtttcagccgatcttatctgatttaaccatattcgatctatgtgcctaagtgacatgttaaatccgccctttatgtcaagatcttactgcatttaagtatattaagcttttgtttggtatattatacttgttttgatatctttatgtagagtagtatcggagtattagccgatacatgctagatctatctgatcggctatgctataaacatatataatcatgttattaatatatatttcgatctaagtgatttatactgtctcggcatggtgaccgatctatcccaatcacttgatttaagtatatattaatataagaactatatatcgttaatatctacagccgatcgaatagatttagttccttactgtctatttataaccgccgatcgattcatatatgacatcggctcaaagataaatgatatgtcatcggcacctagccgatcggctattatttatagatttaaccacgaattctttgtctctatttcttgttgattacaggatcaaatcaactggcacgctcatacattcgaaggtgagctttggacctgcactggagttaagcagatctcccaggcctcgtgttttctgtcaacacatatggaggtcttgacgacacgggagacgacgaccgcgcccctatggtagaaatctacggcagagacgagctccccaggtagcaacacccttccctgccgctgatcatctccgtcgagtggagcagcggtggcggcagcagcggcgacgtccatgcacgggaaagagaaggcgtcgacgaagttggcactgtggacagggagtggatggaaaacgcgaaggagtggcatggatctaatttcccaaaattccagtggcacccagccgatatcgcgaatagtggtggcatttttctaatttggtatatttgtagtggcatgaatccaattagggatacatatacacacatgtgtgcacaacttcacctcagattttacaagcctcataaaacccaaaccttatggcaactttggccatgtaaattgttggattgggatgcactaggaaaatacaacaatgctgaggtgatctcctacctcgtcgtctcatagtcagggttagaaattttggaccaaaatttcggaaattttggtcatttcggtgacccccgatatgatattaattcggctgaaatttttgaatttttcaattttttcatgaatttggataatatttgttcaaattcaactaaattttgtttaaaattttagaaattttgaaccgaaatttctgaaatttcaggatttcggtgaccccaatagaaacccctaaaccgatagagtgaaccctgctcgtagttaggctagcaccttgttttcggccggtgacaaacaagaaagtatcatccacggacaattggcgtgagactacagctgtgttccgacttccggcacgtcggaattacaatcgaaaagctctccacacaatcaacaattgcactcttttttttttagaactcatgattttatttaaggctaatagcacgttatatgatgagttgatacaacttccatagagtaagaggagagcaagcccaaaaaagagaagctgacaagtatgcccacaagcatacgggctggtaaacatacagcacatattgcaaaagaactcctaaaagatagaaaaatgcaaaagggcctagaaaaaagcaaaggacttctaaagataaggaaaaaaaaaagcgatctggtccttgcgctgcttcttcctctaatctggtgaccaggacaacgaaaccgacatcaacaacgacggcgaaagcaagggagactgtaaaatagagctccaagccgtaaaaccatacggggctttcaccacacaaggcggaagttgacgcacgacaaaaagaataggaagaatacagtcgcacattgaagaacgtcgacagcaatgaaatggctcaccacattagtagcaactttgccggagttggttagaatggctggcatcaccttcaacagaaacaccaacctgcttgccggagaagcagacttattgcccttcaagcagcgaacaacgtgagagcaaacctggaagccacccaaaagcaggcaacaactaaggagatcttcagcagcaccttccatagaggaccaccggaacaagggagctcgacgccggtgaatcccttgcactacacacaaaaggaaaacggaatgaaccctacacggaatatatccgaccatcctatcgcctaagggtaaggaggccaacccctctccctaccctcatcagcggcgaaccaccggatcggaggaggaggaaaaggggtcaagaagaaagaggaaaaactctcaatggatctcagagtatcgcgagagggatagagaaagtcccgccccagctgatggcttcttctactgctctactacaagtgaactcgtatatcgtatcccatgtcatggatggagccctatcccagtcatggatggagaaccaaggagatataattagaacaggtagcagctaatcataggagaagtcatttggtcctccggcgtaatcttctactccttacattccaaaatataataacatagaactggatgtctcatctaataccaaattattatattttagattggagatagtaggaaatatcaacaaatatgctggttgtgtttgagattgattaaaaagaagatgaagtcacagcaagcaaaacgagaaagacattagcatatgattaattgagttttaattattacaaactaaaaaatagatttatttgatattatatatatataaacaccgtttattagttttaaaatcatgctaacaacaaccgagaataaatctatttctgagcggttacgtgtttgtaacttgaaagactaagctcggaatatgaatcgttatcattgttaacaatgatagagaaagactacacaacggtataccgttgaacagtataccacttatccctcatgccgcggccccgcgtgccggcttctcccgagtatgtcgtgtgctgctagaattatcatcacgcaggtttgttgtgtgtatcagtgtatagtcttgttcctgacagctagctagtacccagcatgcctaagtcatgcctttgatactagcctagctagtaaataaaactggaggtactactagcttgttgtgcatgccaaatccctgtaatagctacctacgttacctagatacggggatacggatatggatacacgatacgtcgatacgggatacggcattttccaaaaaaacaaggatacggggatacgcttttatatatatatatatatatatatatatatatatatatatatatatatatatatatatatatagtaaatttgtttggtgctccatggtgcccgggcaccattgttgaaattgagtatatacccaattcaaatgagtatgaaacttttttaattatttaggtattaacattaactacttttactaactagttcaaagcaagtttgaactgaatttgaacttatttttgttagattttgattctaggtatatagcatccatacatataattagttaggtatgtaatcatggattgtgaaataaagttaaatttgagttgttttgttgataggtataggtacgaatcaaattcttataactaggtatatactcacaattagaaaattttgaaaaatttgagtgattttgtgcatttgaaaccatggtgcccgggcaccatggtgccccatatgagtgtcctatatatatatatatatatatatatatatatatatatatatatatatatatatatatatatatatatatatatatatatatatatatacacaaaaaaaattaaggaaattgcatttatatataaaaaaaatacaaaaaatcaaggaacttttataaagaaatagcgatataatactagtatcagtgtagcagattccatatcaatattctgcaattttctcttctataagcaattcaaattaacaagcgattaagatcccaaaaaccacatattaatagttcaatcatatatttcttgatgactttgcatcaacattagaagccgcactaagcagtaacctctaggattgctagatgcactagcacttgtatctaataaaaacgatagtactttgtcctaaggaaaacaagaaaggcacagcagattcaagcatgaaacttttgaagataatggattacccggccaggcagtcaagcgaagaaagaaaaagttgctccgtgcttcgatgctactagcctgccactggccaccgctatgcccggcggccggcgtcggaggaagtgcctcacgcagtcacgcggcaagccggcaacagttctggcctcgaggttggcggcaaaagaggtgcgccaccaccaggctggcggcggcggctctgccgtctcgcgtaggggacgttgtggccccgcgcacggcagcgacgcgcgcggctgcagccggcgtccggcggcaacgccgggcacgcacgagaggcatcagccatcaggttggaagctcgtgaggtggcgcatccctgatgcgagcgaagacggaggaaggtcgtggcgtatcgctggcgtatcgtgatttatttatttttttggaaatcgcaaatatgtgggatacgtacgggatacgtatcggagcgtatccgatacgtatccgtatccgttgccgtatccgatacggatacgtgactatgcagccgtatcagggtaacccagatagctactagtagacctgtaccctagctatgtagggtacttattatggcggagcctagtagcctagctacgtgtctaagatgagttgcatctatttgttgtgtcctataccatgcacggattagaccagacaaataattacctagattatacatggatacaatggattattctaattagatatgtcatgttgggctcttagttataccacatcttagaaactctagtatgtgatacatagatgctagattatcatatctgatatctaggtattgggtcgaatacctaggtaccaggtatgaaacctataaatacaagatctgatgctgagttatccggcctgatacctataagtaccggatccgataactaggtatcgcgtctgatacctgagtactagattggatacccgggtatcgggtatctgatctcatacctatgagtatttgttccaatatctatgtgtaacgggtcggatacccaggtaccgagtatgatacttatgaataccaagtctgatacctaagtatcgggtctgatacctatgagtaccggattcgatacctaggtcaggtttgatacttatgagtatcggatccggtatcgcgcatgatacctatgagtatcggatcggatacccgggtatcgggcatctgatcttatacctatgagtatcagttccgatacctgtacgtactgggtcggatacccaggtaccgagtataatacttatgaataccaagtctgatacctaagtatcgggtctgatacctatgagtaccggattcgatacctaggtcaggtttgatacttatgagtatcggatccggtatcgcgcatgatacctatgagtatcagatcggatacccgggtatcgggtatatgatcttatacctatgagtatcagttccgatacctgtacgtactgggtcggatacccaggtaccgagtatgatacctatgaataccaagtctaatacctaggtattgggtctgatacctataagtaccggattcgatacctaggtcgggtttgatacctatgagtaacggatctaatacctagataccgggttgatacatattagtagaggatctgatactaaatatagggtgtgatggtacgagacttcagatgtgataccactaattctaatatttatgggttatatacttctattcaacaatcaaataaaaagatggaccatgcatagctaggccagaaagtacaaccaaacttgctcacatgccgctgacatgctttgtttaggctcatgctactagctctagtgcttaattctaactttactagttgaaccaggtgtcagacccatatggacctaaagaggtgtagaagtagtgctgtattagagtatttcatagctattttgtactgtaggagaaaagagacctctcgtcagtcatcactagtcggcagcctccatgtgaaaggacagcacacgacacgcttttagagagaaaaagaatcggtgagtgattggtaagtataaattataaactataccgttgagacagtacaccgtcccatagtttaatttggaatcaaaccggcccactaacatacgagaaagactggtacattggcccgcaaatatatgggccttttatctgttcatctaggcctacccaatctcggagtttttcacaaaaacccctgatattaactctagcaacatataggtcctgatcttttctaagaagccccccttttcagtccagatatttgcataaatatcccttattttaaccgttaacatcctcagcggtcaggattatagcataaaagcccttgatactgctctagagtcccccccccccccccacgacgccttcagcgacggcgtgcccatccgactccgacgacgttcttccgcctcgccgccgatgatccccgccggccagccatgtgtcctaccctacccacccaccagcagccgattgcacctgccactgccgtttcttccctcaactgtagagtggtcagcggagatggccggcagacggcaggggggcaaccttgcctggggaccgcgcctcgcgccgtgcttggagacgacggtcacgtggttggtcgccgtgatgaagcggcttctcgacttcaacccctgcgccccactggagtcccagcagtacacggggcaaggccccggtacattgttcacccctcgcacatgacttgtttgttgaattgcctgagtggaaatcttacgcttacctgacctgcgctatgtgtttctttgatgattgagttggtacatgtgttctcctatttcatcatactttgtttcaaacttatactccatcccattttgcaaatgagatatgatgatgacatgatgtacagatgaaagaacgagctataagctggactgctagagagctggatggagaaggtcaaagcgcacaacaaggaggagctcttgcgcaagcagagctctttgctgggcactgatggtaaaccggaacaaagtattctcgaggcaactatttgaactcattggaaaatttgtcaaccgtttttctcttgacaaacttcggccaacgaacgcatcgccagcccagcaaaaagaatgaactgtcaagcattctaaaatctaaagccaacactacctattgctttatatcttagggctggtttagttcccaactttttcttcaaactttcaacttttccatcacatcaaaacttttctacacacacaaacttccaactttttcgtcacatcattccaatttcaatcaaacctccaattttgacgtaaactaaacacatccttaatatggtggtagagatgctacagtcagtagggtatgaaagatttgattggaatgaaaggtttcttgaaaggttaaatgttagtcttctgtttttgcgtgcaaggtatacttaggatttcagcttattgaagaaccaaaacttcatcatgaaagcaatatttttttagctttgtaaatcctaattgtagcaacagaaaaatgcactctatacgagagtatagaagatatttgcttcaaaacaatcttgatcacatatgaattcattttatcttttaaagtcactgattccttagcttagtagcccgttcatacccaggctaagatttaaagtggattttagtgcagaacatactaacataagacagccccactgactatttgcatagatacacattgttgatgtgttcctgcgtatttctgcctactgcaatcctttgtttttctcaccgggccggcctacttccatctccacttgggcatgttcttttacattgctgatttatcactttatttttgtactttgattatagtgaacttcatgattgctggcgtacttttaccatcatgttctcccatacaacttagactgcgcagggtgcaatgctacgattgattttcttttttaccttttgaatttaattgtacaatgaattggatgaatgcccaaaaagcaattggaagttttctgcagccagtcttagttttagcacgattagatgtgagctcatgaaaatttcgtcttttgtgatctcaactgctcaaggttcttttgctgccttttctttggactcaactttgactaagttctttgagctactgatgggcattgatgtttttcttggtgcaggatacttgataatgtaacctaaaaaagcaggatggacaatgaaactgaaagaagcaaagttgtgatgatgagatgagttaaactactggctgataacaaagttgcagtaatttctatgatccccctcatgctcctactctgtctttatatctctttatttgttttttttttcctttgcaactgtgcccttgctttggaacaaaactttgataaccatttaacacaatcgtcaaagcagaaggaaagcttatttgcaattcccttttggaactaatgacatctgtttaagtaacaacgaccaacctcaaaacttctgctgcaacattgtgtactttgttgctagactggatgaacatctagctgatgttctgttttagcattgctttacttgagacttgagagagcctgctaccagtttcacttaaccattcgtgtttatcttcccaggatttaatatgctggaattaggaagtctgaacaacattttgtggaggctactttattaaactgcggtgctgctctgtccaaacttgcgctaactgcgggagagaaggggggctagcgtgaaaagaagaggtaaagaaagagaaaggcaaaggcgcgacatgatgcctcgtccaagctttttgttgtcacgctgccaaagaggacaaggatttggccctgcttctcttcttcttcctcctcttcttgcggtaagatcactactactattaccatcaccatcaccgcatcatttgccaaaccatggaccagcttgcctttttccaggttgcagctgcctgacgcagtttagccagccactgtaaagtgcaggtccatttatctgacaaatagagtatgtgagcttaataattgtacagttttttcaaggtcaattttaggggagtaaaacacaattagttttggaggggaaatagcttttgacattgctgtgagatgaggggttggtttggtctgtggcctaaataggtattaccaaattttgtcaatgccaaattttggcaagttttggcatgactaattttggtaagtcaaaattgtgtttggattgaagccaaaatagcctaagttcactattgaaatggcatattttcttaagcatgccaaaatttggattcaaaccaaatagacactaaacactgttgaaattgacaaatattggtaagtctaatttattcctcaaaccaaaccagcccgagatggtttgtgtaggtgaactggtgaacagtttggcctgcatctgcattggtaggggcctaggagcagacaagaacagagcaaaagtgaaaagtggaagcatccagtactgtcaatctgacactggcgccacagctctcgcgaccactcctcatctcacacttaccgaagcaacaataaaaccgttctatcctcgcttcaaaaatcgatcaaaaaattcaaaaatcaaaagtgaaagaaaggaaagcacacgatgcttctcttcacccaatgcagatcgatgggggtcgtaccagtagcagagatcatggctgtgagcctgtgattgagtgatccctttcctccatgccaatcttgaatctttctagctaaaagaatcatctgtgctcttgtgctcgcagctagctgcacagtggtgacaatggcgatgctgctgttgttgcgttctttggagttcttggcgatcatggcggttgcatcgagcttggcaatgccggtggcggcggcggcggcggtgccacagccggagccggaggtgaagccgagcgacaccgacgcgctcaccatcttccggaacggcgccgacgcgcacggcatcctggcggcgaactggagcacctcgaacgcctgcgccggcgggtggatcggcgtcggctgctccggcgacggccgccgcgtgacgtcgctgtcgctgccgtcgctcgacctgcgtgggccgctcgacccgctctcccacctcggcgagctccgggcgctcgacctccgcgggaaccgcctcaacggcacgctcgacacgctcctcctcggcgtccccaacctcaagctgctctacctctcccacaacgacatctccggcgccatcccggacgccatcgcgcggctcctccgcctcctccgcctcgacctcgccgacaacagcctgcgcggggccatcccggtggccgcgctcgccaacctcaccggcctcctcacgctcaagctccaggacaacctcctcaccggcttgctcccggacgtcaccgccgccctcccgcgcctcgccgagttcaacgcctccaacaaccagctctccggcagggtgcccgacgccatgcgcgccaagttcggcctcgcctcgttcgccggcaatgccggcctctgcgggctggcgccgccgctgccggcgtgctctttcatgccgcgcgagccagccccgacgtcaccctccgtcccgtcgtcgccgcagtccgtggtgccatcgaacccggcggcgtcgtcgtcgtcggttgcttcgtcctcgccggcgttggccacaccggagtcgcgcgacggacccggcaagggggggttgagcaccggcgccattgccggcatcgtcgtcggcaatgctctcttcctgttcgccatgctgtcgctgctcgtggcgtcctgctgctgcagcaccggcggcgagagcggcggcgagccacccaagaagaggaaacgaggcggccgcgtcggcctggaggatgacgacgacggcgggatgttcggccaaggcaagggcgtgcagccaggccggccaggcagcgccggcatgcgcagcgacgacggcggagacagcgacggcgcgcgcagcaagctggtgttcttcggggtggacggcggcgaggacgacgacgacgacgacggaggcggcagcgacagcagcgccggcaggagggcaaccggcggcggctggacggcggcgccgcaccagcctcacgggaggaggagcaggttcgcgctggaggagcttctccgcgcgtcggcggagatggtcggccgcggcagcctgggcaccgtgtaccgcgccgtcctcagcgacggccgcatggtcgccgtcaagcggctgcgcgacgccaacccatgcgcccgcgacgagttccaccgctacatggacctcatcggccgcctccgccacccaaacctcgtccccctccgagccttctactacgccaagcaggagaagctcctcatctacgactacctccccaatggcaacctccatgaccgcctccacggtacacatccatgtctgatgtctcctcctcctagctgtgaatcgccatgagagtggcacgatgagctcgatctcgccattgattgtgtttgtcagggcaccggatgtcgggggagtcgccgttggactggacgacgagggtgaggcttctcctcggcgcggcgcgcgggctggcatgcgtccaccgggagtaccgcacgtcggcgatcccccacggcaacgtcaagtccaccaacgtcctgctcgacaagaacggcgtcgcctgcgtcgccgacttcggcctggcgctcctcctcagcccggcgcacgccattgcccgcctcggaggctacatcgcgccggagcaggaggacaacaagcggctgtcgcaggaggccgacgtgtacagcttcggcgtgctcgtcctcgaggcgctcaccgggaaggtgccggcgcagtacccgcagccgtcgccggtcgtcgccgccgacgccgccgcagacgcgcagaggaaagacaagaggtgctcgacggcggtgagcctgccggagtgggtgcgatcggtggtgcgggaggagtggacggcggaggtgttcgacgtggagctgctccggtacaaggacatcgaggaggagatggtggcgatgctgcacgtcgcgctggcgtgcgtcacgccgcagccggagcagaggccatccatggccgacgtggtgcggatgatcgagagcatcccggtggatcagtcgccgttcccggaggaggacagggacatctccaccatgtcgccgtcgatcggcattaccactgacgacggagatggtcgtctcagctgctagctcatcatcatcctcctcctcattgatcttcttttctgaattctgaacaactctgcctgctgcattttttctgatttctgaaatgatgctctgctcgatcttggcattctgaagtctgaaattgctactgcagctggtattatcttgagctgcttttcacttctgctgaaatgtcgaattgtcgatgtgcctgtgcttggaagatggtgcttgtgttcttgtaagataattttggattatgatgtcgaatgcatgctcctggagaacgctggcagttgctgctatactctgtttgcgtttgtcatactcctctatttttaactttgacacagtcttcgagatactagtttgatcaataatatctatataaaagtaaaatattttaaataaaaagtaaaatgttttaaataaaaagagttgtatattgttatagtttatttaatgataaattaccatcaattacattattgatttttttattttttttgctattaatagtcacaattataaatatttgacttgatatatgctaaaaatacttacttatttttggatgaaggaagtagtcggtatggttgtttctttgtttctattagcgaatgtcgttttgtgacatactaaaatgctataaaaatgagaatatgggcaatcttctactactatcacatcatcattttgttctttttttttctttgaagcggattgcgtatgttgtacaacattttggggtgtgaagttcatggcatgctcacgccagacgatgactgtagactatagtactatttcggttgaaaattagcatttgcattattattctattagttagcctgtgttcttcttgaggaggttgggaaccatccctctacacgcaaagtggtgtgatagagtaacgcatgattaaaaagaattaatatgatttttaaagcaattttgttataattgtttttacaaaacatactattaacacgaaacggaaggggtgagttgagaacataagacagatgctttccgaaagaacgattgagctaccctgattaatcaataccagtagcaaaaatgaccagcaatcctgcctcataaaacaatgacatataggtttgctaatgccaactgctaagccaaatacaaattcgtatctgttctagaagactaaaagtagtctattggaaacagaacaatccggtcaaacagaagcatcttgtatgaaaatggtagtccaggacgaaaaagaaaaaaaatgagccgacaactacgttgacatcgttaggtaaacgtaaacaaaattccttacgaaaaaaaaaaaacaaaaacacatgtagacactgtagagaccgatcagtggtccccacgagaccacgaagaccatgtccattggaagcgtagaagaaaagcggaaagagtttgaccgatgcatcggaacacggcccgccacgctggcaccagacggttttgatgggccggaccagtctcggcggctcggcccaccaccacccatccatccatccatccatcgcggcgcatcgtacggtccagagctaacccagcggcgggtccaaacccgcgtgcggcgcggcgcgtcaccatccaccgtttattcgcagctcgttttatcactacttaaccctttcttcgagatttcccttttcttggaggcgccacgtttaaagggcggagtcgctgtaattagagaagaggatttaaagagagagaaggccattctctcttgattgcttggagaggaagaagaacaagagccgccaccgccgccgttaggtttttatttattttttttctcgatctgatccgaggaggagcgaagcgaagaagggcaagatgcattcgacgaatctgctgctggaggagcccatcaggatggcatccatcctggagccatccaagcccgtaagttgctcgaatgctttgatttcgcttcagatttgtttggtttttttttgttgatgaaccctaaattcgattgatctgcggggaaaaaaatgcacagagcttcttcccggcgatgaccaagatcgtggggacgctggggccaaagtcgcgctccgtcgacaccatctcctcctgcctcaaggccggcatgtcgggtaaccaatctgcttgcttcgccatctcctgctcgatcgagctgttcttaaccttcttgtgttggtgttggtgttgtgtggtgcgaattgcagtggcccgatttgatttctcgtggggagacgccgagtaccaccaggaaacccttgagaacctcaaggtcgccatcaagtccaccaagaagctctgcgcggtgagcccccctcctcaccgccttcagatttactgcaattcgattcgatttgattcattcacggtcatggtctcttagtgtttgcttttgctgtttttgcatactgacattttgggtactctactccattggcattggcaggtcatgcttgacacggtcggcccagagttgcaggtggtgaacaagagcgaagcctccatctccctcgaggagaacggcactgttattctcacccctgaccaggggcaggaggcctcctcacaagtgctgccaattaacttcgctgggcttgctaaggtaatactccctttcagttcttttttttttccgaaatcttattacgctgtgcatgaatggttgcaagcgcataggtaggagtacctttcagtgctatttatgcaaaatcttattatgctgtgtatgaatggttgcaaatagataggtccttcttttatggaacttgctattttgtcactgcgatttccagcatatgctctgtttgatatataaaaaatgacttattgttttgtttgcaggctgtgaagccaggtgacacaatatttgttgggcaatacttgttcacaggcagtgagactacttcagtttggttagaggtaaaaatattcggcatactgcgcttagcgttctgcatttttttttcttatgtcattgtcagtaggatttgctttgtgcccacattttccgataccaaaactctaatttgtctggtttaggtttctcaaattaaaggagatgatgtggtctgtgtgataaaaaacacagcaactctggctgggtcgctcttcacattgcattgctcgcagattcacatcgacttacctaccctatctgatgaggacaaggaggtaaggaactcatttcagaatagtgatatgtatctccttatgtatttgtatttgatgtcttcctttatggaattaagtaaaatgttgtatatttttccttttggagcaccttactcaaaatctgtcctttatggaattaagtaaaatgttatatatttttccttttggagcaccttactcaaaatctgtccgatgccttaaatgcttatgagcatgtactgctttcaggttatcagaaaatggggtgccccaaacaagattgacttcctctctctttcttatacaagacatgtagaagatgtgcgacaggtaatacatttttttctcaacgttcccggtgttttgtccttggaagtaaccattcattgaaaacatggcattgctatatccaaatatgtgatctcctgtatgttttcatttggtacttgaaaaggaagttctaaacagtgctgacatctttcgtttcaatacaggcacgtgaattcctctcaaagttaggtgaccttagccagacccagatttttgcaaaaatcgagaatgtggaggtatttacaacatgcacttttaacatctctgagccagcttctgtttgttgtacagcctatcaaccccctatctatttttgcaggggttgaataattttgatgaaatcctccaagaagctgatggtatcatcctgtcaagaggaaaccttggaattgatcttccacctgaaaaggttagtatttctagcttacgtcgagcacatcagaaggcactgcttaattgtacatccgctacacttagtaccttattaacaagaattgtagttttctcaaattatggtgcaatacttgtctttggtttagttatactttatttattttgctctttgacctttgctgctcatactgtaggtgtttttatttcaaaagtctgctctgcacaagtgcaacatggctggaaagcctgctgttgttactcgtgttgtagacagtatgactgacaacctcaggcctactcgtgcagaggctacggatgtggcaaatgcagtgcttgacggtgagttgtttgagctattggtaatgttaaattttcaattgccttctgatagtttaacatacttctattgtttagggagtgatgccattctccttggtgctgagactctgcgtggtttatacccagttgagactatttcaatagtgggtaaaatttgtgctgaggtgaattttcttcctaaatatgtttttatttacaatgtttaacatgtataaggcaaaatcatttctgcccaattttcgttctgtattagtttgttagcatcatcaagttaatggcatatgacatccattgttttgcaggctgagaaggtcttcaaccaagatttatacttcaagagaactgtgaaacatgtgggggagcccatgacccacttggagtctattgcttcctctgcggtgtgttctttggttcttttcatgtttcagacttcatttaatgctgttcacacggaacacattttctcatattccattgatttaagtctatgaggcaagcattttctttttagtctgaactggttccttcactattttctaggtgcgagctgctattaaagtgaaggcgtctgtcataatttgcttcacatcatctggacgtgctgcaaggtagaaagactgaatataagataagtttgtatcttaatggaaaactaatatcatctctaatctggcatctgtactatctgcaggctaattgccaagtataggccaaccatgcctgttctatctgttgtcattcctcgtctaaaaacaaatcaactgaggtggagtttcactggcgcatttgaagtacgtgatcagcctttctttttctactatgtccatgatctgtttctaactttctatacagatgtttagcttgtcttgtttggttaacgcttagctgttgtagctcatatttcttgtatccttgttctgcaggcaagacaatcgctcatagttagaggcctctttccgatgcttgctgatccgaggcatccagtaagtttggcttctttgttgactacagaaattgcaaaaatattcatgcaaaacatacttggtggatttattttcttgcaattgaaaggcttggccttgtcatgggggctttttcagatttctaatacattacaatataacaaagcttagtagatagaagcgtcaaattttaacatgatagctttcttgcttgcatcatgttccacaattattaacacttcatatatgataaacgtaaaaacaactggtatgcttcctgcattgttaactgaaatattcttgaacttgataagctgatttgtagagaccatttaggcgcaataagccagcttattaagtgctattattctcgggtgcaaattttgtaatcatctttcacttcgtctttcaggctgaatcaaccaacgctacaaatgaatccgttttgaaggttgctcttgaccacggtaaagtttctggtgtgataaagtcgcatgatcgcgttgttgtctgccagaaggtgggagattcctcggttgtgaagatcattgagctggacgattagacaagcagcttgtgctcgtcgtcgatgatactatggcatgttttgccagattttgactaggccaaaaacgttgcttcttggctatgtataatcctatagcttcaaatgagcagtttttcctatggtgtattcataggatttgccttacagcttgaaaccattatgatttagttaaggaaattaaatttgcgcagtatttctgtatcgtatcacttagatgggcaaagggaataatgaattttggtactgaaaccttttaaaggtcgatgcgacctatttttcatggatttttcgtaatgctacttgacgtccatcaaagtgttcatctgagtctgacaagggacaatcgatggttgatcccacggtcacccaccatgtacgaaactcgagcatttcaaggaatatgcagtagtattgtctcaaaagcacatgatcacttgcttgatcctttacacatttcataccaataaaaaaattgccttgtaatgccaactctcgagtacaatcctgccatggttccgcagatcaaattggaaagagcaggcagctagtcaatacaagtaaatttcatgctccacagccattacagaaaaaaatcacggaaaacagctgacatgattgtaattagctcctacaacttcatctctctcctataccaacttttgaagtttccaatctacaagtcgcgggttttacacttgaatgtgctgtcctgtactgcagtctaaacagtgatttacacggtgaaagttaaatgaaaattattttggctcactatactcgtgccgttgccgtttgccaaagcactacggaaaaaaaatggttaaaagtattacttgtacaaaagaatgatcatcgacaaatactactaattacaatggattgaccatccagaaacaattgtgcaggagaacctgatgatacccagtatcttctgaagcttctatcagaagaggtcacaactttcctctttaggacatccttagatattgacaggtaacttaaaaaggaagacaattgttgattgaatcacttatttaagtgacacgaatggctgaactggggagggtcagaagatatccggttagtccacagattagcaactttaacaaaatagtgatcaccatcccaaatgatcacttccattcctacatgaagcgaacagagtaaattaattggttgatagaaacatctgatagctaaaaagttcctatccttgaagacgtcactgtaggacaagtattacctggtaaaacactagtcggcaggagggtatgcctacatgtcatcttgctgttgggaagggaacattggagagtggccacttcaatttcgtcaattttaatgatagattcgagaagaactttagcaacaggtgcatctaagttattgctgtcaacaaccattctaagagccgttcctagaccattattagtccatgcattcaggcagccgtcccaacaaaccaacattttactcaccattccaggatcagcaagaacccagggcttgaaggactgcaaggataaatttagaatctgtgcaactctgtaaatctccccaagagcaataaagaattggccacctgtgaaaccagcagaaagcatgttatagtcaatcttcttttaaatgatcagtgagaaaggaaatgataagctctgctcattgttccaagtttttgcaccttgggaaattactacgctgcagacatttgattgacaggattcttgccaaagcaccacaccatgctgcaattcttgagcacagaacagaagcattctgtaccaggcacggacgtaatcacgttgctcctccttggatgcttgctccaaggtatgtaatgttgacacgctgtgcttgtagagttcaactgccaaactcatgtcttccagtgcttatatttgagtatcagataagaattataaaaatttaataacccaagaaagatcgcattatgacccacgaaaacaagaagcagaaggtagaatggtaaactgcaagattaactgcacatattgtatactgaaacaaagaaaaattagttgtgtgccatctacagattttcgttgttttgtataatctacagatcagttaggaggcaattctaatgcggaatatggaaaagcactaatccattcatttccacataattatgtttatcacttatagaaaattgtgcatgtgattattacatgctatccacctaacaaaacaagtgtattgatctcgagtaacttgagaataaattgcaagatttgaccatctaatgaaatagtttattttgggtctagctcaaggaggtaattcctaacaagtactagtaataagataggcagtgtgccgaaacattatattccccataggagaatgcataccatcggtatcttttctattaaatgatattcttcctcaaaatccttcaaatgaacctctctggcactgtcaagcagttcagaaatgaatacatcctttgcagtatgttcctctatacaaaaaccttcaggtagtttctcacagatttcctggagattatggaaaatgtttaaatgacggactatattaaattcatttttttttgtgccaaacaatagtttcaagtgcttgagtgcggagcacacctgaatctcccttgcaattgctgaacttccctgttttcattagaaagcatagaactcttctggactccatgttatcaaatgaaaaggcactatcttgtgttgttttccgttcaaaaaaaatgttatcaaatgaattgcaaaattacaaacagaaaaataccagtgatttatcaactgaatgtaatcagtggttactgaccttaaaatccttcccattccgaaatattactgtcagtgtttcttccctcagcttatggtagaaatcaatcaaagtcctatcgcttgaagatttaattgaatgattttcatctgtttcaaatgaagagttctgatcactgatcattagtgtacatcacatgaaattaaaaagaggggggtgatagcaaactcaaaatagcaaaaatactcaccatttcattatttgagaacatatcagaagggctctgcacactttctgaagaactttgtgtcatgtgtacagcatcaaccagctcagtttctttgtacaggtcaagtatggctgcatcattaggacctgtggacttacaagtttcaatgtggtttgtagttcgaacatggttcaaattttcatccacactagtaaatagtgaccagtcttctgtcaggaatgatggtgatgatgctctgccgcaagacaatggcgccaagactctgtttgatggtgatgagaacgaaggaggaaggaaggacttatcaccacagaggaagcgggccaggtttcctaacaaacttttgagtgggcctgaatgggctaagtagctggcaagagaggagaggtggcgtgagtgagtggtgctgtattaatactcgaactcttgtaacgaattacttgactaatagaatctggaggcaattggcggcggaggatgcaatccggttggattggcgtgagagaaatctcatctgtgaaaattgttcttgcttgcaagttaggtagctaacatcttcctggtcacttcccaatgattttggtacatcctgtaatgacgaaattattcagaccaatcaatggaggaagccatagccatatcaagacttaatacaaagagaaaaggtttagaaagaagtaatgataggatttgcaatgctagaatatactatcaaagaagtatattcacttgtttttttgcgggaactacaaaaaaagggttatttgtgaattaaaaaaatgaattcctgcctaattctacaacacctataacaatttccaagtagaattaataagttgctaaggcagagcttcacacttgatacagatacagaatgtaagaggaaaaaagttatcacatccctttaggaagcttgatcattcaatttgaacattataatcatgatttattgattcagttttgtgagactggtcgcgacgtccgtttcagcaaaggttatcttcatctctgcaattttctaagtgggctagactatctgagcctacctttcctttatcaccagtttgcctttggtaaaatgccttaagtaaacagtttccacataatactatctcacgcgggcggctcggggagcgaaaaaccctagccgcccgcgcctccatcccttccccccccccccccacctcgccgccgccggagcttgccggcggcaaagccggcagcgagcagggaaggcggcggcgaggccttctttgtggcgttctccctcctcggcgcgacgtggacgagatgatgacgaagctccccaccggcgtggtcaaaggcggcaacggcggggatgtgtggggaggcggcggatccggcgcccccaaggccggatccggccatcccccgcctggagctggcgcggcggcggcgcgaggcggctgggcggcatgcgaccgtggtggcggcgcgcggctgccgagcggcgtggtggcgtgcggccgtggtggtggggcgcggcggctggcgttctccctcctccgcgtcagaggcggcgacgacgggcgttctgctcctccacgtcagaagcggtgatggctggcgttctgccgagcagcgccgtcccaggcgtggaggctgctaggcgacgtgcggccgtcgtggcagcggtgcgcgtagccaagcggcacggcggcggtgttccgggcgcggcggccgtgcctcgccggtgtgagcgcgagcggccaggcctcggtggctgggcaaccgatgccgccgtggtggccaggtggggagcggcggccgggcaatgggagcgccggcgggtggcaccggagccaaagcggcaatgtttccggcgtcggcgcaggcccagatggttgtgctaagggagctggcggcgataggtcgtcttcctcgttgccggtcagcaccctcacccttcctagagctcctccccttctctgtggggagtttctaagctggattgaggcggcagcttgttagcgggagaagctcaggctgctgaagcaatgccatccaatcccgggttctccttcggccagatctggcgaggaggccggcgggtggtggaacggagaggtcctgggccagttctcagggatggtggttcgatgaagccggccgacagaggggcgtcggtcgggtatggcggaagccatgtgctgccgatgttcagatggtggattcggattgggtgacgtaccatggtggtagggggttccgagcgaaagcttagcccaattctttgggccaacagtgactttgccttcgggcatagtaaccctcttgagggcactgttgaggtatccctcctccctcggcaaggagctctgggtgaaaaccttgtccagtctttggatggatgacgtcggcgtcttttggcgtcgtgaccctcgtgagggcgttgttttggagtcttcgtgtcgtagtggtgtcgttagctcggtggcgatcggtctcgcatagtgatggccggttcggtgcttggctttcctctctgtagtgtgtgtttggacggttgacacatggtttggggcgtgtgctctggtgcacatcctttctcgacagccagctgtcgatgtaaaacgtacatcctttctgccagctgtcgatgtaaaacttttcttgtaactttttctttccatcttaattacattgaatgacctttgaatgacctcctttggtcattccggcaatataaataggcacagcattatgtttttttttcttgttaaattgaactgtttcgtatgattttacatttgagtattgatcatgtacgtttggtgggaatgaattttgcatactaccccgggtttaaatatacggcatccttaacttcttttaatttattttcgtttttttaaaaaatatttatataaattagacaaatataaaaaagcatgctaaaagtacttttgatgggtcatctattatcactcttttcatttttacttacctaagtaattaaataaacattgtcgatcaaagtttaagaaaaaaaataaatagtgctgcatttagaaagggagtgagtgtgctgttcctccgatgaaagcaaatggatccttgacgttgagtgaaggaatcccttgcattcataggcaaacaatgcttatttcaaacttcattcgaaggtaatttgcaaaagataaaaaccttcccttcaaggtattcctaatggactaaaagttctaaacatcaacgcaaataaataaatgaaatcaagggacgccttgtcgttgtcgcctactcgccttgagtagaaactatagcatcaagccacatattgttcaaaaaaagtgtacccacaagcaaaaggttaaaagctctatacgaaccatagctccaatgctcacgaagcacaaaaatgtcaggagtttctaacaacaatatttgacaccgattgcgtgctgcacaactcgaatttccaacctacagtacaagatggtcaatactgcataatttttccagtaaaacatgtcctatccctactcatccttgcgtttgaacagtttaacaagatagccaattaaggagaccagccatcgccagaagagaactaggaaatttgacgccttcggtttgggttcaggccttggcccgaacagacctttgtatagctccttttgtttctggtacagagctttatcctgctccgcgagcgaccgaagctcgcgctggatctccttgtcttctggagaatacttcttggccttcaggaagtcctcccttgctgattctgtttgaccaagttcagctctagcttttcctcgtctgaacaacgctttcacgttgttttcatcctctgacaacacctgaagaatgagattatgcagttgatcatgatcagcaattctttgattcttattcaaatggtcaatcaacaggtccgtgaatcaatacaaaaccaaaatcatggttgttttacacaaatgagttggaaaagattacacaagtacactaagatcagaagagtgtctttcatgaagaatcatggacaaatatttctccctgctttagccatatgcctgttttccatatttattttgcaaatttttagtgtctgaatgacaaatcaaattcagttttttcttgtgttatacatgtaatgttaaagcatgagtgtaagagtaaattttatgcaatgtagaagaataacatacaattgtacactgtgcgatagcttcatcaaatctcttcagtttgatcaggcatgcggccatgttgagatggcagggatttttcacagctaaggccatgtctctgtacttcccaaacaattgaaacatgaaatcatcccccatgtatgcaattgcctgtaaagaagaacagctagggggattatgattgagcatcttacaatagctgaagaatgacatcagtagacaactaaccatttcatattgctgcatagcctcctcgaacttcttttctttgaaatattcattgccttcaatcttcctcctgtctgctgcttcaatcctttcttccactgtcatatcacttcgggcttttccctgtagttttacattatctgtaagcttcctaggaacctttggttcacaaatatttttttaaaaaaaatcaaaatcaagggtgataagagggatatttatcctacctctttgacatcatcaaacccaataagttcaacttcatatacaaggtctgccattggagggacatttgggaatgaaaagcttccttctttcccatagccaagctcccagttaacatgtaacaatgcacgctccccacttctcatgttactgacaccaatgcctaaaccagtcatttcctttttctctgttgatgagaagaaaaaaaaaagcttcaaagatttatactaaaggcaagtgtaattgatgctcacgtctgttcgtacaatactactcggttagttatctagttaccctgtccagcagatttattgaggcatgaaaaagaggaggtaaaattactagcaatagaaatatcatacttcgtctttagcctttgcaaggtgaggcaagtgggaaagttactggtgggaaaagttttttccccctcaaaaacctcattttgattggcattatggaactatgtgatgcaaagtaagctgtttgagttcatggaatttacggatgatatgcatatgtgcacagaaaagctgaggataaaataaaggaattaactttagtgttaccttttccaagtactagttcaattgaatgctgttcttgccaagtatcctcgaatttgtgcgaagaaccttgaacccatgctctatagtgaactgcaagacaaagattgggaaaaaaataatttgcaaaatcaggtataatatattatcctcattctaatcacaatcctaagcaaatggaacaaactgactacttatggcatacttaccaaagcatgtggcaaaccttgagggtttcttgccatggccttccttgatgacttgctttttgactttatcattaaggacttccatatcagaggtaaccacaggtggagcagtgccatcttgaggaggctcagtatgcacaaaggaagtttcttccactgttatctcatcatcgctagcacctaaacaaccaaaacacatgttcagacatagtactgaatttcttgaataagacaattcactgttctgtagtgtggccattttataaaggagattcaaagtactgtgaactacatccaacatcaaacatttgatgcgccccagttttttggggaatacacaaaaggattgcgcatcattcgatgtgggactaacccaacacggaagatatacttacagttttctagatgtgcgcccatggatacaggagtatttacatctgttttgcttagaaacaccataggccaaaggtcccagtgctacaccatctatgcctatgtacttatatggtgtagtgtcaactactcaatcaagtagcataacctaaccctgtaaagcatgaatcatgtgccaagaacagctaggttactgtttagttggtacgttacataattgcattgcacttgtataaatcttagagacttttagcaactccagaaaattggacagatttatcagaactaattgtcggtactatcgtcaaaatcaacgggatatgacataatatgctgtcatgccataataatcccgcctaactgcttacaaactactccagtagtattgaagtgcacactcgatagcacttgattcgagcattcggggttcattcggcaaggtgcaaactgcaaaatgatttgaatttgagatgaatttggcgtcctcaagagactgaatctagtttaaacccaaaccggacattttacaaccaaaggcgcctaattttccgaatcccataaaaaagcacatatatgctacgattccgcacggggattcaaaacaacagcctgccgaaccaaccgatccaactcaccacaccaaacacaagacagacacgcccccagggtgtagggagtgcgagagaaagcgggagactcactcaccggaggtagaatcggcggcgggtaccggggccggatcttcttccagcacggccatcggtgcgggacggcgggcaggcggctggtccgcggatttggaggcggatggctcgaggagacgagagcttagctcggcacttcaccgggggatcgtgcagcgcgacgacgtggtgttccctcttcactttcacttgggtggtccatccagtccaaggacggcagcgaagacagagaggtggatgagagagatgacgagccgcattcgtaccttcgtgggcttcattcaacttctaactcgttgccaagcccaactactcagtatggtccatgtgctactatggatctgtttgttgaatttttgttatatttttttgaccttttttatttttaattttaaaaataaacccttccaaaaacttattttcaaaatctgaacatttaggccacgctctggagtggcaaaacaacactgacacaccacctgcagcgccgtgacaatcttgtaatatcatgacagcgagagcagtgtgatcagataacgttgttacgctagcaagaccggcatggccaaataacactgtcatgatagtgagaccggtgtggtagtattattttgccacgctagttcgactggcatggccaaaaagattatatcttgaaaataagtttggaagggtttatttttaaaattatagattaaaaatgtttcaaaaataaaaaaaattatttggaagcttaagatcatgagaaaatagctggtttatagggatctgtagaaactcccaaaacaatggtcacaagaaaattagaattgaaaaaaaatgatacaagaaaaatagaaaacagaactattcacgtgaaatttcgattggaaaccaataatatgaccacatgggttaatgcttacaactatgcaaattgtgaacgctatgggacaaacagaaacataaccaaatgaggtagttagtgttaagtatgcgatagtcaagaatatagggataagaaatactaggatacaaattaatccattccagtaagaaatatagtaactaccggattacggtttgagaagacagtaaaccaagaaaacggtcgataaaatagcaagactatatcttttttttccccatttctgcttctcatgatttctcatggttaccctgcaacacttttagtttttcacccctaattatcaccgtcaacgcccgctagacggggcagggacaaccggacaagacaaccaagcgtaataatactaccaaacaacgaacatgcagagataaaccaaaattaagcggagtctgctacatgtgcgctcacaaatgagaagtcagaaccatatgcgtcagcaaacaaattcttcaaattacatagtagtacacaactgaaacaagctgcccatttcgcagctgctatatatttacaccaatcattctgtatgaaacacacaaatcaccgtcataatacaggctaagctattgttaccatgaccggatatacacttggatgtagaggttgcaatgattttcactatcggaaaaaaaaaaagagctactgttacctttgcccagctcttttcgctaacctccgcaattgaaaatcacagcacagtggtgcagcttaacttcttgccaaccaaactgtactaatgtactaccaaaaatgtgtcctccccagctcagctacctagcttatgagttatgaaagctttgcttcagtaagagaggacatggccatccagcagtactcctttggcttttatcacccagtgttgagtcttttagctcccacacttgaaacattgtggggcatcaccatctttcttctcaagaacaaggcatagaggagttcattccatgcatcagggacaccaggcaggcaccagtggctgcaatcctgcctgtgatgagatgcaggccctgaaggactcaggtacaccgagaggtgcccgtctttacgcagagctgtcatctgagtcacattcagtatatccagcccgacaagcttggtcgtgatgctgttccccagtacatgatttatgggttcaagcaggtcagcccacggttccagcgatttaattggagttacatctggtagagtttccaagtggcaggtccctccagtcttccagtcaccacctctgtaagaaatatctaatctagttaaagaaatagtttgactgaatatttgaaagatactatgatgtttgttcacaagtccaacaataaataccatcagcattgtttcatgatgctaacaatatattggcacaattcacataaaacaatgaaacaatgtatggtcaaaagcatctgatatcattcgatacaacatacacaatcaatcaagactgtcaaataatgtttgagcaaggaattaaaaccaagggaaacactcactatttgagtaattagagttggtgattcacagacctgaaatgcacaggagcatatgtacggaagatgatctgggtcttgtttgtgttaacttcattgcgaagccaatgaaacaatgtctgcatggatctttggtaagcatctctaacagtcatctccattttgacctcgttgccttcttggaaataggcgccactggtgcaagacataacagtaagaatagcatgatctctcagccataagacattaagtagagaatgctgttcagtcaatagaattcaaacatttatgcttaccctttgattgttttctcatggttccaccagtgccccgtgttaaagatcaaaagatcagcatccttccacttaccccggccagacatccaatccatggcatctactctaattgtatattttacgactgcaggggctccagctggtgcacgaccttgaaggactatgaaaggagacctgtaatactccacagtgcaattgtactctctaaacttgaaaattaagaaacccatgtgttttgtaataggattcccattaacttcaaagatggagctcttgtcaggaacagcagcagcgagcatacaaagcagagactcccattggtttcttgcaatcgaatccccaacaaatacaactcttctgtttctgagtttctctagcatatttctggcattaaatctaagaaacagaaaaggagacgaaattagagtgagacaccagcattgctaatatgggcatttgaatttattgataatggtacatctcagtccacaggtatcaagggagtaccatacaaggtcacaaaataatgaacttacaaggtcacaagcatgctctttccttataaaataattcactgagaaatcaaaaggcatgcaatacattaaaaaacataagtacaacgagattatgcttctaacaaaaaaatgcgagtccttttacatggtactatgtaacacatccctaatgttataatattccacctttgcaaaatttcatacaattagcacttatgaaggatgacaaacttaccctccaagtatagctactgacatttatggtgacaagaatcaagattaaatattcttttcaaaaggtagaaatctaatcttggaaccactttacttttccaaattgaatcaagcaaccacttaactgcaacaaaggcagttagaacacaacaaaacagagccctcaacaattaacaggacaagaccacctctccatcgaaggtaaagatgattgcaacagcatgacagtcgcagatcaagtaaacaatactgatttaataaaatatatcttctgcaggactaagcaataaccatacgggtaacattgtttcctacttttgtaatcatgtgggaagcaaaagggcatcgaatttccaatcgtggcgcacagttccaaagtggagttggtcgttgacagcatcatgatcatcccatgttccaataatctaattttaaccagggtgaagattgtaaaatgcacgcccactgatccaatctcagcaagaatatcccactggaagattgaagtcagaagcactaacccaaacttaatcctcatcatgccagcagagcagcatgtttgggttctagattcaacccaagtttatttaagtccgtcttaatttctttgcctttataagttaacactcaagttgtagaacattccagcagacaaaattaagtagcacggtctccaatccacatctccttaattaatttatactaatcaattaatcattcgccatctccgcaccgttctagatgcttggattgcagcaagagatctcattaaagatttcttcattgatcttcgtcaagctctcgaagtaaacatttactaaaatcgatttctatctaaacctccaaactcgccaccccaatccaacaatggaatcaatggaagcataatatgcaagagtaccaaagatgagaggaagaagtagaaatcgatggaagaggaggaagcaaacccaacctggggagatcgcagcgggaggggcgccatcgccacttggtgtaggagtcgtcggggcggccgttctcggagcagcggaagccgacgtcgaggaaggggcaatccctggaggcgtagagcgggtagccgtcgtcccacacccactccccgtcgaacaggtcgcactcctcgcctccgccgcctccgccggcgccgccgccgcggggctcctcgatggagaccccgccgctgaggagcttcttgggcgccgccagcgccgagccgacggcggccgagcagcggagcgaggcggcgcacacgagcaggagcagcgcggcggcggcggccagcatcgcgaccagccccgccgccccggccttctccagcggcctcctcatcaccccccgcgccagccgcttcgccgccgacgtcgaccccaccatcatcgcatcgatcgatccccccaccgacgaagcagtagcaccggcactagtagtaccactactactacctgtatactacctcgccatggccatggagcttacgcgcgcgggaggaggggagacgagacgaggtggcggagaggaggaggagacggagacacctcgagggagaagacgaggaggtatttatgaggaggtcatttgaaagggaaatgcacggagtttggctgcttccaattggacggaaagcaatgtgattactatttccctatttcataatatataagttattatagcatttcttacatttatattaatattaatgacttacattgtaaaatggagggagtagtactcctctccatcctataaaaaaaactacttaacctaatattgaaagaaaaattttctaatacaacaaatcagaacagatagaaactcatccaatactaaattatttttccaatacaacaaatcagaacggatagaaactcatccaatactaaattattttttttaaagtagaacttaacctattactaatataatatcgtttcgattcaggaaatattatattttatagtagattaatatatttttgagacgaagtaagtacaaattagtagtgtggtttgtggcaattgtgttgtgcgtgtggagaggggaaggaagaagtggatgggagggggagggttgaagttgaggtgtggggcctataaattcggctgtgtttggaggggttaagtatgagtcaagtcaagcacgatctatccctcggtcatcaaaaaatacttgctttaggtcgagcgcaagttaaatttgattaccatctgtctaatataatgtcaaaagatgtactggtattttattttaaaaaaactttgtttaattttaggccgctaccttttaaccacatcgatcattttcgatcggggcagttgctaaaccattttc

SEQ ID NO: 72123 - DNA, 2277 bp, Oryza sativa
tatgagagcaaaattagttgaagaggacaatagtcactactagtcataaaatatgagaatcaaatgaaatgtgagaatcaaaaatcagttgatcccagaatcaactgaaattgtatcagaaaaataaaattcactagcagtcactactggttcccccaaaaattatgtagaacaaagcaaaatctgtataagttgattgcttatgagtgctgatgaggtggcagacatatgcatatccacagtgagaaaaaaaagagttaagctaacatgaacccacaaatggcaaatagtgagggcatatatgacaataaggcaaaaagatccccattcagtgctagtggtcaaaaatgccaaaaagtgcagatgggccagtcaatcacaacaatatatgctcatgaaaatttttacaaaaatcatcaaaacttcgtgactacctgcaaccagactgaacttaactcagtataagaggataatgagttgatgactgcaggaatacaaacttagaaatgcagaggtgtataaatctgcagtatgtaatcaaacacaacacaagcggctgctaggttttctcagttctggatggtttaatcgtttatatttaccagcacacagtttagacaaaaaagtgcacccattgcactataaaaaacagagcgaaacactgaaactttactgaatatctaatcctacaaatacaaaaacaaaatcagttgatgaggacacctagaatcaactgaaaaaatcgagtcagaaaacaaaattcaaaaccagcccctattgggttctcccaaaaatttgtctagaacaaagcaaatctgcgcacaatcgtttcaggggaaaaaactaactgcatatggaggaacgcaaaatagtacatttctgacaaaaaactcagtacaccaagttaatgcacaaagatgtttttgctcctattaaatcctctgtagttttttctctgaaaatctcactcaagtatgaatgttattagaaagcaacaactatatgatgacacctacaaaatcagattgcagcaatccatgcatcatgtgaaagcctcatgataataccaggtcaagcagggcatggagatagaaaaatttctctgtgaataacttgaatcatgctggcaaaataacttgagatatgtagtatttcaggagccaaatatgctccaagattgcagctggatattgctctggattgaaaatcacattgcaaaaaaatgcagtcatcagttgtgcagcaatatgcagtcaaaaatagcattcatttacagcaatctgcccaaatattccagctatatcaatgcattgattcagcaatatgcagcaatctacccaaattgtccactcactccaggatacacatggaaaatatccagcaaatatgcagccacaaatattcccatttgcaatactcctgcttacagtagttcattgcaatactccagcttacagagattcaagcaatggcgttttgggtttagatccatgattttgctagggttaggccctaaccctagcagcgacgggcggcggtgacggtgtctactgcgggggcggcggccgcagcgttaaccgcggcggcgacgacgtcaaccgcggcagcgacgacgtctacgcggcgacgacgtctacggcggcgtctacagcgtggtgcatgtggtttcacggcatgattttgtgacggacaaacccaaaacgccatggatctaaacccaaaaaaccaaggaactaaaacaaaaaaaatcaccaatcaaatcaagctagctcgggggaacagaaaatcacttccaaaaattaaaccctaactacaataaccgagaaatagcaggaggaatcgattccaaggatgctcgaggagatcagagacgaaccacgttgcgttggagaaaaatcgtcggagaatcacaggagatatcgaaatcgccaggagaggaagaagagggtactgttcaaaattgcaacggcatccgcttccgcttctggtaagggcgataaaaaaaagccaaaaacggttccgtgctgtggatgggctctcgtgggccaagcccaataggaaagaggctgagaaaagccagaaaaggcaagtggtggcggcaagtggcggaaagggaaatcgatcgctgctcctgtcgcccaacgattgatcgcgcattaggagtttcgttccatttaggtataaagtacactgacttccctagcatttctggtaattcacgacgctatgttacaatgcttgattactaccgctaccgactccattaccggttgaata

SEQ ID NO: 72124 - DNA, 664 bp, Oryza sativa
actttcgacgagacactagtacacaccagtgcctgcttctgcaccttgaagatgtagatattgtaggtctccatactcttcttgaaaccttaaagatgtagatcttgtaaggcttggtggggcgcatagcgccccgagcaccttgggggaaagggaacccctgttcccacttctccgataggtggagcagggccaacaatttggtaaaaggggctataaggaagggtataaataatctgatcattcttggtgcatggactatttggaagcatcaaaacaattatgttttcaacgaggctgcctcaagcattttggcttgagtagttcttgcgagtgacgaggctcacctatggagtttaggcggggccatagggacttccgttgattatggatcccagttaagaaggcctgtgattcaggttggtaggagaaccttggtgaggcactttgttcttcttttgctcgtgttatgttttctctcttttcgtgttttctgaatctttgtatttgcatcgtattcctccgttcttccattaatgcaatgctacataactctcatgcatattcgagaagaaaaataatcttaattagtaaatattaagttgatattgattgcctctttttatcttgtttttgaacagtttttcacttgtaaaatatcatt

SEQ ID NO: 72125 - DNA, 817 bp, Oryza sativa
gattttaatctagcaacttcaaagttaagagattcaataataaactcctattttctatacatcttctcacacttcttattttttgcactcaaaataagaatagcttcctcaaaagaacggacctcattgtcttcacactctgaatccgattcaccaggtgccatgaagcaaacaccagagatgttctttcccttatcttcatctccactttcaccatctacatcgcttaatggctcaaaagcagcatagacttgagtcaaaagccttcttgagagtctctttgatcttcttccctttgaatgtgctcttcggcttgttatcattggtcttctcaccaccattttcttccttcttatctctcccaagcttaggacaatgcgaacgaaggtgatcagacgaaccacattcaaagcaacgatttggtccacctcttttcctgtacctaacattattcatagctcgagaaaatttgttagtaaccaaaaccaaatcctcctcctcgaactgttcgagttgctcatcggagatggcattaattaaaacaagaatagaagacttcgatgaaggagcaccaacatccaaaaaagtcgaggaagaaaccaaagcactaaacttagaatcaactttacgagaaaagaatattcatctcatgtgttttgagttttgtgtaaagcgaatccaaagtcaaagtagacatgtcaacggactcctgaatagctgtaactttcatctccaaataggcatgtcaagaccattcaaaaagtagcgagaaacctcagattgtgtataattaacatcataagaagaatcaacagat

SEQ ID NO: 72126 - DNA, 1546 bp, Oryza sativa
tttttaataagataaatgatcaaatatcacgttaaaaattaacagcatcaaatatttaaaaaccgagagagtagtttggaacacatgtttaagttacagtcatttaaacttgaaatattggctattattattgaacctaggaacaagatagtagttccaaaatttaaggtgtgatatcatattttgtattatccattttacaatatattgttgatactatctttttatggaccgccacttcgaaaaagcaaataatacttatctcagtctccagaaagttaccaggaccaaataaataaattttcaaataagtaatcttatttttcagtaaagcaaagcaataatgaacttatgattttaaggcttgctattcactctataattatatattgccgataaaattcatcacaacaaaacaaaatagtgtcaggaggagtagatttgttgagagaaaaagaccgagaataacgtatttggcccaattaagtatatacatatgtaatgcgtaatatacctacatgtgttgattattttcggacaacttttgagtattcactccaatacccaagagcctccctgtgtcccaccctgaagcaaacaaaccaggaagaacaataacaacagcatgggtagatatgttggcatccctgtaaactctataactcaaacttgaaatcggcagctctaaattatttaattagtaactggactaaaatatatatttctcgaaaaacgaagtggacaaattagaacttccataaatttagttttctcattaaaataagattttgttcagatttaagcatgatattctgctggtaagttatatgatattatatggagcatgtgatgatttttttaaatattcttttaagtcatttactaatgcaaacatagttgggggttaacttggaccaggttgtcgaaaaactagtataaagccacacagccacaagctagaatatccatcaataaacacatcatactgccatctccctcaactagttgcaaaagcacacgttcttccaatattccatcagccatgcctggagcagctgctgccgctgttgttgacagccgcctgtgcacacagcacgcggaaggccctgctgcggtcctcgccatcggcactgcaaacccggcaaatatcgtctatcaagatgggtttgccgactactactttggtctaaccaagagcgagcatcttattgagctgaaggacaaaatgaagaggatatgtaagtagaacaatcctttcatttcgatcgttgcattgatcatcattatcgttagttgtttttcataaactctaatgagaataaattatgcaagcgcttaaatttttaggacactcctgccataattcattataaaccatacaaatatttatactatactacgtagaaagaagagtgaaatgatgttggagttcagccaaattttctttatttcgcgtgtgggatgcaatgtggatgcatggggtgtggttgcatcccaaaatttttgaaaaaaaatctactatatacagtatatacttggtacatat

SEQ ID NO: 72127 - DNA, 666 bp, Oryza sativa
cgtacacggtttctagcagtgagaggacttctggcgcacccgggaagggaagactcacacaaatgcattaagttataattatgtttaaattatcacatggcagtcctaccaatggcgacaccactatagagcccctgccttacacatcaagaagccactatgcatggatactgcctccgctcagctatttactccgctaggtctatccccatacgagaagtgtggttgtacggggtcgtttcatgcttaacttcatggctcggtccttaattgaccggggacgatactagtctttcccagataccacccaaatccaccgtccgccccagtctaaaatatgtatttaatttcattcctacttcctcaaatcatgtcattattatcatggcaatgtggagctcatgtctccacatgccgcatctcaattatcttcccaaagataattgccccaagcatatagcatttgataaaatatgagtatgcataaatctagagtagcatttctaagcaagtgtcataattgactaagtactcatacgtatttatggttacaaagatttaaaagtaaacaatattcaaggcatggcataatcacaagtagaatgttcatcattgcatgcaatcttatttgtaaacaaaataatttcgcaattgggatcaatatgt

SEQ ID NO: 72128 - DNA, 4848 bp, Oryza sativa
tacctcatagaagaaaggtaataatagtgttatgtatctccactatgaacaccgagttttaactccaagtcaaccattagataataacaaactcaggaattaatacaagtgaaagcatagactgtgaagaagcaaggaatttgggaatagggagaagcactaatggtgttcatgcatgactccatccaccagggtttaaatcctaatgcccagaaatattacgcacatataactggactttcaaccagattatactgagatcagagatgtgctgctagttttcatctcttagggcacccacaatggttatctataagctctctacaagagatacatgtcggcatattttcctacttggaagagattaaatgaagagagagagcaaagctatctactaacctggagatagtctatagagaaaaacgaggcaatggattagagagctatagatacccatgtagacatactattgatgtgatttactattaatctagtctattgctgagatgtatatgttttatagagagcaccttactttaccattgcgggtgctcttagagcatgtgttaggagacgcattctttagggtgtgagtgtgatgttgtgtgtgtagtggtgtgtgcgcgtttgttgtgaaattaaaaaaagaggattttaggaattagggaatggataatagagtttagggtggagactggatagagcactgctacactggcccactggggaaggaagacgagaacccaattctgttgctgctgctgcctctttttcatagcttcgacgttgcttgtttgggccccagcccaaagaccgtgacaaagggcgtatgttatcagaatttatcgcaattaaatgaagatagtagctcagtcgcatattaatagttacttaattaaacttgatagggcaaaaggaggacgatgaacaactaaatctcatctctccaaacccctaaaatcatagtattcgaggaggaagaggatgagtatacgtactcgcgttccttggactcttctctacttcctccaaataaccacactctactctctctctaccacaaattaccatttcagaatagttgagtacttgagttcatttcagaccagtttgtagccggtgacccagatgttcgccggcgccggcgccggctgcacgtacacgaacctgaggctcctccccggccgcagcgccggcagccacctcggcggcacgtacccgtacctcgcctcctccagcccccacagccgcccccggagccccgacacgcccaggtgcagctccctcaccgtcttcccccgcgacctgttcgtcaccgtcaccgcgtaccggtagtacgtcctccgcctcctcgcccacgtccccgtcacgttctgctcgatcccgatcgccgtcgccgtcgccggcagcgacgacgacgacgacgtccggttcacgaccggagtcgccgtttcttgttcgtattcctcctccttgaggccgccgcaggaggcggcgaggcgggcgaggacgccgagcagcggcgcgttgttgtaggtggcggcctccgtctgctcgtagttgtcgcgctcgtcggcgaagtcgtcgtactcgtcgggcccgccgacgacggcgccgtcgagcagttcgggttgccggcttccctcccgtaccacgacgagtacccctcctggcagctcacgaacgacgggtccctcttgatggacacgatggacgcgccgcggtggtgcacctgccgcgggtagctcgcgccgtacccgaccatgtagctcgtccccctcggattatcacccaaaatataattcacctgaaatcaattcgacaaaatttgagtaattcgtcaaccacatttgacaatgttttttttttctcgtgaagtggaagcggtgagagtattgccgaatatattagaaggacagagttgaccctgtttataaggaaaaccggctcaaaaaccatacaattgcacggcctttgacaatgtttttgtttgttttttacctgagatttgacgaatttgaggatgtcgaatggttgggcggcgccggcggggcagtggacggcgccgcggccggagatggcggcgaagtcggcgtagacggtgaggaggaaggaggcgctggtgacgaactggaggttgttccacctctggtggtacatcatgccgccgggggtcctggcgacgttgacggcgcccttgccgacgcaggagcacacaaagaactccgcgttctgcctgtacctctgcagcgcggcggcgtggtcgccggcgcggccctggaggaggaacttggcggcgaggacctgcacgccggggtacttgacgtcccacccgaactggttgatggaccaccccgtcccgcccagcgcctcgccgttgccggcgaggtactccaggtaggacctgtcctccgtcgcctcgaacagccacgccgccgcccagagcagctcgtcctgcagcaagatcaggtcatgtcagcaaggtgttcgtccgaatcctacggcgccgccgccacgccacttaccccgtatccgctgaaggagccgtagtagtttcgcgccaccgtgatgctggcgtcgtacttgccccggtacttgtcggcgaactcgaacagctgaacgcgccacaaaattttcagaggaaatttcgtttgatttcgagctcatttgcgagagttcttggagtgtttggatgaccgacctgcttggagtgcacaaggaggaggttggcgtagccagggtacgtgccgcggaagacgatggacgcggcggccatggccggcggcggtctcggcggcgaggtctgacccggggtgctgggggtcgacgcggaacgcctggcggctcgtcgtcatgtcctccggccgctgccagcagctgtggtcggtgtcgccgtcgccgacctcgccgtagagcacgtcgggctccgggtgcgccttgatgaagtagtcggtgccccacttgacggcgtccatggcgttccggagctcgccggccgccgccatctgcttgccgtactctaatatgctccacgacatcatggtcaccgtgaacgccattggcaacccaaacttgacattgtcccctgcatcataataacctccaacaagatcaacctgaaagacaaacaaaaacacaaacatttgcattgcactccattagaacccaactcatcatatctcctgaacaaattgaacacaatgccattgatggcatcatggttttgatcaaagatttgaaggtagaatggtgcatactccattggcctttccatcaaagaggccagagctggctctccaggagaccctctggttaggagggagaacgccggaccgctgcgcctggaagtagaggatgctcttcctcaatgccatggcatagtcatggccacccccagcaacaaatcccagcttcaccattgatgcaagtgccaagagaccaaacaatgtggctgcaccgtgagcaccaccattcttggccattgcaaaattgcaatgtaccaagaaggtgagtgagtgagagtgaagcagagtgaaggagcaggggagcagaggactttggttggcttggcttggagggagctcaaaagagtgcttcttatataccactggagtggagggaagatcagataaagcaggagattcaaagcatgagaaatagtttactgaactccagggcccctttctcactttagcaagttgttgatggcaaatattattccaaatgcatgcaactgatgaactcctaggtaggttacatcctcctacaaaatggcaagttttgtccatctctttttagtaaactactgactaatatagccacttctatgattgattatattattcatcgatggtcaccatctgttgtgagatatacactgaaatgcgataagcaacattagacagtggccacataatcagggcatgtattttagaaagctttcatgaactccacaaaagtaaacatttggtgaaaaactgaaaatgaacataaatcggactaaagttgctagattgccgatataaaatcatgatatgatagttgtaattttacagttattgtcactgagaaaaattttgtgatgttatggatagttaataaatgggataaagataattcaattccattgaaaaataaataagaaagctacatattacagaagttaactttgcatgcatatgcttgagaaacaagcgattcctcgtgcaaaagaacaccataggaactaccaactttaaaaaggaaataatgcaggcaattgtcttgcaattttgggagtatctgtaaaagccaaagaaaaggaaaaggttaaagaacgtcgtttctctatagaatgatcgtaccagcgctatcactattgataatactcttgttcttgcaatatacatgttttttttattatcatttgttttctagcagtttactgaaactaatgctccatttgaaatccaagtataatatgcgaatttcattagaaacagtctcccacgtagcctagctagggagtagggactagaaaatttcccaacttcatattcttacaaaagtatatttccatcccttaattccatcggtatctttgatgatagctgacaaaattcgctctatttgaggaaattagatcccgatctttcgataggtattgataactctcgtggaaacttcacacacacgatccagcttctgatcaacatgatccaaactctggttatcagccgtgccctactcagttgacctcgccgagaagactaatccttgtatgcaaatcgaaaaacacaagcaagaacaagatagattgcaacacaattggatatgaatgactaagcactcgaatttggggttccacaa

SEQ ID NO: 72129 - DNA, 13298 bp, Oryza sativa
acagacatctcgtcgatgaggcaactgctactgtggccgttcctgcctccatcttccatgaatcacatctgacagacgttcacatggcgacatgaacccccaaggtcattgatttataggaagggcagcaacaaggagggaagggcgggtcgcaaacacatccccgcggccgtcgcatcactaccaccaccgacgcggagctagagaaggggtgaagcatattccgtatgcgctcgcccagcagcatgagcccttgtggtcatcgattaccgaggaggacggtgacagagagggggagggtgcgcgtcaagcattgcagctagtcactacgacactgtaggggtggataccgagctggctaggctcggctcgttatgctaaagagctaaaaccccggctcgtctcggcttgcctagaagctcgagctagctcgtttggctcgcgagccaatgcactcttgactagtcttcacttcaaaataacatcgaagtctcaaaaataacatctgatattataggagctgctagaaatgatttttgcaattgaataaaaataagcaactagcaaataaaattcttgacatgaattttttgtgcacatcagtttgaaatatgggaaattgaatccaataacacaaccagctacccgagatttaccagatctgaagcctggttaatttcctggatcaacgaaccaaaagatcaaccaaacaaaatcaccaaccaaatcgacaaggcagattggcagatcgacgatgatacagactagaggccaggagggaacgcagcagcggcgtgagcccacaaggggtagctgggacggttgatggtgccatgggatacatgcgccaggggaggagctcgagctgcttcctagtggcggtggcgctagggactgggggcgcgagatgccggtgttgggcagcggcgggcgagcggcgctggcgccctcggcaacgacactgggatgtgctgctcctgtgacctgcgggctgtggcgtagctagcggctgttctagagcaagggaagagaggctgggctgggcattggggttcgattttgctagatctttgtcaacagattttcacccccaatatttgtcgtttttctatccgtaggatttgcgccatgattcgtgcatttccctgtgtggatgagaccgtgtggcctgtgagcagatggcctgggagtcaatgtgggccaacccatgttaaattttggattccgcgctattatgtccgtaaccgttggttgtttcctcgctctctttctttattctcgctctttctctacatctctttctcctctttcttttctcttctcgttttctccgtcgagagagagagagagctcgccggcgagagagagcacgagcagctccccggcgggagagagagagcgcgcgcgctcgctgggggagacaactcgagagagagtgttttttgagtttcttccctgatttgctggcatcattagcttgtgttttggttttttcaatgtcaatagggctaggtttagaagattcgggtcaatacatgacgatttttttttgctcccaacgtatggatctgattcagaatcacttgttttagttttggaatccgtttaggttttggattccctaagtttttagttatagtttgattcagttcagtctagggtgttttgttactagtccattgtttgcaaacgaccagattcgatggtgttctatgtttttttttctaatccacgagggtttttgtatttttggttcgatttttcttcaggggtgttcatgttgggggttggattcaggggtatttgatggagttaaaggtttaattcgaggtggatttagggttttttctaatcacccagatagttgatcattttttggatccctgcatgaattttcttcagggagggggtcagattcatgagttgattatttttgctttgatttatgtgtgatttgaatatagtagggaagcatcattgcaactttatctgaatgttgcatttcactttcagtgattagttgactgatctgttaaactccttgcatgagtctgaatttttctgcatgtgaagcatttcgtttcagagatgatttatctgtcaactccctgcatatatctgaattcttatgcatctgaagaatttcgttttacatatgcatgctaactgaaccccaagtatgttttgtgttgccttctgcagcatatgaatcatttcgtttcagagatgtacggtttgatttcctagtatgctgagttgcttggttaaattaaacccaaacccctacatgcgttctgctttcttcagattgtattctactgtactatttggtttataaaattcctgtacatgttctgaactttttagtgctgatctaaatgagttagcagcaagccaatacctgaacttggtccctgttgctttgagaaattatgggctattggttgcatctgctctttcttctcttctgaacttttgttcattgtcaatcgctcgtaaatcgtaaatctgtttgaattggcgctatttctgaacttgggaacataattggcactatttctgaattgggaacaggggatagcacgctcgtaaatctatttgaattgtcagtattttttgaatcttggagcaggctattgcacagtttcagtcgacatgagctttttaaaatctcatacttcagcaaactgaaaaataatttggagggtttcagtctaatgttgatctaatgcatttcaatggtagcaaaaccaaggtcacttgggtgcctggaggtattcacatgcctgaaatatctgtatgattttttttcttctttattctgaatgacccatcgtcccatcccaatattgttcccatgttaattatgtgtggagcttgttagtcagttaactcatttgctgtgaaatttaatcgggaggctcaacaacaacaccctgtctggtccattcccttctggtccattcccttctgcatcagctaacttgtcacatcttgttgtcgagtgattttaatatatgtgcacagaagtttgagatatgtgcaaattatgtacaaaatttaatatatgggcaaatttgtacacaactggagatatgaccgtttggaccacaatgctctgttttttttatcctaggctctaatctaattgttgtgctttgttaaacaccacggtctgaagatgattttcacttgaggaaaatcttcagtccgttgtgacaaagtgactccttttctgaagaaattctttattttttgaagaaattcaagcatgcttgcagttttagcccagttacagtctatatgtattgtagttacatatgtaacttttgttatttctcactgtaactaactatagatatatagtccttgaaaatttatcaacgctacaatctctaatttgttgtatataattttatgctagattatattgtctgccaagatcattttatggtgcataatgctaggtgagcatgataactgacctttcaatgttttcttgcttcttatttctctggacaaaattttgtcactttcatatctctccgattgcatatcccctgatttttcagactgtaacccatcagaccctgcatgtttatattatttgtaacataatttagaacttgttataataggggaaaatatttaatgctgctgcatgagtactaaatttttttgaagaaattcaagcatgaaagctgttatagcctagttacagttcagatgtaatgtagttacatatgtaacttttcttatttctcactgtaactgactatagatagataggtctttagatttttcaaagccgccatctctaatatatgtgctagattaaattgtctgtcaaggtcaaatatggaccataatgctaggttatcatgattatgacctttagttgtcttcttgcttcttttttcatcagacgaaattaatgttatctctttcagatctctctgattatgtatccactgttacttgagatcgaattgtaacagaacctgcatagataggttatttgtaatataatttagataatgtatattagacaaaatttttttgaagaaattcaagcatgattgtagttacatcccagttacagtcaatatgtactgtagttacatatgtaacttctgttacttctcactgtaactggagatagatagtttttcaaaaaaaaaatcatgctttcatgtatacaaaattgtgctagattttatgactgacaagatcaaatttggtgcataatgctatctgtccattgttctgaccttcaagtgtcttcttgcttattaatttttctgagaaaattttgtcactttgacatctatttgactctgtattcactgttgcttgagcttctaatctatcaggcgttgcatgtttcaatcatttgtagtacaatttagaacaagtcataatagtaaaaaaatgttaatgctgttgcatgagtactgaattttttgaagaaattcaagcatgattgcagttaaagcccagttacagtcaatatgtactgtagttacatatgtaatttctgttatttctcactgtaactggatatagatatatagttctttaaaaatttatcatgctactatctctaatttgttgtatataaatttttgctagatgacattttctgacaagataaaaaatggtccataatgctaggtgagaatgattctcacctttaactgtcttcttgcttctcatttcttcagacacaattttgcttctcatttcatatccatctgattgtgtatctcctgatttttgagattgcaatatacctgaccctacatgattaggttatttgtaatataatttagaacattttgtcataggcaaaaaaaaagttagtgcatgagcactgaatttttttttaaaaaaatcaaaggatgattccagttataacccagttactgttcaaatgtactgtagttacatctgtaacttttgttatttctcactgtaactgaccgtagataaatagttctttatatatttgtaacataatttagagcttgttatactaggggaaagtgttttaatgttgctgcatgaatactgaatttttaaagaaatttaagaatgattccatttacaacccagttacagttagatgtacagtagttacatctgtaacttttgttatttctcactgtaactgactatagatagatagctctttatatatttgtaacataatttagagtttgttataattggggaaatgttttaatgtcgcagtataagtactgaattttttaagaaatttaagaatgattccatttacagcccagttacagtttagatgtactgtagttatatatgtaacttttgttatttgtaactgtaactgactatagattgatagtttttgttacgagtttttctgaaaaagttacatacttttaactacttgatctaaagaaatttcctattccaagcacttttctccaaaagaaattcactattccaagtgcttttctccaatatttttacagaactgagttgtttttgtttgatttaaaagatgactggcagaatatggtgaagtcaatggggaaaggtaaaggtggattttgtgctaggtaatttgttacctggaagattatgtcttgttgatttcaacttcttgacctcaatgttcttggtaagaatttgcttcttcttctttttctcgttctcctcactgtctatggcgtgctcgatttgttttgctcgatctaggggatttgtgcgaactggtgtggtctccctgtgttattttgtttttttctaacctttattggatgtgaagttgatcattatgggccatgatgtatttgcagttatggcctgtataattttttgtattgttctatgggctagaattcgagcccatgtagttttgtgatctgactagtcagagaaaaaaatatgtagcattttttgtgtcctctggatcttaatctaacggtagaaaaaaatctgggtgattttgacccaaggatttgtcgacaaagacatagctagttccatatgggcttgtgggttgggctatcattggctcgtgagcaactcgcgagccaattcgagctagctcgttatctttaacgagctaaattgtcagctcgtctcgttagaaaaacacaatgagccgagccaaccaagtgccgagcgagctaacgagccacgagtttttttttgtccacccttacaacacagagttagaggcggggcgaagctcatcctgatccgttgtcattgcctaggctttaggaaggatgtggatgctagcatcaagttcccatcactggctctgcctctcccgatgcaggtgtccattgcttggcactagacactgcctcatcgcactcggctcctccggtgcctctttgccctcgacaccagtttcacagatcgatcggtccctggggcactggcaaggggtggtggtggtggcactgctcggtgccgacggtgggggatgtggtcgtgacatggttgtgtgcggtggaggtggtgaggtgcggccacactcaagcggagaaaatgagataagaacgaaagaagcagatagaagattgacaaaggacctatgatatgagttaaccaggtcaaaatgcctcttaggatgaaacaagcttcaaaacaaaaactgtccactgtggtaaattgatttggttttaatagttgagggatatctttttgagaaaatttcttacatgccactcaaaattactcatttcctttaaaagccattgaaaattctacgtttccttttatgcccactgagttttagttttcatccctttgataccaccaccgtcaagtcagttgaccctagctcccgttaagtgagttaacatgttagatttttcttcctatatctgttttaccctcactcttctgtccatgctatcactaattaacgatctgaaatgcgcctagcactctcttcatccttggactcccagcgaatcaagatgattagttaaatgaatgcaagctaaaatcaagaataattaaatgtgtgccgatagttaattcatggtctagtatatatgtgcccttgatgcaaattaaatgtgtgccaatggttacatcaaatgactgcaagcttgcaatcaaggataattaaatgtgtgcctacagttaattacggaagcttgttcagcagagcctgtggaggtggttcaccgatattagcaacctctctggtatgcatggagaggagcagacgatgtcacacaatagtgggagtgtgggactacaggagctagctcagttagtgtctcggtgatggaatatgcacgatggtgaaaagaacagaaacgagagtgagaggaacctgagaaaaaacagagggaacaagggcactagtgtcttttcatggcctacttaacaccaacttaacagtagtctaacagtagtggcactaaagagataaaaattgaaacccaacggcatagaaggaaatgtaactttttcggtagcatatatggaagccgggtaatttcgagtggcatataatagattctctctatctttttacatggttttgtagttcaaaggatacgaatcaaacttggctaaaattggacttgaatccagccgaatcaggtctgtttccttagctaaacataatggcccatccaccatgcaaagtgggccgcccaggattcgaaggccgacgaccatggcatatccgaaaggaataagttcatttgaggtccgttgacttgtcaatgaatccgattttcgtccctcaaacggaaaatcagacataacgagtccctcaactctcaaaaccggcgcaaattaggtccctcggcggttttgagggtggttttggctgacgtggcgcctacatggccaatttgactcggtcttcgtttgacgtggcgcttacgtggcaattctatcggaaaaaataataaaacccgtgggacccacatgttagtttcacattaaaaaatggtgggacccacgtgaggcccacctgtcatactcccagccctcctcttcttcctcatttctccatctctctcccctctcctccctcctctcgcagtctcgccggccggcggagataacgacggcttggagaggcgcagcctcctccacttccgccccctcgggcctattgccggcagccgctgggaaagaagcagcacacgagcgtcagccggagggaggagaggagcggtgcgcaggcgcgggcgtgggcgccggccggagggaggagaggaccggcgcgtgcactcggccggcggaaggagaggagacgcgggcggaggccgaggggagcgggagaaatccgcgacgcgctccgcgtccacatgctctctcacggcgccccacgcccccaccgattcaccacctacctcgtcacgtgcgtcaaccaccgcctcctccactcgccaccaacgccttctcatcctcgagggcgatggcggggtcgagaggctcctcgacctcctcgacgcggctgacgccgccgtcgatgcgcgggcagcgcttgagcgcgaggatggcgcggtcgtcgaggccgtagagatggacacggagcgcggcggtggtgcggcggaggcggggcgtgaggaaggaggagaggcggaggtgcgcggcggagacggggcgcgaggaaggagaggcgacggtgcgcggcggcgtcggggaggcggagcttgatctcgacctccatcacggggggcagggaggagaggggaggctagggtttggggttgcaattgggattggtagggaggccgatgcggtgggacttggagggcgcggcgccgggcggtgggtggaggaggaggttggagttggagggcggcggggtcgtggtcggagtggatgaggcggtgggggtgctggccgccgccgcggtggcggtggcaacgcagaggtggtcttcgagctcgtcacgatcgaaggtggtcttcgcgcgccgccgctccagccgccgtctccccacttcgcccgctgccccagtgcacatcgtgaaaaagagagagaggataacgggaagaagatgagggatgggaggatgacatgtggggcccacgtgggtcccaccattttttttattattattttgtatgtgaaacagacatgtgggtcccacagggtttattattttttcggatcaaattgccacgtaagtgccatgtcatatgaagaccgagtcgaatttgccacgtaggcgccacgtcagccaaaaccgccatctaaaccgccgagggaccttatctgcaccggttttaatagttgagggacctgttgtatctggttttccggttgaaggatgaaaatcggattcgttgacaagttaagggacctcagacgaacttattcctatccgaaatttctctctttgttgtatgttactagtaggttggatgaatattggtaagagaggagacccatatttctcacctactactttcgctggccggttatacgaaacaacattggtgcgctgcctgcgctgcttctagggaaacacttgacgaaaatgattggtaaaagtatgggcaaccttctccctagtttgcaccaacagcaagacgaaaggaaaaacagagacttatatcaagatgatacacgcactgaattttctgcgccgaaaccagtccgcgatagtccaataccgaggacgctcctcgctttctgttgcaatgtttgccaaaaaaaaaaaaagagaagagagcaccaaacacaatttgtttatctactggagtgaacaacagaacaacgtcgctaaatttcttgttaggaagaatggccaagaaggcaagaagtatgaacaagagcaatgaattttatttccccttgttgaattcaaaaacttgagagacttaaacttgggccgacaagggaagcaacgccacacggctcgtgtgaagtgcacatatatatacacgatggcgccaaacacatttctcaactcaccaggcgcaccgcaccatttctaaatcacatagtgctaaacccgccccctcttaattatatctccacttagcaaggtgtgtggttgcgagcttaaaacgcacccacgcagggccatggcgaccgatggcggcgtgttgcagctgcacccctacgccatggccgcggctgccgtggcattggcttcggcgtacatggtgtggttctgggcgctgtcgcggcggctgtccgggccacggatgtggccgctcgtcggcagcctacccagcgtcgtgctgaaccgggcgcgggtgcacgactggatcgccgacaacctgcgcgccacgggtgacgccgcgacgtaccagacgtgcatcctgcctctgccattcctggcgcggcggcaggggctggtgacggtgacgtgcaacccgcggaaccttgagcacatcctgcgcgcgcgcttcgacaactaccccaagggccccatgtggcaggcatcgttccacgacctcctcggccagggcatcttcaactccgacggcgagacgtggctgatccagcgaaagacggcagccctcgagttcaccacccggacgttgcgccaggccatggcacgctgggccaaccgctccatcaagtaccgcctgtggcgtatcctcgacgaccactgcaacgcggccgcaagcgtggacctccaggacctcctcctgcgcctcaccttcgataacatctgcggcctcaccttcggcaaggacccagagacgctgtcccccggcttgccggagaaccccttcgccaacgcttttgacgaggccaccgaggcgacgatgcagaggttcctgttcccgagcttgttgtggcgcatcaagaaggcgttcggtgtcggcagcgagcggagcctccgcgacagcctcgccgtggtggaccgtcacatgacggagaccatcgcggcacgcaaggcgacgccgtcggacgacctgctgtcccggttcatgaagaagcgcgacagcaagggcaaagcgttcccggaggacgtgctccagtggatcgcgctcaacttcgtgctcgccgggcgcgacacgtcgtccgtcgcgctcagctggttcttctggactctcatgcagaggcgggacgtggagcgcaaggtggtcctcgagatcgcctccgttctcagggagacgcgcggggacgacacggcgaggtggacggaggagcctctaaacttcgacgagctggagcgactggtgtacctcaaggcggcattgacggagacgctgcggctgtacccgtctgtgccgcaggattccaagtacgtcgtggcggacgacgtgctgcccgacggcacagtggtgccggccggctcggcgatcacctactccatctactcagtgggaagaatggagagcatatgggggaaggactgcgcagagttccggccggagcggtggctatcggccgacggcagccgcttcgagcctgtcaaggacgcgtaccgcttcgtggcgttcaacggcgggccgcgaacgtgcctcggcaaggacctggcctacctgcagatgaaatccatcgcgtccgccgtgctgctgcgcaactcggtggagctcgtgccggggcacaaggtggagcagaagatgtcgctgacgcttttcatgaagaatggactgcgagtgcacgtcaagccgagggacattgccagctacgtcgagccgtcggagccggcgccgccgcagggctccctcgtgataccgactaccaccgcagccgctgcgtagcccagcgtacgcgcccacatgaattgcgtctgattcctgctgcctggtgaggttgtcctgcttgtgccaaaatgattgtctttttccttttcacaattctcctgcactagagatcgaatttccttgcgtacaattaggattgttcgtgcctggggtcatattggttgtatggataccgacgtgtgtgatagtgtgatcagggtgagggtggtgtacttttgttgggatctattatattattaaaacaactttgtggggactagaaattcccacattaatcagagaaaaagaaaaaaaagaaaaggagagtccaagtagaaaatacaatctaaaaatagctgaaattcggaattaaaaataagcaatattaaaaaaagtttccatataagaacccaatacgagattaatcaaaattcgaaataaaaataaaataaaatccaaaattaggaaaaaaagagagtccaagtagaaatacaatttaaaaatagatgaaattcggaattaaaaataagcaatattgaaagaagtttccatgtaagaacccaatacgagattaatcaaaattcaaaataaaaataaaataaaatccaaaattagaaaaggaagggagagtccaagtaggaatacaatttaaaaatagctgaaattcggaattaaaaacaagcaatattgaaagaattttccatataagaacccaatacaagattaatcaaaattggaaataaaaataaaataaaatctaaaattagaaaaggaaatgagagtccaagtaggaatacaatttaaaaatagctgaaattcgttattaaaaataaggaacattaaaagaagagttcatataagaacccaatacacgagattaattaaaatttggaataaaaataaattaagtaacaggcctataaatgagtagagtggtggcggttgatacgacatataaaaattgttaataaaacatcaaatagaatcctactgacgattaaaaaggagggacgtcaggcaggccgtgaagtgtcacgccccgaactagtcccgaccggaactagcccgtgacgctccaaattaacctgttaatcgataccagtcctaggaaacagtgttggtatcacagggagacagagtatcacagcaacagaggtctctttattatagagtagaagtacagtcatgttgggctgcgggcagatcccgagctcacaactgcattacaaaaggaaagcggaagccaggacttggaccaatcatcacaggtgcgacttgggaactaggccgaaaccctaaaactcatcgtagccggcttgctcctggaagaactcctcgtcagcaggatccacttcatcttcttcagcaactaggtggggattatttatatggagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacattggatgagacagtgcgtttcgtccggtcggagtatgtgcaatgtgtcagtctttaagattggaacaaggttggcacccggcc

SEQ ID NO: 72130 - DNA, 66170 bp, Oryza sativa
cacgatgcaccttcgtggcgtttagcccagaaacgacatattctacgccacatccatcacaagcggagcctcatgaggactgtctaaccaatattactcacccattcttcccactgaaaaacctgaaaaagttgcacacaacggttggggagaggggagagagagtgtggaccgcgtcgagcgtcaccttgccccgcccacacaggccgctaaggagccgagcgccggcgagttgaggagattcggcgagccgccaccgccacccagaaccgcgagcaccagcgggctgaggagagaggggtgatgcggcgagccacagccgccgcccgaggcttagatcttgcaagcgccgggctaggccgccccgccgtcgccatcctccttttctgctgccgagcttgtcgtcgatcttctcctctccacatcgaccgtcaagctcatcggtctcctcctctccgcaccatcaagctcgtcttcctcctcttcgcgccgccgagctcgtcggcccgtctcctagatctacattgaagagggaaaggccgccgccggcgtggggaggaaaaaggggaaggccaccgtggggagagggagaggcgtcgtggtcctccttctcttcgctgccactcttcttcgcccccggagaggagcgtcggacaccgcctcggcttcccgctcgccgtcctcaccgcttgggctaccccgccgctgctccggtcgccgccttgcttcctccgccgctgcctcgcttccttttactggtggggaatggatagaggagagatgaaaactgagggtagaaaaaaaggcgggtgggacccattcaaaagaatatgcactgcgcagtatgtactacgtatctaacaatgtttctaggtatttttaagctgagttggaggctccgcaaatgtttgcgtcgcactgctaataccttaggccgagtttagtatcaaactttttcttcaaactttcaatttttcccatcacatcaaactttactactcacataaaattttaactttttcgtcacatctttccaatttcaactaaacttttaattttagcgtgaactaataaacacagcaaatataacgttattcttctctctctctttttatttggtttgattgattgatatggctttcgagacttctccactcgttaaactcacctcactcacagcttcagcagtcccacagaataatcacatctccaagttccgaccatgaaggcagacaggcaggcaatcaagaaaaacaaacgactctctgaatgggtagtccacagcacaaacaaacctgctttcttgacaccacaaacaaaacatcttcttgccccctactacaatcaacggacccgccgcctatctactggcctcacattggatgcgtttttaccgctgatgacaaaccggctgacaaaggaacaataaaaagaaacagctgtgcgtaggactatgctgctaccctcgtgtccttctctgtcgagaaaaccggcaacacattgttcaggttatggcacggcaggattattaccctaccgtgcatgagagagaagagaagaggagaacacacactcatcagagagaagaggagaggagcagaggccctacgcttaaagccgccattattgcggcctcctcctgctgccacaataaagctaccacttcaaaccagctatgtggacagctatcctaactctacgacgatcactttgaagcaaacaacaacagcaacccaagccccctgcaatgattcagtgcagttgcaccccccaaaacatggcccggaaatcgcagcctatttttttttgacctagcatacgcctaccttttctcagctgtgtgtgtatgcgcgacacgtttcgctgacaagcagctgttgaatagtcatccgatgatttatgtgagagatttatatttcctaccttcaatttgacacgattttagtaacttcattttgataatgaataatttacttttagattttataactgtagattttcataatttatttctagggcatgacagcctgagcatcttcgtaagggtttcgactacttagtcctcctgatctcctatcagttgtgaaatgaacggaacttcagggtgtttcacttcacactttagtcggttctggtggtcctagagcacattctccaggaagcccaaatgtgatctactgcggacgtcgtgacttttggagctctgttaggagtgtagtgaggctccgccgccaccctccataatataggagcaacatttagcttcccttagcggccattttctcctcttttttactttcccatggcaaagggtctttctggccgattgcgttgtgtaactaaaattctgcttcttccaatatattgacgtgcaatttctttttcgcattcgtgaaaaataattttagtgacaatttagattgttggatgggtttaagaagctcctataaacacaacaattgagccatacatacatagaagtacataccccgcctgccctacatgcatagagagcgagtagcattcccttccatccggctccatcgcttgccccactataagatccttcctcctactccatggatcgctttggagaaagctgcttttgcctacttggacaaacacaacgcaactgaaacaagttcatattaacaaaagaagaggaattgaagctggctggcttgctcgtttccaagctcatgatggcaagatgggcctagtagtttaatggaggcgtgtgattaatgatggtaatctacggcacggcatgtttttggttccaattggggacagcggattaatctaatccggagagggatgattgctgttgctgctgatgctgttggtcccaacagtggagcgcccctgatacggagcagagcgtgagtctcctgcgcgaaatccagtggggatggatccaccattcgcgacaactaacatcgaatctcaagcatcgagtgtgcggcaaataccatgccaactaaacaaaaactttgtactactatctctgtataggtgtagccctctaaaataatgacagtactaagatccgtttaggtgaagaaaaatgtggtcaggacaatggtagtatgatactgtatttacaattccaaggcttgattactagcagtacaatagtactgcatacaaaagttcagacaattgttgctctgatcatgagtctgaatgctgcatatactgcgatatttttctcaccttttaccgcggtagttgggggtggaatcaatcgttgtgagggagagggaccaagcagttctatgatcagggcaggcagaagcagtggtgcttactgtggtcataggattgaaatgtgcaattctggtgtaagggcctgtggtcattagttggcgaaaaaatttgcccccctgtcacatttaaaatattaagcatgatctaataacaaaaacaaattacatattccaccaaaaaactaacagacaaatttattaagcctaattaatccatcattagtaatgtttacagacaaatttattaagactaattaatccatcttaattcatcattagcaatgtttattgtagcatcatattgttaaatcatggagcgactaggcttaaaagattcgtctcgtaattttctagcgaactgtataattagttttttttatatttaatacactatgcatatatacaaatattagatatgacaaaatcatagagcgattaggcttaaaagattcatctcataatttcctggcaaactgtataattgatttttttatatttaatacattatgcatatatacaaatattagatatgacaacctgaaaaattttgtttgggaacccctaagccaacctgaatgcagcagctgctgctgctacgggacagcgctatcttaccccatcaataatgtaagtgcagggtgcaggaaaaggttgcaaccatggccaaaactgcagcagctcctctcctctatgacttccctcttcctcctcacataacacatggaccaccaccaccaccacagccatcatcatgatcatccatcccctctcctccattgcattgctcccacaattatcattgttatcaccttcctcaccttgggatggagtattataatctttcttctctcacaccaaggaagaaagaaaagcatggcattgagttgacaacattccactactagtggcatgtaaaaagagcactatagctagggcacacatccactgtcacagtcacagaggcacaaacaaaccatttggcaacacattttgctttgcacattgttcgtctaccatgcatcgccacaaccttatatggagcaagaaggaaaccaccaccaccaccttccttctcgaattataaagcaccaccatcatctcttatgaaaaactatagataattactatacctaccttcgccttcaaggaagttgagttctcctttaaaagaaaggtgaaaacgagctaagtaaaaagaaaaaaagaaaaagaaaaaaagaagagcgatctagatgggactcatttcccatggtgtatactggttgactgatcctgagcatctctcatctcaaccatgatgatgacgatcacctgtgacctgatgagcttcttcctccttgactcctggttggttcactttgttgaacaacagaatgaccagaagcagcagcaggaggaggaagaaagcaaaccggacactggagacctcacatcaccgagcagctgtttgggttctcgtcgctgaagtagttgtagggatcggcatgcgggtggggctgcatcgggtagtgcatcgggtacggcatcggcggccggccgtacccgtaccccatcgccgggtaccccgccggagcagcgccgccgccgtggccatggtgaccgtggtggtggccatggccgtggtggccgtggccgttcatcatcatctgctgctgctgctgctgcatcatggccatgtactgctgctgggccatggggttgccggccgccgccgcggcctgcagcatctctgggccggacggcatgccgccgccaccgccgccgccgccgccctggtagaacgccgccgttggcatgccctgcacggcgccggcgccgccgccctgggcgctccccatgtgggggtggtgggccatcggcatggtcatgggcccgccgcccatctggcccattccggggaaaccggcaccgccccccatcatgttcggcctcatcatcatggcctgctgctgcgccggcatgccgcccatcggcccaccgacaccgccgccctggccgccaccgccgccgccgccgcccttcttcccctgagcaggatggttgccgccgccgttcggggcgccgccacccttggcgttgttcggctgcccaccgccgccgccgttcttgccgttaccgcctccgccaccttggttctgcttgccaccggcgtctttcttgccgccgccgccggcggcgttgttagcgttccccttgatctgcacggggatctcgttgccaccgccgcccttcttgccgccacccttcttgtcgccgccgccgccggcgtttggtggcggcatggccatctgcttcatcatcttgggatcgtcgaagtagtcctcgtcgaggccgtcgtcgtcgaaatcgtcctcatcgtcaaactcatcgaactcgtcatcaaactcgctgccatcgtcgccgaagtcatcctcggggggaaggttgaacttgacggacttggggtccttgatcggcgcggccgccgcgaacggcgccatcttggcggcgtccatgaactgcggcagcttcagccccttcatctgcagctgctgctgcagctgctgaagctgctgcggcgtcggctgcggcatctgcggcggcatcatcatcttcacgtctttgctgccgcctccaccgttgccgccgccaccgccgccgcccttctggcccttgccgccggcgtccttgggatgccccttgccgccgccatccttgggctggcccttgccgccgccgccgccgtcaaggtggagcttctgaaactggttgttcaccgccgccaccccgaccttggaaccccatagctccgccggcttgccggccttgttgagcttcttgataatggtggccggatccaccaggccagacaccgtcaccttcccctgctcagcgtcaatgctagtctggtacacacctgcagacataaatccaacgagcgtttcacccagaaaatttcaaaccaccatataactaaaagcaatttgctcataaaaaataatctctcttttttctgttaccttcgatcttgtggaggatcttcttgaccttcttctggcacccatcacagtggatgttcactttcagcacacaagtctgggaatttgggaggaacagagaaaacacaggtttaccaaaacagcaaaaacagaggcgttttcgaagaaaacatagcaggagaggaacacaccaggtgaatgaaaaagaaaagctagctgccctgtcttaccttctgatgaaaatggcagcaaaaacaaggagaaaaacagaatgtctgtatcatggttttgagttgagaagaagcaaaaaagaaaaaactgacctgaatcttgaggacttcctccttactcatccctgaccacctcaagtgcggcgccccccaccaacacaagcacaagaggaggcctcctcacagatctggtacaaagagtcctcaaatcagggacagaacaacaacaacaacaacaaggcagcagcaaccagtaaacattgccctctctgaagaaagggagaaggtatgatgagcaaaacagacaagaaaaatgccttctttctgaagataagttaatggcctccaatataatatctctcccttcacacactcacaccaagagttagtgctatggagagagagagaaacatataggcttattagagtttgcgtgtttgcagaaaaccaagaaggatggggctactattaagccggtggtccagagaagaagggagaggaggaagaagaagagagcttaatataaacacaggcagcaccatctcctcttacccttttgtatttgctttcgccttcggcactgcagccttgcctggaagaaggcctttctctttgcaccctccacagattgtgaaggaagggaagcctggggctcttgcaaaagacttgaagagaagagagaattaaatacccactttgtcacttgtcagtaagtacagggagatgttcaacatgtgaggtactcatcagatgtttacgccgagctcgcaatgtcggttttttcttgcttttttgaaaaagtgtccagaaaatcttgtttttctgcaaatttcatattagcccttctagcctctgtaacttgcagttaagactgactctgcagcattttggtcttcggggttcttaaaaaaaaatatttttgaatgtttctcaaaagacttggtgaaaaatttagcaaattgtacgtaggatgacaccgacgcatgaaaatatgtttcatgcaaaaattaagattttacgtgaaaaaacatgcaaccaaaccatccatgcacgagcgcttgtcctattcggtcgtcatgtattccatgcattacatttacagtttatatgacaagagcaatacgacgtccgtacaaccgacatataaagaagcttttaatgattcaattgtaaacgagtagtcttggccataacgtattccatgtactccaatccattgtagtttgtgtgacgagagcattagaacgtccgtataatcgacaaataaggaagctttaactacttgcaacgcttcaaaacgggtagcggttatgattctccgacgtttattgcaacactcgtacaacaagatatacatttccgttttgtagcatatcacattatttaacgatgtagacattacatgcttgaccttacaagctatattttcggttacatacgacaacggctagtcagcttctcagactcaacaaatctgtttttgtcgagaacagaagaaataggcatatcacgttttctccggtctatcaccctatcaattcaacgtaaagataaaataggcactaaggtagtgcaaaataagaaaaatacaactactagagggtttttaccggcgaagtaacctcaaccagaattactctcttatgaaggggctaatatgcaaaacaaaaggagatgagaaggggttccctgtgctgtgctgatcacgcgcccggtcaatcgtgtaacgcgcgtagctttgggcatcgtcacgctgtgcaggcagggcaaggcgatgtggtccgtagacgcgccgcggccacgccatctcatctctatctctctctctatctatctatctgtctatctcccctggctgcgcggcgcccgcgccgtgctgccgtggcgagcgagccgtgtgcgtgtgcggcgtgggctgcgcgcgccgcgcggtgcgcggtacgtacgtcgtccactgcaaaccgccgcgagccaagccgcgcgagacgacggcaacaacaacgtacgcgaggcgcgcgcgcgcggtcacgccatcctcgcgctcgcgctagctagcgttggcgttggcgtggcgcgacgcgcgagcggcagcggcagcgcgaggcgagcgctctccatgcatgcatatccccatgtctgtgtgtcagaggagggaggtgagcacaataactactcaggctcttattgatgacgccctcttaacttggcctttgcctctctctgcactgcacctgcatgcgtttcacctcccctgatttttttgtccactctttcccttccgttactgtcttttactactactccctctctctttttttttctttttgtttctatacgcactcgtctctccaaaaaggaagaggagaaaaaaaaacgtaaaagggctggtcacaaaaaaaaaaaacggaagggaagggatggtaaagtcttggtcacgctgacctcgcgcggtgtgacggatggatggacggttcacggctcatgcgcagaattgcagggtagtattgcagttttttgttgttgttgtagcagatcatcgtggtttgacgtcgctgacggatgaggaaggcagcagggagggcgatgggtgacagtttgcgtgtcgctgtcgcagctcctgctcctgcatgccatgccactgttgcgatcgggtgcacttcactgttcactcgtaaaacacagcaccatccagcgttcgatccattatcatctactacgtgctcaattaccctggaaacagttcggttaattcagagggattgacacaaacataaatttgttaaatatttggagatatatactgtactccgtattttacatttcaagcgaacaattaaaccaagatatgtgcagttgagctgaagatatgattgcaacatcgtcatcgtcgcgagcaaatcgcaaatcgaggttacagatttgttcgtatatgcactctcatctttttgacgaagagaggcaccgcaccagccttgcatgcatgctgctagtgtgctggatcaagctagattgatgtcaggtagccaattttgaacttcagtttctcgcgaaatttgctgtcatccatgggatcgatgcagtgacctgtatacattggaaactcgcgtatatggatgcatgtatctgatgaatttctttgtatgcatttgctatctttgcatgcagtgtcttaatgccatgtctactttgattgctatgtgcctatgtttgctactgcaagaggacaaggaggtagtcgacatatatacacgtacttgaatttgtactcacatgtagtagtaattgttcatctctcgcattcaggcttactgtacaatcacaccttgcaggagtaccgcatccgtgtgactctccactactagtatttgttctatctcccatatgaaaacaagaggctttttgatcatctagtcattgacacactcgcaataaattggcttgacgtattttgcagctgtggtcgcgttaacttatcttcataaaattccaacagccaaacagaaaaaaaagataccacaccaggcacaggttcgttcttgcgtgccttgtgagtgaagaagatgtttgggaagatgaagatggcacttcgaagttttcttttggtgaaaccatgaaagggatcgatggctattgtgctgggaacaagttcctctgacatgctgttctctaacgcgtggatcgttaacatatcaatcatttaaattcagaagatagtagtaataagttagagcctcattggttactcttacaagctactccatccgtcccattttaagtgtaaccatgagttttcgcgctcaattttgatcattcgtcttatttgatttttttatagttagtattttttttgttgttatgagatgataaaacataatagtacttaactcgtgatttatgtttttgttttttttcaaataagacggacgatcaaaattgggcgcgaaaaaccataactgcacttaaaatgggacggagggagtaaagtcgaagctaaaatttgaattatcaaattttattttaaagttgattttaaggtatttttaattagtttttaaataactaaaaacacacatatataaaattcttattttctaataagtcgagctggggctggacggacggcgccaactcgtgggccaccttgtgcggcctagcaaacgtttgctaccttgtagagatgtcactagtgatcgacttttgcaggagaagttttcgtggagaagcatgcatgggccggatggattagttggtacagtagaaaaaggggcacacaagaggccagaatgtgaccgatttttttgttgagatcgacttgaggaggaacacgttgcatcgcatgcattttggtggtgtttgccgggccacccaccgccatgcatgaatcagtcggtcggtgtgacatgattttgatggatcatgcttgtcctaattaatgtgggtgccatattgcatggcaaacttataaggttgtgtttagttccttccaaaattgaaaatttgagttgaaattggtacgatgtgactgaaaagttgtgtgtgtatgacaggttgatacaatgaaaaaaagttagaagtttggatccaaagtttgaatctaaacatagtctaagtaaatcactgcagttttgcaaccggcatatatcctgaactctgcgattgaactagctggactgaatatgatcagtcgatcatgacttggctaattcggacaggtagggaaagcaaaggtatatatggtatgatggaggctggccttgcacagttgcactttccaagtgacagcaactgaactcacaagaaaacaatcggggctactcctaagttggactctgatcacgtacactacggaattgaagcaaagaggttacttgcattgtcctatataagcttggcaaatggcatgcaaatgtttacagcatatataatagcggagtggattctaaaactctaagagattccttacttgcatattatttaaatggttataaaaatattagaaaattcaataagatagttaacgtatattcaacaagacaagttgaaaaaaccaaattaaactatgactaacgtatattcacaatcaaatttgttttctttcgttacatcttatataagttgaatttgaccttgtatatttttggagtgatttatcacattttaatcgatcttgtttaatatttttacaattatttggattaaatgcaaatattattagtagtagtacattggatatgcatgtcggcacgtctggttcatgagaggccatgttgattgattatgaaagtaggaaattaaagctttgattattgttgcctagctggtttcatccatttgtagcgatcgatggcgtttgagatcattaattctttcaagctagctagccatcggtgttttggctacttttgtgtgcccatctgatgtaaacctgcgatgtataagttgtctagaactctagattcagcatgcatgggaagcagacttgacattatatccaatccaaggacgacatcgatcaattgatcgacataaaaaatactgtgcaaaacatgattacctactgctcaatagtatgatataatgaaccatattattaccctctaccaggtcccttttgcaaaagacgtgataaattcttgcgcgtaataatattaatgttgaaattacttgctttgacgttaaaattaacaacataccgagagttatcatataattaaatccacacaatacgttcgcaacacatctatatactccttgattaatgaatgactttcatcaatcaggattaaggaccggtggtagtaccttgtaagcattgctaaagcaaaattaaaggccatgatgcttatcttgaacccagcacgtgattcgacaatagagaatccccggcagggatctacccatcaggcagggtgggtagaccgattcagctacgactcgtgtcaccccacactcttaacacccccttatagtagtcatggactatcaaaattaggtataacaaggtataaacacataacaaattaagacagttataagaatgaactattaatacgatatgtattgtgttcgattgcttttatcgagtgaacttatctgttctccgccccatctatagtttagagctgcgtccgccactaatccccggctatctcgcggtagtgaatgcttgcgaaatgacccatcatgtaaatgacgagatttcaacagacttagcagtcataattatgcacatcaacatttgcaagtacaacgtttatactgcttagatggcactttacaatagatttgtttttatagaaaagatttgatttaatttagagcatctccaatagaagccgtatatgttccctacagtcaaatttgaggatttcaagtccataacccaccttaaatgactgctcaaaacaactcccgggttttacagagccccgaaaacacctcaccctcgctagttttggggcgtttttggagcccatgatccgtccctaccctcattctctcgtccagccttgcaatccgtgatgtggcactggtgcggatcaactagagctagctcctcgatgaggctttccaccacatccatctactctgcccaccggccacccacaacatgagtagccatgccacgggatctatggcgttaccggccagcacctaaagtcattgttacaatcgtccacaattgtctctgtgtcttatttattatattatgtagttatgttgagtaaaatatgtgattttgtagtcgtctaacattttcaacatacattactagtttcggattgatgtagaaatgtttcctccatatagttttgtctcttatactgtttttgattccatatcggaggaaatatatgattgatgctgtgttctccggctcgagttgggaacccttcccccattatacacaaaacaagtgacggttttacatatgattaatcaagtaatagaaaagaaaaataaaaaattgattaatatgatttttaaagcaacacacacacacacacacacacacacacacacacacacacatatatatatatatatatatatatatatatatatatatatatatatataaaacacattgtttaattggaaagcgcacacgcgaaaaacaagggagatgatcaaagttgggaaagtagactaaatagcacatcctgagactgtttttcgaccatttcgaacccttttttttcatagttggagatgctctttgatgatgtgattcggttattgggtttatcgctctcttttacaagcttcctttaaaaggcgctaaaatttcactactacaaaatattgaccaaagaactattccctccgttctaaaataagtgtagttttgcactattcacattcaacgtttgaccgttcgtcttatttaaattttttttataattagtatttttattgctattagatgataaaacatgaataatactttataagtgactaaatatttttaaatttttcataaatttttttaataagacggacagtcaaacgttgagcacgaatatctacgactgtacttagtagttcagctcatccccaaaagattctctaaatttccaacctgccgaaggaggcgacggacgattttcctcttgccgattcggaatgatttgatttgaagtgtaataatggaagcggatgattgttcatgggcatctagcagggggccctggcctggaccagctgctaggctgcccagtcgatcggccggctttgggcgctcaccaaggcccgtggcctcggcctcctcgctcgtttgggccacagtcgtacgtacagctgatgagcgccttctggtcttgtcgtcatgggcctcagggaccacgcgtatcggcgtatgtacgtacaataatacgatcgatacatacgcggcgggacatcaaattatgtttcctgattccgagtgtatttatatacgtacgtacgtacgtgtgtgggcctcagcaaacagcagtacgttcgtgtgtacaatatcgatcacacctgtatttgcactattgcagtgtgagcacagctgggaacagtgtgtgattcggtactaattaactaagggcaccaaccaaaaccaattgatgtgatcatgatgatgatggtgatcatgttttataggtacgaaattaactgatcaatggtttgttaagatgagaaattttatagtagtacttaaaaaataacttgagatatctacattaaaactgttagtatctcaatgtacattaaaactgtttgtaggtactaaattttataataaaaaaattgataccttttgatattttctcaagaacagtaaaattagtctattcagaatggtagcagcacagaaaaccacggttaatacgtccgcctgatttatttgaggctacaaatggaagaacaatcagccccaaacctgtacgtacacgcgtttaattagtattccctccgttctatagtagatgacgtttttgactttttatttgcaacgtttgaccatttgttttatttgaaaaatcagtgcaaatataaaaaaaaagtcatatgtaaagtacttttgataataaagcaaatgataaacaaaataaataataatttcaaaattttttaaataagacgaatgataaagtacttttgataataaagcaaatgataaacaaaataaataataattctaaatttttttgaataagacgaatgatcaaacattgacaaataaaaaatcaagacaagtaatatgggacgaagaaaatcaagacaagtaatatgggacgaaggtagtataattgtgaaaaaaaaaagagaattgcacgtgacaataacgtccagatcatcgagaccacgagctgtcttgactctgagtctggacagaaactgtgagagagtgagtttgtctgttttgttttgttttccgcgcgcatgtttcccaatctactaaacggtgtgtttttttgtaaaaattttctatagaaaagttgctttaaaaaatcatattaatctatttttgaaatttaaaatagttaatactcaattaatcatgagctaatagctcacctcgttttatgtatcttcccaatctcctcaatccccttctcctcaaacacacccttagctagtgtgtactactgttagtagtgtaccactgcagggttgtgtacgtgggctatgtttagtttctaaaattgaggagaagtttggagaaagttgggctgtgtttagatccaaagtttggatccaaacttcagtccttttccatcgcatcaatctgtcatacacacacaacttttcagtcatattatctccaatatcaaccaaaatctaaactttgcgctgaactaaacacaacttggtagtttagaaaaaaagttgggagtttatgtgtgtaggaaagttttggatgtgatgtgatggaaagttggaagtttgagggaagtttggtgtgaactaaacagggcactggtgagagcggccgatcagcgtcgacacaatgtaaggccgagtttagttctaaactttttcttcaaacttctaacttttcaatcacatccaaactttcttacacacataaacttctaacttttccatcacatcattccaatttcaaccaaactttcaattttagcgtgacataaacacatcctaaggcttctcacagtgcggtgagctggctcgtgccttacctgcgccatggaggattttcgcttaggtggagctaggaatcgcgactaagcttggcccctcgtccccaaacatagcgacacggtaccacgctttgacgagtccacgcgcgtccgttctttgacgcagcgtgtccttgcgccgcagccgctcggagaaatcccaaattcgccctccaaaaatccagtctgcgccgacgttcttgctgctgccgacggcgtcgtcgtcgtcattggccacaactcaatcaaatcaaaacaaaatcccaaacaagataccaagttcattcaatcccaagatcaaatcccaactcaccaagacgagaaatttctccttctccgagaaacaatctgaactagtatatgcacacaaagatgaaagctaagaaaagcagcggacatttctccttctccaagaaattttgcctaacgacaagaaggagcaggcgcaggacaagccgccgccgcacctacacccgcacctcctccgcgccaccgccgctggcccggcccacccgctccttctcctggcggcggtggctggtgctgcgcctgcgcggctcctctgtgggcgccggcggctccgccgacgccgagccactgcagctgcgaggcggcatcagcacggcgggcgagcggcggactccggtgacgcggcgggcgagcggcatcagcacggcgtcgtaggcggggacacagaggaggatgctgaccacctcgaagccggcttcccgtcgtcgtcgcgtcatcttcccatcgggacagagaagggaagggaaggaggcgccgtagccacatcccgcgctgtagccacagacggaagggcgagagacgggtgagaccgtgccgccgccccccgaagccgaccgctgccgccggggatgcgtcccgccgccaccgcgccagtcaccgccgttggggacgcaccccgccgccgcaaggggttggatagagcgaagcggtcgaggtgtccgcctgcgtgctgggttggagagaggggtaggtgaggaataaattttgctccgttaccgtgtccaaaagcctgggttcacgcccactgtgggcttcgtttccttcatcagtgtctccatccaattaagccacacatatatgggtgcttacactatgtggtggatgtctttggactaaccttttgagctaagggcacccgcaatggttatctataggctctttacaagatatccatgtcagcatattttcctacttggaagagattaaatgaagagagagagcaaagctatctactaacgtggagatagtttatagagaaaaacgagacaatgcattagagagctatagatacccatatagacatactattgaggtggtttactattaatctagtctattgctaagatgtacatgttttacagagagcaccttactttaacattacgggtgctctaaggtacgggccccatgtcttacaatgtgagaggcctaaatatgcatcatgcatgccttggcagtttggctggttcccgtttaacttcacataacaacaacgactcagcgctcggtccggatcgcaagcaacgcggccaccgcgggatgctgccggcggcaaatgctcctcgatcggggcaggaaatccacgcggattcacaaaggcgtgtgggttagtatgtactccgtactagctagcctgtacactaggatcacgcacgcacgcacgcacgcacgcacgcacgcacgccggccggcctttgttgttgttgttcctgcgccctgggcagtcaatggatggggtgtggcacgcgcgtcgtgcaaccgcggcaacatcccgtgactcgcgtgtcggtgtcagtagttaacgattggggctatttgattcaatgcttcaatttgacacaactccttaggcttgtgtttggtttattgtcatagttatagcaagccacactttctcaccgtcctaccccacatgtcataaactcaattctttgcctaactttgccacacgtgtggcttacaatttgtaggaaaaaaaaacgtgataagtcacatttgtctaacattgtctaaagtgatttatatcaatgttagttaagaaccaaacagcccctaactcctgtgactgtgtgactgcaacttgcgtttgcacgccgcgtaccatgtccgtatataggagtactgtactacacaggttgtgctcgccgctgctgccaatacagctagtagtagtagtagtagtacagtactgtacgtcaatgcccgtcatgggcgctcctgcacccagcagctagctgggtcgcgtggcttgcgtgcctctcaaacacgtacgatcgcgtgttcgtgtgcaccgtggaatggctcgcggggctgcatctgtagttgtagtaggctattttgtagtaattttggaagaaaaccaacatcagctctagcctcatgttttctctttaagtcttgaagtttgtatggttttccagtagtgttgccaaacggtatttgttgcaaatgtctgtggttaaaattcctttaggattcaacgaggcattattcccgcatttttactattcttgtttttctgaatcccatattccaaagaagcccttaacgggtattaactattgccatccaatttctatcctgaattatggtgcatacgaaattacaaaatcggatggtacatacatgtccaaatttctcatatacaatttttgttctaaaatataagcatatgttgcatatcttaactaattaagagattcgtattttttctttcgtcacctcgtccgtgcggtgattttcgctcgccctcctccccaacaaaaaaaaaccagtcggaattccatcatacaaataaaactgaagcgtatgaatcgaagacaaggacacaagaagaaaaacgataccggaaggagagggtgccgctgtcgccgccgaaccgccgccgccgtcgaagggacgctggttcgccgcggctcccctcctgctggatccgattgaggggaggctgggccgttatcgcctcacgtcccctcccctcctgctagatccgggatgccgggtctaggccgccgggccgccgccgcctcccctcccactagattcggcggaggggagggtgccaccgccgctgggccgcagcggaggggagggcgccgcgcggaagacgatggggaggggcactgcgcggaagacgacagggaggggcgccggggcaaggccgcttgatggcggcgcactcaccctcgggcaagtgcgcacaccggggaggaggcatgcgccagtgccgctgcttttctcttttcgggcgagggggcgaggaggctagggttttcaccggcgccgggagggatggggttttgtcccttcaacgtcggcaccggtcgtccgatcaaaaccctaagatcagacggccggcactggccgaaccgaattcggcccaagtagaggcgcgcgcggggaggcttccccagcccaggcccaggttgcggcccagggaggtggggagctcccgcatgtgtacataagaggccgtgggccgaccagccagtccgggagaaagtctgatttagatccctaagcaacatttttttttcaatgtacacactccgtaatcacccggtgcaacgcacaggcacttttgctagtctgaatatactcaagaacaagagtgaatatttatatccctgtaaaaatatatcaggaaattaatactattttctcacaaacagaacatatcacactgcactgaacagccagagcactcatagtactaaaaacatgcatacacaagatagcgagcaatataatggtatcacaatttcctggatcgagagggggcttcaattaggccgtgtagacgccgatggaatcgagcaattctccagagcggccgaagaagccgacgacgcggccgctggcggtgaacgacgtgccctccgcgcggccgaacgggccgtacgccctcaggttggtggccaccctcagcgacatcaccaccacgttgctgttgtacgcgccgtacgtcccggacacttccatcacgtactccgatagccccagctggatctgcatcgtcgtcacagtacacgatcgacacaattgtgaacggcacgaacattattttgttggacatggatgcatcatgttcaaaatctagtatatatataaaccacagtggaacccgaattaatatttcaccttgggtgtgcaattaatgatattcaaactctacatgaaccactgttgcttcctctggggagaagtataaggaattagggagtattttcaataccaatataattgatgcatattgtagaaaaaatagtgttaaggtatttctagaaaaaaatattatagaaaaatatgaagtagaatgctttatgcacggaaaattgacatataattcaaaagggcattcttaattatgttatatttccatgttaaaaaaaattcatatactcaccgtggttgtatcgcctccactgctactgccccatgggccaacagagcgctactgaccagtttggtcagtgtaagaaaaggacatggagtcaattgtccagccgtgacggattgttatgctttctaaacgctggggtgcaatagggatgtcgtgaggagtgcctccagttccaccccatggtccaaccttagtgggatggctttgctgaaatggattgaaagagttacttttgctttacctattcatgatgcaaatgaaatatactttttttgcacggtatgtctaaaagaagatatttctcttactcctatggtcataaatactcggacagctcttgaaaaagaaatgttggtgactgaactaattgcaaaatacatgtaatgcttaacaatttacaagtttgtgttaaattgctctttaagccaaatctagtacatgattttccaaaataccatttgaaggatatcgatgcttaaaacttatagaagtatgacaaaaaacattgtccaaaattatgagcattatttgtgactacatcagaatgagtagatggtagcaatcagagttctaaggccaaacaaaccacacggagaatagcattctttcagataacgggtaaacttccattaatacttactccctctgtttcaggttataagatgttttaaagtcaaaattgctttaagtttaactaagtttgtagaaaaaagcagtaacattttcaacccaagacaaatttactatgtaaatatattcaattatttatttgatgaaactaatttagtattataaatattactatatatttatctataaacttagttaaatttgaaatagtttaactttgatcaaagtcaaaacgtcttataatctgattataatctgaaagggagggattaaaaactaatgaaacagaggaaaaacttggtcaaaatttttgttcaactcacattgtacgtgggcatggggtactgctgggatggtcccattggcagagtctgagagcctctaggcacagggcagaatccatggattgtaatctctatgatgttgccatcgtttctccgttggtgcaccctcttctggatcacacctcctgccatggcgaactgaccggtcccaccaacaattccccattcaccgttttcgacagacacttgtcgacgtttgatgtctcgactacggtatttagacagtatggggatcgttggtgctaggatatatgcgagactgaggtaaaagagatggagacagggatttttatacaggttcgggcccctgagtagtcaggtaataaccctacatcctgttggccgaagccggtattgctcttattcaccataatcataccagtacaatatgtgggtagcctatctaactgttgtcgacatgtcggtctgaaggtctgactcgtagtcgacaacagggtagtcttcctcctcgaattcgtgcccggcgagatcagagatagcgctttcgtatctcctgacagtatccggaggcaccgtaggagaatagccatgcctatccctgaagtcgatatccggcggcgtgtcttggcgtatgtaggcttctatgttgtggcttctatgtcgattgtgttgggtgttgatcctgttgattgtctccttgtgggtgtccccctgtcctcctaggggggcttgtatttatacccataggtgtttccttgtccaagtagaactagggaaaccaatatggatacaatccgagtagtccttgtcatttccatgtagaactctggttctctttccttatccgaaactccctccatatctgaagtcggtttccgtataggacatggtatgtggtgggtcctgccgagatttagtcaactactattaggtatgtggtatccataaccataacaacactcccatcaccaaaagcgtggatcccctaaacctaagtacaacacaaataaacatgtcaattttttaattaaaacatgccctttcagctatatattattctaggcgtatcgttcttcggtgctcaagtgctatcttcgtcccgaaataaatttattttcatacatcctgcacataccaatataaaccacaaaaaaaactagaatacctctactttatcaaatctcaatgcaactatttctcactccatctactctcaatataattatatcatactttcataaactatgtttcaatgattactcaaaaacaaacttattttaagacaaatggaaggggctaaaagtaaatttaatttggaatagaggaagtactttaacaatgtgacgaatataactgatatgtaaatacaatgtaaatagggtgtaactactacgtaagtactaactaaagtgttatgtaattattgcataatggatataactttagttttggcaagggaagaaaaaatggtgccatgctcaattggtttggtgctatcactacaacttagaagattagaagaccagggtttcgatccctgccaccgtgctttgtacattttttctgctactacgcactagcacagatatcaaagtacatcctatggccaaaaaatcgactaattttcataaaaaactgatgacatatttatagcaaatccgattttatttttatatttgtttaaattgaaacgtgtcttacaataaagttatactgcctcttttcttaaatagatattgccctaaaacgtatatatagtcaaaccttgaagtcttaaataattaattaatataaaaatattatgatttgatatgagaaaacgatatcggtgtatttgttataaaaagtacattcatatggttatcatatctttctagcttttataaacatgtattccctccgttttatatcataagactttctagcattgtctatatttatgtatatgttaataaatctagacatatatagaatttcgaggaagtagtaaaaaaaaagatggtgatataatacatgtactgcgagacggtttcaatgcccaaaacgacaagtaaagaaaacacggagggaattgaagcacgggtacctttggtcctcgaagacgatggtgaaggagttgtgccagtcaccggcgtagacgtggagtccccgcgcgcgggcgacgagggagccgaggccgtcgtagatgggccagttgttgacggtggtggcgccgagccccgtggcggcgtcggcggcgagcatcaccgactgcgtcgggttgggccccaggtagagatggtgcaagtagaggttgcggaagttgagctcgttgtactgctccaccagcgccccgcacggcgtcacctgcaggctactgcctgtaattgggtacccagagctaggagggtaagccatgtctcagcaatagctgaacttagctagcttcagacttcagagatcgattgtatgtgtgttataatgttaatatgttgtgtgtgcctttgctatcgctagacagtagacagagaagaggtgcaggattgtagctagctagctgctgggagaatgtggagctggctggagtagtggtctccatctccagggcatatatatcccatatatatttgggcatacatgggtgtgtgtatcacgagtgtggctggccacatcctccatatcgatcgtcgtcctagcttgatcaaaacattggatagcattgttgattgttgaaaggtcgatgcggccatagcttgtgtgtgagaaacgtattgtatgtatctaattcatttggtggttgttctacaattcgcgtacgtgttcctttcaatcggattgaaagttgatgttctcacttaagaatgtacatactgtaaattttcatgattaatatgctaataatgagatatttgagagagaaccatgcaagtttctatggttaattgtgttagaatggaaaattggctttgtgttagttaatatgattgttgtgaggggaatatgattgtttttgttggcgaaaacaatgaaaaatgcttaggggtcttttggttagctccataagatggtgagttagctggcctagctaggttcaatttttttttaagaggggggtattgtattcaatatgcttctgcagtgataatggtcctctatcataatgatcatcttccattcaataatttgcccacaatgtaatgttatccacaaatttatttagacaaacattgaacttgatagcaatgccatgcctgttagaccaaacacagctatctccatcagtcttccaatcaagcacgtgaggtggatcatggccaagttcagcaactgtcctattaaacacaacaaaatatatatttgattcaaaattatgatttgactgaacctgcatcaacaaaatttaaaattaattgttcatccccggtacctatgccgtattggtgtcatccggatgatctgtcaagcgttgacgttcagttcaattcagaggattccgattcattctatgctgaattattctccatatcttatctggcaaacctgtttaacgtcgagaggccttgtttctcaagttatgaagtcatatgacgaattcacgatgacttttgtctagttaatgttacatatactgcgcttgatttcacaagattgtcgccatgctctagggcctattttgggagctttagattctgagaagcagctgtttggtagccagcttctgatattctggaaaaactctgaaaaccagctgtttggtagctaacttctgatattttggaaaaactctgaaacccagcttctatagcttctgacttcttagttcatttttcagaatctgtaactacagatgaaacccagcttctgacttcttagttcatttttactacagatgaaacccagcttctacagcttctgacttcttagttcatttttcagaatctgtaactacagatgaaacctagcttctacagcttctgacttcttagttcatttttcagaatctgtaactacagatgaaacctagcttctacagcttctgacttcttagttcatttttcagaatctgtaactacagattcacagcttctgacttcttagttcatttttcagaatctataactatagattctcagaagctgtggactatttggggcagcttttaagaagctgtgaattgtttggggcagcttctagcagaagcagcttttgggaaaagctgcagttgggacaacctcccccaaacatggccctagtgtctttggaagccagagatctgagccctaaatattcttcatccgacggcaacggcgtgtcattcttggtccggcagccctatctatgcagctcagcaacgcaccacggcttgctattaatccaactctaatgcaaattaacaccaccaggatttggaagtcacaaccagtgacccaatctcttgcattcaaacatgttaaaaatgttatcaaatgatcaaatgaaaacatagatgataatttacatgtgtacatcctaaatagaacctaaatcggcacgtttagccgatttaggatcgcctgtgccaatacatggcacagcagtaagcatctgataaattcttgcttctggtcctgaagcaaccacatgttactgggatccgttcttcttcatcctcagaaagctaactaatgtgagcctggagggagcaccggttcccggtctcctcttaattgttgtcgtcttccacagctttccatctctcatggtagtcgtggttgtagatgatacgttatagaactgcatacagacaagttgtgactggaacttaaaatgtttggatgaagatttaagttctcaagaattgttgagaaaatatttacctcacatacaccatgcagaagcaacctctgaaacggatcctggacattcagtacaagcacatctttaccactagcatcttcaatgaaggccctaattcggtcctgcaaatgtgaaaagcagattcaccaatatcaaataactaaggcttcttaagtactttatgtaaagaaactcaaacacaatcatattgtaattgttaacttgcacttgcattcacgtcgcacgtgagtgtatacatcaaaagtttcacaagactgataaatgttggcaaaataagcactcaaccatctcatttctgagaataataacacatttcacagtagcaataacagacaatcaggtcaccatgtttaagcctgaagcctgagcaacaggactgcttccttttcattaagaagataactatacagtaccattccaaattgcagagacagatgcaagagcgaacagaacatcatctaaaaagcttaggtacccgcactgttacttgtaagccagctattagggctagcaatgccaggagagattttctcagaccctcaaaagtgtaaatcatgttgtaaaggaatatttctagatgtatgtttagatggtccttaccttaccatgagttgtacagaaaaatcttttaaaccaaaatggttaatggtgtaataagataggtgatgatctcagaccctcaaaagtgtaaatcatgttgtaaaggaatattatagatgcatgtttaggtggtccttaccttaccaggagttgtacagaaaaatcttttaaaccaaaatggttaatggtgtaataagataggtgatgatctcagaccctcaaaagtgtaaatcatgttgtaaaggaatattatagatgcatgtttagatggtcctttaccttaccaggagttctatagaaaaaaaattaagccaaaatggttaattgtgtaataagataggtgctgatctaagaccctcaaaagtttaaatcatgttgtaaaggaatattctagatgttagatgtatgtttatatggtccttaccatgagttctacagaaaaatcttttaagccaaaatggttaatggtgtaataagataggtgtgtaatgcaattccacgctacaaccaaaaacactgtaaggatccctaaattgcacctaattgtttgttcgaacttgctcataaaaaaggtgtttgatcttttaaaactacaaaatcagaaagatgcatcaagtagtaaaacaactcccaactaaacaaatctagtaaccattgtggcaaacagaaatacaaaaagtatggcaattggtttaaagagtacaatcaaagagaaagaaaggcatacctcatatatgtcaagcagatctgggaggaaatttctctttatggcttctcttgtttggcgatctatacgatgccaagcattgagagcaatcaattcatcgctgtccacatgattcttctgttttgtagaagattgtttcatctgttgcatcaatcgtgcctacagataaaaagcacagtaagcaaaatggatccctaaaaagttcacatggtatctagatgataggcccttttttctaattacacggtcggtttgatatattattgtcaactcaaggtggacaacacagattactgacgcactagcatacctcaacgtccatgtcaatactcctgaaggcatcccattcaccatcacttgtcctacaaaatgcagaaacgggcagttcctcacctacatgtagaatatagataagtataacatacaaaaaagatgtggaacatctctgtaataatacatcgaaaatactaatttccctgcagtaaacagtcagcacaattaaagtgcacaactgaacataagcacttggaaggaaaaaaagtgtgacaatcagggaaactggatagcatacatccttcctgtaaatctatatatttttaattaatgacacacagttaacatgcacatgcagtaaggaaaataatattgtttctcattctcaatgtgaacacatcgtaaagagtatgcataacatggctcacatcttctagagaacttactactccctacacaaatctgaacattcaatggccagactgtaagacctgcaatatggagttagaaaatgtgagcagcactggagcttaccccatggtggaggagcaaaaaggcctttgatttcttcaacatgaagacgggggacaagttcaatgagcaagcgatcattcaaccacctacgagatctccggttactaacctgtgtaacattacaatctgtaaaccatcaacctgcatattcctaatgtcaaatataacaacatactgtatcaaatataacagattatttttagctgctattccgtagatcactatccatttctttgcaacagggatgaaaccataatttcatttaatcataagctaacaacccaccttcatttagctgcaaaggaacaagctaacagttttttttattctagcaggatgagccgtctcaccttggtggccatgtcctcaagaacttcaatcttcctctcaatcatctgcccacgcgacttgacggcatcgccgcctaagttcacaaaccaaagggcgcccagtgtgaaaaaaaaaagaaaaaagaaaaaaaaactcacttgcattaggagacacctcggggggcaatttcgaaggtaaaaggagagtcacctttgggggagtcgaacaaggaggcgtagaactcctcctccctcctcagcagatccgccatggtggactcccttcccgcgggcttgtcgcgctccccctcctcggcctcgaagctcgaagtgctgcggcgatggaggatttgagagggagtagaattgcggggtggatggattgcgcgtcgtggtgtttctagggctaaaatatggtggggcgattgattggggaatcgtgttcgagagaagcgatgcgcacgcagagtagtggtgaggaatatgcggatacgtggcaccggatacccgtgggctgatattagcaattgggcctaaacagcaaagcccaattaccagaaacagcaaagtccaggtttgcttcccattcatgggcctcatggctgctcatggccagtgttctagataatttttaggaaagtctatacgtagcttgtcttacttaaacttttattactaacaccatgtgttacactgtgagtacatctcgattttttattatttctatctacttacaaatggttgagcttattgtttgtaaaagttttgtaaaagaaatttagtacgtgtagcagtgctctaatttttataagtaggtgaaagcccgcgtattgctgcgggaatttagtatgtttgtgaattatgtgaattattatgtgatatacattgaaacattatgtgaattatgttggatgataatttaatatgtttgtgtttgaaaagctcttaaattataaaaactataaagatatagcatgtttgcatgatgtttaaatgtgatgattgttagtggatgatgatgtggtatcttgttaattagtggatgatgatgtagcatctttgcatgaagatatacattgaaacattatgtgaattatgttggatgataatttaacatgtttgtatttcaaaagctcttaaattataaaaaatataaagatataacatgtttgcatgatgtttaaatgtgatgattgttagtggataataatgtgacatcttgttaattagtggatgatgatgtggcatctatgcatgttaagcttaagataaaattttcaccttcctatcaacagaagacgaccaggcaaagttggcatcacaagtttcttagtagtattttcttttttttagcaagagaggagatcctctcctgttcccattagcagaaacgatacaatatcccattggagttggacacaaccaaagcaccattctgttgtactccgttttcctgtgatgatgccatggcaatgtcacgaggggaaaaaaaattcaacaaaaagcatccaatcccttgtaaatacttttacttctacttcatataatgaaattggcccggtcttatgtcggtgcgttaaaaaaaaaagaaagcatccaatccacataccaacgcaacaaaagcaaacaccgccggccgcagccgcaccgcacgacacgacgagacgtgagggccggcgcacacgacgcaagcagcacgaacggataagataaaaattgccctcaaaaagaaaaacggataagataaaacagataaatatactatgcgtgccaccaaacaggcaaacaaaaaaaaaactacaaaaagcacaggagatttctatgggattcgtctagaaagctacgattcctagttcctacccttcccggtaacttatttatcctcccaaatcctctccaaattcaaacccaccatttccttttctttaaaaaaaaactttacttaaacgctagtagtacacttccactagtgaaaaaaagacgaggagtcggagtcccccacgcttcgtcctctgcttcccacgcgccacaaatttcttcgccttcttcccacgcaacgcctcgccggagaaacaggagacgagtagtagacgactagtgcgagccaagggcatggcgcggcagcagcagcagcgggaggaggagagggccccaatgggcgcggcccagcggcggctgcgcgccgtctccggccacctccagccgccgacggagtccggcggcgttgacctcgccgccaaccccaccgccggcgagtacgcgcacggtacgtacgatcgatcgatcgatcgtctattcgtctgcactactacttgctacttactagtgatgtggtatgcatttgtgattttatccatcccgtgcatgattgatgccgcgatttggatcttggggttggattgcgtggggcctactgggcgcgcgcaccgctcgagcgtaaagtggataaagtggagaataacaagtgcaaccactcccaaattcccaattcttaagctgtagagatagcttcctctttctgaatttgtgcttagactgggcatctatgccataattccattgctgagctcggtaaccgtctaaaataattgcttagctccgagctcgttagcttttaactgactgggatgcttcttttcctattttttagtacgccgacgcatgctagttgcggtttctcaactgcactctgcatgttttaagttatctttcttgacatagcaatgctttttttttttaaagtttacaactcaatgtgcatagcttctccagtgcagggctacagtgctgtactccctgagaagttgcaaactggaaagtggaatgtgtacaggtaggttatttagtagtatatgttatactgcatttgcttatgtcatggctcaaaatttctgtttccatcttgcagatccgcaaagtcacctcttaagttaataaatagattccctgataacccagacattggaacgcttcatgataactttgtgtaagaatcctcatagtctgacttgagcatcaaacttctatttctgaatgttaatctcaacttcgacaaatctcagttatttaccaatgttatgctacgatttatcaaattcttgtcttgaattgtcagcaaacctttgagtgtaattacataccatcaagcaaaataaatgctagttatgttttccttaggaatctcccatattttttgtttctgaattgtatcaggaagatttttaggaaaatctaatctaattaggaaaaagaattattcgcaagtgagtctgttattttattgaaaccttggagttggaaaatgtttgtatgcaacgacttgaatgcaaaggtttttatctgatgtttttatgaaaactggtaaacttaaatgcctgttgcaggctacatgttttacaagagaactattagtgttcaaatttaagttctgtgataagttctcaggcaatatacccaaaattgtgcaggtatgcagttgaaacctttagggactgtagatacctgggcacaagagtctgtgttgatggaacagttggggagtaagaattggttcctggatatatatgtcattattgccttttgtagctttgttaaaatcttttaaatgatatatatgaattgttgcagctacaaatggatgacatatggagaagctagtacaagccggactgcgataggttctggtcttatttaccatggaatacctgaagtgagtcattatgatctcaacaagcaccgtccttctgattttaactactaacaggcagatcttgtcacacattgccataatgatatagcatttgtggttacacttacagattcctttttttaaacttgcattaaataattttctaaaactgaaccagggtgcgcgcattggtttgtattttataaacagacctgagtggaccatagttgatcatgcctgtgcggcatattcatatgtatccgtgccactttatgatactctaggtatgcactcatcacataatgatcatctatctccttttcatttatctagcaacaagttttatgtattgtttatacaggtccagatgcagttcagttcattgttaaccatgcgacagtacaagctattttctgtgtgcctcaaacactaagcactgtgagctttaacccttatctcaaccttgtatagttactagtctatacaatcattaaaagtcgcagttttcatgtcactgctcatactggtccttaacttagtgatgctgggaactagctagttatttccaggaaacagatctgtgctttcaggtgctgatctcatcctgcagaaactgcatgcacatcaaatactgtttttttgggaccatatccacatgcacacaaccaatgggctgagtgctgggctggggcctgatcatgaaatacattctatgtggattctgatcctatttccattttcttatttcaaacactacatcaattttggtaacactgcctagcatttaatcttgaattttatcatggtatattctatggaacgaagtgtacttatgttctgcttatgtgtaactatttattgcagctactaagctttataactcaaatgccgtgtgttcgccttatagtggtaagttcaaaccatttatagttagtatattcaatgaacggccatgattgtttaagattctctctttttctttttttttaaaaaaaacttgtttaatataggtaattggtggagacaatgcaaatatgccatctaccccaacagctactggagtggaaattataacttactccagactacttagccaggtgagtttgctaaatggcccttaagtttactaacactacttcttgcttatggtatttgttctctttttcataaaaaaaaagtatctgttatctaatgtcagtcaaccaactggcatttaaacttgttaaaaaaacactttacatgcatacctgtagtccttgagaaccacatatctagttccaaagttgtatgggcatatggttcaatatttatatgaaatctcttgggatacgaattacttggctgcactcttgcactgattaatttagtactgtttccaaaagatttatccatggcaaacaaagttgatgtgacatcttgtttccacttccattagaaaacacgtttgttatgcaattatatttatgtatgtatgagacacgttgatattttggggtgaaaactgggaacatgaatattggatatccagttgacagctgtaatgcacgtatgcatacgttagctctctaattccatttcatattttcatgtatagtaaacttgaaagctaaatgacaatcttacataataacaaattgtagggctaccacatggagtaaacattacataataacaaattgtagggctaccacatggagtaaacatctttttttcctttcaaattgttataaaaccggccccgaaatcacatcggaaaccaatccgcggaagaaaacgccataggagatccaaacacgatgatgacaccgaggcatgatatttgataacggagttcagccgaggcctacatctccggggcactgattacgggtgctcctccccgatctagcatatacagcgtatcagagttacaacgactcacggccggtagccgccggcagccgctccctctcgctatgctaagtcgccatgcggttacaacaggcacgccctctatttatgagagatcctaggatagagtccgactcatactctagtcctaatacctattacaactccaagtcctaaactgtaaccgactacgtatacatattcgacacaaactctaacacaaatcatagttttgtctatgtgctatagcagtgtgcggtgtgcacacttgctcaattcttttcttatggacacacatagtatgtgcatggtggatatatattgccttagttttagttttgcatcaacggcctgcgaaataaaaagtatgtgtgtatctatttccagccatatacattatctttgctgttagattaaaggatgctagcacattttgctcactgttcttctgatctttcaatcttcaactcagggaaagatgagttctcaatcttttcgccctccaaaacctgaagatattgccactatttgttacactagtggcactactggcacaccgaaggtaaataactcatctttctgattatttttagtttcattcaaagagctcttctaattcaaccttccaatctgtgacgatgtcatatttatttcagggagttgttctttctcatgggaatttaattgcaaatgtagcaggatcaagcctagtcattaagttttacccatctgatgtgtgagtttacattaaatctagatttgtttctttctgccatagcttaataaatttatcccatctggtaatgttttgaattataatcatgttggtatgtctttgcaggtatatctcatatctacctttagctcacatctatgagagagttaaccaggtctcagtggttcactatggtgttgccattggtttctaccaaggggtatgcagatccaaaaccatttaggttgttaattttgtagttatttgcatttgctgtttgtgtaaataataaaaccagtagaataatggggtttctgagttctgacctagcaaaggtaaatatgaataaccggggacaaatgaattaaaccactcggaaaagtaatttctaatgttagttctgccacaagttacccctagatataggagcagaattgaatcacctagtgcaatatttcaaactgttatatgacaatcattcagaggttaattgaacacaacagatgcattttatgctggacctttcacctacaaggctacaagataatattctgataatcccattgtactatttgttatggcctcatcatcttaatggatgcattatgttggctcatgctagttcacttcagctctatgttgctcatcatcatcctttcctcaccatcgtaccatcatattgtaaacctattgctggatttccttgcacacagcaagcaattagatccatatagggttatatcttatgtgtttgccagtagcaataactttgttcaacacttgacaaatatgcatttagatcaaatatccatcttacttactacatggattctttgccataataatcgtttacattcaatggattctttgccatatatctgatgtgtatattgttgttgtttctaggataatttgaagctgatggatgatctggctgcattgagaccaacagtatttcctagtgtgcctcggctatataatagaatttatgctgcgtaatccaactacacccgtaacttagatactttcatgttgggaaaaactatttctagtcatatcctttttgaggttagcattttttccccttttcagtacagctaagtggttagttgtttatcattttgtagaattacaaatgctgtcaaggagtctggagggttgaaagaaagattgtttcatgctgcatacaatgctaagaggcaagcgattattaatggtaagaacagctcattgatattaagtgtcttagttttgcaatgacttctcatttaaaaacagttcctacatgctttctgtgacttatgtcatatcccatttttttgggaaaattggaaccatgccacttttttatccactacatctacatgtatgaaatgttaattctacattttgggttattagggagaaatccgtccccaatgtgggacaggttggtatttaacaaaataaaagctaggcttggtggacgtgtgaggcttatgacttcaggcgcttctccattgtcagctgatgtaatggaattcctaagaatgtaagctgtcttcatatatgcccttggggtagcacgattattatttagaacttggattaactaatatactactgttttaattttttaacagatgttttggtggtgaagtactcgaaggatatggaatgacagagacatcatgtatcatctctgcaatgaatattggtgataggttaattggtcatgtcggatctccaaatccatcttgtggtaagatctgtgtttgggtttaactagacttggttggataaataacttgtccttttgttcacagtaattcctcactgttattgtttttgtacattatcacttctcacactcttccataacgcaaattctgtttctatttttcagagattaaactagtggatgtcccagaaatgaattacacctctgaggatgaaccatatcctcgtggagaaatctgtgttaggggacctacgatattctgtggttactataaagacgaaatccaaacgtaatttgctatatatttctatcttctactatttaaattcataaatatttgatgagtttcagcaattaaatttgaaaacctgcagtagagaggctgttgacgaggatggttggttacacactggagacataggtttgtggatgcctggagggcgtctaaaaattatagataggtaaaactgaatgatctagtgtttcatgtttaagaatttccttttgaattgagatggccttgtgcctttgtttcattatatagagaaaaaatgtatatctgatcaatctacacttttaccttcgctgcagtttcgtaatgatacctaaattagtcagttgctaaattaaattgttaagatgcatacttgaaatcttaagttagcttgtactattttcttctcagtgtattgtttgttagctgagatttgcatggttggtgataaaactctaatatgtgaaagttcaatgctatttggtctaacttgtagaatttgctgtcatttgtaattttgaatacataccatattactaagatggtagggatatctaataacaacttggtaagttcaaaactactgtgctaaaagactaaagtgaaagcaagatgttaaaccttcttagctattgatcaaagagcaaaccaaaactatcttacccactgttattgtagcagacagcacatggtagccttcaactaggaaggttgtaacacatggatgtttttgagaaatgaccacaaccctattgtgaaatacttttgtctctaattacttattatcctctttccacacattttcttaggtaatttaagcccctggaactgtatttgatctgattagttttcttattaaataaattattaattgattgtgttttaatggtctcaaggaaaaagaacattttcaagttagctcaaggagaatacatagctcccgagaagattgagaatgtctatgctaagtgcaagtttattgcgcagtcctttatatatggtaatattcatgtccttatactggttataactaccaataatttgccatatatgttctaagctgttgattcggatgcaggtgatagtttaaactcttctttggttgccgtagtagcagttgaaccagatgtgttgaaggcttgggctgcatctgagggaatccaggtaaatatgctgaccttagagagtagatattctgcaactgcacaactggtttctccaaactagcggaacattatattcttcttgcacctctttgccagttcactacacaaattatgtctctctttgtcaaaaaaaaataaataaataaaaacagaacacccacaaataaaactccttacatcttcgttggctacttatgttatgtcctttctaacctgtagcacgaggatttaagacagctttgtgctgatccgaaagcaagatctgctgtcctggctgagatggactctattggaaaggaagcacaggtttacttctcacttctcataaccttgcatgctcttaataagttatgaatcatgtgtatgattcccttattaatctctctttccttgctgcaccagctaagaggttttgaatttgccaaagctgttacccttgttgctgaacctttcacattagaaaatggtctcctcaccccaactttcaaggtaggcccgttaatacaagttggaggagatttctacaccaggtactaattctctatctcaatgacttttgcaggtcaaaagaccgcaagctaaggcatactttgcaaaagaaatcgcagatatgtatgcacaactgcgccaagcagaacagataaaacctaagctgtaactacccgagtgacaatcggagtaaaagttctagcaacaaactacaaatgactggcttggtatagtgaaggcaactgtgaatgaactctgttggatatgtccacgaatgcttgataatcatctaataggatgatcaggtaaaagaatagcctgttttatgtacatctgtaagatgaaatgaaaaaagatgtagacatgttaaatgtcatatatatgaatccattgaatttcacctgactatcataggaatataaggtaaaactttccctcttaatcctgctgtgaggcattctgccaaccacttgccaagcaatattcatatggaatggatctattgaatttcacctgactatcatatcaatagaaactatggaattgtttccctcttatattacatgtcttgatccttctgtgagaccgaggcattttgtcaggcaatatacttgcacagctgttatattagagcaggtttctctggatgaaggcacatttcgcatgaaagcaaataatcgacagctgtttattggttagcgtggagctaaccatcacgcatcctcctgcgcagacgtggtgtttcatagactgttataccaaagctttaaactgatagtggtctgttattctttctgccatatttttttttaaaaaatatattcactttccaattgtacaggtcactgaaattattgttagtttaaaatgcaatggtaccttttattcccctctcaagaactaaacatgtctgcaataataaattaacattattcacctcccgattttatatgtcaattcaaattatggttagtttaagatgaaataccttatacaggtgccctttcatggacacaacaagactaaaataaattagtaaacaaatatcattgctaatcagtttggttaggggaagacgctacttagattcagtactagatttagatagttgttcacgggaaaaaaaaacaaaaaacaaaaaacaaaacaaaagtagaagataaacaggatgatcccttctcacaaataacaacaaagttcatacaaaaatttaaagttagaagataaacgagacggccatttctctactactgtaaaaacgaaattctccctccctatcatcttacttcccttgacgtcattagataaaaacgaaccgttggatgataactgtggcaaattattcactgttggattgcatatatgttatttaaggctctagatatgtggaaagtagtactgtattagttcagtcaacatgcatgtaaaaaattaaataaaaaatggaataatccagaaatttgtggagcccttgggaaggggaacaatccaatatattaatactcaattaatactgaataagggcatgtttagttcacgttaaaattgaaattttagttgaaattggaacgatgtgacggaaaagttagaagtttgtgtgtgtaggaaagtttcgatgtgatggaaaaaattggaagtttgaagaaaaaatttggaagggctaagaaaggagcgtttcagtttcccatgcaactgagtcctctctacacaagcacccagtacggctttagctgaaacctttgcacttccatttcaaccttcacaaatcacaaacaccccaaacccagctttcatcgttttcatcttatccaaattgactgcatctggagacctggtcgaagcttgctgacgtacggcgccggatacaagctccctccgcctctttgaggccatgtaatgaggtactacctcccctccgcttccctctcctccatttcctgcatctcaatctgaggtcgcatccacctgctgcaacgagacggagagcgcttcgctggtattatcatatcatgtttatgtcgtgtttgtgttatctggggaggtcagaattgagatgttgggtttcattttcttattagacaggatatacttttgacagggcggcgcgcctgattttctagtttctctactactgtaaaaacgaaattctccctccccatcatcttacttcccttaacaaacaatagtgtttccatgtgaaaattaacccatcaagaaaacagattagataagactgaacctcataaaaccacgtaccgatcgcttaaaagactctagtgaccattagcactcttcagagcaagaataataatacagccagctgcttacttatagcctatctatcatctcactcatataatggttaactcttcactataaatatatggtctacctatctgtctcacagattttattggttcttgtgcctaagccggctgtaaacttatagctcgcttctcatctctctcctctcctctctcatccacatcagcattcagccttcttatagccctctattatacttgctctcaggacactgcacacccgttggcgttgtgctctcttattctgttggagcccatcttactatgtgtcatcaaagaacggcaattcgtcattaatatgtctcatcaccatcatcacttcccatgcattcttgtataagctcatcacaacctatctcttgatcttccaagacggccggggttgccataaattaatcaatatatagtctattaatccgtcctccaatcctccgaacaaatgcaccaccattatcttaatccaacccattgacagcgagatgtttgtgataacttcatcaatatcaatatcaagatataccggtccactattccaaaggtgtttatagagatagaatgtgcatgtatattcatagggataagtgtgcgtgtattatgagcgtctatatttgtaccgcgtttctaaaaaaaaattatcttgatcgtaccacttatacgaaggatgatcctccatgtttccattttgtagcatattgtctgtttgatactgatgagcataaccctcaatatttccatgtggcaagatatagtcaggatggacagtatatgacgttagtctagatcatctccaaatgcatgcaacgctgctattaatattctcggcttgctggtaatggagattctccgtgtaggctggctgtgtgatcgtcatcaattgatcagcagagtaccgtggctgctggtcctggttgcaccacacggcagggccctgtctgggctgcagcttgcactactagctacgctgtcgtcgttgagctgagaaatgcttggtgtgtttgcatgttgttcttcgtcaaacatcatctgcatataatggggatcaagttgacaaagtgtctccaatatgttattgaatgctcttcctgcccttgggaggtagccgcttcctgccttccttccccttgctcttgcatttgctgccgctcttcgcctcttttccggccttcttttgatcaaccttgtgggtatgcttcaacaccatcggagccaaaatggcatataaacaaaaagtaatttatgaataaaacttggtatatacgtgttgttagcgatctagtttgtagaaaatatagaagtattttcgatacaaaacaaacatacttctaaaatatattcatccagctctgctaggctggatgaaacggcccaatactgctccctcccgcagaaggcccaatagaaagacaagcccaagcagtttccagaaggcccaagtagcccaccgtcgcagccggagcaaccgcactgttcacacacgcaacggcgcaacacaaccacttcgtcgtcttcctctgctgcttccttctcctccaagcccccgctccgctccgacgacctcgccgcctccgcctacaggtgaggaggtttttctccgccgcggcggacgcctccgctcgccgttctcgcttgggtttttgggtgattctggttgggttctcccctgatcgcacatttcgacgcaggtgggcagatggcgccgtccaagcagtacagcgaaggcgggcagctccagctcatggacgccgagaggatcgaggaggaggaggagtgcttcgagtccatcgacaagcgtacgccctccgcctcatctccatcccttcctccccctgtctcgtatcccgcactgcattgcttggcgcgcctgctcgtgtgcgttcgtgtgtgttcgcgtgtgttcgcgcgtgcgagtggcagtgctcgttctgcctcgcctttcaattagtcgctgttcgacttgtagttcgatgcttgattcgcggtgaagtaaacgagatttagcattagtacgtttccactttttttttgttggtttcgattctgcttgcgagcagcgtctggatgctttgtgatgtgcgtgttgggttgcttctagttttccccccaatttcgtgcgttctggacataaattagcctcgtctcgtgacgaatttgttctggaattttcgccgctccacaattgatctctgtttttgggctatttcctgctgatcggtgtgtggatcgccacatcgcttgctatgagaggatcgattagaatttatccccatttttagtcaaatttacacgcgttttgcattaacccgtcaaaatgatcgctggaactcgtcggaattctccaccggctagtttaaacatttgcattttctgcatattagttgaatcagttgtgtgttttggtgcacttggagtgcatttagttgaaccagttgtgtatgggtgcacttggaggtttagggattaagcttgagttcctcttgcactttacgttttctggtggctccctaactctagcgagttcaattttagtaagttgtttggtgtgatcctgacatttgcctgtgtttcatgcttcatttggttcttcctgcaaattattcattgccgtgaattcaaactaatgagcatagttcctgcattactgttcatctctggtgcacttgtctacagtaatctcgcaagggataaactctggagatgtgaagaagctgcaggatgctggtatctacacttgcaatggcctcatgatgcatacaaagaaggttgtgaactcgggatcccaaaccttcatgccatctcctgcttgttccatttctggtttatgacacccatcttctttcgtttgttctatttctttcttacagtatgcttatctgatattgtttcaatatatggattcatcttgtagagcctgacaggaatcaagggattatctgaagcaaaggtagacaagatctgcgaagcagccgaaaaacttctggtgtggttctcttttcattattaaagtctgaaagcttcactgtcaattctgtgtgatacattcttctgaaattgctatatttgtttttctcagagtcagggcttcataacaggaagtgatctccttattaaggtaaggaaataggagctaatctgcatacagcatactagtgtacaggatatggtgttatagcaaactaagtggaaactattccttgcttcatggatgctctagagcttttagttactccagctgtgcacttccctgggctgtttggtttattctttttcttcttttgaagcggaaatctgttgttcgaatcaccactgggagccaggcgcttgacaagctgcttggcggtagcatatatagtcctctgattatgttatgatcagttgttgcattatgttgttctaatctattttcattcttcaaattttcaaggagggattgaaacactttgcatcacagaggcatttggagaatttcggtgcgtagacgttcttgttccttttgattctttttcctggattacaactgcagattggttgtaccaatggaatgtggccatatctgtctaatagatatggtgaaaatctagcttagcaatatgtttagtattctggttgaagttaatttgctaaggctgttgtgctcccatttttatcatttattcatgccagtatatacagtaaattcctaaatatgtttgtattctgctaacactgagaacttaatactcctcatgtgtaaacttcaggcatatacacatcaatattgtctgaaactgttttctttgatgttaatactaaattggttctactaaacattaaatttagctgagataatcttgttttgcgacaaagttgatgtattatagaatgattccttgaattgcagcttggaacaatttggctttgtgtagcacataaataaaacatcttactatttaatgtgaaccagccaaactttgacccttgatgtactttgatttaacgttcatcattcgtcaatttggttccagcttcttagctttgtaatttgtaatctgtcatctttatttttggtcctcagatcagggaagacccagttggctcacactctatgcgtctccgctcaggttcatttccgacacatttttgtcatcaacaccttactaccatagatccaatgaataattttatttattttttgtttgtgaactgcagcttccaatccacatgcatggggggaacgggaaggttgcttacattgatactgagggaacattgtatcttttgaatttactgagtaataactcagctgattcactcaatggatttatttgcatttccatatcgccccaacttgtttccttaatggaattttcagccggcctgaacgaattgtgccgattgctgagagatttgggatggatgccaatgctgttcttgataatgtatggctcttaatttgtctttaccatttcaggcctaacagatgaagctgtatgttatatttccatttatttcttgtttagatcatatatgctcgtgcatacacctatgagcaccagtacaaccttctccttggccttgccgctaagatggctgaagagcctttcaggcttctggtaggcatggctccataacataaaagaacattgataaatttgtgtatctcagttacttatgtggttgttttacctgagtagattgtggattctgtgatcgcactattccgtgtcgatttcagtggcaggggtgaacttgcagagcgccaggtattgtcaatatttgtgttggtagaaacaaaaaaaaatcataaagtagttgaaggcctaaagttatgtactaattactctgaacttgcagcaaaaattggcacagatgctctcccgccttactaaaatagctgaggagttcaatgttgcagtgtacatcaccaaccaaggtgagctttcaggactatcctgtatatcccaagaaagagtaacaccataagggatttcaaattacaagtgtcctccttgtttcagtgattgccgacccaggtggtggaatgttcataactgacctgaaaaaaccagcgggaggccacgtgctggcgcatgcagctaccatccggttgatgctgaggaaaggcaaaggagagcagcgtgtctgcaagatctttgatgcccctaacctgcctgagggagaagctatatccttttgtattatacatatacatgtttaccaaaacttcttgtgcaattggtaacttcggttcagtaggttgctaaaatattgattggtttttctttctttgttcagacttgctcctcaaactcttgtgatttagttaattgcagatgctgttttcggtgactggaagtccaaaagctttgcataacagattattaatggtgtggtgtaaaatagttgcttcccttgaccaataacacgttttccaggtaacatcaggtggaataatggatgcgaaagactgaatgttcattgagggtgcttcctgtcttcaaattattcaggtttctcctagtaaattcctgcataggccatataggtttggtacattgactaaactactactgctactttgccactgtcgaggaaatatgcaacctcatttatccagacgattataccttaaaatgggtatttttctatgcttatgagatcaacagttgtactgaaacaaatacagtattgtcttaagtgaaaaatatataagaggtttacatgatggtaactttccccagaaactaaattctttatacccgcgtgtgcacaatttatacaatctgacttattctgctgtatcagctataaggtccttaattatttgatcaaaccccaaacaattattttttgcggcttatcctgggatttttccttcaaggacgtggtctaatctctctatactccagttcttcagtcccccaatctgcaatcttcagttaaaccacaaaagaatcccagcatgtgcgacaagcattttctcgttagaagagactccagttatcttttagcatgcacttcttcaattggacagaacaaggatcattagcataatcggcatagttgcagctaagctaacaacaaagagagttggaatgaacatgccattgtacttgtagtttgatattcggtagaggagatacataacatgcttccaattgaaaagtactactcgatcttggaatagatcgatagagaaacatgcttctagctttagctttacattgatgggacgataaaacatcgtctcagtctgtacaacacaactcttggaacagacaaatcaccaatctgcctaatgcagaggatatttaggtgaacagaggaacaaaatacagccttttggccggttcatcagctggttgctcctagctccgggcacccaagcttgtcgtcatcctcctgctgtagtgctgtgtgggtagagcgcggcggcagagagggcagatgcagctgagccggagccagtcgaagatgcagcgctggtggaaggtgtgggagcacggcatcatcctcagcttctcctccgccacgaaatcctgcaagcaaacggcgcactcctcctccctcgcgccggccgccgtcacctcacgcaggccttggatggccttgctcagctcgcctgtaggacgcagccgcctcgtcggagatctgtggcgtggggtgattgatctcctcctcgttgccagatgacattgatgaatacacgtcttcggatgatgatacgtaagcttccggcggcggcggcggattttgttccaccctcaggggaagcctccggtcgccaataaccaggtggctatagataagattcccctgctcatcgaagaggggggccattgcgatagtatacttctgtatggatattcatctctccggccaggagcacgacggcggcgacgcgatcgacgacggagatgatgaaacgagtcggcggaaggaagaggaggctgccaaacctccgactcggatcctggtatgatggaggcgcatacaaatgagggggcaccgggcgctgttttagcacttagcgaaagaatgttctttaaaaaaaaacacggtaagattactagatgaaacaatttggtttaacttacacaacaaaacgatttaagtcattgaaacacataaaatccgtgtacatcaaaacaaaccccgtatatatcaagtgaaataattaaacactatctaaaatccaccgtaacatttgattcacacacaaagaaacatcacgagcatattagttgaaacattgcttttgaaccattgaaacatcaacaaagctggtgaggcaaaaatagaaatatggaatactatcgaaatatccattggaacatttgatccaaacataaagaacatcacgagtacactagttgtcgaaacaagatttcggcaatactaaaaggggtggcaattaagctagaaaagtggatgggttatgagacacaaggtttatacaggttcaggtcttctcgatgagaagtaataccctactcctgtctggggattgatctgccgagtgtattattgatcgtatgatctgggagaaaagttacgctcataagagcactcggacccctccttatataggaggaggagccgagattacaacatacaatccatgttctttatggactaggcctttagagataaattacaatcataaccgactagaactatcggatgtttccttgatacacaagttaacattacaaccgagtcctttactacacatattctaaccgcataaagtatcccttataaccagtcagatatctatgccatgtgggtatgtagtacccataatctccacactagcggaaacacacaaaaaacacaaaacctagtctaaactgcatcttcctactctccgatgaacacagggttgctcgcatcggtcttctccaccacccccatcactggatctggagaaggcaggagagggggagggcagcggagatgaggagggagtgctcctgggagagagggggagccggcgagcctcctccaccaccactgccgccgccgccaccaccacctcgtcgggcgtgcgttgtcctccgcgtcggccgccaccacggggacaaagccaccgtcgacgttgaggaagacaaaaagcggcggcggatccgacggagaaggcgacgtaggcgaggtcgtgggggagaggaggtagcgtgggcaagggagctcgtgggagaggaggtggcgccgatgggggagaggaggcgacatgagtgagagaggcacggggagcccgagtgacaaggaatgagacgtgcgggcgcccgatatttttctctcatcaggcgcctgagtataaggatgcagtgcctagggggcactcggactggctgcctgagatcaagatggatggccgggcatgcgcaagcggtcgaaccccacgcctctactggcgattctccgccaccgagctagcagctcgttgagcctggtggcggcgatgccttgccctgttgcccgccgctcatcgagtctgcaggtggaatggaaagggtgacgtaggaacatgtgaatgcaggagtcccacttggggtcgctgatttcatgcccacgtggattgatagacgatctagattattggtttttacgtaatcctagtacaattctgcttgatatttcggcccactctcgtccatgcctagcgtctaaatctaaaagtagaaaaattctcatatcaatcgcataaaacaatgggcaaaattctgatcatcaccttcactgtactcgagtcgacgaccacgacgccaccattagcgcctctgcctgagttttgattctgcccctcccgttgccagtaccaccatgaaccacaaaattgggttccccatccttgtgctctccttggtttgtcccctcgctaccatcgacctgcaggcgattgggctaaaacaagtagacttgtcgggcttggaaggtgatgtgggggaagaggaaatgtggcgaacaataaaagagttgccgggggattgagctcttgcacccgatggttacactggtctcttctttcaaacctgatggggtataatcaaacaagacttgatgagggctttggacaagtttttccaaggaaactttcaaaatttggacatgcttaattcgacaatgattattcttctttctaagaaggaggcgcccggcccttttgaaggactaccacccgatcagtctaattcacagcttctccaagttggctacaaaggttatggtgactagactggcaggctaaatgggagagctcattccttacactcagtccgccttcataagaggacgttcaattcacgagaatttcatgtttgtgaagggcatggcgttgctctgtcacagggggcacaaaccgatggtgttgctcaagcttgacatctccagggcgttcgactcggtatcctggccgtttttgctgaggttgctacagtacaagggtttcggggtgcggtggaggaggtgggtgtgctcgcttctcctgacggtgcacaccacggtggggctgaatggagaggaatgtgaatcaattaagttgatgaggggactacgccagggtgatccgctttcgcctttgctctttgtgctcgtcatggacgtcttgcaagccatggtaaccacagcaatggcttcagggacgttaagagggactggtactgctttgcagtcgtcggccatttcgttgtatgccgatgatgcggtgatcttcctccaaccaacggaacaagacacataggcaatcaaagcgattttggacctgtttagggctgcgacaggtctcaaagtgaacttcaccaagagcactatcaccacgatcagatgctcacaggagcatccgcgctcgtccagtccatcccgtgttgtcagctcgatcagttcccgatcacctacctcggcctcctgctctccctccgacagctaacaaagcaggatgttcagcctttgttagaccgtttgccaagaagttcgtgggctggaaaccaaatttcctctcgacgggtgatcgacttgtcctgattaagttagttctgttagctttactggtgcatcaaggtttaccaaaaatgatcgattatcacgttgccttttcctgaaaaacatttgcccaggagaaacttgtagttcaaactgtttcttcctcaggcctccccttccctccctatccaactccactgcctctgccatcctcttcctcccctccaagttgcattccacctattcacctacctctatcgacaccggccatagagtgcaccaccagcgtcatccgcaaggccatctacgcactacctaaagcccccggtggcgcgatccagtgaagaccaaggtaatactggctgaaggtggtggaggtcggggtggaggcattgtagacgatatgggccgtttggagggcggtgccgggaatggagactagcgtcgtctttgttctgcagtgaacgggggttatggtgactactcggagggcggcgctgggagaggcactgcgtgggatggctaccaattagagcacggcgatagtgccctgaaaggagacctgcagcatctttgcgctgtagtgaacatgggccacttgttgggcgcctccaatagaggtgctaacttcgacgtggattgctcaaggattggttccggcagaggcggctactactcgaagggcggcgctgtgcgcgatggcgaccagttggagtgccgcagcagcgtcctgaaaggagaccaacattggcacgccgcagaagacgggtgccgctcgctgcgagccgccgacggtggaggtgtccagtgtccaagtgctacaatgcccgtagattgcttgttggtcagctcaggtagagaggccatggtttgtgggattatcgggagagcagcgccgacaaaaccggttatggtatacggggaaacactcgaggtagacgctattgggaggggtcatggtcgaggacctcaaggtggcggcggcatggaggggagcccggacatggtgatgtcgtgacgagcacgacgacattgcagtggttttagtggtgttgatgctgggacacattccattggagagtactctgtttcagttaatggagccgatgacgtggccaaccaccaggatgccgtattcagcacatatgggtatgattgttcccatgatttgtatttagttggttgcgctgttatgagtcatggacacacatataggaaagacttctcctcttgttctttaagatagagtttttctacaagcaagaaaagctcagggaattttcagcagtgatggtgctcctgatctcataagtgagattacatatgtttttactgaataatttaggcccggtttcatgtttcgcgttgactcatctatatggagttatgtgattgatcaattaactcattagatgaagattttgtagggaagtgagtctcacaatttgttctaattaaaccttgcctacccaaccaatttggattcctacttgatcaattgtaaggaggtgagtgtcacaattgttctaattaaccttgcctgcccaactaattttggatttcctacttgatcaattgctcaatcctattttgcgtatggatgacttaattaaacatattctcttttcatcaagggggctgtttcggaagctaagattctaataagtagctggttggtagccaggttcgtagccagtttctgaggatcttccggcttctaacttagttcattttctggattctataactacagcttctcataatctagaacaaaagctcgattgtttaggggagtttttgattctgggaaagctgcaacaactataagctccccaaacaagtttcaagattattttagttggggtgaatgaaagaagaagagcgtgacctcttttaaaagacaaaatggatgattttgtttggaatcagtaatatgtatggggctgttcggaataagcagaaggaaaaatttctaattgagcttgtacatatttgttaacaacaaaaacaccccctgctggtaggggatttcaatattataggtaaggagaattacaatagatggagttttatttttaatgctattattgaataacataatttgagagaaattatcatgggtgggatgaatttcacttattgtaagaaccagagtaatatcacgtatgaaaagttggataaggttctagtttcaaatgatttggagtgtaagtgtcccaacggcagaagttagaagtttggagagggtcggctaacacagggcaaaatcctattactcattctggttttaaatttgaactgagttggtttcttagagaagacacagatgaggtagttagtaaggtgtggacagaacatgggactcaggggtagtattgaaagatggcaaggaaagatgaaacacatgaggaaagcacttaagggttggaatttaaattgggaagtgtctacaagaaagagaaaaagaaaattctagagcaattggataagattgacaagtggtatgaaagtaatggtatgaatgcccaaacaagaggaaaaaaagatcttggaggaacaattgagattcacagtaagggaggaaagaattagagagaatcccttatatgccactagaatttgaccagttcccttatatgccactcaaaattggcttctcccttatatgccactacttcaagttttttcacccttttatgccactcccaccactatagtgttagttgactgttagtcaaaggttagtttttttgtaaatgaccaatatgccctctcaactaaaaaatatgtaaacttcaaaaaatcataactaatttattttaaatcctttttgagtgaacaaaattttgtcagaaccagtgaaaaatgctctttatattaaaaatattgttggaaaactgcatgtttcatgcttacattgaaaatttatttgtgatggtaatggctaaaattgcatgtgatgcagaaaaaatcaattttcatatgttgtatccagtagctatattagtactaaaatacctattattggttgtatactaattctcaagggtaaatgcgtctttttacaatgaagttaacggtcaactgacggtgtactgacggcaatggcttaaaagggaggagaaatttgaaccggtggcacaaaagggagaagccaatttaaagtggcatataagggagccggttaatttagagtggcatataagggattctctcaaagaattaagtggtttcaaagaagtaaagaaaaggagattatggagggtgtgatgtgatgatgactactatgatacaaccattgctcacatcatggatcaacaaaaaggcatcatgatcaaatcctccaagtgctggaatccaatttggccacatgctacagtgctgatttcaaacagctgccaagtgtgcatatgtgcccaagaaagaaagaaaaaaagaaagaaagaaggaaaagagaaaatcaattgtatatttgagtttgttttcatatatcagtgtgtgcttgagttgtttctggtgctatcttgtggtaccgtttgtgtctaggctcgtgtttctactacattctagcctaggacaagcacaatacttgactttgaacaattattcaagtttgcattctctgatacaagcatttgctattcctttgctacatatttaagcctacccagggctccacagatttgattgcagtcgtacagctagtgtttgccaaggcatcgatacattcaaccttcattagggtgcttggttgagtcggtgtatgtcaccatctagcttgcattagtaaaaacttgtaagaacctggtaaaaagcttgagtgtgtgtgatatctgagcttctactacctagtagctgataggagcatgcatattcttatgtgtgtttcttgtttgctattaaccatggcagaattgagcaatgggatatgacggagcgtggggctcctcaccgggagaccgcgcaggcccccctttgccggttcggccgggggcgctaagtgaggttcttcgccctcgatctggggaatgttcgcgagagagcaaatgcacaagacacgggcgatgtagacaggttcgggccgctgagaagcgtaataccctactcctgtgttctggtggatctgtgtgtgaaggagttacagagagccggagagcaagagagttcaggctctagaacccctcttcctctttctctcctctacgagctcaggtattctcagagtcgtctgagcgtccccctttcttcggtgggcaaggtcctccttttatatctcaaggggataccacatgcaccacttctacctactcttcttttgggtggggacccaccctatcttgaccaaaacctggctcgcgccttcgcctggaagctaaatcacagcttgtccttgagtgaggcccagcgccgtcactcgcctgacacaggggataaccctgtcattccttcattaatgggcggagatttgcaatggccgctgtccgaatgaccctccgatgggatgagtcatacctacctccactccgccggaagcagatgcaacgtgggagcacggttgtctgccgatgacgtgaccggcgtcagaccagtcacaaaccggtcatttttgtccaccgcgcgtcagtttagcatgccgcacgtctgcccttcttcatacaatgacttccttgccatggttgcgatgaagcctggaatgaatctggccgggactgacataccaactccaggagttagcacgccggctccggctagggacgagtgcctggaggctctcatcattccgacgggacggggcgaggcgtgtgacaggccgcctgttgccacctaacccgcgatctgaccggtccgtgaccggtcacacactgcgaccggtcacggaccggataagcgtgcgctgcgctgcattaaatgcggcgtgtcgtgctcgtccaacccgcaataaatgcggttaggtgagccccgctgtgttcacctaacccatacacgtggcgccaataccacagggggtcggggcgccccagccctcggggccgaaacgggagcggcctgacccctcggggagacagagggaggggtggccacgtcaccctcgggcccgacccccccgagggggtcaggccacgtgggtgaccgcggctgcccaagcctctagtcacgatacccccggtctcatgtcaccgacaggatacgatatggttatgctcaatgtcgacttctccaccttcgacgagatatgacgacttctccacatgattcatatgaggtacttgactataattttgcacgagttgaatctaagttaacattctacgatgggaagtatgattatgttgcttatattgattgggagctagcagtagacaatgaatttaataaatatgatttttttcatgctcaaatgattaaggctgctagtaataagtttacctcttctgctttattttggtggagttatgtgagtaacaaacctgaaacttgggatgaatgcaaaaccttgatgagaaaatattttgtgagttcttattacagatgtacacttctggagaaattagaacatatgaaacaaggtgataaaactgttagagagtatatccatgaatttaaagtttgtagagtaaatttcagattggaccccttttcattaccatagttgcacaatgggcaagggtctatcaacacttttcatatatcaccatctaaccttgccaaaacatagcagtttggaccaggtgtagtggggtactgccttgagctgctaccatggctatttcacccagggtgaaagatgaggtgagcactatgcacaaggggataaacggcatatatcatgctggattagattaaaccaatggctcctatgtgctatgtgttgagaggtcagtggcaactagcaagacgattcgcatggccagacaattgactcaaatagcagccaattttgatgcttacgtgccttgttctgccgctcgtgtgcctgtagctggggctttggcgcagtcaagctgctgtgagaagaacaaagcaaagcaatgcatcaggatcggcagcgccaccgcttatgtagctatgtgtggaatacaagtacccgggtacccaaggagaggcctttgggccgtacggcatagggtgggccaagagccctaggcccatgcgacgtacttgtaaataaaagaaagagatatttccgggataagatataattctcgaggatcatgcatatctttatagatagaatacggagatctagtttcaatcaactacatactttccttgtaaccctccctcctcatcctatataagagggggcaacggtctcgagaggagagggaggtcggatcatctccaagatttcttttttgaccatttttccaccgatacagagaatcaaccacactggacgtagggtattacctcaccttgagggcctgaaccaggacaatcatctgtttcactatctctccttaatctagcgcgccccataaaatatattgccaatcatagaaatcgacagttgacgccccaggtatgggggtgctagatcgtttctttaaggagatagcttcaaccaccgatcgccgggtttgtcgtttcaatttgtttttatggtttgattaatttctaatcatagattgatgcgcgggtatttcttgctttcatgtcccgacgatctggccatccgccgcacgttggaaaaagcagttcgctgccaggacgagatcaacaggttttggccgtactgcaaatcgccgcgaccgcgaagcgaggcgaggcggccttgccgccaaccgcgcaagccgtgggcaatgcacgtctccgcgcaagccgtccatgcagccacgccggatcgtgtctgatatatgggaagccaatcgcaggcggcctggaaacacaagcaagacgtgttgatccagtcacatgcatgcgtggcttaatcaacaatcacacatgcatctatacagcaagcatatacatgcatctgtttgttccatttagactaatcttgccggttgctaatcccgaattaatctgtgattttttgcatgcatgtcgccgacggcttctacgatcggagtatgtaccggcttaagctgtccacaccgagggcacgcacggccgcacgcgggagtgcgagaccaccggccgccagccgccagctgccagcgcacgacatcgcgtgacgtcgcttggttaagcatgatcaggccgtccgtctcgattgtgtgcagctgtgcagtacatgcatgcgatgggccacatgcatgtgaccgatgattatctgggagcaagcaaatactccatgcttttctttgactttgcatctacgtatatacatatgtatttaattcattgatgctgctgcagttgtttcccctttttgttttgcacgcacgctcggggcactacgccgcacattgggaacttcatccattacccggctggcgcggctcgactgtgcccggggcacacctgcgttgtctgggcgctctacaccgacccgccacagactcgagggctttgcatctcccgttgtccgggcactccacgtcgactcaccacagatccgggggcttcgcatcccccatcgaccgtgcactccacgccgactcaccacggacccggggggcttcacatcccctatcgtccgtgcactcctcgccgactcaccacggatccaggggcttcgcctccgtcgtccaggtgcccttcgccgacctcgccacggactcggggggcttaacctccctcgttgtccgggcgctctacaccgacttcgctatggactcgggggcttcgcatcctccgtcgtcctggcactccacgccgacccaccatggactcgagggcttcgcctctcccgtcgtccgggtgccctatgccgacttcatcacggactcaggggcttcgcctccctcgtcatccgggtgcccttcgctgacctcgctacggactcaggggcttcgtctcccccgttgtctaagcgctttacgccgacccgccacggacttgggggctccgccttcctttctacccgggcgttctacgccgaccttaccacgaactcagggacttcgcctcccttgtcgtccgggtgttcttcgctgacccgctacgggctagggggcttcgcctccctcgttgtccaggagctctgcaccgactctgccacgggtttgggggcttcgcctccctcgttgtccgggcgctctgcaccgacccgccacagactcaggggcttcgccccctcgttgtccgggcgctctgcaccgactccgccacgggctcgggggcttcgcctccctcgttgtctgggcactctacgcggactttgccacgtactcgggggcttcgcctacctcgttgttcaggtgcacttcgccgaccttgccacgaacttgggggcttcgcctcactcatcgtccgggtgctctttgccgacttcaccacaggctcaggggcttgacacccctcattgcctgggtactactcgccgacaccgggtgacaagctcctcgcgcaggacggctacttagtcgctgactgaagacttgcaccgagccgaccgcatacaccgctgtcgggtgatccgctccgcgcgcaggacggctactgcgttttcgaacgaaggcttgcacctccaagccgaccgcatacgccgccgccgggtgatctgctccccgcgcaggacgactactgtgttatcgactggaggcttgcaccttcgggccgaccgcatacaccgcctcagggtgatccgttccccgcgcaggacggctactgcattgccgatcggaagcttgcaccttcgagccaaccgcctacaccgccgccaagtgatccgctccttgcggaggatagccggacgtctacgtcgatgcctagcgacttcctccccatgcaccatggctgcttcaccgccactgactgagggttgtgctccctcagcggatgcaacccttacttgatgagataaccactcggctgcaacaattttcacttagcaatattgagatgagtactcagccagtcttgtcttcaccagatggcttcaccaacctctgagtcttcgtcaagctaaatactcgggggctactgtgggatacacggtacctgggtacccaaggagaggcctttgggccgtacgacatagggtgggccaagatccctaggcccatgcagcgtacttgtaaataaagaaagagatttccgggataagatataattctcggggatcatgcatatctttatagatagaatacggagatcgagttgcaatcaaccgtatactttccttgtaaccctcccctctcatcctatataagagggggcaggggtctcgagaggagagggaggttggatcatctccaagatttcttctgggaccatttttccaccgatacagagaatcaaccacactggacgtagggtattacctcaccttgagggcatgaaccaggataattatttgtatcactatctctccttgatctagcacaccccataaaatatattgccgatcatagaaatcggcaatatgcttgtgcggatgccggatgagctaaggagctcaaaactgtccaatgtccgcccttccccttgctcgaggtccatcagcccatgcatgttcatcactagcacctctggtgtgcgagctgtgcgctcgaccccacgctccgctagctcctccctctagaataggcaacaagagttgggcactgttgcactactccttctccctacagatcaagccaccagagttgggcacgatgcagcagatagcagagagagaaagagggggaagcaatggtgttgccgcatctctgatggcccattggacgtggagaagacgagaggtggactagagtgaaacaaatggtaagtttaagtggttcaaagtgaaaaccttggctaagatatgatccaagctgcaacatgggtaaaaatatatggaccacactaaaatttactcaagtttgtatcatctatagtggtctaaaagagtgcaatgaaaacacaatgcgtagatttttcaatgggctcaattttgaagttcaggttatgcttgctaatgtggcatataatcatagacacttattcatgcttgctcgtagcgttaagagtaaaattttacaagatttcatatcaaatacgagaaagcatgaacaatgtgatttatctgttgtttctgaatctcctatttccttgtgcaatgatgatgtgcaaacattggaggagcaatcttttgtgtctcctgttactaacgttttgcagggagttcaaaacaatcaacaaaaggaggagactaatgttcttgataagaaagcggagaagtatgaagcacctacaatgtttgaaaaaagtttgcaaggtaaattaaatggtgctgagataaatgaaggtggatattctcaagatgagctgcacatgtccactcttcatgctatggtagagcaactattagtggaaccaattgttgacattcttttgtcacaagttgatttgtttgatgttccttgtgataaaaaagaattgtgtgataatgcttcacttatatcaatgccacaactagtgaataaccgtgctatttctagtgtgagttctttctgtgctgattttaagcatgtttttcacatttctcatgaagtagaggaacgtgaattgctttcttctttaaatacttagggctatgttcggtttgatgacttttgtgagctcgataattttaaggagaaattatttgctaagtctaatttgccatgtccgactaatgctatttttcatatctttggtgaatataatggtaaaggaatatatttggtgcatagagtttacatctgttcggatttagaacctcatgtagatgtggataaaacatggacgctagggagatgttattgctaatcatattatctcgagtttgtcttgttttgatttaaagaaacaggttggttttgaagaaggggagcgacaagatcgctcaatgttgctactttgtgccactgaaaaagtatcatgtcaatgctttgtttatgaagaaggggagcgagatgagctgcaagagaattatatctatgtagttcctacatactttgcagtacattccaattattaggtacatttgtttcataggagattaatacaatttgctaaagaactaatgatattacatgataaaattttgttgcgtttgttttcttgtagacacttctacgggcaagatcatgcactacgcgatgaacaccatatgaaaaaaccgatgacgtttttccatgaagaagaggaggatgatgtgactatgactactatagatacaatcattgctcacattgtgaatcaacaagaagacatcacgataaaatccaccaagtgctggaatccgattcggccacttgctagagtgctgatttcaaacagccgccaggtgtgcatatgtgctccgttttgggcccgtgagtacttaatggaaagctatcggagtcctctttcaaatggatccaacctcatctccaaattccatctcagtcggccgcaatcatatgaacaaagtgttacgtcactcataatgggtctataagcatgtaacttcatttgggatcccagcctaagtggagcccatgtggggtgcaccccatccaggtggagcacgaccatagggaccccttggtcatcctcccacccccttaaatagctaggtacctcttcagggttttttggtttttgtttagattaaagtttagcttcactactttgccgtgtaatcctgtggtcgattagattgctgatttgctcgttacagaaccctaatttatcatttgtatttaattcctattttgctattcagattgtttttatctagttcttgcttgttttctcgatttgcttgcaggaataaggttgatctacactggctagatcaacaacccacggaaaggtgtatcgatcgctaaggcgcaacacaacaacatctcgtatggttgtagttgggtcgtcaacgtttctctcaaatcgtagttatcttcaactcatcgaaagatcggatcaatcatagtcgtgagtgtctcgagtggaacgcaagatttatcatggtgataataacataaagtatttccatgctaaggctaatggtagaagaagaaaggataggatttacactccggaacaggaaggaggggttattgagagtcaggaggagttgttaacatgtcggtttccccataagctaaattctttataccttcttgtgcacattttatacaatctgtcttaaaactgttgtgtcagttaaaaaggtccctaattattttcatcaaacctcaaacatttcttcttttgttgcttatcctgggatatttccttcaagtatttggcctaatttctctatactccagttattcagtcccccagtctgcaatattcagttaaaccacaaaagaaacccaacatctgctacacgcatttcttgttaaattagacttcagttatcttttagcataaacttattcaattcaacagaacaaggattgttagcataattgacatggctacaactaacaacaatgagagctgaaattctggcaaggtttgatcagagtcaagagatgggttctacttggattgcagggaggggggatcacaactatttctggagagatacctgggttggaaactatccatcgaaaactacctttcctaagttataatttggcaccaacaaaacattgctgctaagagaggtgattacccaggggatgggtgtgctgtctctcagaaggtctttcaactctggggatctagaaaaatggctggagttatcttccctagttgagagaacagtcctgtagtgtccgatgaacctgatatactgatccggcagtagacaaaaaaaggggcctattcgcctaaatcaatgtataatatgatcactttgccctgtggagttcccccactccctcaaaacaaaagcacttcatttggctggctattagagataggattcaatcagctgctcaactgaagaagagagggtgggcaggttcagagttttgtcaactgtgtggtgaaattggaaatgctgtgcatatttgctttagctgccctattgctgtcttgtatttgtagagatgcttgtggttgggctagattacctcaaagttttgaggatttcttcgccagagtcattgggaatgatagctccaaaaaaactagaatcagatgcatgttacttgcggttgcagctgtgtgttggttgctttggtctttcagaaatgatatgatttttagatgcaaacttgtctcatctccattagcaattcccctgcgcgtgatttgtctgttgttgcagtggaagccacttctgaaggctgaagaaattccgaccctggagttcgtgaagcgatcaacgaccttcgtctagcaagagtagggattggtctctgttttgggtgctagctgcgagtgtccttgggttggtaaactgtggcagggagttttgttcaggttttgttatttgccttgttagctggagccccgggggatcttcagccggttcatcagcagggtcgctcctagctccgggcaggggcggagccaggattatatcaaaagtagggcttaatcactagagtataaacttcttgaacgaattttaatagaaaaattagtaaattccttgatattttttctgccaggtgtggggcccgggcccaagctgccccacacctggctccgcccctggctccgggcacccaatcttatcatcctcctgttgtgctgtgtgggcagagggggcggcggcagagagagcagatgcatcgcagccgccagccggagccagtcgaagatgcagcgctggtggaaggtgtggcagcagggcatcatcctgagcttgtccaccgccacgaaatcctgcagacacacggcacactcgacttctctcgcgccggccaccgtcacctcacacaggccctggatggctcgaggagtcgaggcggggaatattgtccaatccagcgcgcctgtaggcggaggaggaggcagccgcgttggtgggtggagatgtggcgtgcgtggggtggtggttgatctcctcctcgtcgtcggatgacagctgatttcgtgggggtgatgtgcgatcgacaagggaaggcagatgggaggaggaggaggcaattttccaaacaaacgcgcgaacgaatcctccgttcgttcggatagcgggccgatttctttggagatgaaagggcccaatagcccatctcatccacaggctcgcggccggcccaagcgcaaatcagacggacttccttccccacctccctccgacccgcctcggctcccatccactaccgtttgctactccggcgccgccgcggccaacctcgcgcgtttccctctccctcctccacgcactcgccttccaagccgccgcggcgctgcgctcccccacctctcttctctgccgccgcaccgctttcccccgtcgtcgtcgtcgtctcgtctacttcagcgccagcgagaagcccccttgcccatgagcttgcctcgtctccggcggctacgcgctgccgcctcctaaccacgtcggtttcattgccctgtcgctgaccctgcgcaccgccggcttcctagggcttattggacaagatgtcgtccaagaagaactactacaaggagaagctgatgcggcggaagtaagtatcatttcacttagaaagatgtaactgattcgaggtagaaacaaaatctgtatgttttgggactgtaggagaaatttattaaaagtagattgtcaaaaaaataaaaagaagaagttgcaacatttgatggtatagttactgtttgcttgtaaaatagtttttgagatccagattctatgtagtagtatggtgtcatgaatttttgtaatcaaaacaaacgactgaagtcgttgttcttgcagttaatcttatagccaccttgttagacagtgattagggtctaaagaatcatgcaagtgacctgactcactgaaccatcccacttaactagatctttcgttcactttcaatacactgccttgcatactataaaaagaaaataattaggtgcagtggtgatttctttaccaatctgaaaaaaattacccgactgccct

SEQ ID NO: 72131 - DNA, 5989 bp, Oryza sativa
tcccctctcctcaatccatctccccctcctgtgcttcttcaccttctccacgcgccgccgtcgtcgtgccgccgcgtcgccgcttcgagccgccgcgccgccgccctcgtgctgtcgtgccgccgcattcgtgccgccgcgccgccgccgttgtttaatgtgaacgctggtattaaaatttgatcggtctatgctaggtcttaggcttgtgaaaagaattacaaaacttgctttacgcaaaagaaccatagccatcctttgaattcccctgtcatgtgcattattgctgtggtggcttgctgagtacggttggtactcacccttgcaatatacaaatttaatcagaggtcggagatgaagcttcggaggatccctacgcttactactaggagggtgatgaagacgatggcgcccagtaggtcttagttacggtcgttgcctgtggcaatggcgtgccgctgccttaactccgctgccttaccttcttctgtttttggaatgtattccggaccgctcggtccgatgatttaagactatgcctgcgggcttatgatgtaatgattcgtactagacactcgtgtatgtgcacttgatatttcagctaagaattcgtgtgtaccagactacttgatccagggaaatggtactgtttacacgattgattcctgttataaaaatgggggtccacagagctggtatcagagccatacgactgtaggaaagaccaaaaggcgccccaccccttttctaagctggccaagggagaaattcccatttagtaatactttcaaaaataaaaacactatgtttacaaaactcggaacgattttcatcttactcttagctattttcttcacaaaacaagttttactcttagctgactttgggtttttcttaaaattagatggcagatcaggattcacccgccacctgggagatgggcgtaccccgctcagagggatacgtcattgagctacaccggctgatgaggcgtctgcgataccccagatttccgatctaccgagtgagacaatgtggatctgtttgggaggctcgggtcgaggttcacacgctagttccttcggagttagactacagcttcccgacacgccaccgtcgcgacttgccggagaccgcgatgcaggatgcagcacgggaggccttcctccgacttagctctatccaccgagctgagttggcgagtactgagtttgctcaccacccgtttcgagaggagagcaactccgtctgcacagttcaggacacaccttgctgctacaacccgatagtgacccgactgtcacgatgggctgaggtagtagacgacttttacgaggaggctctgttagagatcgacgaccagcagaggcgtgtgggagagttagagaccgaggtgactgacctcacagcgcagcagcttcagttggaggaggagcaccaggcttggggcagtgagatagactcactgaaggcacagctccaggtccacggcgaccagttccagcagttatctgactagtacaacgatcgccgcgggatgatggatactcttgaggagcagctgagagagagttaggagcacgtcagccagctggaggagcagcttcgagcagccacgatcagcaccacaagagcttctacttccacagtagtagggcgtgactgctacttcttcctcaccccgccgtacccaccagcgttccacgctcttctgggagaggctagtacgctagctaccgagtcagcaccttacctagtggacccgacagtgacatagccacctgccccggagattgtccacactccactgatccccgcaccttctccgcagccgggttccagtttggagactccgatccaggtcgactccgagacagaggggaccgacaccgagccagagaccgagccagacatcactgacccttcagaggatgagactcttgttcctcgcatcaccttcctcggaggacctcgcaccctcagcactgcccgcaagagcacacgacctccgggcaagaagcccaagccagatccagaggccactacttccgagccgtggggactcaggtttgcccgtgccagcgaccaccctctacctgccccgggatcctgcgaatggctggatgactagactggaggacttttgcagcttcgatctcgcttcagatggtttttggatagtatgcgagacaccccccttacctagattgacgagtagcttgatggttagttcgatgtatcttttggatgaaccttatttgtactgcgtatgtgtgcagtcgattgcatcatgatttatgtaccatttgtggaactctgtgatgttatttatgatattattgctgttgtgttataaatgagtttattccaccatgcttgcaaaacaaagttcacaccaaaacaactcccttaatgggataaaaccataagaactagttagaaaattaggatacttacttaaccggcctacacagatggcaagccgacgttgggcgtcaaccagcaatgaagaaactcagacacctgacctaactaccctgtccggagttatggccactcaaacccaacttctgcaagccattgcaaataaccaaggcaaccgtggcagatcgagctttggagaatttatgaggaccaagccacccacattcgccacagcggaggaacctatggatgcttaagattggttaagggtcattgagaagaagctaactcttgttcgagtacgggaggccgataaagtgatctttgaggcaaaccaattggaaggaccagccggagactggtgggacacatacaaagaagcccgagaagaagatgctggagaaccaaactgggaggaatttaccacagccttccgtgacaacttcgtgcctgccgcggtgatgcggatgaagaagaatgagttcaggagactacggcaagggaataccacagtacaagagtacctgaaccgtttcactcagctggcgcgctacgcgactggagatcttgccgacgaggaggaaaagatcgacaaattcattgaaggcttgaatgacgagttgcgcgggcccatgattggacaagaccacgatagtttccagagtttaatcaataaggtcgttaggctggaaaacgaccggaaggtcgtggagcacaatcgcaaaaggaggcttgccatgaaccgcccgcctcagcccgtaccctagcgtcataaagggacaacctcctcagtatggagaccaacagtggtgacaaccaatcgtcctaccgcatccagcaatttccacaggctgattaccatccagaaccgagctcctgcaccgaatcaagccgccactggatcagtaagactaggaagttgtttcaactgtggagagtatgggcattttgctaataaatgtcctcatccaaacaagacacccatttgcaccggagctaatgcaacggctattcacgggactgctacccctgctgctggacgaggtctattcgggactccgcagactaacaggaccactaccggatttggacgcgggcaagtgaaccatgttcgagctgaagaggcccaggaagaccaaggcgtactgatgggtatgttttctatcaactccactccagttaaagttctcttcgattcaggagcatcgcattcatttatatctttgaaagtaagtcaacaacacaatttgaccagagttaaattaagacaaccaatgttagtacattcacctgggggtgagatagcagtggatacagcttgcattgatgtacccatccgccttagggatgtggtatttccctccaatcttatggtgctgatgccccaaactcttgatgtcatattgggtatggattggttaacaaagcataggggagtaatcgactgtagacgtagagaagttaccctgaccacaccctggggatcggatatgagagcaaccatggatcaagatcctagactaaccgaacgtgccggaggcatatttaccatgctaccccaaaaaggaattcccgtagtgcagcgatttcctgatgtgttcccagaagatttacctggaatgccaccagatcgtgacatagagttccttattgacctgatacccggaactgcccccatatccaagagaccatatcggatgccggtcaatgagttggaggaacttaaaaagcaaattagagagttgcaagaaaagggatttgtacgccccagttcgtcaccttggggagccccagtgctattcgtcaagaagaaagatggtagcatgaggatgtgtgtagactaccgttcactgaacgaagtaactatcaaaaacaagtatccactaccacggattgatgatctttttgatcaactcaaaggagccaaggtgttctctaagattgaccttcgatcaggataccatcaattgaagattaggaccggggatatacctaagaccgcgttctcaacgcgttatggattgtatgaattacacagtgttgtcgtttggattaaccaacgccccgggcatattttatgaatcttatgaataaagtgttcatggattacctggacaaatttgtggtagtattcatcgatgatattttaatctactccagagatgaggaagaacatgcggaacacttgcgattggtactcgagaaacttcggaagcataaattatatgcaaagtttagtaaatgtgagttctggttaaaagaagtcgctttttaaggccacgtaatctcagccggtggagtagcagtggatcctgctaaagtggaggccgttacggaatggaaagcacccaaatctgtgactgaaattcggagttttctaggcttggccggatactaccgaaggtttactgaaggattatctaagatagcccgaccaatgagacaactactcaagaaggaaaagaagtttgtatggtcagaacagtgtcaggaaagctttgagcagctcaaagaaaagctgacctcggcacctattctagttcttcccgacatcaggaaagactttgttatatattgtgatgcgtcaaggcaaggactaggaggagtactgatgcaggacggaaaggttgttgcctatgcgtcgcgaaaactgcgaccacacgaggaaaattaccctacccatgacctagaactcgcagctgtggttcatgcgctaaagatttggagacattatctaattggaaaccattgcgatatctacactgaccacaagagtctgaagtatattttcacccagtcagatctcaacttgaggcaaaggcgatggttggaattaatcaaggattatgacttggaggttcactatcacctcggcaaggcaaacgtggtggccgacgctttgagtcggaagagccattgcaatcatctgaggacggaaggaatggctcctgagcttaaggaggaaatagcccaactaaacctacatatagtacctcatggacagataaacaccttggacattcaacctcttttgagaacccaaatagaagaggcctagaaggacaacgaggaaatccgagaggtgaaggaacgtctagctgcaggatttgcaaaggaattttcaaccgacgagaaggatgtcctatggtataaaaagaggatttatgtacccgaacagggtggactgaggggattaattttaaaggaagctcacgaatcagcatattcattgcaccccggaagtacgaagatgtaccaagatctgaaggacggttactggtggcccaacatgaagagagatgtggcagaatacgtagcactctgtgacgtgtgccagaaggtgaaggctgagtaccagagaccggcaggtttgctgcaaccccttaggattcccgagtggaaatgggatgagataggtatggattttattgttggattgcccatgtaacgccccgattttcgttcgggtttaaaaatcaattaataatacattttctagaaattaaataaaagttaaatcaatttatccaagtgaaatgttgggagaattaaaattttcccttaa

SEQ ID NO: 72132 - DNA, 3175 bp, Oryza sativa
atacattccaaggtcaaaagatctgctacatatgctaaatagatagtgcatgtgttctttcttttgcaggcttgtcagtctgtactgtagaaataaattaaccgcagaacatttttcttgatgtgtgatggaaaatagtcaatatcctgttatgatagtactccgtttggaatacatgggaatatcacaatgaatactagtaggtctatacatgtgtttttttaagggaaaattgtaaccatgccattataattttgcattgaaaaattataatggcatggttccaaattaccctttttttaaaggtacacgtggttctcgtatatgcacttgaatgaattatagctatggtattggtacctaacacaactgcaagcagtttttctattaattccttttggaaattaatgtagatttgtcttcccctacaaggctacaaggggataatatgttcactttccacagaaaaagtagttctgtagacctgcatgtttgccttcatgaactatagttgtaccaaataatcagatattctaatataaatttcttgctcaatcgactacattaatgccattccgttgctattttgcagttgagaaatttagtatgggcaactactagacatgatgtgtatcttctatcacaacgttctgtgcttcattggtcaccattcgccagtgagaagcacaaagtcattgatcttcaaggacatatcacgccatctgaggtccctatttctctttcaaatgtttatttgaacttgctagcctcatgaatagccacttctttgatatttgtattgtaactttgtaagcatacatattcaaattccatatatttgacttcagaagcaccaggggaatgtctccgaggggttttaccaggctcaagttagtacactagcagtgagaggtaatttgcttgttgccggtggatttcgtggagaactaatttgcaaggtaattttctttcataacctcttgttcaatctctgacatctatatggagttacaatgtagccatggtgtaatgtgtaaattttgtgtggggatgtagtttttggatcgtgaaggaataagctattgttgcaagtcaacacacgatgacaatggcatcactaattctctggagatatttgagaaacccaggtactataacatcattttaaaaactactactttgtttaaaatgaagtgagaatgtatgaatcataacttcaaaaaatgaattatgcagtggttcggtgcacttcctggcttcaaacaatgattgtggagttcgagactttgacatggaaaaatttcaaatttgcaataatttccgttttccttgggctgttaatgtaagcctttacttcattcatcaaactgtttatatctatatcttgttttatttattggatactcccaagtcctaatctattcgccacattcaagtcactactgaatgctttgctaaagattcttgcattccatgaggaaagaaagcctaatgttttattgatttaatcttgccccttgttttataccatgcagcacacatcattgagcccggatggtaaacttgttgctattgttggggacaaccctgaaggacttatagtcgatactaattcaggaaaagtaagcagaaagcaacgctcagcgattaacttccaaatactgacctcacatttcagaaaaagaaaagctcatggctgtttgtttctcgcagacagttcatgaactccgcggtcatctggactactctttcgcgtcagcgtggaacccagatggccggacattcgcgactggtaaccaagacaagacatgcaggatctgggatatccgaaacctttccaagtccgttgctgttctgggtggcaatatgggagccatacggtcgattcgctacacatccgatgggcgattcttggcaatggcggaaccagcagatttcgttcatatattcgacgtcggaagcgggtaccgaaggaagcaggtggtggatttctttggtgagatttctggcatttcgttcagtcccgacaccgaggctctgttcatcggtgttcatgatcggacctatagcagcctcctccagtacaaccggctacggttctactcataccttgattctgctatctgaatttgctacttgcaatcactggcagagtaatgtgagttctgaatcacaaaaaattgtagaagctagtaaagtagtagagaagatgtagatatgtccatatctgtagctgttactgtaaaggaacctgaaatgcatctgcaaatggcctgttgcttttgctggacaaaactgtatccatcagacttcagggtgagcaatcatcctacggaagagaagatgttatctggtacggcgctgtctacttcagcaaaggctgaaaaatatcttgacctagtttctgctgccgccggtggccggccggaccgccgtgttggacgacgttggcggcggcggcgaccgtgttgggtcgaaatgggcccccacagagcatatgggctggaccgcctcgttgggtttactacaattgagaaagaattggaaaaagtatacacaaggtccctcaacttgtcatcgcgataaaaaacatcctcgaaccgcaaaaccagatatgcgggtcttcgaggacttttggtagttttgaccccggttttggtctatgtgacggctgaattagcgtgagccccacatgtcagcgtggccacgtcagcctcctctctcttcttcctctcccttctctctctcacttctctcctctcgggcaagccggggcgggtcgggaggaggtcgctggggcggccggcgacgcggcggcgtgagcacgagggcggtcggtgaggagaggcgcgtggtggccgtcgggcgcgtcccatctcgacggctagcctatggtggcagcgtgtgggggatgtggcacccgggtacctcatggtagaagccaaagctatgcttcgggggtgggccaagggcccataacagatatagtaagtgtcgcatagttggcaagagaggaaagcatactattgtatcccaaatcatgtaacaaaaggcgagtatccagattattgggatacggggccttcattggcaccggtgggcctatgctggtataaaggacgccggtgccatctcttaattcttcttgggttttttatcttttgaccagagacgg

SEQ ID NO: 72133 - DNA, 10104 bp, Oryza sativa
gggctcacctcgacggcagacacaaggggatccacagccatggatgacggcagcggctccccatcgtcctcgctctccccccccccccccccaacgctctcgccgctgacgccctccccttctcccgcgtcgccggccgacatacctcctctcttgccgcaggccgcccgtcctccgcctcacatgtgctggagaagctgcgcccatgcccacgcccatgccgaggatgcccgctgcatcgcatcatgtcccggtcccctatcctccacgaatcccccgccattgccatgaagtgcgccgcatcggcaatgaatctgaccagcgaatccccagcagcggcggcgaccagttgaagaggtgcccctttggtcgccctacactgtcgtctctgtccctgcgagccgcctaccttctctagtgtcgctgccatcaccaccgtcgcgtcggtgagacgctggcgtggacgacggggagcacgatggcggcagcggccctatccttgcccggagccgccgccgccgatgaggctgagcggtgcggagttgtcggtgcctccactcctcatccgcagctgcgctcgcctgccgttgccgctgcctctccaccaccgcggtcacgctgccgccgccctccccttctcttgtgctgcatcgccggccgtcagagagaagagtgtgtgagagagagaaacacgaggtaaggagaggagggaaaagaaatacatgtgggacccacgctgacttagccgccacgtagactaaaatcggggtcaaaaccaccgaaggacctcgggtgaccggttttgtatagttaaagggcaccgcatatctggttttgcggttcgagcacgttttttatcccgatgacaagttgagggactttcggtgtactttttccgaaggaatttgcatcctgggttgttctgggcccatctgtacggccttcgttgggagctttccttactcctaccacgacgagtaaactgagcctcatttacgggaaggcccataatgagccgggcttcactgcgaggtcacccgcgatctgcgtggtcgaaggactgcaggagtcgttcgatcgagcatccacggcccagattaagatggatgaggaatttcttgcgtagttaaatatctgatgaaatgcatctcatttattatattcaggaaattattaaaatatataccaaaagaatttccaaaatgataactggataacccaggactgctgagccagagatttcttttccgaaaacatagttacaaagaaaatttacaagcttcatgtcctaaaatactactccgtacaagggaaaatttatgaaagcaagttctatttcctgatgcatatgtatcgtgtatcggtgattccatggctctaagctcaagtaggtacatactcagtaggagagggcaagagccgtgcaagaaaggttcctacagcagtaaacagcagaacaaactggatgaaacaaaagagtgaaactctgcttgctctagactgcaaccgcaggacttctgaactcccagacagaactctgcattcagctcttagcttctccgccatctcttctaacatcgccgctcggttcttggtatgctgtagtttaagttcaagctgcttgtaatcccccgacagagatttctgcgcgttatagagagctatttgatcgtcaactagaggtgcccaggtttgagcagctcttgtcaggatgatgctcttaatctcggcttctgtcttctccaggaagagccgaccaaggtaagatgcttcttctggtctggactcaggatcctttacattttgacttgttccttcaagaggttccgcgagatcgactaaaccactccaatcatcgtcgtttccatcaaaattatcatttgactctttactgatcactgcaaacattttaatctctgcagtaagcatggagcaaaggttatcataaagcaattttgcatggatgaaagttcgaaccaaggcatcaaaaggtacagcatgttatcaccacaataccggtatgagacctcagattcaatgaaccaaggaaacttacaggagaagttttgattggttgatcaagccacttctatatactgtagaacacaaagcgctttacccatttatttggtactatgcctaaatggcccagttattagaatactcaacaaggtaatattattacaaccgtcaaattgagatgtcaacaacttcagcaattaagttcataatgttttataggttccctgagttgaatcacggaatgaactagaattatcacttaagaaattgattaatcagattatagttgcttgacttaactaccactccaccaacatcatttatccgaatactttttatcatgactgaacaccataaggcagctataacttatttgtttccacagaactggagtaaacaacatcatgaaatagtaacaaataactgaaccatgacatggcattgcttcaacatcagtaaaataataacaacaactgaaacagaatttaacttggcaagatccatgaggctaaacgggaacgaaatcaagtataccattctcaagcgcttcttgcgttctctgaagcaatgaaatcgattccgcatacggatcagcactcgacttcatccctgatccaaggtcaccattgttccccacactcctctgagcagcatcagcatccgaatcaacactcccctgtgccaatctcctcaccaccacgctcccattctccacattgcagtaatctctggccatcaatggcgtctcctcgccgtgatcacagtgatcggcaagaaccttgtggattccattgccggcaatcgattgccgccgggagttcacggcattagagcagcgcagcgagtactgcgcctcggcggcacgcgcgcgcgcggcgcgggaggagcgccctgccctgtcggcggcgaagggcgagaggtcgttgtggcggcgcggggcgctcgctgcggtggaggacctgctgccgctgctccggtcctcgctgtggtcggagtcggcgccgcccgcgccgacggagaatcccgaggaggcgacgagcagcacgccgaggctcggatccagcttcgccggcgggacgaagcgggactcgacggaggcggtggagctctcctcctcctcctcctccaagaccacctcgtgcagcttccccctcggcgcgccgccgggcaggggtatccgccgcttgtgcagctgcgccgagccgctgccggcggcggcggaggcggctgatccttccttgcgctgctcccgcgggatacggcgccatcgacggagcccacggcctttggtctttatcacgggagagctccccggagatgcaccggcctccacctccgccgccggcgacccgacggcgccgttctccatatcggccgccggaggtggcatcaaagaatcgacgaaatcatcgttgaacgggggttgtcggaatcgagcaaggtcgtagtaacgaaaattttcagttcgtttggtctcgtggaaaggagatcgagggaggatgacgaactggacggcgacgacgacgaaagggagaaaagatacgaaaaagaagtgatttttttcccaccttaacagcagcccttttccagttctttctcttcttttttttttccaacaaaaatggcgcgttcgcgtacggtgtctgcgtcagttacagccacgtctcggcgaaacgcattttaaacaagcgagatggcgacgacgtggctagctctgcttagctcagcagcttgattgaactgctatgttttttttttaagaattacacggtataacgcaaacactcaccacgcacatacactcaccccatcaacgcacgcacgtaaatcctacccctatgagcatcttcgaagactgggccggaaaatccttgagattgatgcagttatgacgggtatgccgcctacaactgaaagctagttcctgtcaaaattaaaaatttgattgaaataggaacaatgtgatgaaaaagttaaaagtttatgtatgtagaaagttttgatgtgatggaaaagttggaagtttgaagaaaaagttgagaactaaaccaggcctaaatagtgaggtggagaaaaaaaaagacgaaagagataagggcacggtcaatgcaaggggtacctgaagtgccatctaggatggggcaacacccccagaaagctaatttcccatagtgcaaattgctttaggtggtagtctcacatttttatttcagcccctggtgtttttttaagtcctcataatttttcaatatatatataagttcaaaatttacactaaacatcccaaaatctagaaattgatataaaatctctcctccctcactcttctcccccaccgacaccccaaaatcccctttccccatgccgtcctacttcaccatccgagctcctcttctttctcatttatttcaccatccattcccatcctcgtctagtctcctccacccgatcctctcttcgtctgtcgatttgatgtgaggaatgctacggcggttgcgttgaaagcaaggggtaccgtcggcagttcccgccgtcgccgcttccctcatctccctctctatcccagcctccgtcgccactttctcctactctctcacctctttatcccggcacgcagggtggccgacggtgcgcttgtcacaggggccacggacggtgagaggggcgcaggggctgacgatgagcaacgcacaggggggcggtggccagatctagtcagtcgtgtcgtcgccgtcatgggcggatctagccacggcgcccacggaggaggtcggcgactctttcaatctctctctctctttctctccgtcatgggcggcgccggatttgctcatcgcctctctttccccctctcttccccgctgccgctcgttgccatcgtggccttcggctcctctaccacctcaccgcctacagctctgcccaagggtggaaaggggaatacagatgtggggagcggtgtccacaagctacggcgtctcctcgcttggttcctctgccaaaagtcaccaggagcgcgtctcctgggagaaaacgtgcgcctctccaggggcacggcacaaacgcgaaagataacggtgtaatactaaacgttattattgcacgataaccttccaatagcacgagccaaggtaaccgttatctttcatgccccctggtagaaaacacgcgcctctccaggagcacgagccaaggatacccattgctcatgctctaataacctaccaatagctggtgcaaacgtgcaaagttggtggaagctaccagaacaacctacccagggcactcttcaagtataaaatgtaacggatatataatgtaaattcaaaacttttgttaatttttttaatacaattgtttttatatggatgagtatacgtatttgcatttgtactatatttttttacgcgtatttgcatttgtactatgtttctttaaagaaaaggttactaattctgactaggaactggtgattttctggtatgtctaggcctgtttggagagtttaagattttgagaatcagctgtttggtagccaacttctaagtctggaaaagttagttttccagtttctggcttctagtttatttttttgattttacaaccacatcttctcagaatttaaactaaaagctggatggtttgggagagtttttgattctgggagaagctacagaaactcctccaaacgtacatagggtcttgtttgggagcttaagattctgagtagtagctggctgctagtttatttttttattctacaactacaacttcttatagctgaatcaactagaaactcctctaaccaaagccatatatagtctgtagtctggttctacgggcccggcttctgctgtaggcggacaggtcagggcagatcggccgaatagcgtagacggcgcctctctcggccctcgcggcggccaccacaaattgccccgaacgtccgacgtaaccgggccacgttccgcgggccagcgcttgcggtaaattgcttctcccgtccctcccacgcgacgcctcccgctcccgtgccggcaaccgatgggtggtcgtgccacactgccgcctgcaactgcaaggtgggggacactgcgcacaaccgcacccgtcgtgggctcgtgatggtcagcctggttgggggtgggcgggtgcggttggagttggagaacctgctgcgatgcgagatgccaccatcccggccagcacgctacccaacgccatagggccgccaccgcacgtctcctgtctccaccctctcctatcccatcatgctggcacatgccgctgtcgacgccgacgccccttccccatccagcctgccttgcttgccatgtcctactactaccactagtagcagtaaaagcctgcacagtgcagctctgcagatcgaggacagtctgttcattttgggcccagtagtcatcttgcagatgagatcaaaatccgcaaccaacatgacacggtgagtagagtagcaaccatggaaagagatgttgcacttatcaacatgtagtacagtaacaaccatcatcaaatgtccctacaactccgtctctctcatgctcgaagaatataataatctcattgattgaaacacgtataggaaaatttaagcggcaattaaggaagtaatagtatagttgtagcagtagaagagtacagcaacacacgttaattaatcacgcgagagcgatggatggatcggccggtaaggtctcggtctcgacctcacacgaggcggcggcagatggtgatgccgtcggcgatggcgagctggcagacgtcgatgcgcgggtcggcggcgagcctggagttgaggtccctgatggcgacggagaacctccggtccaggtccgacagcggcgtgtccggcggcagcgccaccgtgccggcccacagcgtgttgtcgtacacgatgtgcccgccgacgcgcaccagctgcagcagctgctcgtggtacttgacgtagttgggcttgtccgcgtccacgaacgcgaagtcgaacgccgcctcgcgccccgccgccgcctcctcggcgagcagctcgtccagcttctccagccccttcccctcgcggaagtccaccttgtgcgccaccccggccttctccaagaacggccgcccgatctcgtagctctccctgtccgggtcgatcgccaccaccttcccgtcctccggcagcgccagcgccgtcgccagcagcgagtagccggtgaagacacccacctcgattgtcctcttcgctccggccatcttcagcagcatccccagcagctgcgcctcatccgccgacgactgcatgaaccccctgcatgaattaatgggctaattagttaatcaaccccaagatctagcttaattaagcagattaattagcagagatcgtggtttcttaccactggtgcttgtccgtgatgaggcgcagatcgcgcatgcactccggctcccgtggcagcaccgtcgtgtccaggacatactgcaagttcaccggcgacgaacacagcaaccatcagcaaattaattaaaacagagagatcatcctaaacacaatccggcgagctgatcaagaatcatcagcagcacgtaccttgtacagggcgtcgctcttgagcagcgtcttgttggtgctgtcgatgtcgctgtgggcgttcttgatcaccggtgcgtcgccattgccggtcgtcatggcgatgagatcttcctccgtttgagctgttgctgcttgagctgctggtggtggtgcgagtcgattggttgggtcgtcaaccgagagctccggcgagcaatatttatcggctcacgagagcagggttggtggcgccaccaaacacccggtcttttttcctcccttccttttcaaaaaataaattagcaatcgatcgatcgcacggtgacctggttgttgagccaccaaacgtagtggccatgatcagtgcccaaaaaaagggtattttataagcgttaatttggtcttcccgttgagacggtccagtaaactgaacattattacagtactcagtactacatgtactacttcatgcatgatgcatgtgaaatttttgttttttttcccctctctttcttcttcttcctaccaccaccacctgccgcgacctaacctgctttcgtcgtggtttggttaaagaaagggatcgcacgcttttgtccaccctgtttatcccaatattattccgcctgcttaaaattattttgcccagggaagaagaagaagcttcagcgaaaacggcttctacaaagctgcgacaggtagtactagtagtacagtagcaaccaccagctcaccacgatttacctgtgatggaaatgattaatgagtggtgctgcgacttataattaagaaatgcagtagcactccattagtttaaatttgagatcgtgttctgaatgtatttttgggagaaaaataaccaggagaaagctcggagctgtcacgaagatggatggatctagtaggcgcttccattgatttgggcacagtgaattttctggtggcgactgtggatgggcagccaaaaaaggagtcaaaacagggttgctactgtccgaagactcctaaccctacatctaggatgttgtctatgtcattaactatattattatttactagaacttttaacttatgtgacattatattaattaagagagagtggagagaagaagaaactgggtctcatgtaagaaacagcttcaacacgagaacctatgcactagacattatcaagttttacattgggagaaaatagtgccgtcataatagataaagaataaatatgattgatagaaaagatagatgatgtatttattaatgacccactttaagaaactatgggttgtggagtgtagtttctattatgatgtcttattgacatggcaccatagacactacttatgaatactatggcttgggactgcccctgagaggatgcaacaattgcaggtcgctaccgcgaccagaggagggagcacgcaacaaacgtttttgtgacacactagcaggggcccaacggctgacttccttccgtccacacgccaatcaccaaacgcacgctggtagagtagtcgtatgcggttggaacagtagatgtacaacatcattggaccgagtacagtacagcgacgacaatagcatatcccattaaccctccattaattacggaacccaaaatcgtagtcgaatcgatcgattttgcacctcgaacatcatgatggtcgtgttgtgagcttatagtactcatttccgtcccaaaatataattatttttaacatagtaataagtcaaatatttttaattttgattattaatagcaaaaaagaatcaatcatacaaaattgatgttattaggtttattattaaacaaactatcataatatgtaactctttttatttaaaatattttatttttatatagatatttgttgatcaaagtagtatgtcggcgaccgtgtaattttggaacggagggaatacttcattctcccttcaccaaactcaatatatacacctagtaggcccactgacagggacacacaccaaccctccagttatcgttgaaacgaccagaaaaagctatggatgggtgcaccgtgcacctggacgattggttggcgcgaattcgtccgtcgcgcgtgcgatgcgagagaagaaggctccgatcggggcattgctggtggcgcgccgcatcgatcgatggggccaaaattacgaggacgattggcgggcgggtcgccgtcgctcgggtcaccggagtccacaactctcgcagagtggcaagggtggggtgggggtgggggtggtggtgccctggtgggccgagtggcccacgacgacgttatcgccggtgggtgtaagtcgggagggcactgattggctcgtccggagtctggtcattaccgaatgttactagatttgacacagtacttttgtttgtctcatagtagtattgatttcgagcctctcacactgtggtacttcctccatacataatactttatccgttttataaaaaaccagctataaatctaaacataggctatatcctgattaatagctagaagtta

SEQ ID NO: 72134 - DNA, 47162 bp, Oryza sativa
gtgctatttatccagaaaaaatgatctcatgacaagagatggtggcaagttaatttgttgcatggtcagttactggtttttaagtacaaataaatgtggcttaatctcagtccttgaagtatacggaatggcacatatttggccaactccaccctgtagagttatattcatctttaggggatctggactcatgttgagttttagatgtttagtgagcattagctttaaaaaagaaggggtaataaatatagatatcgtggtgctattttgaaacagtccatatatgataatgtagatcgaaacaaaatttctcatggtctagattctttcttcaattagaaggctagtaccacacacgaatatgatactccatatgtacatacgtatttgatttggcctagctaatctgctcgagtaattatacaaaagaatctagcttagctcatccatgaaaagtagatgtataaatgtcatgacgcaaccacagcatgctataatacagttgccaatagtttccagtattgcaatccctatagctagctttaattaaacaattgaaattagtaagaacacgtgattacaagttttctagtggaatagtggcgacgaagatatgatgcttagttggtgacaatgaaactgcataaccagcatatctgcatatactttgcaaagcaatgagcaaaatgcttaatcgagcatgcatgctctatgagagagacgtaaaacgtttaccctcgatcatgcccataatgcaaattgggcgttaatgaaagctttagcttctccctttatttcggatatcaagttgtttaatttcttggaataatatatattttagggtatgtgcttaaacgatactagcgcacctagttcagcccataaggatgaaccccatttgtttatacttcagcatttctccctcacgtacgtgaaggctgtcttagaaacctgaggaaacacatatactctctcctcaagaaacatgcatatatactctctccattccaaaaaattaatatagatgcctttaacttttattttttttcacctctcaaccagtcacagccatcatattttatttagtgttgtttatacctcgttccccatttcaaccaatcacaaccatctatcattttattttaccttttttttattgatactcaattgtaaaagtctttatattttcggatgaagtgagtataacgtgggatatgatttcctttatttaactataccatatataataaattgtttgcaccggctaattcattagttcaaaagattatgctaatgaaaaaggtatggatgttatctattccattatttaaaaatatatggctaagcaatagagatgatccttgtgcagccttaaatctttgccatatacctatatgactccaagtttttcccttgtcccctgtatggctccgattttttttgtattgatccctatatagccatttagttagttctgcactagatttttttagaatgattattttacccctcccttatgtacatgagttagctcaaaaggcataattttcaatgtaaaccaaattttaaatttataactaaaggagataattatatcaccccacatttaaattttgtaatgaatttctttgatgaaaattttaaatggaattttcaccttctctctacatggggatctcttcaaaagtagttgaagttgtttaaaacatatagaaatttggtttctaataagtagaggaaaaataaatgttgatttgtgcaatttccctatttgaagttttattaaatttgattgcaattcatttgaaaattttgaattgtcaaacaattatctcccttcaattttccgtactgaagttttcgccttcatgattatgtttcactagctcttatataaagagaggagtggtaatatagtcattctaaaaaagtaatactcaactcacagtcaacttatgaaatggatattgaggagtagaggatgtgagacaaagctcggaggaatgaaaagggtagagtaccgtactcgagggcacacaaggaattttctctgagtgataatatgtttaattaacaacatgtacaagaaagcacacaccgataaacatgcattttacatctttaagaaataaacatgaatttattgaggaattatactgtacttcctcttgtccttgctttacgtattatagtgcaaaattcctcacacctcacgataaaaggtgtagtggtcggtagatctccaaattgcaggaaaaggagtggacacaaagtttttcatcaaaaactaagacaatctcacaccaatcaatcgatgtgaagcaattgagcattcatgaaatgcatgataactcgtgctgattctccatggctgctgtacttacctacatatgctccgtaggagtataaactagtgacactgatgttcttgggtaaagcttgcaaaaaaaatatgtggcacatcattgatttctcctcttctttataagtggcaactagagaattaatcctagtaacccagttttggccatgcatatattccctcttaaaaatgatatcatgattaatatagaaagagattcgagccaaaattaaagacaaggttgcttgacctcgagatgctcatgttccagaaagaagagctctgctgaagctccatcagagagagattcagagatgtttcgcctcgataggcttcagcttcaagcctgcatgcatgttcggatgttctgttctgttcgtcgcctgaagacgacgttagatatcaaggagcattttactaggttggatccgatcattgactgcacaaaatgcgatgtaaacgttgtactaactatgaaggaatcaagatggcaagagaaaagagtggacatgcatgtttccctgcaaaaagaaaggtaaggttcgtcagatacgctgatcgagttgtgcatgcaatgcaggctttgctttgctttggtgctgcatcgacatgacattttctgccccaaatggtccccaagtcaccaactaagattgttcctcttgtgattgatcagcatctagtcatggatcgatcgagctcccaaccaaaaggagagaggtttccttcattccccatcctagtgtgagtactaggaccattggaccaatccttcatgaagaaagatgctcaaatctgagctcctttttcatgttgcgaccaactcagcagcataaagaatccattcgagtttgagatgcttgcactgttgcacaggatgggagaagagagctactccatccgtttctaaacgtacttatcagccttgactcagttctatttcaaccattgaccatcaataaagaaatatagtttagtttctaaattgttaggttgtgataatgtgatggagaaaaatatatatggttaattatacctcaattccataaggtaaggtgttttagtttcatccaatttatttaacttcgacagagtttacggaaaaatacaccatcatctacagcatcaaaattagttccactataaaatatgacaatgtattaattggtagtaaaaatgtttatttttctaaatatttgatttagggtcaaactaaaacaccttataatttaaaacgaagagagtatttagctacaatatgataatatggtatgtttttaatatttgtaaaattattgctgaaaaataagggtctgttcactttgatgccaaaaaaaaccttaccaagttttggcattaccaaaattttggtatagttgccaaaatttttgcatgatttcttatatagttactaaaatttggcagcaaactaaatgtagccacttttttggtaactttatcaaaatttggtaaggttgaaaatggcatcaaagtgaacaggccatagccagaataagtagtgtgaaacagaagtagatgagaggatgaaaaaaataaagccagaataagtagtgtgaaacagaagtagatgagaggatgaaaaaaaaagtgcattgaaagaagttagttctttgacatattgacgcactttaaagatctgagatctatcactgcctctcttttgctccccttgaaaagaggagagcagggcggtccctgacaatcataagctgattcaaccttcacaataataaaaccagtaacttagtagtttgcacttgactattgtaccatgtaatgttaatgaatgcaaaagcaattggttctcacagactaggacttgatcgcattcaaaaaatacaaagttgcagagatacaacaaggctgaagatcctcgttatgctgtgagaattacatgataaggaacagtaaactgacaaaaatgtttagtgactggaagaaccatgaatatggtagcgtatactatatgatgattgccatgagaaaaccgatcctgctatgaggatgccagtttcctgagaaattcaggcactacctgaccacagcttgtaagaacctcagacaagggttttgcaagcagagcatcagcgctagaaaagatgcaatgcacctcccccacaagcacatgacagcttgcaccagcgaggatttcaatgtattcgtcaactgaaggaggcaagtctgcaaccaacacagtgtcgaagtcctcaaaatttgccgttgttatgttctcccagtctttcacaaggacattaatcagcccaacactgaagaaaatccagagaaatgtaagttgtcaaagtaaaagaaaagcagccaatctcaaatcaaaagataatggtgtgactacaattccctttcaagtaaacccccagtcttagtgaccagttttcagcttggaagagtttagggaatgttaggtgcattgcacagctcttggtttgtccccatagataggatgttcggcaataaactacatactgtaaatattttccatacctgctgcatatggtaaaagagttgccatgcgagtcattggtcacggtacaattttgcaatttcaaggatgatgacagatgctgtgcttcatgatcacttgcggttaccagtaggacctttgcagtctttctagcatgatcatttagaatttgttcaagaatttccttcacctgcatgttggaaaagcccataagcttaccatggcaggcaaaaaggcatattttaatcgcacaagagatttgtaactgtttctgttccaaaatcacaaccgtgaaaacagtacatgaggttaaaaggcttaacaacacagagaacaaggctacaagagtaagataggcagatcaaggcttagcaaggtgatctaacagactaatcttcagtaacaggaagcagattcctttaagtgatattatgaagccaggatgactgtaaaggaaaactatttttcaaaggcaagtacatggagcaaataagtaatgaactagcaatacatcagtggttattggttatgataattaccttcggtgccttttggtcctttgatgggcatatgtgtatcttttgtgttatgaatgcacctctagaagtaactgaatcattcgtacaaagccttgtgatcttttttccaccgactagttttgttgccagtgcagctacccttcggtcagacgggtcactgaatatagttatttgagggttgctcaatatggcatccctaatagaacaaagcttgtcgctgacattaaggtccgtgaaacacttcagaccatcaatcacctgtcaaatggagtttccatatttaaattaaacttgactgtaggatgagtaggcttgttgggaataggcttctaggttgtataattgctaagagtatccaaaacttggagatacaaatataatttgatatgacaacagcattcgttttgcaaactgaaattacataatcactaagatggtgaatggaagtgttacagatgatctgtcttagtacaaagaagttcaacaaccaaattaactcaccagcatcgatacgcctgatatgtcaatcgcctttaaagctattagttcaagcagcctctctggcgtggatataaggaactccggttcgcaactctttaatctgaattgagtgtgcatgaaattaacatcccctaccctaacacgcttatacgcttacagataacaatgacactgataataggattagactgataattaatttggccaaaacatacccagaaatctggtgttcaatggaagcgccgggatgcagactgacggaatggataccaagtgatttcagaggcttgcaaatcgaacgcacctgcacaaaacaccatcaaatgaatcactgattcatcatttaggaatcaatcttaagtgaattaaccaaacgagcaaaaatggcggcactaacttgcacggccttttcctgggaggggacgaggtagagtaggaaggggcaagagacgaccacagcgagcttctccttcctggcgacgatgtcgcaggctgtggagacgagccaagccgtcttctcccgggtggcgcactcgccgctggtgtcgagcacgtgcgtaggcggcgcagccgagcagcaattccagagctccacgccccacgacccggtgtcgtggatgccgccgccgccgccgtcctcggacgccgccgcgtctcggatggcgttgaggcagaccaccaggaacttggacggccggtcgtactccgccccgtccttctccctagacttggcgttcgcggcggcggcggcggcggcctccctcgccggctgcttcttggcgctcgaatccttcttcttcttcttcttcttcttcttcttggattcgtccctgcctgcggcggcggcggcgggggcgtctccggtcggctcgtcgtcgcccttccgcttcttgccgtggcggtcgttgaaggggtcctccggggtggggagggagaagcacatgccctcgcaggcccgccgcttgccggacttgcggcggcgcttggaggcgatgatgccggcgacgcgggccgacacggcgttctcgctgctgcgcatccgcttccgccgcaccttgttgcgcttccgcgccagcgcgtcgtcgcccttcgccatggcccccctccccttctcctccgctccgacactcgcggcggcggcggcgacgcgaggtgcgagacggcggcgagagagacggttagccgccgcgaccccgagcacgcagagggaaaaaacctagcgaagccactaaaaaggccgggccggtggtagtgggccacattttctagatgggcccacttaagttgcatcagttgctcggtgaggcccattactcagtgagacctatattggcccaactggagagtcaagctttagcatgcgttggcccatgagaggattggcccaccagtcagtgacagacaagggggcctttctttcgtatgggccgcataaattacgcagtggaatgattatgcgttcggccttgttggcaccaaattttagcatttctcatttttttattcgcagcagaccatacataaccatcacaatcttatgataattaaacttctggtcactcacttggtaattttagaaacatcaactcacacaaaactatactgataattctagaaactcctcaaaagaccatattaaaacttgccaccacatcttatcttgtcaaatttaccaaattattttagcttcatcgtgtagttttagttttagagtcccactccggtgctttatactcggagtagaaagtaatctgagccattgatcatatttaattgaaggcttaagatctagttctactcccaccagaattagtgggagtagaaatgtgaaggggtgttttcatccaggaaaaataattcgcgtagggtattatcgtatattatcagtctcttactcaccctatccctatcctatggattcgtatcgcatcgtcgccatttcactccatcccgacgccattcccctccatccccgcctccgtcgccgtccatctccctcgccatctatgtcgcccgtcctcgcgtctcctccccctccagcgccgttgccttctccgctccctccgtcgaagcccgtctccccgccatcgccaccttctcccccgcccgcatctccacgccgccttgtgagccccctcggtagccatcctcctcccccgctcccttctccagcgagtcgcctcacgtcgtcgcgcctccacccgtcactgccgccacgttctcctcgccaccagccctctccgccgcgtcacctccacccgccaccgccgccacgtcctcctccccatcaacccctgcccccttctccactcctctcggcgatcccgcatctccgtctgggatctccagagctccgccctatcccgccgctacccgcgtcggcacaccttctggcgagttccaccttagaccccagcaccgcgccactcgctgccgccgagccttcgtcctcctcgctatccccttactcgctgtcggcctcctcccccacgctcggctccagccccgtccatctccgcccgccatcgctcctgcagccgcgtgggagagcccccaatccatcgcccacaagcggaggacgcagcctctggatccaatggcaacgcacgcctggttccccttcgtccccatgccacctcaagcacctccttcggagcatgaggaagacttgccattggacaatagcggaaggtaatgcccggaaatttgcagtaagatgcactcccctaatgccgcccctcaactttcaatctcaagttgtttgtttttcttaaattttgatttgatttccgaggctacctgtttcctattaatctgtagcatgaaggatgagatgatccatctatatctgaacaactccaccatggcgttggcgatcccgagagaggcatgcttactgggtgctccgaggtgccatggcattgggatgctggtgggagcattcagtatttgcaaggagcaagagcaagtgcgcgaagccatcttggaaggtacgtgtggctgcttcgtcgtaccaattggatttggcacgcaatgttgtgctattgaattatgatgtctaaagttgtcatctttctgaatgaaactaatgttcacctgttgtgggggctttggaatgggtggctgttactagtggctatatttgcattggcattgttatgccaccatcaattaattacgagtagatgatgcgtggtgtctctttcctttgaactttggtgtccttttcaccaattatattgctcgttttggttcagtaaatacattgtttatttcataacagaacggttaatgttaacagcatttttacttacttactctgaaccacatgccggcgaaggggttctcggtgttcaggtgcgacattgaagcagatgcacgttggtgacgtcgactgcttactgccctgagtcaccccgaagcgtaaggtttcatataccgctccttctcaaatggatacaaatatgaactatgagtacgcggactggatggtaggcccatcatagcaaacaaaaagtttgattatgacagaaggacatttgtagaaaataagaaagataacatatagttgttgtgatctatgcaggaaggcatcgatgaatacataagaaagctagcagcgattctttacaactctccatccaacaaattttgaatcatgcacaggccatctccgaagaaatctaagatgttcagctttgtattgggaggatattctttcattaaattctgagatgttcatttatcattgagatgttttattttggagattcttagtttgtcttgtcggatgttcatttcgaataagctaggtgttaattttttaatattaaactctatctgttatttattaaatgatactcaatctcgttattcaacgatgtcagatgcggggacttattctttcttttgtaaaaaaaataatgttctgctataatatatgcgcgcggtcgattgaaaaaccatgattttttatgataagtactttctgcgagtttaaagaaacatctcgtaccacgacgaagcacctttgtgcttctgcactgcaaatcttacgtaaagaagctgctcaatgcaacatcttacatcctgtcaaactgtcaaatgtgtaagctaatgttgtatcaaaatcggatgctacggagaacaaaatgatgtgtcagtatcattttttcttggggacgacatgttccccctggaactgttcctatggtttgcttcgctcctgaatcagcatcttctggaggcctgatggctgaggatgccaaatctcccaccaccaatcctttttggtggcttcgagactccgaatagagctatcgcaattcgaagttggaactagaaaaatatggacagaatgagtcctccagcagcatgtgcattcttattgatctggtaggctctgcatgaaaaaacaaccagtttcagcagcagcagcagcagcattacagtttcagcagcaccagcagcaccagcagttcagtttcattccagcaacaacagtgcagttctagcagcagcacaatttcgaatagtagcagtatcattccagcatcaacaatagcatcattccagcaaacagcaccattaaagcatcacacaagcatcacaaaatgaagtcaccattccagttgcagatcatttaatcctaatatttaaaaaggcaactaaatttatttgttcattacactcctttaaaaataaataagcagccttgcaacgcaaacaacagaactgtgcttgcgccggaatcatctcagggtaaccaggtgcgccacagttatgctgcccagggacgtcgccccaacgctgaactgcaggaggggctactgacctcctgacagggtaaaccacagctccatgatcgtcatccaggacctattttcagaaaccaagcagcaacaagtcaagttaggacacaggaggcagctcaattctgtaattttctgaaaatggattaaatcaagctcaattccgtatttatgtaatgtttctgacaaagaattcttttatagttctaaagcattttagcttatttgcctctgtacacatctaaaataaattaagtgcctcagtttcagagtataatgcaaatgcagagatggccaaattatgccctgaattctttattctttcagtttcagagtgtaatgcagatgcagagatggccaaattcaggaagacaggtttgatttgctataaaagagtatccatctcacagatccatcaactgcataaattcattgccactctaaactattgaacaattactacagttcccccataatggctgcaaattttgtatgtatgataaaagaactaaggcatgcactaataaattaattcaatgtactactagtactactgatgaactagcaggaaatgttggatgctttaaccagttgacaaggcaatcatttggtagaaaagatcaaagatcaattgcacaagatatgatttaacttgccacctttgctgaggtttaatgttggacttatattagtaacacatcaatttcagcaaactgttttgagtggaatttcaagtgacaggtgtatttcatttgcagcttaagaccaaaattattgttcagttttatcgttcatgcttacaacttaacatacaaaatcgatttaataaatctcctattcaatttaacatccgcaaatgtagattctctagtatagttacaagctagtatacacagccatttacaagcaagtatatgcatttgtagaggaaaaattcagacaagtttaacactgaggagaggaaggggaacagaaagtcaggtggggggggaggagtggacacctgaggatttcaccgcgccaccgcttttgccggtgcttgtgtcggacagatgcgacgcgccgtgccaccggccgcgacgccgcctgccgggaggactagctgccggccgcgccgccgcctgccggtgcctgcctctgacctgatgccacgcgtggtaggaagacgacggaggaggcaaggacgctgaaggggaggagacgccaacggtgccggaggtggagagggcgggggcgacggacggcgacggagagggcagggaaaacgtacggggacggagggagaggagaaggcggcgagggtgggggaggcggacggcgactgaggaggcggacaaggcggcgacggagagggcgggggatacggatggtgacggagggggtggacaaggcggcgacgccgggggaggaatagcgacgagactgcgtgcaacggagtcggacctaatgcgatgcgataaggagtccgacctgatgtgatcgaaccaaagaaaacaatccatattaaaattacccctaaacgatattaggagattacttaattgccctttatatattagaagattacttacctgccctttatttaaacaatccatatcaaaattacccctaaacgatattaggagattacttacctgtcctttatatattagaagattacttacctgccctttaaaataaataaagggtccctattaggatttatacccatcaggtttgctttatggtttaaaacatgagaccagcatcctaaaaaataaaaaggggatgctcgagtaagatgatagagcttcagaatgctattgagttacaccgacatttgctacagagcaacattctattattacaatctacagtctattattacaatctagcactctataaaatctatcactctataaaataagtgtatttaaaaataattgaatgaaatcagcacacaaaaataaatttaaccaaatacaagatcgggagaacacattatttcggcaatgagttgaacaatccctaaatccagataccacagttcatccaagttcagtttgatgctcgattattattcatacagaggcataaataacacgcatacaaaaccgtaaataaacactcaaacaaagtaacaaacacacttcgaaaacaccactcaaatggcggctgggcgcccctactgcggctgcagctgcagtttctcgtgcagctgcggcggcgcgacgacgtcgaccctggcgacaccatccctggcgtcgccggcgaccttggcgacctccacctcgccgacgacgtcggcctcgcgctcgtggtcgccttcctcctcctcgtagttggggtcgttgcggtcgatggcggccgggaggggatcgagctggctgtcgacgatgctgtcggggccctcccaggtgaacttgccgccgcggccggacttgggcggcggcgcgccgatgccgcgggagccgttcgccgggtggcgctccatgcggtggagcccctgctggtccagcttccgctcgaagtgcctggccgtgtccgggtgccgcgtctccggcaccgccaccttctccgtcaccttcttcccctcctcgtcccggtgcgtcgcgcgcatgtacatcatcgatcttcgccgccggtaggtcggtattcacaactttctccggcgaattggttgcggtggttggattgcgatctgggtgatgaatcgatgagcgcagagacgcgggtatataagcggcgcgcggcgaggcgagcggcggaggagtggagaagaagagtgtgtggagagggggaggaggtggcggaggcggaaggcgacgcgtggagaggaaggcggtaagggatggatggatagggggccacgtcatgtgcaggtgtgtgtccaggtgcaacgaacgccgaaaggatttgttccaggtgttgcacgcagcacgcctggttggttgcatgaattgcatcgatagcgtcacgggaaatttaaagcccgtattattttctatcaagaaacacagtataaacacttagtgaaactataaacgtgcaccctacttataggctgagtttttttttccttcacttttccgacctatttctttcttttctatgcgcatgctttcgaactactctctccatttcacaatgtaagtcattatagcattttctatattcatattgattatctatctagattcatctatctatgaagagttttactcccgtccggcagtctgtaccagccagtactggtactaggaggtaccagattaaatctggccgtccaacttgaaaggatacgattggaaaacaacaaatagaagcggaacaattccggagtcacacgccgccgctttcctccctcgctgcgctctttctttcctccctccccgcatcggttctttctcatctattcctccatctgagcgcagaaacggagcagttgcgccgcatccacgccccgccgaacggttttttcccatccatctgccgtccgtggtcgcggtactggagaaacggcgcgctcgccccgcatccatgcctctgccggtgccgattttttcccatccatctgctgtccgcgacagtgtcaccaacaacgccgccgcattcacgagcgaagatgtcatggtattctgtgtcccctatccccctccctcgacagctcaagcaagtacctaacctcccccgctgccatggcgcagcctaggcccccattacggctcaaacactactccactatatggtctagttattttgtaattaacaattcaatctgccatgtttcttgtaatgaatttgtgagaaaagcacaagcttttgctggagactttaatctttgaatggaaaattttaagctcatctgtcgtccgttttttggtatgctgtttacagggcatgatctatcgttgaatggagcttttgacttaatttttgtctgctgtgaacagagcatgatatatatgtcgtattgagagccattaatattttgtctgatgtttttgctcgatctcctgtaaaatatatatcattctgtggagtgatcagcagcacaacaatggttacaagcaagtgttttcaatgaacagcaatccagctatagatgtaaaagttgaggaatcactggagtagagtgctagacacatgggcaataattactgaaaaaaagtataatttacatgattctgaaagactgaaacaaacatactcgtactagtgtgttgtaattcagagtttcagacagtgggagatagataaacagaattctgcaaattttcagccaaacagaacgaactagaacttagcaagaatctaaaattgaaggataagttagacaacccatctgaagaagctgtaatttagagtttcaaatagtgggagatagataaacagaattcacatggataggttgctgagacatcaacatgctgagtgatccccatccattaattctggtaattgacatgtacaaaatcaacaatggcaagcatagtacatattatcaaatagcttcatgagaaggaacacagctacaactactgttcctatgaaccaatttctaatgtcatcagtctcttttttctgcttagacaacttcttgaatgaattttctatgtctgaaagccggtcatggtcaaccatttccagctctagcttcattttatctcttctgccttcgttttctcaacataacagttgagtgcttgagctgtgggcaatgctacagaataaccagaggttgaagaaggatgcccaccacgaaccacccgctgccgacgccattgccgccgccacctcactgacacgggcccaagcaccacacaccgccgccaacaccacctcaccaccgcagcccacggaccagccaccaccttctcgtcgcctcccatggaccacctactcgtcgcctcccacgaatcagctgtcgctgctgccgcctccgagcgttgctcccgtcgagcaccaccgccacctctcacggatcagagctgaatcgagatggatccctacgcgaaaagacaacattacccttccacccctctaactattccagtaccacctcatgggcaaatatgtacctggaggtaccgtataatttccaccggccgatcgagctaaatgaatggctgagatttggtaccgggctggttacctgctggatgggagcaatcctctttgataaaacttctataattccaaccatttaataatttttcagatgctttctttgttttaagaaaatgatatacgtacctaccatagtatcaaaaacttattagtagattttacgaacttattttattgtaagattgatggctcaaattttaaaagtttaattaaatctttttttcgtggggagtttaattaaatcttgtaatcataatgtagtaaaatgtttataaccgtacggatattagattttgagactatgagattcatactggacacaaaccgagcaacaatgcggaggaggaacacaatgaagcaggagtacaagagaaggtcacagcgagaatgaatcacatccaaatgtcccagcaaaatgacacatccccaactctaactgagagcatataaactatcacattctgtcagattctggctaaactgttcttatgttggcctgtttcatcccccaaccaaactgcaaactactcaagacacgtgattagatagaattgaacccaaacacatgtcacgtgacagccatgccacaacaacgcatgtcaggcacgagggcaacaaaaaaataggacaaattgatcctactcttgaggagtcaagcagacattgatgtcaggtgaaggcctgtgcaccatggactgcgagcttgcagctgcaggccacccaaccatggcgaaaccagtactggagctcgatgaattcaggttcatggcgcctctactctgctccacaccggcatgtgcttgtggaggcatggatgagatcgaaacctgcggcgaacggcagccattgttgccaggagctgcctgagaaatgggcatcgcagctgtgagcacaggaggaggatgaagaggagccatcggtgctggaaatgccggagcagcagatggttgtggatgtaggcccattcttctctgatgctgcttcaggttgttgggcaagaagctccccacaatcacctgtccatggagatattgtgtttagagcttcagagaaaaaaaatggctacagagtctaccatgcatgagtgacagagttaacaacgaagttctctatcttcagttgtaaaagcatggtacttggttcgactgaattacgttatcgaaaaatcgattaattttgtccaggttcttcagttgttgttgttgtttctttacctgaatagggctggcggctcgcagcatcccagctactacaccgccgacaacacggccatcagggccggcaagcgagacactgagcccgccggttctcctccgaacgccttcctccgcaattgtaaaggagccagtcagttgaagaatctcaaagcagccctggcaaccacatatccataaatgctgccatcttagagttcagtgaggataactgtaaacacaaatgtgtatgcacgtacgataagtaacaacttcgcttcaattgttatcctacactgatataggcatacagccgctctgtctcttaggcagggccctgtttggcacagctctagctcccaactccaacttacctggagccggggctgtgccaaacggtccagatcctccattttttggagtggagctagcagatctactcctagaaaatgaactatgggggtggagctgggtttttctgctccacagctccactccatcctaaaatacctactaccctttaattttttagtctatttataaaaaatgccattcaactacccttcactcctctcatcccgttctctctcctccccccatcttcctcacgatgccaaccgagctgcgggagcgggagcgggggagggggcgataggccggcgcggagaccacgggcgggtggcgcgcctggggacaacgtgtggccggcggcgcgcggcacgcctggcgacaacaccggccggcggacgaagcgcctgggaacggcgagcggctggtaggctggtggtacgcggccagcgattttttcaattttttttctttttttttcatatctagagctgaaacgtagccaaacacttttcaacgagtcttcaactctaataggagctagctctcacttgagttagagtttggagccctaccaaacggggatgggagtgggagacattagcacaaatcacatgctaatctagtaatataccactgttttttttggccgggcatcactgactgttttctggacaacgttattgagactcgcgtacaatttgcagacttgagcgtatactccctccgtcctataaaacccaccataataccagatgtgacacattaatatgttacatacagttctagattttttttgagtaaagtccatcatcgatccctaaacttgtaccgctgtgtcatcccggtccctaaactcacaaatcaaccgttcaggtcctcaaacttgttcgactgtgtcatcccggtccctaaacttgcagatcactcgtttaggtcctccaacttgttcagttgtgtcaccccggtccctaaacaggacggtctaaaaactttatatcaaaaaataatttataactttttcatgtgaactctaatgaagacaaactttatatcaaaattgtatccctcgacgtgacctacaactttgtagttgaaaagtttttgaattaaaactgtttagggtcccaaaatattgttgcatgtttatagattttgaaattttaattttaaaattacattttgggacaaaaaatgacttaaaataaaataattcaactacaaagttgtagatcgcgtcgagggctacaagtttgatataaagtttgtcttcattagagttcacatgaaaagttatgaattatttttaaatataaagtctttagaccgtcctatttgacccaaatgatattcaaatccaagttttgggaccgggttgacacaactgaacaagttggaggacctaaacaagtgatatgcaagtttagggaccgggatgacacagtcgaacaagtttgaggacttgaacagtcaatttgcgagtttagagaccgggatgacacagcagtacaagtttagggaccggtggtggactttactcttttttttttatgggacagagggagtatgttactacagactgccggaattgtatatgtgctatcatgaacatagaaaaattgggaagaagacttcacccttgatctgtcttcaaaagtggctcgcataaggtggttaagacttaagacaccattacagaaaaaatactttctcaacttaggcaagaagaccatttattgtatctagtactataaaggtggtgatactgaaactaagagattaggtagagacaggccaaaaaaactgaatagaccgacttgagacatacccataactccatcagaagttcaggcagccgtcaaattagctcacaacatttccaagtatcatactatcacacgatgcaaggagtgaactccatttcatacctcgtaggagaaggtgctaccagacgagccaggctggttcaatacaacatttgagatggtgccattggcagcgagaatgcaaaccgagcgaggacccttctgcgagaaggacattatgcgagccgccacatcctaccaacgaattgcaccaaagaaacagtcagtgttcatcctttcataatcaaatcacaatgccaagctaactgttaaaaaaaaaacttcagttatggcttacctcccctgtggcgacaatgatgacatgaggcgtgaagctccctccagctgataacgcataccattcccctttacaagcattgagaataccaatcagacaaagcgatgtgcactttgttgtctactaccagactactccttaactgaagtttatcctcatgaaaaccaacgaaatcgcccaaaggattgggtcgattagttaaaccacctaggaaaatcaccaaataattcatacatatccaaaggtttggactgagatgaatccggacaaacacaagagcatgaacagcagaaatgtgcttattcctaacggttattgactggtaagcagtagagccctcttcagctcaaaaggcaacattacacatcatcctctccactggaccccatgcaagcaatgaaacagaaattcacccccaaaaaaaatgaagaagagacaccaataacaagaacataaacatgaaaaaaaatggaaactgggtattttccaaatccaaagaaaatcatgtaatgaactctgcatttctgaagaagcaatatatactgacctagattggcaaggatctggcgccgcccggaccctttcggccggccacgacgccgtctggagctcaacccagcatgctcgccatggccactcacctgcatgctgccgctgtcccctgcacccaaactccgcgcggctggcgttgcaatggcggcggcggcggcatcctccgctcctcctcctccatggacagctgccgccggtggaggtgacggagtgggggacatcgacgacggcgaggagggagaagaccggtaccctttcgctgctgctgcggcttcttgttgtgcagctgcttcagccatggaacaatctgctgttctgatgaacaggccgtagcctgctggcgctgctgctgcttcatggccacttgccacagcaatgcactcccttgatcttgatccctccatgtacaagcatgagagagagagagagagagagagagagagagagacaaggttttcttgcttgtttttcttggttttcttgcttggacacaaccaaaccaaggaggaagacaaacaacagtgagacagtgagacacctcactctagttttgctttgtgtctggttatcaccaggcagcacagcaagtatagtagtagctgggaaaaagaatttgaagatggggagatgacatgaataaaaatgagattttggaggtggagactgcacaaaaatggcggggttaatgtgactgtctctatctctctctcctttgaccaaccagctggattagttggacacttggactgcaaaagtgtactggagtactacagcatagggtacgcccatcttaatgaacagtacgatgagaactcatacacacagtatcttcagtcaagaaattgatagataaacgaaataatatgtgaaataaactacacaaatacatttaaagctctatttgaaaaattagattttttttctcaaattagattgtcttatatgaaaatcatgcaaaatcgcatgtagtttacaatcttgttttggagctaaagttcgagtaccaacaaggcagcaagataaatgaatcttgcaatatcttaaaaaaattaagttttcaaccgatcttgatcaaagttcgacacataagagcaagtttaatagtatagcctaccactggctccaattcagctatagtcaatttaatagctaattcatacaatagttaccaataaaatatactatacaattactatctagtcccacctatcatacacacatgcatcttgaagtccgtgttgcagctggctacaaatatgcaaccagctgctcttctctctcctctcttatctcctcaaaatgtgtttatagatggtttatagtatgctattatacttgctcgttaactctaacgagtaggttgtgagagcttagaaattcgtcgaatatatttcaaattttgaatgaaaatgtggacgtactctctccctcaatccagtttttttaatcattgttcatatttccagagtaaagagaaaatcaagcacgttggagaatgtgcctgaagttcattactttgagcaatatttattgcactgcaattaactactctatccgttacaaagccagtgtagtaattggtgatgttaattttactgttttgatcaatgtttcttagcagtacaaacacatcccgtattgtattatctattctaaaacttttattaataaataaatacctgaaagtacaaaactaagcatcttgcatgataaagctataaaaattaatcaatcttgactggacaatttcattttattagtggtcagactttagtagtgaagcagagagagtattcccgaacaatatggtctccaaaacatatttcctccttcttatacaaagcttttggatatatttttaatacgtctgtatgtattgtttagtgtgttcaaactaaataatttaaaaaaaattaatagtcaaagttaagaaattacagtaccagagagactactattaattactttcttcgttcatttgtggttcatcccatttatctcgaaataaatatatatttttaagtaatcattgtattagaatttataaaagtagaaaatgatttcattgagagttaataaagtatgagtattctaatttttcttattttgtattggtatatgtggggtttacagacattgacgtgtgaagaaataaaatggtgggaccatatataaatgaaattgaagtaaaggatccacacatttttcttacctcaaggagagcagctttccctatgctccttcctctttaaaattcccaggcttgcataaaaaggcatcaaaagcagattcttgtttactccgggggtgtttagatggggctaaaactttttagtccgtgtcacatcgaatgtttgacgctaatttagagtattaaatatagactaataaaaaaactaatttcataaatgaaagctaatctgtgagatgaatttttaagcctaattaatccataattatgaaaagtttactatagcatcacattgtcaaatcgtggtgtaattagactcaaaagattcgtctcgcgaattagtccaaggttatagaataggttttataattagtgtatgtttaatactttaaattagtgtataaacatccgatgtgacagggactttaagtccctgtttcccaaataggccctcattcattttccagcggttacagtaaaccttcagggcagtctccaaatgagactctcgtacagtacgagaactgttaaaagtgtagtactttatgagaacatcaattgacaaagcgaaacaattctgtttttgtttaaactctgcctgtacagctgtccattaggcttctgacggggtaagaccgaaagttcatttggttgatcagtaaaactggagttaattcaaagtgaacaataaagaatcccagtcaaatccatgatgtgctgcaactgtaaaagcacgaaatcctcgttgctgtaaaacgaatgaaatgatctgagtaaacaaggccactgatgccatcctagcccttattatacctgctagtatcatccatagaaagaaaatgctaaaggaatcaaaagaccagactacaactctaagagctaagagcatgtacaatagtagactatatattagccagctataaacatattttaatgagataaaagataagagagaaaagtagcgggctacagatctgtagccaactgcagcatgaactccaagacacaatgtgtgtatgataggtgggaccatatactaatagtatagtagtaagcaattattatatgaattagctattagattggctatagatgaattggagctagtagtgagctatactattaaacttgcagtatagcccgctgctagctctaattcatctatagctaatctaatagccaattcatacaatagttgcttactatattatgaatacctggtcccacctgccatacacacattacgtcttggagtccgtattgcagctggctataaatctatagcccgctgctcttctctctcttcctttatctctttaaaatatgtttacagctggcttatagcttgctattgtacctgctctaataagcaaaaggaagaaccactaagagtatgtacaatagcatgctataagctagctataaccacgtatcgagaagaaaagagaagaaagcgggctacaaatttgtagttagctgcaacatggactccaagacattatgtgtgtatgacaagtgggattgggtattaatgatgtagtatatttttatagttaattattatatgaatggtctattagattagctatagatgatttggagccaatagttggctatactattaaacttgctctaaagtaaggattctctgagtcgcttccatccacctcgctcccgtcccaggggcgacatggacggcgaaaaactctcccccgccaccccttcccacctcccccccttcgactcgccgccgcccgagcggctcgccagcaaagtcaaacggttgcaaggacggcggctgcggggcgctctccccacgaggatacccagccggcgaggacatcggggttgcttagcggcagcgagaagcgggaggcgacggtcgggcgttggcgcgatggatctggcagccggcgcggtggatccaccccccggcagcggatctggtgtccacgatggtgggggcggcgacagcggtcagaggctcgggcggcgcgacgaacctttgtggatagcggcggcgacggcgcatccaagtgagggcagccgcggatccggcccccacgcggcgggatccggcctccctgggccgaatctagccgggaagctgcagggccggcggccgcggctgcacgacaacggtggtggtggtgcgacagctaggcaactgaggctggacggcgtcggtgtcgacggcgctggatgcggcgtagtgtccgggcggctagatggcagcggtggcgccggtgacggatgtcgacggcccacatcggcggcctagggccgccgcgatgtggcttggaggctcgaccgacgacgttgagtggcccgagtggccgttggtgggcggcaaggtggcggcggagtggtggcatcgacaaggccggcggtgggtttggcggcgaggtcgtcttccttgtggttggccaggttaccactatatttaaggagctcttccccttctttatagggagcttttaggcacgggtagaggcgatggccggcctacagggaagactcaggttgccaaggcgaggttgttcccggtcagatcccataggccggattcgacgtggaggccgacaggcggcgtggcagaggtggcctgggtcagcgtgctagggagtagcggcgtggtaaagggcgctggcggcagggtcgtcttccttgcggtcgggcaggctaaccctgtttggggagctcctccccttctctgtggggagcttcttggcaggatgaaggtggtggtcggtctacaaggaaaactctggttgctgaggcaatgttgttccttgtccaggcacccttgggccggattcgactgggaggccggcgagcggcgtggcggaggcagcctgggtcagcgcgctggcggaggtgaccggtgctatggcagtcttgtcattggcaggactggaagtcggccggtggaggggcgtaggtcaggtgtggcggaagccatgtgccgccggtgttagatggtggattcggattgagcgacggaccacggcagtaggggatttcgagcgaaagcttagcccaatttctttgggccaacagtgaccacgctttcgggcgtggtaagcctcctgagggcattgttgaggtaccccctccttccttggaaaggagctctgggtgaaaaccttatccagttctttggatggatgacgacggcgtctttcggcgtcacgaccctcgtgagggtgtcgttgtagagtcttcgcgccgtggtggtttgttgtcccggtggtgatcggtctcgcatagcgacggccggttccgtgcttggcttcctctctgtagcgtgtttggacggttggcacatggttcgaagcgtgtgctctggtgcacatcctttctcgacagccagctgttgatgtaaaacttttcttgtaacatttctttctatcttaattatattgaatgacctccttcgataattccggcaaagaagcaaaaggaaatactggagtatcaaaacatatgctctacactagaaattgcagggaagtttgtatataagagagcatgggagagggagtttcagtttcctttaattttacttggaaacaatgatgtcaacagctgtaactctggagctgtacagcagctggagcaaattttctgcagcatctactgcggcatgccggcatctactgcgaaagatggaaatgtgtgaagtgcagatcaaaaggatggatacgcaatgcactagtaataactgttgcatttattgcatttcagatactggaacatgcacaaacaattcagaatgaatactacagtttttccatgtacaacatttcagatacttgagcatggccgtgtttagttgttttggtaaaaaaaatttacgtatacggacacatatttaaagtattaaatatagactaataataaaacaaattacagattccacgtgtaaactgcgagatgaatctattaagcctaattaattcatcattaggaaatgtttactgtagaccacattgtcaaatcatagcgtaattaggttcaaaagattcgtctcgcaattcacatacaaactgtgcaattggtttttttcgttcacatttaatgcttcatgcatgtgtccaaacatttgatgtgacggaaaagttggaagtttgaagggaactaaacacagcccatgtaaacaacattattcaggccacattaccaaatattcatttgcctattgttttcagctttttcatatcaagcggttagtgtctattccaaatctttttggaataggtaccttgcaaagaagcaagatctcctataactgtcacaaacattttccccttcaaaattgaaataattttctaaatataataatcctgttataacataccccctccgtttcacaatgtaagactttctagcattgctcacatacatatagatgttaatgaatctaaacacatgcatatgtctagattcattaacatttaaatgaatatggacaatgctagaaagttttacattgtgaaacggaggaagtatttgctaaacaaaataaacatgtataaaatatttaattagaaatcaatatgcccatttcaaaaatttgatcagagatctgcccaaaaatggcatgtttgtggagaaatggaaacctttatgaggaaaagggtaaaaagatagatcatactctgataattgaaacaaaatacaatgcaaaagagctgtatttcattactgcacttactttattagttgttagtaggaattattcgtctgaaaccaggaattgtaaaacacagttgccatccatatggacatcaccattcatgaaggacattacaactcatgcaaacatgggccatgcacataacaggataaatgtgctactataaattttactttcagcgtgataatgttgccagttgttagtttgttacgcagaaaataattttgaccttctttaagttttttttccctcaatcatttctattcagataaatgtttggaacagcattttctttctattacttgatctcaacaactgagcaatcataattttgttcagccaaacccacataagcaggatcactaatgacacaggtgtaatcgacatgaaaaccaatgcaaaatattgtgatagtatcgtacattactagtgattttgtgtgtagatacttgatgtgaatccccaagtcttaatataaagatgcgcaatacttgtatgtattctcgaaaagaaatttgtgtcttaatactaaaacagaccaattagaaacctgacaagtttatgaaaaacccatttttggtagacaaaaactagaaataaaaaagacagaaaaagactatccttgaagtttttggagatatttgacttggcagatgtggagtatggatcaattgatagccctctttgcttgatataagtactcacaaggagccaaaactcgccgcccaaagtttaatagtagtaatactaatagggtgattaccgataaggctttcatgattaaattaggcatgatggtggtattttatcctaacacaaggaaggggggaattctgatctcaaacttttttgcaagcctattgtagatataaaagaaaacaggacgagaggaagcagctagcacacctctgttgtttacaacttttaatatgctaaagaagtgaaaacaatacgggaaccaaaattataaagctgccagataataattaaagtgaaaacaaacagagaattcagacctagagtaccatcatatgatgctttttctaacctttcacatgaccttcaagcacccttcccagccaacaagctcccccacttggctgaggtctggggacaatacaaaaattactgaatgagttaacagatcgatgttaactcaagaaaagagaaatccttcatgacttcagatcagaaaatgcataccttctttatgataatgatatatatgtgaaaaaaaaatgtctatcacgctagctattatagatttcctcaaaatgttattagtattgttttgagattcacgctaaggtcgagtatacaatatattcaatgaaatgtggagcacatacctgtgggtttgcatctatgttcacagtaaaagcaaaaggttgtttacctcctaccttgccgatgtatatagtacatgtggcgatcgcgctcacccaattactaaatatttcagtgacttcaatgtaatatacagtagtttgtactttccaactgaggccctgtttagattctaactttttcttcaaactttcaactttttcgtcacatcgaactttcatacatatacaaacttttaacttttccgtcgcatcgttccaatttctttaaacttctaattttggcgtggatctaaacacaccctgacttgaagctgaaaaaatattggtctataaataacataatgaggatgaggactctatgatacggctttcactgacacaaaacaatgaaactaatgttattttatatctgaaacaaaataaataaactgatctatgtatagtgcagatctgggaatgacgcaaaacttcagaaatcactccgctgaacaaaacggaggtaataccgcaatacacaatgcaagcaacatgtgtggtaaaatataaacaaacataactactgaactagagtggtccaagatcaacaacttcaattaagcatctagtgagaaccgagatttcatatgcaaatacaaaatatatccttccattattcattctataatccttagtgttttcacaggtgctatcatcagtaaaattcatgcttctaacaagtcacaaaaggtgttcatcttagctctagaggttagtggtagaaaggggaaacaaatgtagtcatcatgatgaattcagggtggcaaacacattgctgcatttccagatcaacctgtgatttccgaaccattatgctaagtacacaaacacaatatggcaacaaaatgatcggcagaacaccgaattttaaattcggcgcgagagaatttcataacgaattctgggaactgcattgctgccaccccaaagaaaaatccagaccagcatacgtaccggcaacacctagcttgatttccccagacatcggagaacaagattacgcagaagatcgtgccggatcagcatcatcaacctcgctacaatgttgagtgactgtgttagtatcaagcatgaagatgagaggagcggaggagtttgtgggaagtgattgccggagagggtcaccgtctcaccgatttagccgaggagtttgagagtcgacgccgcgtccgtccacgacttggggaggagacggagacagtccgccgcagatgagggtaacggaaccgggcgattgacgaggccggcgaatcaatggtgggtttctgccgttccggcggtggcggcccgcctcgatcgccggcggccgcggctccgttcaccgtggggtgggggtggggcggcgccggcgtgatcgcgtcgtgggattggaccgattctccggcccagtgggccggatgggcccaggaggccgcatggctcgctcgttcatttcgaattggtgcgtgaaattttccgggaggaaagatgctatgttaaaatttgcatggtctgttcatgaagaatgaagatatcgatgatatcccagcatggtattttgagccaagagtgtgtttttttctgtgaaatatgtgtacaatgtctcctatgaaaacgagagagatgggaggagggtagacagggaattaattgttgcgttattcgatggaaaatcaagatttaggggatgttaggcacaactcaaatatttcttagagctgagtattcctagttctacaaattcatagatctggatcattgataatatctatataaatcattttatttttattttatataaaatataaagttttaaatcactataatttaatatacaaactctaaatccaacatggatataagatctggagctattctaagggtttgtttggtagagcgctctagctccaactaacatttctagctctatctaaaatggaattggaactggttaaagtgctatcataaaataaactagagatgtgaagctgtggtttaggttactttagacctaatctttaacttaaatttagagttagagccttgctaaataggcctaaatagaaccttagaaagttgttgaggtttaatataacaaacaagacgaagaagagttttagtttatggcttgtttggatcactaacgatttaaatcccgcaaaaaaaaaagaagtttctggttgagcaggggagccggtgagacggtgcaccgctactgaatggttccaaagaggatgatacatcaaggacaatggtgatgttaggttttggatctgttaggaagcgtaggtagcaacatataaaaaagtatattttttattgaaggtgatccaaaactgacatgaattcatacatcactatattagtttaagctgtagcgagttacatacttgatttcgaatgagctagttctgtactctacgctcttctcaccttataatggaatgataaaatgctcacgctttttaaaattctaaatggtgtattttttaataactttatatatatgactctctgagatataatttatttttaactctataatacttaattattcatttccgctctcgaataactatcataatcattcggccattcaacattcactctggaagggttagtgatttaccatatatactttgaacttaattttagctcgctgatgtttgaggcttaaaactttaacccttctcttaacaggtagtcaaatgttctagtattgcacacattttcagaccaacatacctatagttatatataccctactggtatatagtagaaagcttgccgttgcctaagtcctaactgttctttctttcgtcaagctggaccagtctggtactataccccaacctacttgggccggtagaaatgatcttatatttggccgctttacatgatgccattagccatagacaccggcaaattgccaaatcctcttacatcaaaactagttttgaaaaattgattgcaatcatctctgcagccagtcaaataggtcaacaacacgcacaggcatccaccgagtgaaatggttccgaaggatgatgcgttatcatttatcagggccaatagtgacgttatgttttggatcagttcggatttaggaggctccgtttcaaagttataagatgtcttgacttttatcaaagttaaattgctttaaatttaactaagtttgtagaaaagaaaataatattttcaactcgatacaaatttattatgaaaatatattcaattattaatttaatgaaactattttggtattataaatattactatatttgtgcataaacttactcaaatttaaagtagtttgattttgatcaaagtcaaaacgtcttataacctcaaactaacctcaaacggatggagtattatgttgtaggcttgtagcacctaacaacgagtttaatagtagagctaactattagctataaggttgaaactaatgttgaaactgatatgtataatagatgatatataatgttgtctttaattttcttctcttctctctttacctgtttaatccatttactttgaaatatgtgaaaagctaagtcttgcatgagagttaacatattttttatttgttttttatatagcatcatgtcaaacttgttattgtaattggtcgaaagggtcatgatacttcatactacaaacgtatacgacttattgttatcgaaggtgatccaaaactgacataaataattcagagtacatcattgggttagttgatatcgaatgagccaaagtatatagcaaaaaaataaataaaatgaagaaagaatgagccaaaatacttgagtgagaaggatttattagtatactttggacttaataattacctagatcactgatatttgacactaacgtgttagtatcgcacacactgtactagtatgatggaccaataatcgaacccacttcggccggtatctcacacaaacacacaagaaatgaaaccgaactttaaatttggacgcatcacatcataccgcatgacacagacacggggaaatcgccaaatccaccagcatcaaaacctgtaaattgtactggcggtactctcccgtctccactactgataaactcgtaattatccgtgcagtaatataagccagtcaaagaggcgatcaaagtggcaggcctgccaccgagacgaacaaattaaccggctgtccgcttccaccctctccatcattggaatccccgcgccgcggcgaacatcccaaccctccctcccgcaccacaacacagccatgcaacagagcatcgcctccgtctgggtagtggatcctgaattccagaggtgcatgttatcaaataattatgaaataataaaattattttattaatacccctttcgtattttagtgcatgatgccgttgactttttctttttaccaaccattcattttatgcaaattttttttgcaaatatgaacatattatgtcatacttaaaaaaacatttgatcataatccagtcacaataaaataaattataattatataatatttttttaataaaacgaatggtcaaatgtaagtcaaaaagtcattgacgttatagaataacatatggaggaagtatatgatagatcactccacaaatatgcaaattaaaacaaattaaactacgatcagttaacgtattctcatagttaaatttgttttcgttgtaacttgcacaagttaaattttatactgcatatttgtggagtaatttatcacataatatatattattaatttttttatattttttgtaactatttgaaagagcatctatgcccctagtgggttttggtttattgatgacaaacgattaagggactaatgcacttattgagtgtataagcaagtgattagtcctatgaagaagctaggaaatagacttatcgatggatgagaattaaagagaagatattgaagatgcgggtatgaagtgactacctatggcaagacggtgaagcacaagcgacgctcagttgcgatggaccatgcggtggtgaagggcaagcaaggggcttggcgccgacgaaccgaaaccggtggtgaagggcgagtgaatactgtgtcgtgatgaaccgtgcgaggccatttgaagccatggattatccacattaatcatttgagaaatggaagatgaaatgtcaaagatcaagaagatgagatcttcccgatgatcaaatgactttgacgttggtaaccctccaagtgaagaatcaatatggtgtgaaggtactcctattggtataactttgctttttaaatttgagtttaggatgctgtactattaagagggataccacatgcatataattggttaaatactagtgctcaaaatgcttcatgtttgtgtgagttgaaaaacctaagccaaaatttttaatcccgagttgtttcacttgtcacaacacttacaccgggtttctttgcaagtttttcaatatctcttgaaggttttggaccatgttttatgttgggtttgatagcccacgaaactagctttccatagagtccaagatcttcgaaatcggagttcagagtaaaaagttattgcatttttgcttgagcaacattagactatccgatttgaaatcagactatccgatgtatcggactatctgatttttcacagaacttcactctctgtctttgtttgaaaaatcctttcgagtgagtttttctaagtgtcggagtatccgatgttggatcagatagtccaatgatacagagactccgaaatttcatggaacttgagtctctgtttgaagatgaagtttttgcttctaaaatatcagatactccgatttaatatcagatagtctgatgtctcggaaaatccgaaatttcatgaaacttcgttctctgtttctccttgccttggaggtttaaaatatcggactatccgacgtggactgaaagattccccttcaacggtcacattttgggggatctataaaaaccccccactaaccccttttctagggttgcccaaactcattttattcaaatcttgttttgggttgagctttgtgctaagtgctttggatctttgagctatctccctctctatctcaaatcccccttgttctttgtgacttggatctttgtgtgtgaatttggagtttgggagtctagtgtatatttcttttgatcttgagcactaggatttgtccaagagttgtgtggtgtttattactcttggaggttgaggactcctagacggctaggtgtcgttcttgggccaccgatctacgtgtggttgttcaagagaagtttgtgaaggccggatctcgcctccgcaaggaaagagatacccttagtgaaaggaggagtccatttgtgcaacctcacgaggatagggttgaaaaagacccggctctttgcgagcccctcaacggagactagaatcccctcaaggattagaactccgggaaatacatcggcgcataaacctcggtgatatcctcactctctttaccttcttgttgcattgctttgtggcatgctaatattgttgttggttgagctcacctctttgcttgtggattgaatctagatatcttaggttgttctcttgtttgtattgttgttgtgcaggtcagatagtctgatctcagttcagactatccgatcacatagaactatccgacctgatatcagacaatccgaccctgttttgttttagcttccgtatttatttaaaaatcgcctattcacccctttagacgatatcaagatcctttcactatttaattacatgtaaatattgaaaagataatgacatgcaaataacgaaaacgatattcgagaggttagaatagttcccctccgtctgctgcgcagcgctgggcgacgggacgcacgccgaatccacccaaatcaccccaacttctcgatccaccgaataatctcccccccccccccccccacctcactcggtttcaactcccaccgcgcaaacgcaacccgtgacaccacctatgctttcgcttcgcctcgtcgcctcgcctaaaacccactcgcgccgcgcgctgcccgcacgcacccacccacgtcgcgtcacgacatgcggaagctgagcggaggcggcggggagaggagggtggtgggggcggtggcgttcgaggtggcggcactcatgtcgcgcgcggcggggctgtggcgcgcgctcggggacgccgaggtggggcggctccgcggggaccgcgtccgcctcgagggcgtgcgcctgctcgtggccgacgacgacgcggcgctcctgtccctcgcgctcgccgagatggcggccgcctgcgccgacctctcgcgcgccgtcgcgcggctgtccgcgaggtgcgccgacccgctgctccgcaggttggacgccctcttcgccgccctcgtccgtggcggccgtctcgccgacccgcaccggctgcggtactccgcggcgaggaagatggaccggaaggcgcggaagatgcagcggctcgtggcgtccacggcgctcctgtcccaggagctcgacgtgctcgccgagctcgagcaggcggccgcggggggcctgcgccgatcaggcacccgacggaagggcgcggcgagcggcggcggcggagaaggagaggccgcccgccgcgtggcgcagcagaggcaggaggtcgaccgcctccgcgcggcctcgctgtggaaccggagcttcgactacgccgtccgcctcctcgccaggtcgctcttcaccatcgtcgcgaggatcgcccaagtgttcggcctggagcccaagaacgtcgccaccatggacgacgacgccatgatctcgctcgccaccacccgcctctcatggactaattccttcgtcggcagcgtgcattccttggtctatccttcagatttcgccgcagatacacatactccccggagatcattgctcgatgcaaaatccggcaaggtctccaatggcggcgaacatgttcgtcggtttcttgtctccaggagccagagcttgagacaactcaaatggccaatggccgggaagcacctcatcggctgcatggtcagtgggagcaggtctccggacagcgagaggtggaagatccatggagatggtgatcttccactcagcttcagctactacgtgtcagccagcaacgacgattattccagcatcaattccccgttccaaggcgaccacacaaattcgaatctctcaatagtgttcgagtcgtcatcgcacaactgggtgatgaacgcgcccgcggtgacgacactcggcgccgcggcgctggccctgcattacgcgaatctcatcatcttcatcgagaagctcgccgtcgcgcctcgccatatctgcccagacgagagagatgccctgtacaacatgctcaccgatcggattcgggcatctctcagagctcgcctcaggccgatcgccaagaacatggcagcctcttcatcatcttcttcttcagcttgtgatcctgccatggctgcagagtggtctggcacggtgcagcgcatcctcggatggttagctccgctggctcacaacatgctgcgatggcaatcggagaggaatttcgagcagagaaatgttgcgtcgagcggtacaggtgtgctgctcctgcagacgctgcattttgctgaccagaagaagagcgaggctgccatagttgagctgcttgttgggttgaactacctgtggaaagctggaagagagcttgatgcaaaagctaaaaaattggtgtcaggtggtggaaaacgcgatgaattcacagattattatagtagtaataggatggaatgtcgataagatgcaactgaattggatgagcctgggatatgtaagcagaggtagcatcagattccctttgctgatttgctccttcaatccctacaattggcattatgacacgcatctattctgtaattgatgctcctgcattttagtgtataagtgtagggcagctgatcattttaatgtaaatttaccatgtaattcattagtgaagacgtatcaggtttaataaggtcaccggaacagaactgaaacagtgaaaatagacttgcactagttagtatgtttgtacatgatgcattctgaatcctgaaaagaaagaagggtatcttggatgggcatgcgtcttgtgcagcatctgcagttccagaatatgttgagaccaatttcagttagaacttatattttcaggttgttaggaagcgataggcaaataaacgataaataacaagagatcaatcacagaagacacgagatttaacgtggaaaacccttccaaaacaggagagaaaaaccacgggcgccagccagcaaaatatcttcattatatcggggtgaggttaacaacaccgaacaacggcttataacaggtatatatgaaggtgaaaccctaaaaggataacgattcgtaacaagcctctggcgacggacctccgcttcactccggtagaaactggcctttattatgtgcaaatgaatttggatcacaacttaatataggttgcactaaaattgctacacttaaacagtatcgtaatattggtctcagattaagcccatcaaggaaaaaattgttgggctttacatgggccgagctggccatcagaacatgatcaaacggcccacaggaagggcttcctgctccaactcgccgtcgccggccaccgccgcggcgatctctcccctgtcccctcgtcggcgatggcgctctcgtcctcccggccgcgccacctcctccgccctctcctccggggcctccacgccaccgcgcaggccctggcgaggccggagccgcacgagttctccaaccccagcgagcacctcggcagctggggggagcccgctggggatccccgcgaggcgtgggcgcggctggagcggctgcgcaagggctacgcgcgcgacgtgcgggctgcgggggcagtacgcctacgaggcgcagctgctcggcgccgagcggcagcgcagggcggaggcccgcgccgaggccgcccgcctcgccaccgacgagcgcaaggccgccgccgcgcagacgcgcgccgccgagcgccgcgccttcgaggactacttccttcaagccctcgtaaacatccctcctagtcccgcttcatcccccttcttttgcgttgatcacccgttgcacatgagttgcttgttgaattgccggagtgggagtcttacgattaccgtgcgggtttttttagaggatcaagtgaattacgttacttgtttgtagaaatgaatctactaatttaatttttttttctggtacgatatgttaaaaatatcagcgaaatgactttataactgagatgagatgatgtacagatgaaagtaagaggtgagaagctggagaactggagggagaaggagaagctcaaagcagataagagggcggaggacagggagctcttgggcaggaagagctctgtgtggattgctgataatgaactggaaaatagaattctcaaggctatcaaatttaccacgcctctctaaggacaacttttgctgctaaggtaacttgaattcgttaaaatttgtcaatcattccatattgcaacacgaagaacgctacctatgttttatctctttttgaaagaagaccgatgctttatggtgttatcaatcagtggcggagctggagcacaattgaggggggtgcaccactttgccatatgtatggtggcataacactctagataatggtatttaaatattcctagacaacttttaactacaacatcagtgagcagcgaggaaaagtgcttaccgaaataaaagatgaaaggaagccatggagggaaacataaaaaaatataaaaaaaacaatcgatctatgaaaaatgtatcctgaattgttcaaaccctaatatgaaaaaaaaagaattataaacagtcacatagttcaaacaacgctatttaactttgagatttgcttggaacaaattaatcaaactaactagatcagaaataagaggagaaaaatcgatacctttaatttttgtggcatatttagatgagcaaatcttagcaagtggattgaactgcttcttgccatgctgatcgatcggttcctccagctacacgtaagagaagatgtcgacggtgatgggatgacggcggatctgttgcctgagggcattaacacgagtcagcgagtggtcctgatggcgattagagaaaaggaaaagaagagaaagagagatgggtctctgcgaacgaagtgatcgaggcgtcggtcctggcatcgaggacgagtgctggcgatctcagcgagcagcctattctcagccttctcctctgcgtatgggccaacggggggtacactgagttgggccaaggggggtgcccctatggtgaaacttaacggtaagcagtaaatttagaaattgggccaggtgcctgggaaccccccctggtccattgtgctccgcccctgttatcaatagaaaatgctgcagattttagagcggtagccctatgtaatattgccatcagttccattgattctgtctagatacagcgtaacttgaaattatgtgtattctgaactggataacttccttcagaagatcggggcttcaaagacagtatcttctgatacactattcatgcagtaccagtgtaccatctgtgcagtaaaaatcagaattttatttgaacttgctaaattgtaattgtggccaacagaaaaaatgcatgctttgtagtctgatgttttttttttgaaaaccatgctttgtagtctgatgtactaaaataggaagtctcaagagtatagcggatgttaactttaaagcaatcttcattacacttgaatcattttaactcttaaagtcactgggtccctgtgcttaggtagccactgactttggtgggtattacataattatacactcttgatcttccatgtgtattttttgtttatgcctattgggaatgctccttgcagtcttgtggttaagttactgatcattggcatacttctaccatcaaattctccaatacagcttggacagcagagggcataatgctatgattaacttttcatctttccaatttatccgtgcacttgagttagatgaatgtccaaaatgcaattgtatattttctgcagtcagtagttacatggtttagtacgtctgctcatgacaatttcttcttttgtatctttaagatacttttcctaccttttcgttagactaactatgactatgttctttcagataccgagaagcatcgttgttttccttgcacaagatactagataatgtcttctgagaagcaggatgtgggatgaactgaatgagttcctggaactaatcacagctgtctaagcaataacgatcaattttgaaaattccgctgcagcattgtatgttatgttggtggtggatgaaagtctaggtgaagttgtgttcaagcattccttcgcctgagagagacagctttcctcatgttcatgttaaaaaaaattctttcgcaattgaaattactttagcactagctggataaactgatttgtgaagttcaatttcgttgtggacaaactactgccccgattttcccataagatctcctataattgcatagtgcgtaatattttgaattttgcttttttttttgtatgtgtgtgcaggagatgttattgtgtgtgagtatatcaattcatgtaccactgtgccagtgcagctaattgctagtattatgtgttcatgattatgggcaaacataccatgtgttcaaggatatactccctccttccctaaatgtttaacgccgttgacttttttaaacatgtttgaccgttcgtcttattcaaaaacttttgtgaaatgtgtaaaactatatgtatacataaaagtatatttaacaataaatcaaatgatataggaaaataattaataattacttaatttttttaataagacgaacggtcaaacatttttaaaaaagtcaacggtgtcaaacaatttgggagtatatggatggtctcatcaatttttgcagcacagctacttcatgatggagtgactctgaactttatagtgtatttctttctcattacaccaggagcctatcatggtctgtactctgtaccttccacaaatggctgcaataccagatcaaattcaagatactacccctctcctctttatatataagcggtgttggtgaagcgagaagagataccccaacatttcatagaaaccagatgatcgagtagagtacagagagacaagagattcatgttagcacaatctaaacctcatgacaaacataacatgtccatgcaaatcaaatggaagtagtactacgaatgggatggattaggagacacaactacagtgaaagtgacggctttgggtatagctcgtagtcccaaatctctccgcgttccaatcactgcagtatggacaagctacataggcctagtggtgtgccagatgtaagagcgagtataataagatgatgtaaatgggctatatatattcacatatatttgtgcttatgtggagcagaaaggagaggagagagaggaaaagcggcctatagattttatagctcgtagtcccaaatctctctgcgttccaatcactgtagtatggacaagctacataagcctagtggtgtgccagatgtaagagcgagtataataagatgatgtaaatgggctatatatatattcacatgtatttgtgcttatgtggagcagaaaggagaggagagagaggaaaagcagactatagatttatagccagctgcagcacgagctccaataaaccatgtgagagaaatgcggggaatgcactaatgatgtaatatatatctatagttgactattgtattagtaggctattgagttagctatagatgatatgttaatttttgaaactagttggctatattattaaactgattatacagttcttaggagctattgcgttaattaaaaaaaacttaccgttgatttggtgtatcgtattatcgcaatcacacatcgtgttgagagtccctataaataaccataaaaatatatctgttgatttagtggatcgtgttatcatgatcgtagatcatgtacaaatcccatacatatcgtaatacacacacacacactatgtttcacaaataatcctatatactatatactatgtttatagctattggctttaacaaggtgaagtgccaaaaagctattggcttcctttgttcctttactctgctcaggaatacggcaggattacattagctcggtaggcagtagtgagcagggtttacgattccgacaggcccttctgtttcaggtactggcggaatacggaatttcgcaaaatccggtgaaaaaccagtaaattctgaacaaatttcataaaccaaaatttgaatacaaattccctaagtttgccgacaagttctcgaaaaccggtcggttttggcgaaattctgatcgaaatcatcgaaatcagtaaatgttttcctttttttatttccggtcggtttttgcccatgtaagtgttttccttttcttgattatttattcttttctttcctgatgtaagtttcagtaaatacatacaatacatcatttttttcgaaaatttatatcccaataggttctatgaatatcatagtatttataagattttatttgatttttcttttttatcaattcaaattttaatttggatgaaacttctcgaaatctcagacgatttctactttcgagcctcgtcgaaacgtcgaaatttcacgaaatccggtcggttttcgtcggaaccctggtagtgagtacatgcccaaccaaatgctactattgcagcccctttgtagtgagtgcagtttaaactacgtcaagtgaaaaatactacactctccttaactatgagaggaccatagagatattcttcattaatggaaggtagcaaaataagagaggaaataaatacttatcagtagtttttcacagcttcctggaaagttactcgggaggtgatcgatgatttatagagttttttgctctttgttttccatgacaaaaatcaaaacttcacaactgtcatgtatagcagtgatgattaggtcagccatgagcatttgcaaggctagctaggaactggaggcgtttggaaatgctgcaaggcctcaacacactctcacatagaacaaagctcctaacactgttgcagatctttggacaattgacaagtgctgggatgcccaaaagctcaattcaatctttgagcagcaagcggttaatatgatattgcaggtaccaatcatccaagacaactctgaagataaacttcgatggaaattcactcccaatggagagtgcaattccaaaagtgcatacaaggagatctggaaaagagaagcctcacatggatctcaagtaagtgaacatgccagaacaatcttgaaacaggtttggaaagacaagtgtatgcctccaaagattaaaacctttgcttggagattgctgatgggagctcttcctactgcttccaggcttaatttcagaatcagtgaaatttctccaaattgcattagatgtggcatgattgaaaatgatttccatcttttcttggactgcccttttagcaaaatcacctggataatctcagatatcaatctgaacactgacattttttctgataatgtctcaatggctcacattattgcttgcattgtaaataattgctctaacaaagcctcccttaatagaatcttctcaatcatgtggcaaatctggaaagcaagaaatgatcttaaatttcaggggaaggtgctcgagccaacacaagtctgttttgcagcagaagctatgatcaacacttactcttgcttgattgagcaacctcatttgcaggataacatcgaccagagcccttcggagagaagaatggaacagctgcctgaaggtaacagatgctatgttgatgcctcctgggaacataataaagcatgcattgggatcttttttcatcttcctgctactcacaatgctcttttcattaaagctttttgtcacttgactgaatcccctttacaagctgaactgcttgctttgcaattagctatggagattgctttggttttgaatttcacagacacaatcttcctcatggattgctcaacggtggtggacacagcgaagaaaggaaacttccatgaagatccaagccattggagtcttttacctatttggagtcaaatcttaaccttcttaccaggacatttgctcaaggtccactggattccaagacatctcaacaagttggcagataagctagccaaggatgctagagggaacccttcatcccctccaatctttagttgccaaaacattgctcatattgcttacccatccaatcaatgttttgcttctaccctaagatctagcctgagggctcgaaattgtactgtcaaccatgtactttgtttctgagcttaataaaacgcatggttttcaaaaaaaaaaagaacacatagaacaaagctggagatggcttcctcctctgccgagtgagacacgttgttcccctcaagactatcgctccaatttccttttctctggtctgaaagtggttgaaaattacaaatccatgggaccaattgatgtgttactagttttgcattacatgtacatcataacatactattcatttggctacataacttggcacacggaagaaattaattaaagacaacttcaattccggcagcatagtgagttagtgactggacagagtaaacgtttgaacatacatcgattccagttttggctatatggagtagattactagattaattacttatatcttttacagtgatcagttcttgtatttctgtgagcactgaccattccacaaagctgacgaattcaccattgttgtcacgatgatccataaagagatcgagccatatatatatatttttgagagaacagtcaaggagttcttacacttcactgtagaaaaagagagttgatccaatttataagaaaaattgaacctaaaactctggcattgacacactgaacctaagaacaatagttgaacaagggaaaaaccctaaaacgaagccttcgagaaggacacgccgacagaacggtgacatcgcctgatccaaatgaatctaaggtttttatccggagaaatcccttaatgtgaaatagagcatatctctcagcatggaattcgagaggaaatcctagacggccgttttccacccgttgcccataggattaacgcgattcaattgcaattatttccataattacgtgattacgcgtattgatcggtagcgccaaatccttccatgtttggattgcccccgatctccctcagcgccatactaataggggaggccggtatcgtggatagatgacgatctctccacgatcatcttctccccgaaaatcccaaaaacctatccgatcaactgagcgctggagggagaacgtgtggtggttctgggacagtgtaggtggcgaccggaaggccatcgctaccccacaagtgattaccggcaaccccttcgggatcaagccggtgctcacactgcaactgctaccactactacctctacaccaacaagaacaaggagaaccgcatcaatgacttcaaataatggtcagttaaaccccaattccgcattagggtgatctataggcttagcaaattatatcttagtagatcgcaaagtctacaaatattgcccacacaccaaaactacctacaccactgcacaccgccaactacacaccgcaacaacgtgcacaccaccaatcgagccatatatatacacttggtcgatacatatgcataatggagcagaaatccaaagggtccagcccacagccaatatagtagaattatttacggtacaccatactagtatatatatgtatatgttgcagatgcacaatccaaacaccacaaaggcacaaactgggaagcaatggatcagtcataaccgggaataccagggcgtttccacggacagaagtcatggccagagatccaatccaagtcggccgaacgaaaatttgaccggtggtcggtggcaatccagctgggctgtgttcgtgcgtacgtgtggcttctggattggatatgacacagctgtgcgtccaatcgagggttttattcactcttcttctcgtgattaactaactccctatggacaaaggccacacacacatccaatgtatacgaaaaatcgtatgtgtgtgccgagcgtatacacgtagtatgtccatgtgtgaagaggtatacgtacgttgtatgtgccctcgtaaaagattaatggttggttgaaatggacgcattgttgttcttggcaatatgtgtttaacacctactctctccattctaatctagaagtggtctttttttttcatagagggtgtaccctgcagtagattttatattttaccccctccatttcacgatgtaaatcattctagcgtctaagattcattaacatcactataaatattgaaaatgctagaataacttgcattgtgaaatggaggaagtatcaaagtttctaacagatcgtgtgtccaaatatatgggctctataaattgtagttactctgatgccctcttttcttattacaccaagtgcctaacatggtctgcaccatggacacatggctgtaatcaggggtggatccaggaacaaaaaaattggagaggctcaattgcgcagttttttcaaccttcagccatctagagacttttagtttatcattcatagtgaaaaaataaaaggggtgctccggagggtattcatgagtcttgtgggtgt

SEQ ID NO: 72135 - DNA, 15901 bp, Oryza sativa
ttgaaaatcaatttattttgaagaatccctggcaactcttatgggaacatgagagaacacttgatagtggctcgcacgaaggaataacaaatgagatcgcgctattcatgacccagggaaagcttcttgcggttaattagcaacatctatgactagctagtggctattcctttgacgaagctggtggtgggatcaagtagcagcatctatgattgacttacatagatctagtggctcttgcggtttcgccggtcttcgcatccgggcatctgccgatcttcgggggtaggtggttggtgaatgaaaaaacgaattgtgttatttttttttaaaaaaaaagagttgcgtggaaatgtaaaatacttgtaggtagatatccccttcaccctaaaataaagctatttcgatcactcagttttttcttttcaaatgaagctattttctcatatatctatcatttcaacgaatcacaatcatcttttattttatttcttcatccaatttcttttaccaatcataatgtttcctgatcattttttacatttttcaagtagatgtggggtcctgagcgaagttgaccccactgctacttgtggaattgccagtaaggcgtcaatttggcgcgacaattgcagctttctccaagaggacatgccaaacttgacaacaacatttccgtaagatgctagagtgcagttgtcacttgcatatacagcagggagaaatgatgacgaggtttttggcttactgtattagcattaggacgtttagttcacgctaaaattgaaagtttgatcgaaattggaacgatatgacggaaaagttgaaggtttatgtgtaggaaagttttgatgtgatgaaaaagttaaaagtttgaaaaaatagttggaaactaaaccaggccttagtaacaccgtcccaaaataaggttgcgttcgggagggcacgcaaaacggagcagcgtttagcgcgtgattaattaagtattagattttttttcttaaaaatagattaatatgattttttaagcaatttttgtataaaatgtttttttaaaaaacgcaccatttagtagtttgaaaagcgtgctcgtgaaaaatgagaagaatgagaaggagggaataggaacagccactgctgacgttttggacattctaaatactagtgagtaattaattagaatccatattttccattttttccatattagatatcaattttatggagacgaagcaacacatctctacatgaacgtaggggtactctggaaagctaaaacatcgatattttccatccacaagctattaacctcatcgttaattaaaagtgatctaaaaaaattatttattatttattttggaacgaaggaagtacgtaccatctgatcttatagttaaaaagatacatctgatcttatagttaaaagatacagagagggtttggttatcataggtttgggaccacgggtaacaaaaacagaaggtcaactctggtttccgtggtgaataatttcccgaaccttgagaatgccggaggttagcttcgttcagacttggcttcagccttcatacgaacaattttcaagtcagatgcatcattccatattgtatattttacggagcatattttacttgttttagcttctttccaatttttctttgttttttttccaattacacgacaaacccactcacaagctaaatcaagtaaaatatgctctgtagttttcacaagctaagggtgtgtttggttggactgtagcttttgaaaaagcggctgtgggctgtgacttttagaaaattagctgtgagaaagacaaaagctcgtttggttacacacaggtggcttttgaaaaagcttctctcctgacgagtggaccccacatgtcatacacaggtatcttctccatctacacagacacaggaaaggcagggcagacgagcgaggtggcggcagacatgggcggcggcgggctagctcctgctccggcgtcggcgaggagggccgtcgccccgtggcatctgcctcctccggctccgggtctggctcgtcccgcgcgtcaccgaagaagttggcgtcgatgcggtcgtcggtggcgccgtcctcgtcgttgtcgccgtctccccacgagcagttgcggcgggagccgccgcggcggcggatgcgctgcggcgtgcggcggtagacgcaggcggcagggcgaggaggagcggcggcgacgacgaagtgaggaggaggaggaggagcgacaccgggggtagaaaaaagaaacgcgaaccgtttttttgtgtaatggcagagatgggtaattttttccccaaaaagcaggtgaaagcagagggtagaggtgcttttgatttatactacactaaaagctggctttggacaaaagcaattgtagcttttgggtcctttggttggctttaagcttttgcaaaagcaaaagcaggttgaaaagtctaaccaaacacaccctaaatcttgctattagtgagatatctcagtctacaaatgtaggcctaaaattgttcatatttttttgacgagctcgcacatatgttctttttcttagtttgacctcagagtatgctttacaaatatttgcaggaattcacaaaacacgtggaattcaactattttccaatcttataattagcttgtcgctgtcgtatgaccgacgcatagtccgtcatgttacttcccttcataaaaaaaaatcaatctagataaagatgtatccatcacctaaaacaacaaatgatataagattgtccagatttattatttttggtggtatcacatttttacatagtttgtttttttggatggagagagtagatgaaattgtacgtaccgtcgtaccgtcatgcacaaagtacttgaacagttgctaatgccgcggttgccaatgcagataacccaagataaaacatcactctagaatttaatttttgttctcagacacaaacctgcatgaaaaacatacaaaggctacgatataattgcagtgcagctgcttatttatactacagttcaggcccatttggggggtccattcaaagcccaaatccagccccacttcagtctccccgagatcagtgcttcgcacacggcttgcgccgatctcaaacgaggcggcggcagagggtgatgccgtcggagaccgggagctgcacggcctccacgcgcgggtcgccggcgatcttggcgttgaaggccacgatggagcggcggatgtcctggtcgaactcctccagcacggagtcgtcctccagcgccacggacccgccccagagcgtgttgtcgtaggccagcacgccgccggcgcgcaccagccgcagcagccgctcgtggtactcgccgtagttccccttgtcggcgtccacgaacgcgaagtcgaacttcccctcgttctcctcctgcaatgcacaaaagacatgagacatatgatcgagcagctggcatgcaatcaccaagacgtacgttgctttgctattgcttacgttggcgaggaggttgtcgaggatgggcatggcggcgccctcgcggaagtcgaccttgtgggcgacgccggccttcttgatgacggggaggccgaggtcgaagtactcccggctgacgtcgatggcgacgaccttgccgtcgtccgggatggcgagcgcggtggcgagcacggagcagccggtgaacacgcccacctcgatggtgttcttggcgcctgtcaggttcagcagcagcgacagcagctgcccttcctccggcggcgacgacatgaacccactgatcgaatccaacaaaaatgttacacaacacagcatcatatcatcagcttctaattaatcacgctgaatttagcatgtactacctccataaaaaaaacctaatcttagatttgaatctgaacatatatgtgtctaggttcaaaacctaggagtgtgtccagatttaaacttagaattagttttttttttttggaatggagagagagtataaattaggagacaaatagtactaggtgtgctcgctggtgatgaggcggagctcgcgcatgaactcgttctcccgcgggtacaccatcgtgttcagcatgtactgcacccaaaaaagggtttttggtcatatcatctcaatcaacgattgctcgtccatgcactgcaatatggggatgaaaatcacgaaaattaatcaactagaaactgatgtgtacctcgtggagggattcactcttgaggagggtcttggggctatcgttgctgtggatggccgtcttcatctccttggactgaatctgaatgccgccgttggcgccatggctggcatcgccgttcgccgccgccatggccgtgcttgatactcttgacgccggtgtcgttcgcttcagccgcctagagtgtgcagtgcagtacacagggagaagtgttaccaggagaggcattgctgccaagctctatatacacgagggatgggcacgctttctgggccgacagctagcttaggccggcatcagctggagtgtcagtggtggtgccatgtcatccactgtgtcgcggtcacgcagatagcatgcagatgcagggatggatgaggacaagtgcgtacgtcgtccccagcgcagcggccggcccagctgatcgatcgatcggtgcgcggccactgtgtggctcaccgctcatcgatcacacgcacgcggccgtccccttcggtgttttcctcgtgcggttgcttcttttcttcggtagtagtacacgcgcttgcgtggttggcggtttgcccgtgggcgcggcatgggcatgggcatggcggtgtggctgcgtcaccgaatcggcgtgctctccatcacgccgctcgcgtcgcgctcgcgccgggggttgtgagcggcgcggcgtgacgacggatggaccgcggatggatgggtgtcatggactcatggtcatgttggtgggatatttgggatccgcgtcggctgcgcctccgcgcgtcggcgcgtgcggtgtgagccgcgtgatcgggatcggatggcccgttggtgcgttccgcgctggtggatcgagtctattctccccgtctccaaataaatcaatctaaaacaagcgtgtgtttggcttggaatcaagtgagaatccatcgttttatttataggatggtctcatctatgtatttagcacaaggatcgaaatgctctttctcttaagggcatgtacaaagatagagttagatatgagctctacgttatttagagactagcattctacaacagttagagacaatatggtctctaatcattaatgtatcaaaatactttttattactctcctttcctttctttcaccatcatgcaacaaaatttgctctaataaatgctatgagtcgactctgagccgttgtcatgcataacaaccatattcttttctctttcttccatatcatcaaatttacttgcatggcaatagagagaccactaataaagaccattgtacatgctctaagagtttgaagggtgtgaccggcatgtcaataagagaaaaggaagtactattaagttggattggtccaccattttttcatgaagctaaccgagatctaaaggaaatgttgctttttagaaatcatcccatcgcaattgttctcaaggcccaaacagccaaaccaaacaccctaaaaaataagttcgctcaaacccaacctatcctcagttatagctccaatctgatccatatctctgaaccgcaatattggatatctcgacctttcaatttattaaaaccagtgtaatttgaatccctaaatggttttagagagcggtttcgctgacgtggcactttgatttagtttgatcggctgactcaacgtgtgggttcagcatgtctatgactcctccttttttccttatcttttgtctctctcctcacttgtctcttcactggcaacattggtaggaggtgctggcgcagtcgctctgtctcgctcccttccgcctctcccttcaagtcatgacgccacccaccttgctgaaggagagaaagatatgtgggccccacaatatttttttaatgataaatgggtccctcatatttttttattctaatgccacaagcgccacatcaataccatgttggacgaaaccaggtcaacaccaccacattagtgaaaccgtcatttaaaaccgtcgaaggtgtcaaaatacattggttttaataattggaggtgaagatatctggtattgtagtccgaggatacgaatcagatttagccactagtaaggcagccaaagtggatttattctttattttttggacggatttttggacggagggagtagttggtgttaggttgcaaaggcttaagcgaagacgggcagtggactggcttggttggctaggaccgaatggccgattacgctggcggccatgttcgggtgaacggcccatgtgagtggttgtttgggcttgttttggcccatttgtaacactaaaagagcacacgtgcataatacgaaagagatgtttatcctaggcatgttgatacatccgtaacagcaaccccttggaggagtatggggaaaggaaccttcctgctttgaaaaggagataaaggaattttgttggattcacactggggtatatggtatacgagaatatggacatggctataaatcaaaatttaactcagaaaattggattgttaatgtttcagttgattggaggcgaaacacaaagctatatgatgtgaaaaaaaaactatattttccactctgttttttttttggaatgtctcctccactgcaagcttaatctcaggcatttaatacattgcaacaaaatctaattgattgcaataagaacttagcaaatttgtaacaaattaacaccaatatggacgatggaaaacaaaatttattcccctttcgatcaagagagtccccagaatgcaacggaaggaaaacaagaattggaacaacaaagaaaacttgttgcaacgaacaccgcaacattaattgattatgtgcaaggctagaagaggaggcacctgggtgtgtacatcgtgcttctccacaccttcgtgcaagccatggacatatgctcctcggtgacagcttcaccagcgacggaggacaagcaaaggtagcatggagagggaggctattatgatgtcctatttggcactagcaagttatatatggtcctttagatggatgaggttaaggttgttaagtggatgagaaatgagtggtcagcatgcacattctcagtacaaatattttctttcatgttttgttggctcatgaataccatgcatgaactgtacatgtggaaaagttgacgttgaatttgaacttcaattattgtacgacaagatcaacagcaacagtagagcaacgtactctctcctacgcaaaataaatcaaccacctattacaatgtcctaaaataaacatcatactactacgaggttgttttattttgagaccgagagggtatagacactctagcgcatttctaagattgcccgatcgatcggtcgatctcacttgaggcggcggcacagcgtgacgccgtcggcgacggggagcaggcatgcctcgacgcggtcgtcggcggcgaccatggcgttgaacccgaccatgtagtcgcgcaccacgcggtcgtacgccgagctccccggcgtgtcgcgcggcattgccacggacccgccccacagcgtgttgtcgtacgcgaccacgccgccgacgcgcagcagccgcaccagccgctcgtggtacccgcggtactgctccttgtccgcgtccgcgtacgcgaagtcgaacttcccctcgccgccggcgagcagctggtcgagcacggcgagcccgtcgccgtggcggaagtcgaccttgtgcgcgacgccggcgtcctcgatcaccgggcgccccagctcgtagtactcccggctcacgtcgatggccaccaccttgccgtcgtcggggagggccagcgcggtggcgagcagcgagtagccggtgaagacgccgacctcgacggcgttcctggcgccgatcatcttgagtagcacggagaagaactgcatctggtccggcgacgaccccatgaacgacctgtgcgtacgtacgtaaattaaaacggccgacgtcgacgtgacaagccaaagaaaaagaaaaaaacgattatgcaacgcacttgggatggttctgcgtgatgaggcggagctcgcgcaagcgctcgtgctcccgcgggtacaccgtcgtgtccagcacatactgcaaagtgcacacacaaatatgcatctctccatcattttttcgatctcttcctccaaaaaaacgaacatgaaacacacaccactgcacacgtacatcgcgcttacacatccgcgagtctatacgtacctcgaggatggagtcggacttgaggagggtattgctgcccggccggtaggtcgccatggctagctagctagctccgatgatgatctctcaatggcctctctagctatctggacctcttacatgagtattgcagatcaattaatgactaaaaaaaaagataagaagaagaacaagacgacacggcgttttgttaaattggtaggtcgcgtgatgacctgaacgtgcagttactcagcgtctctaccgatcagctaattgctgacagtactttggtataaaatatggtgtgctccctccattttaggttattagaagttttaactttagttaaaatcaaactactttcaattttactaagtttgtagataactatagtaatatttataataccaaattagttttattaaatcaataattaaatatatttttataataaatctaacatgggttgaaaatgtttattttctataatttagtcaaacttaaagtagtttgactttgacatattaacctgaaacagaggtaataattgttaccggttcatctataactttaattattaaaaattttgagatgattaaatcgttagagtatcttaaaaaaataactatcaagttttttgagggaaaactttcaaatgtaactataatgtaattgagtgtaattacattgtaactgcactataaccgcattgtaattacattaatttataccgtggctatgttatagctacagtataactgatataaacctgtatttaagactagtttagttgactagcaccgggatcttatccgtagcctatgtgaaatttctttctagcaattatttttctattcaatgcacccatcttaaaatgatccaataataacaaatctgaaagttttgacaaaaattttctagcattctagcaattttgttaaatcataatgaaagaaagtttaatacttatgtttatgtaatatacttcgatagcatgatatttatttaattatttagataacatttgtgaaaatccaaattattaaagtctaaatatgaaggaaaggagggagcagtggcggatctatgtggacccccgtttttataacaggaatcaatcgtgtaaacagtaccatttccctggatcaagtagtctggtacacacgaattcttagctgaaatatcaagtgcacatacacgagtgtctagtatgaatcattgcatcataagcccgcaggcatagtcttaaatcatcggaccgagcggtccggaatacattccaaaaacagaagaaggtaaggcagcggagttaaggcagcggcacgccattgccacaggcaatgaccgtaactaagacctactgggcgccatcgtcttcatcaccctcctgttagtaagcgtagggatcctccgaagcttcatctccgacctctgattaaatttgtatattgcaagggtgagtaccaaccgtactcagcaagccaccacagcaataatgcacatgacaggggaattcaaaggatggctatagttcttttgcgcaaagcaagttttgtaattcttttcacaagcctaagatctagcatagactgatcaaattttaataccagcgttcacattaaacaacgacggttctgtccaccatccattgtgatcccaaggatagcttcccgccattgagtggtcatggttttctgaggacgtccacattcccgcctctcaggaagtggctccatcagcataaaaatcatcatgcaatatcccatcccacataagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagctttttgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccgatggcgacaccgatgtagggcacgcctctcggccctacctcaacggctaccccaccatagcgcacctacctcactcaggggtgaaccatctatgcagggatactgcctccgctcggctatctaatccgctaggtctatacccatacgagaagtgcggttgtacgggggtcgtttcatgcttaacttcatggctcggtccttaattgaccggggacggtactagcctttcccagataccacccaaatccaccgtccgccccagtcgaaaacaattgtttaattttatttctcctttcacaaatcatgtcatcaacatcatggcaatgtggcgctcatgtctctacatgccgcatctcaattaccttcccaaaggtaattgcccaagcatataacatttgataaatgtgagtatgtatgattttagaatagcatttctaagcaattgtcataattgactagggactcatacgtaaatatggttacgaaggaataaagggcaaccaataatcaaggcatggcataatcacaagtaggatgttcatcattgcatgcaattttatttgtaaacaaaacaatttcgcaattgggaccaacatgttcaaggaatagtgatgacttgccttgctcaaagtcttgcgggtcttggctttcacttggatccgcaactccctcgggctctatagttacatgcaaaaattgatttgaattcggttagaattcaaataaaaatccaaataaatccaaatggaagtcgaatgcgaaagtcgattcttttatattaactttactatttgcgaactagggcaaacccaatttcgatttatacatcctaaactattttttgcgggtatacatattttgttaccataagtttttaatttaatctacccgggcattatatccatataataggttagaaatttctatcgcgagctaaatatcggacaaaatcctaaaattattatacgatttaatttagtctatgactaaatgattaaatataatacacggctaaaatccctagtaattaaatccgaatttctaccgtgaatcgattacttatagagattacccaaaaataatctataataatctataaggatttttctacttgtttagttgttaattacatctaaatcactaccgcaaattgatttcttatagaaatttccaaggataatccataatttatattaaattttgcaattctacgactataattaatctataattaaattctaattattttaaattttctaaactttcctaatctccctctaatttctatttatttttcctccctctctctcttctttttccttctctctctcttttcttttcttttcttttccttctctctcttttcttttctttttctttctctctctcttcctcccggtttctctcctccttccttcttctttctctccctcggcttctcccttcctctctctctctcggctccctctctacccggcggcacggcgacaaacagggggggcagcagctcaccgacggcggcggcggcgacgacggcgcacggcgcggcacactgaggcggtggcgcggtggcacgaatgcggcggcacgacagcacgagggcggcggcgcggcggctcaaaggcagcgacgcggcggcacgacgacggcggcgcgtggagaaggggaagaggcagaggagggggagatggagtgaggagaggggagaacggtggagcttttataggggagaggggggagtaaggggaagaggggagagaggggcgggtgacgcgacggcggcgcggcggcacggggcgagaggcggcgatggaacgcgcgcggcgacgggacggcgacggcgacggcacggcagtggtggcgcgcggcgcgaggcggtgatgggacgcgcgcggtgatgaatctcttccaacgtagcttgttccttcggcactcgtaagcacttctttaattgagacacatggaagactgggtgtacatcggcgatattttttggtagctgtaactgataggcaacttctcctcgtctagcgatgatttggaaaggtcccacatatcttggtgctagtttccctttaaccttaaatctttttgtacctctcatcggagaaacctttagatagacgtaatctccttccttaaattctaggtttcttcttcgggtgtcggtgtaactcttttgtcgtgattgtgccacctttaaacggtcacggatcaagcgaaccttttcttcggcttcttggataatgtcaggtccaaataccgcccgttctccagtctcggaccacattagcggggtgcgacatcgtcgaccaaataatgcctcatttggcgacatctttaggtttgcttggaaactgttgttgtaggagaattcggtgtagggcaaacatctctcccagtctttgctaaaatccaatgcacaagctctcagcatgtcctccaagacctggtttgttctctctgtctggccatctgtttgtgggtgataagctgtgctaaacgcaaggtaacttcctagggcttcatgtactttctcccagaaatgcgaggtaaactgtgtgcctcgatcagatataatcctcttaggtataccatgaagacacactatcctggtcatgtataactcgactagcttggcactgctataatttgtcttaacgggaatgaatctcgctgtcttggtgagtcggtctacgatcacccagatggaatcatatcctgttgcggtcttgggctgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaagggggaacacaaggacggtttgtggctatttgcataaaggcggttgtaaaacattttattgagcaaaacagtaaaactgttgagtaattaaagtaatattaaatctccactgatcaacgctacaccacgttgaacaggcccaaccaacccacctgtactacagtgcattgggtcgatttattaggtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgctatgggtgcgactcgcaaaaccatgcatccacagcccaccattcagtcgcattttagttggataattacgaccataaaacatggccagatgtctcgagcacgcagctcaacaagatactagaatgtctaatactgcaattatcccatcgactgagctagtggtaattaagcatggctaagcatatagttctagctaggtcacataagtaacacaagctagtcaatttattacccaaggttgacaaagaacagatatcaagtaaacatggcgcaagcgagcagataggaaaaccctgatcccatgtaattagcaaaacatgcatatttatttgtaaacggtaaaacatttataaattgggatcaacatgctcaaggagaatgtgtgacttgccttgcttcttcactttgatcttctgaactcttttcctcgcgaccgcggacttccgaaacgacggaaactacacgctggcacgcaaaacgaggaaaaactctaataaacaccaagaaaacagtacataaaaagtaaacaaacatgtagagctcaattttagatgaattttgcaagttgaatggctcaattcggagttcgaatgaattagatatgaattttagaaggttttgagccatttaatgaatttctagaattattaccgatttattgcgcaatttaaatcaattatgacgtcatccgacgggggagaggtggcgccggcaagcgggccccacctgacggtgactcacgggtggcgggcgcaccgtggaccgagtccacgcatgcgctggtccgcgggcgcaccacgtggcagacacgtggcggccacgacggacggctagcggaggtggcgccgacgtggcgccacagaggcaccgacgcgggcggcacgggaaggccacgtggacggcccagatcgccccgaaggaggatcgggcggccacgggcgagcgggagccagctcaccggtcggccggccgggagcgacggcgcacggcccgatggtcgccggcgacgaccaccggcgcgacggcacgcacgggaggcgacgaaaagaggggaaagggaaaggagatgaagggggtcctcaccgaggagcgccggcgacgggacgaccatggggaggcgaccggcggcggaaaggatggcggcggccgacacgggaggcgacgggaacggcggtccgacgacgcccgaccatggcggagccgcggccgagggccggcaagacctagggaaattattggagcggttagggagggaaataggcgaccggagcggcgagaataccacgccagagaggagaggaatggtggggctcaccggcgaccgagaggtaccacgttccggtgggtttccggcgatgaacaacggtgaccgaggtgctgcacggcgctgcgaggcgagaggtgaagacggagcgacgcggcggcggctaaggcgacggtggcacacggctggaggcggcgtatggtggaggtggctcgggatgcacggtggaagggtggttgcggtggtggaatggggaaacggagcggaggccggggtagagcttggcacggcgttgccgacggcgcaagcggcgaggtgcggcgacgactaacgcagcggcagcggccggctgaaggcggtgtgtggcggtagtggctcggcctcgcgatgggaaggtg

SEQ ID NO: 72136 - DNA, 2250 bp, Oryza sativa
caagccgggccgcgggaggggaaggagagaggattttgggccgagcccgaaagggaggaaggggaagtttattttgttttctttttatttaaattgatgcaatgacctttgtgctattaaaactatttctcgagctccgaaaattcacggaaaattccggagagtacattagggcacaaagaatattacaaaatattcccggccaatgatttttaagggaaaattttaattctcccaacatttcacttggataaattgatttaacttttatttaatttctagaaaatgtattattaattgatttttaaacccgaacgaaaatcggggcgttacaaatctaccccccttacaggaatctcgtcccgagattctgggatggctagaaagaaagccggtgctggtgggcggtctgactgatctgcacattgaactgccacattctgcttcgaactgattgattgactggttgatcaaacctgcacgattgcactggctggattcgacctttctgttcctttgctttgccaaaactggaccgactggttctgcttgaactgacctaggccagaactgcggatactcctgaaacttacttatcttggactgaactgttgaggttggcaattttggtaacctgagaattcaccacgctggctataagaggatgaaaattgaatctggcatttgtaaatcatttaccctatgtccgcttggactggtcccaactcaaatgacaagtaaatccaggaaacctgcttgacctgtctaagctaagcggttgaactggcctcatgggtgtaccttagaattcaatcggttgcccggggatcggcttaattcttctgataccttgcaacttgcttcttcaagtgctaccctgattgcggcactggttgaaccttcaactaaaacagcgacgaagtgaggcaaaactcttctccgagacctaccccccttacagggagtagtcttacttccgcgtggctgggatcagttgaactgttgtccttcaaatatagccaacacttctctgatttacaaagagccctgactttgaaaactgaaaacttcatcggtccatcaaattgaagcaatggcgatgcactttcaccccgacaagatttggaacttaacccttagttgatgataggaaattccacataaaagtgactctcatttagctcatggacacactgactcttgactgcaacacactactgctggagttctttccgctacacttgaccttgcatcgagctttgcatctcccgcatcaatacatccatcatctaatcttggacaccaaatgttgatcacgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgttatgttgtgagtagacttttattgttcaagttgcttaagcaaacaacctagtatggtcgcatccccaccaatgatgcaaaccatacccctacacacaagcaaacaacacacgatctagaaagctaacggaactactcttctgggaaagattgggtttaggtcaacttcgggaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagattgggaggagaattttgaaaaaccgtttcacaaagaaatgccgaagggcgagaggagacaatttgcaagtagggttttcagaaaacttgtccttacggtttgaccatttggctcaacctacagtcaagttggctctgataccactttgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggccaaactcaactggggtctgagccttggtcctctaactccatcttcagctcagaagcactacacttctgaaaaggggga

SEQ ID NO: 72137 - DNA, 9717 bp, Oryza sativa
tggaattgcaagattattttccccagggccatgcgctcctccccacctatgccttgtcgagttgtcatcttgtattcatgtcaaatgtattgcaatgactgccaccaccactcgatatccaactaggtgtgctctaccatattaattagcaccatccccatctcgccatagacgctaacctatgtcccttctcacagagccacaatgggctagcacttgagcccctccatcgctgccaaggtaccatcaacatcgagctgctgatggcccctatgccacatctactatgcatgccacaccgttgcccctctgtgcctggccatcaatcctaaccgttagctctaccacccctttgttttccactagcatcttcgccccttatttgttcatgcgttgctccacatcctccataaacggcatgatgaggtaattcatttttattgtataacttaaaaaataagtagagaagatatgggaatgcgtagctactttttgagaggtccgcttgtcctgcaccagcgaaacaaccgggactaccaggtttgcatctatttataggaattgcattagagttgctcaacgaaagagccagccaacgatctctatgctgcaccatgcgtccctgcctagttttctttgccccctgccaccataaatacgcacccagctgcaacatggatcaccaaacacatcgatccattcctttcaagaaacaagaaagacaacaccaacaaactagctagctcgccaatggcctcgttgtactccttccggctcgccgtggcagtggcggcattgttggtcgttggctcatgcgccactgaggtcgccttcaaggtcggtgagggctctagcggaaaaagtctagagctcgtcaccaacgtcgccatctctgaggtggagatcaaggagaagggcggcaaggactgggtggcgctcaaggagtcgtcgactaacacctggtcgctcaagagtgaggcggcactcaagggccccttctccgtccgcttccttgtcaagaacggcggctaccgtgtcgtcgatgacgtcatccccgaaagctttacggctggctctgaatataagagtggcatcaacatctaagtgatagacatgtgtgcttttttttttgaaataattcttaacctctctataatcctttttttttcaaaagagagatcaagtctgcattcggggaagccaaaaattaagtttctatggttattttgtgaaatatgccatcaacaaaataaagcattccatatgccatgtccgcatgttgctgcagaggtatatatccagacgattttgagtatattactgtaacatgctgaaaattagatattttctaattatgtatcatgccggttcttatgttcttaataaccttctaaatctaggaaattatgattagagggaccttctagaactaacttgcataaaacccctctttgatatttaacttcttttgtgtttttcatttaaaaatatatttggttaaattgaggtatttcttgatttggttttaaattaaaaccttctttcgacaaaatttcctcttattcaaatttagtttaaaaacccttttcatttgtataaattatggtccaagaaaaccctccaaaccaactctttgtaattccaattttaattggaattaattgtcgacccatcctttgattccaaacctatccttagttccctttccaaatctcaaatatccaaattcctccttttgatctaaccgccaatttagttcctacggcttgatcccttctcggcacaagaatggtattattacaaatattatgaataattgctcttgtgctaagaaaatatattttatccttctcttccacacatccaaattcctattagcctcaaatacttctctaaaatccatgccatatattttggggctaaaatcctattattttcctctttgtttgcttgcctcattcccaaaaatattttgaggaattatattgttaatttctctcccatttgagtgcatcaattccaccataccccacttctaaaaatattgcactcaaataaatagaagatctttatttcgaaatttatctccacatataaactccctccaaatataattccatctatacacaaaatcaattctactcaatttgggccgaagttccttcacctaagcccaagtctgaaagtctaatttccctcccttattcctttcctcactgtgggcgccgccgccgcccagctgctcccggagccgccgtcgtcgccttgctgaccacgccaagccgacgccgtgccgtcctctacctcctccgccgcccaaacgcagcagagccgccgcgtggacgcgccgccgacgccgaccaatcacagagaagagccggcgccgttttcttctcctccactccaccagcgccgtgcttcccttgtttttctcctctctgaaccgccattgaccacctcctttcgccgcctataaatagccggcgaagccccttcttttcccccagatccgagcctcgagctccatccttctctctcgtccccaatgccggccaccggccgatctccctcgtcggactatttccgaccaagccctcgcgccatcggcttcgcctcgatggggcaaacccattccctaaccttccccttcctttccccttccaagattagccaccaccgttacttcccaaaccggccggggcaagcttttggccatcgccgttccggtctcctctctcattccccctgccggacaccaccctccccagatgcgcgtcgttcgggaacacattccgccaccgatgtcgccgcctcccaaccaccagagccctggtgcccctcctccccctcctctcgtttgctcggctggaagagaggaggaagacgacgggaggaagaagaaggaaaggaaaaagaaaaagaaaggctgacaggtgggcccatgaacagtgcactttcatcttttctagatttaattcaaaacctaatctttagaaacccatatctcctaaaccatagatccaattccgatgaaacttagacctaaattcatctaaattcaaaatctaccttttggtaccaaatttactattctaatattttatttgaattttcttaatttattcaaatactatttgaataaatatttgatttaaacctatatttgcttttcaaatattttattttatcccaattacccttttagccactaaaaagccgccggttggaactttgcgccttccatggggacgttcacggttttctatccccgacgtcgaaccgttggttgtaaagcccggcataaaccaaacccaaggtcgaagtgctgctcctggcaccccacgcctcgatgcgtatagcggtcggagcttcactattccatcgacctccacagcacgccgcacagttagctctcgggctctgtgtaatcctagccgctccgtcgccactcacggttatcggagtaacacttccaccccactaaacctgcacccacctactattcttctagccgatatgatgtctatcgacacctgctagaaatgataccaaatctagtcgctatactgtccaactctagcgacaactagcaaacacccaaaaccctagccgatatttatcctacctcaatatcggcttaaacaactaaaccctagctaacaccttgctagttaaaacccaaccgtcatccaaataccccacctaccaatatcgcctatccactatacgcagccacctactctcctagaacctatacagagcctagccaatatgcttccctattccgtagtcggcttaaatataaccaaaccctaggtattatactacctaaacctaccaccagctaatactagccatataccagttgaaccagttcaattacccaatatacatcccatcctttcagcaatcaagccacacataaaatacaagtgaccctgattgcttaatcccctctagcctccaagcctttagaacttacacatgaaatactagcccaataatcctaataacctataaaagagataggctataccctaaaccctatccctcttaaccgtttatcgctttcttgctattttatggcttttattgaatttagttcttcctcttcttcaagtagagtctattgtattttggatgacaacctgtggtatttcgaggatcggataatcaggttgtctatctcggatttatttgcgttggagcaaggcaagttattattcctccccttgagcataattaccctatattctatatctctattctatgcattagccattcatgattttgaatgcataacctgaacatatagcaaaccagttatatgctagattttgcttagccatgcctagttagattgcataaaatataatgaacttagattggaatagtgtggtagaaatggttgatttccgggtggctagtactgttccaaccgacataagactgccaagtacatgtgaagaacatacgagtacgaccgcaattctcgtatgggcatagacctagctgattaagttatctagaaaaggtggtacctctgtatagtggttcttcttaagtcctcgcgcaggaggcaaatttatgccgcgaagggcaattgtgatatttaccgaggcgcaggtaaatatgagatttattgacgtcaacttgtttgtgaaccctgattgtgatgacatggtgtcatacaatcagttctctctaaagacctcgggaacgccaaaactcctctcgctgctgataacgttacgttcagagcgcatgggaactagagttcatggaacaggtaccactaatgttagtaactgaaaagctttgccatgacaaagctaatgtgtttggcacgtcatggattgcgggtaaagcgtacatttactgcagtaaaatataaatgaatatattcgaatagccgtgctcacggatttgagcattgggactcatatggtatttggttagaaacctaattccaaactttattaaatactgttgcattaaaatcattacaggctttctactttttctgcaagtaatcatagccctactcaaataccactatttcatacattcatattgaatttaatagcttgctgagtacgttgtactcacccttgcttcaacccctcttttcagagtcattttggaattcttatcgaagccgggagttcagttatataagttagtctcattctaacttagttctcaagtatagattagatagatggtttacgtctatagtaaaacactagagttgagtcattctatagcttctgctataatagttagccacaatcttgtaaataccctattattttatgtaagagaatccccatggaagccttgctcaaatgtatgcaatgaagatccagattgttgaacctgtatcaatttactgatccagggcttgatacagttaaacatgtcggtttccgaatcattagttttgggacccgacaattacgtatataatatttgtgggaaaaagtatagttggtgaaccttcatcgagatagtttcttacattttagttgattagtttcttacgttttttctaaagtttgagtacatttgtatatgtatttccatatcaatgaagctcatttatcttcttcagtttgacagtaagaaaaaaatgctacgaaagtcgcatttacactagtcattgttttgtgaccacaaattcgtccatgcgttggtccacatcctccataaatggaaaatgaggaaatgattagtcttcaatatttgtaagttaaaaaaataagtagaaaaaagatgggactgcatagctgctatttgagagatctgcatgctctacgcgagcgaaacaactgggactacccaaaccacatctatttatagcaattgcataagaattcctcaacgagaaagttggccaacgatctccattttgcactgtgcatccatgcctgttttctaaccccaggcgatataaatagatgtcatccacatcctccataaacgaaacatgatgatgtgattaatttttattatataagttaacaaaaaaagtaaagaagatatgtgaatgcattgctactttttaagaggtctgcttgtcatgcgccagcgaaataactaggactaccaagtttgcatctatttataggaattgtattagtaaatacgcaattggttccaaactttaaatagaagaaaaagctttacactaccagcgtgttagaaggaactagaatatatatatacatatatatatatatatatatatatatatatatatatatatatatatatatatatatatatatatatatatatatatataccattagttccaaactatatatgtaaagaactaataaattcttaaggcctaaaaacatgtagtggtggtttatggtccctcgtcaatcgtaagcccatcctcactcccacgccctctcgagcgagttctacacgcatgatgtcccttccgctgcatgaatggaagcacgcccccgacccccaccacccgatcaaaatcaatcaaccatcattccgcggcgcttgcctatggacctcctttcacgtctagctctcaacttgcatggatgtaacagcatgtgcacttgccaataaaaaaaatatcaattaaatttatagtgtactcttttttattgtacaatctacaccaagacctagaattgttggattattttcataaggccacgtgttcctccccacatacgcctcgtcgagttgtcatcttgtattcctatcaaatgtattgcatcaactgccgccaccgctcgatatccagctagctgcctaggtgtgctctaccaatttacttagcaccagccccatctcaccataaatgctaacctatgtcccctatcgagcagagccgcaacgggccagcacatgacccatctgtcaccgccatgattccatcaacatctagctgttgatggcccctctgtgacatatactatggatgctacacggtgcccctctatgtgcctggccatcactcctgaccgttagctctaccacccctctgttttctgttagcatcttcacccctaatattttcgtgtcttggtccatatcctccataaacggaacatcacaaatttttattattcgcaatttaaaaaataagtagagaaaacatgggaatgcatagctaccttttgagaggtctgcatgtcctgcaccagtgaaacaatcggaactaccaagtttgcacctatttataggaattgtattagagttgctcgacgaaaaagccggccaacgatctctatgccgcaccgtgcatccatgcctggttttctttgccccctgccaccataaatacacacccagctgcaatatggatcaccaaacacctcgatccatccctctacccttcaagaaacaagaaagacaacaccaacaaactagctagctcaccaatggcctcgttgtcctccttccggctcgccgtggcagtggcggcattgttggtcgtcggctcatgcgccactgaggtcaccttcaaggtcggtgagggctctagcggaaaaagtctagagctcgtcaccaacgtcgccatctctgaggtggagatcaaggagaagggcggcaaggactgggtggcgctcaaggagtcgtcgactaacacctggtcgctcaagagtgaggcggcgctcaagggccccttctccgtccgcttccttgtcaagaacggcggctaccgtgtcgtcgacgacgtcatccccgaaagctttacggccggctctgaatacaagagtggtatcaacgtctaattaatagacatgagtactcttgcattgggttgcatgataattattaacctctaaataattttgtcttgaaaaagatcacgctacgcgtgagcaagcaaacaattaatttcttgtggttattttgtggtaataagccagtggtaaaataaggcatacatgtgtccttccaaaacattgttgtggagctatatgtgaacacgatttcgaatatatggttgtgtgtgtgtttttttgaaataattcttaacctctctatgattccttttttttcaaaagagagatcaagtctgcatttggggaagccaataattaattttctatggttattttgtgaaatatgtcatcaacaaaataaagcattccgtatgccatgtctgcatgttgctgcagaggtatatatccagacgattttgagtatattacgtatataatatttgtgggaaaaagtatagttggtgaaccttcatctagatagtttcttacattttatttttctaaagtttgagtacatatgtatatgtatttccatatcaatgaagctcgtttatcttctttcgtatgacagtatgaaaaaaatgctactaaagtcgcatttacactagtgattgttttgtgaccacaaattgttcaactatgacacctgcagatactataagcatgatgcattggtacatattttagcttactcagaaggcagagtgcccacaaatcatgttcatcccatctccagcaccgaatgcgtggccatggataaaatggaaatgaatccaacttcgagaagagtaatctatgattcacgtcgtacaattggccaacaattaaagctttatcaaatatcagttatccgtgtgttgcttcggataatagaaatatatttaataatatctcaaattttgcaaaattataatggcatggttccaattttcccttctattaaatgtgttaataatatgtttgctaaagggaatattgatcctaatttaattttatacatagctttccatttaatgcttgtttttctaataataagatgctcaaaggctaatttatatattggatgggaataggtggggtggcagattcactgccaccagcactattttttcaaaggagtatagaccatcataataccagcgtgttacaaaggatctcaaataattatatttgattattgtgtggtttcattggctaatcaggtgcgaatttggtttctggataactggatttgctcctcctttggttcctgtccgtttcttgatttcctccggctttgcattgattaattccactgctctggtactggtgagctgtagaattagagattttagtacttttatttggtatgaacatttttttcatgaagtgtttgaatcattaaatcgtaacgagcgtaacagataatcccagattgcatcgttgccaatcatatattgagaaccgcaaaagctatcataatcacaccatcccgcttgttattagtggtgaaaatgtcagtgtcaatggaaggcgacagtgacaaccatcatcagttctttatttaagttttactctttttttcccgttacacggaagacgtatttgtggacaccatattcacctatccgtgaaaacgtcctctaacacaagctcaaaaaggcagagacaacggacatcactataaggccccctttgtttataggcttataagccaacttataagtcgaaaagtctaagcctaaacaaacaagcagcttttccgtttggcttttttaaagccataagccactctaacactattaagccaaaagttagattggagaagcttttttggcttatatgaggtagatgtatgactcaaccactaaacttaagacattaaatccaccggcttaaacaaagagggcctaaacttgttgaaagcacaacggtgtgttcttgatatactcattcacgtgctttcctt

SEQ ID NO: 72138 - DNA, 3454 bp, Oryza sativa
tgtttacctttttaaatctctgtcaaatatgcttatcttgccatcatgcagggagatgatccagcacaggccttatgatcataaagtagatgtttacagctttgggattgtcttgtgggagcttataaccggcatgctccccttcacaaacatgacagccgttcaggctgcatttgctgtcgtaaacaggggctctcgtcctgcaatcccgcaggattgtgtggattctctgagcaagatcatgacttgctgttgggacgcaaaccctgaagttcgcccatcatttgccgagatcgttgtcatgcttgagaatgccgagatagaggttatgagaaatgtccgcagggcacgtttccgctgttgtattgcggggccaatgaccacagactgaaactaatgcaggatagagtacagaaaagaaaaaagaaaagagagaggacaccatgatatcggtcgcgtttgcgtgccgatatggaagtctcatccctggccttcaaggtttaaaattgctgatttctactttatcaaatatggatggtaccttgtatgattgtatatcttagcaaagagccgtgttatgtaattctccgaaatgagctatcttgtgaaataatagcagctgtatttgctggttgatcagcagctgttgtgtgttctttgtctgaagcgtcgacctacttgtggtcatcatctcctggtcttgttgatttgagtcggttgtatatgctgccattctttgcgcctccaaatccatttcatattattctccttgtgttgttttccatatggatccatgatacttatctatgcctatcatctatgtcgaagtcaaatctaaaatgtatctgccggttccactccggtttttgattatccaggtaaattatgcagattttccaagtggttttgtgtcaccaaattctaaacacctatagtctgttgaacttccacttattggagtactccgttctaaaatactttctctgttccaaaatgttggcatttttttttgtaggaacagatattaaaaaagtaggtgaaaatattggaggaatattatgattgattcacaaaaagaatgtagatgaagaattattatgattggttgagagaagatgatgggtgaagaaatagctttattttgattcatttgggacaagattttgtgctaaaaataagaaacctttattttccataaaatctacattaatattttttttaactaatatgaattaaaaatgtttttggtggcatgtgtgtagtatcattattcgtattttaaaatatttatatatgatgttaattttgtagtaattgataatgcattatgacagaaattaatgataaaaaaaatataacgttaaccaccgtgtaaaaagctggtaagatgcacatagtacaccgcaccagtcagaaagaaaccatatgctgtccaggcgaccagaagtcaagcgcaacggcatatcggggtaaaatctctctcccttttttaaagagggataaaattactttaaacatgttaagatttcaaattatactattagacactgaaaaacagtatgcacagggaaaaatcatgtcttgtttcccgaaagagctaatattctgacaaatggttaggcagtagattgtacaacgccaagaacaatgaataatttgtacaacacgaagaacaaagaattgcacaacagcaattacattttgacagaaataaggttgaaactagcacactttgtgaacgcttgatacttagatgttggcgttcacaaggtttatctgaattatgggaaggtaaataaacacacggatatagcattgacactcggcagattggggcaagtcttggacgatcttggatagtccaggacgtgtgcttattcatccatactagcagcgaccgtgctggtgatcattgcaggcttcaatgtatctggttcagaccaaacattgaagactcgtaggaaggtttgatccgctctagatccggaaacacagtgttaccggtgtccattgtgaactgaaacacctgaggctctactgcttgatgttgtccatcaacccaaaagggtacattagagtttccttcgcttggtacactgggcaatgtgctgttttggttcgaattcgtaaattggatgatagaagatgtttggtgtccggggtcagtcaaaccccttgaactagctgacagaagagagagagcacgctgaacatctagtgctccatctagttttgaagcagtttcagatgcatctgcacctgcaaaattggaccatcaaagcattagagcgacagtcgaaagaaaataaaatagtggtaagtgataacagaaacgtatgaaatgaaaaatcaagcatacagcgccagtaaataaaactagagaaaatactactctcaagacacggtatctgattgtattgagcatatcaaggggctcggaggatggaaagcatttagcaataggatggatctcataagttcactcgtgcatagtggtcaatggtgtgatacctaggctataggtatctgccatgatgccacaagtgtaactggaatgctggattgctagtcctacatgggttgtgaatattcaaatatacatagtaactaggaaaattttcatttcaaatgttcctaacttcaaagatggggggaaaaaatctgcagccaagattttggcactgcataagaaacttgcaatgttgtgaaacaacaaattgggagtttggtttacagaaagaatgctgaactataaacctcaaaattcaaatatcaatgtacctacacatgtttaaagttcgtttcgggatagatgccagtatcaacaaacttgatgtatcaacccattttgggtagtggccatatggattttactgttttatttcttctttttactagtaatatgccagtgctttgcaacgtaccaagctcatacaattgaggattgggcgattggctgggtggatggattaaggataaaatactggatgctacggtggttacgcacacatgaaggagcaggcgactgcgcacagtgggaagaggacagaaggagaatggttgcgcttttaaggtagtagagatacatattatgctgtcaaatttagcattgtagcctatcttttaagcctgtcactgcacatggcatgaatgctaagtgaagtaaactaactttgtcagcataagtaaaattattcgagtagattaattttccattcatgatataaaaagatcatggagccataccttttattggcaagagctcatttgtgtcatgacaaagagttggcaaagcatttgacaaacggatatttgcactgtctgccccagcttttcgtgaccttttgcttatgtccatcacttgggagagctgtaagtcagatgtccacgaggaacttgaagtggtgtttgcatggttaagtggagcgttattatcccatgcgaaacttatttg

SEQ ID NO: 72139 - DNA, 591 bp, Oryza sativa
acctttcctgcaagctgatgagaatcctcccatattagctcatatggtgggtatttcctgtccagcctaccagacattaaaaaatggagctgtgttaacaatcaatgacagccacaagtatatatggagagtgggacagtacctttcagtttccttaggaacaatgagtatgatcagcttgggcttgaaagtgagggctttattaatgaattgattagcaagagaagctttaaacccaaacggaggattcaatcccatgatctgagggaaatagcaaatatcaagtagagaaaactgagactttctgtgagaacaaataaaatgaatggctgggttgtgagtataccaatcgacatcctgtgggcaattcatctggttgaacggtcatccagtctcgtctctcaaaattgaagtcattctagggaaagaggtatgttgtgtcagcttcaacacaggatagggtgtgacaaaaatatttatcaggtgcatgactaggccctcatatatgtagcttttacccttttaatctccccggtatttccatcttactgaacgtatctatttcatgcatggtaacttgttcaatattaa

SEQ ID NO: 72140 - DNA, 537 bp, Oryza sativa
caaaatgactagatgttggtttaggaaatgcttagccatgcttagttcaactagtatacaaatggggatcacattattgcatagactttgactattagcatagctttggattggtgccaccgcaatggtgttagttaattaaaatacactgaatggtgggctgtgggtgcatggttttgctggtcgcaccatggcaattaaggaccggttcacgggaaaccctgggagacttaccgtgtttaccacaagcgggagtgggtaactgcttgatctaaaatatagctcgaccctttcctaggcatcggtggcgagggtgggcgtgatggagttgggtcggtcggggtgtccggttgtctagctgccggattcaccgcgactcaagaggggaccgtccactgccttttgaggggtgggggtgaaaccttagcgtggtgtggatggttaggggagggttatgcggagggtcttgtcacgatttcccccttcgcagtatcatggtgatacttcggggcatggcgacatgtgtggaatcgtgtc

SEQ ID NO: 72141 - DNA, 689 bp, Oryza sativa
aagggtgctctaaaaaaaaggagcaaaaggatcaggcagacaggtttcgggctacttgtcatatttgtatactatattgcatagtccaaatggatgcttacatacctacattttcttagtgcactattaggacatcaaaattgagagcaagtcaacaaacacagatgaatttaagaagtaatgaggtattacatattctcaatccgtggaatttttttaactgtcacgatgcaaagagaagagggccaaagacacttaacaacgagtaagggagagacaaacattgtgaaatcatgaaacaatgttgaggacagcaattcatgaattactctataaagcaaacaaatataaatgttaaagccaattatttacctccaaatctcctggttgatgcatgagtggttacagcccctggcagtgagcacgtgacaagtgttgacatggaggacacttttaagatctacaatcaagcaacataacattgtcacatatgaaaagaaatgaaatgccatgccaaatgattgcaaaatgaaataactatttactacagagtgcataaatacatggcatctcaaacctgatttgactgcttgagaaacaacacagtatgctcagggataatgttatcatgcatataaaaataatacttcctccgtttcatattataagactttctagcattacccaca

SEQ ID NO: 72142 - DNA, 624 bp, Oryza sativa
tcctgcacccccgtcagcgattaccgcgcgctcgccgggctgatccgagcgcggtgaggggaaaggtgctgccgaaggcgggcaagggctgtcatcctgccccgcctaagcttgaaatagaaagaccattccgttgacgggaagcgactaaacacgcattttagtgatgtcgacggcccaggaccaggccgtcgaccgcggtgatttgatgagcgtcgcttgcgccgcgaaaccaaacgctaaagcaccacgaagcccgcgcgccgtcatggaaggcgagccggcttcatggtccttcattgtcaggaggactttttatgaccctgtccctcgtagcagaacggaagccccgaacctgcgtgccctccttggcacgtggctgctgtcgacgctgagcgccgtcctcaccgttcgatcagccatccgccggcctccgcgccggccatcgggagttcctcgtcagatgtccaatccacagagcatcgccttcgctgcggcgaacgcgcatccgcacgccgtgccggccccgtcccgcatcatcgagatcggcgagatcgccgccgggatcgcagtgccggaggggcggggcgtgcgcttcttctcctcggcccgcaccttcgacag

SEQ ID NO: 72143 - DNA, 3338 bp, Oryza sativa
ccatcgatatgatccagtccgcctcttgtcccgccgtgcaaccacaacactatgtatgcatcacaccagcagtcccttgttctctggctactatttccaattaaatggcctcactgtttggagtttatggtttataccttgaacccactctgtctgcccgtctgcccggatcatatatatcatgacatctcgtacgtatcctcttctactacctcattgtctccaccccccccccccccactgtcctctcttgccctccaaacattgcatggatatatacatcacttaattgatcgtcaagacgtcaatggtgaatgtttttctattagtacataattccactattccataaaaaaaaactcaatctaaaaggggatgtggtttctcctagtacaatgaatttccaaaaaaaattaatccaggaggaatgtgacccctcctaatacaatgaatttggatagagagttgagtttttttctggaacgaagggagtatatatctatgtgcttgttaattgctctacacttccgtggcactgataggcgagccactccgtattctacgggtaaatttgatttctttttttttctacatagggttagcggaggtcaactagtggtcaaccgatgacgatagatggcaaagaaagaaagaaaaaaacgcttcatggcatttcgtataactcacgtttctcaattcgtacaactgatcatttgtcaattgcaaaacatagaactaatctctaggccatgtgatcaagttttgcatatacataatttagaaacttttatactactatgtaacttgtatttttcacacaggactaatggatcgatctcccttggtgcattcgggtgaggccggattatatatgtacaggggatcgcaccgatggctaatcaattggaacagtagccggcggttggacagggccactacctagctgactgctcgctctgcacgcagagagagagaggatacactgtgatgcacagctctcacacttaatctgacgcctcccctccatcacccatatgcatcgatcggagatggaatggaccgcgacactacgctacacgacgacgccaatgtacaagcacagtgtacgtattcaatgccaatctaactactacaaacacctgcaactcctctttcttttttctcactatatccttcaggtggtgtcgatccatggatgaaatcaatgcatcatatgcatggatagatactactatatatcgatcgaagacgacgacactgaatggcttgctctctgtctctctccatatgatgatgatgaccaatgccgaggtcgagacatgtaagaccaaacgctgcactggagagcatttgcatcccatgtcgctgcatctgcgaggcaagtttaatttgctactagtagctatagccttcagtttggttttggctctgcatgcatggatggattccattgattgacagagagagtgtggtggtggtagtagtatatagtacttgctagcgacaatgatcgtgcatgatgcattcatgcgatatcgaccggcaatatcgcatgcatgcagtagttttcataggcatgagcacagtgcgatggcttaggtaatcacagtgtcaagctgcaggggagagagaggtgtgtgcatcttgcgtttgctatagtgttgcatcaatgagctagctagctgtatgcatgagatgtatatcatgtggtgcctttgatcattgctgctgctgctgctagctgctaagcaattgaatctttcgatttggattctcagaagaatcgatcgatcgagaccgagaatatatacacgctagctactgtgtggttgtgcatacatatgcatgcatgcaccctagattacaaaaaacctggccggcttaatttcatttgccaggaggcactagtacgtatcatgattcatgactgatgatgcaatcgtcgtcctcgaataatgttatggtatagtagaagctagcagtgtgtgcagcggcgtgcatgcagcaaaatcggtggttaatcattaatgcatttctcttctatttcaagggtaggaaaggttgatgcgtgaggaggtaccaccttttctattataaatttggtactttttgatacctactccctcagtcataaaaaaaggcaaaccctaggtttccgtgtgaacgtttgactgtccgtcttatatgaaatttttttataattagtattttcattgttgttagatgataaaacatgattaatactttgtgcgtgacttatctttttaattttgtttcataatttttttaaataagatggacggtcaaatgttggacacggaaaccagggtttatcttttttttgggacggaggaagtaggtactatgaggtatcaaattttaccctaaatttttaataccccatgatatcttcgtaaagaccgtaaaattgctcgtatttttaaaggcagctaaaatgcatttgcaaaggtggttcggacgacagcctctaacaaaaggcgtggaaaatgatgcattttcacacatggaaaatgtaggtgctcgtgttagacaaccatatgtgtaaatgatttttcattggtgacgtcaacccattatggtagcttctttagaaaaagaaggtacggcttgatgcacatgcagttgctctctgcagtctgcacttgcgttgcccccattgtcaatttcaaaagtcaaatgaattggcatatctttacatactcctccataaaaaaaaactcaatctggacaacgaatcagggcaagaggttgcctagattcgttgtaggtcacaccctatctagattggatttttttttttgaagagagggagcacataggaagaaaatcattgcccccaaccctatcggttcgaaattcacatatagaatatcataaattgaatagcaaaaagggtttcaaatataaaatctcacaaaattggacagctaaaaggggaagaacatgggtaaaaaaaacaacaaacgagctcagcctcggtcttcccaccatctcgagacctcggctacgcagatgttccagcagctctcaaatctgtgagaaaagaggagaattgtgggacaacaaaaagaatagagaaaggatgaatcgagattcattcagagtctcagtcatgacagcgaggcaatgagcaggtgcgtatctgtggttgtggttcggcaacaaataggtattgcatcaactacatgactgacgagtgctaatgcaggtgatggtgccaacagaggagttgcaggggtccatcgtctagtttaggatgatggtgccaacaaaggagtcagcgatcttcgcgcgtgcgcgtgtgagggagagagaga

SEQ ID NO: 72144 - DNA, 2055 bp, Oryza sativa
tattgtcattcgaataacatttgtactaatttagtgtattactccctccgtttcaaaatgtttgacaccgttcactttttagtacgtgtttgaccattcgtcttattcaaaaaatttaactaattatttattcttttcatatcatttgattcattgttaaatatactttcatttacacatatagttttacatatttcataatttttttaataagacgaacggttaaacatgtgttaaaaagtcaacggtgtcaaacattttgaaacggagggagtatcattttagataattagtatccttcgataacttaattacaatgaactctgaccggtcagagtattaatgcgtcggaaacttttctaagtatccagaatcgtatatgcgcttgaacaaaatagattagcaatatacaggagatcaattttgtagaaacggaagcttgaaaggtatgtatatgtactacgccttgtttaaataaggcagtgtaatgctccaatattgcttgttcacacttgtacttcatccgtttcataacgtaagactttgtagcattgctcacattcatgtaatgttaatgaatctagatacacatatatgtctagattcattaacattctatatgaatgtgggcaatgctaaaaaatcttacattataaaacggagggaattagccagattaaggccctgtttgggggagcttgtcccagctgcagcttttcccaaaagctgcttctactagaagctgcccaaacagtccacagcttctgagaatatgtagttacaaattctgaaaaatgaactaagaagctggagaagctgggtttcagagcttttccagattctcagaagctggctaccaaatagctacttctcagaatctaaagctcccccaaacagaccctaaaccaagataaatagagttggctagctttgggaaataaaattatggaggcaatccgatccatacaaatcaaagccgttactgaactttgatcgaacaacttcttgagagacatgaacatgtggacgagtgatgattacagtactagtaaacaccatgcttaaaaacactactaagtcccaaaataagtgcaaccattacacagctgtacttattttagtacggatagagtgtgcatatatggattgaaacatcgagaatcaggactgctaggttgaaatttatgtgacctgatgacgacctagctagacaaggacatactgatagtcatatttccaaatctgaaaaatttatttttaataggcatatttcaatccaacaacttatcatcttaatgactttcttggatttaatgcatgactcttcattcttccatacatgattggctacatgggcattgagaaatgtaaatattaatgaatcgcttgtttacgaggaatgactagtagcatatttaaatggataataagtagaattaattatccttggtctgtgtgccaagatgaaatatgactatcaaaagtagatggagggagtacacatgcatgtacatcccactagtccgacaagtagctagctactccatttccatttagaccgacctttggatagttatattttaaaatggagggattacttacactattgacaagcgttactttaatccgatagtcgatataatattttgatgaacaaatattgtgtaatcatatttaacatacaacatacttcaataatattttcatgaacaaatattgtataatcatatttaacattacaacatagtacttcaataataccatggtatatcttcaaacattttacagatttattactcaaataagagtaatcagagtttgattgtaaacagtgtctggtgagtatttgggaacggagataataactaccaactgatcgatcgacaggttcatcaagtgacaacctttaattttctgcactagaaatcagcagaagctcacctcagaacagacttatgtggtacaccggaccgtgaggtgagacaacgtacgagccccaccaagcttgaaatacggagatatgtttgctgttccttttaaagcttctattcagat

SEQ ID NO: 72145 - DNA, 2679 bp, Oryza sativa
ggttaccaatttgtagtccgctactactcttcgatatatcttcttttttatcttctcgatatgtgtttatagatggcttatagtccactattgtgtaccgtacctgctcttagagcaagtttaatatatagtccactactagctccaaatcatttatagtcaatgtaatagccaattcatacaatagttacttactatactattaatatctggttccacctgtcttacactcattgcgtcttggagtccgtgctgcagctggctacagatccgtagcccgctacttttctctctcttcctttatctttttaaaatatatttataggtagtttatagcctgctattgtacctgctgtaattagcaagatttactataggagtaatttgcatgcatgggattagcacgtcgcacactccgaggcggaatgggggtaggcggcagatcgatcgatcacacaacatgcggatcgatgtgtgtgatcgatcggaagctagggcgcgcgcgcggcacgcgatgcgagggtgcgcgtgcgcgtacgacgtcgtcggctcgacggcgtacgtcgcgttccccggcagcgcggccgcgccacggcccgaccgcgcgccgcggcgtccgaggcgggtgccggtggagggcgcggccgacgcgccacgccccgaagcggattacgccgcggctgtcgcttgcagcccgcaggcaggggcagggcagggcagacgagcggcacgcacggtgcaggtgcaggtgcaggtgcgtaaatcgatcgatcatgcaaaccatgtaatgtctggaagtgaaaagcttagttagtctcgttgtttgcggaattgtttattcatatgcctgcgtttcttttgcatgctttgtttggctttgtccatttccgttgaaccgtttcttggttggttcctagctagctaatactacacggctggctggacaaaccgctagtaggagtaatataatatagtacaggtgttactctaactatggactaaaactaaattaaattagttcgaatttaatttgatttaatttcccacacaagcttcatagcaacatactgaaacaaattgttgtttgaaataactattatgcatgttctgggaaaacatttgaaaagccagtcgggaccagggtttcccaaaccgtcggggctggggttaccgcaccccgacggtaagcacggttaccgcgcggtaaccataaaaaaccgtgcaaaatttatcaaaaattcaaataatttttttaaatttatttgtatttaaggatattaccgtggtatttatattaccgtaccccgcggtatgccggtaactgtgcggttaccggcggtaacataaaccctggtcgggacatcttgaattcgttcatgctataaacaaaatggtgatggaagccatacatttataaaacagagaaagtagtttattgccaaatcatttttcggtgcttgaaataatttgttaaatacacaatgaaaataattttttgcagacctggaaggaaattacaggtacaagtatctctagagtgttaattttccatgttccatcaatacatatatgcactcggaaaaggctcaaaaaaatattctctgccataaatggcgggaaacaatgaaaaaacaacatttcatcacaaatacatgtttttagagaatattattgatgtcctcatcagcatttgatcaatattttaaaacatggagtacacgaatgtcttcttaaatattagagcaatttcaattatatgatttggctaaactatcacaaaaaagatatagttagccttgagcttatcacaaaactaccagcgcaaaatttaaggcacggtatcacaaaactacaaatttagtgttaattttaattcaaaactacaatatttatatttatatatatagctctaaattatgttttttttctgataactttattactaaatctgtacatttgtaataaatcgacttgaatataagtttttttaacagtttaatgaaagcaaatatacatagttttgttaaattactctagatattagttctcagaaaggatacatgaaattacttatatatggctaggttcatctctaaaatattcccataatattagacatataattgtgttatttataacttacaatagaaaaatggatatattgaagctgtatttatttggaacataactagcgccgatgccaaaataaaacgacgtgtattttttaattgtatcagataaagtaactttacttataggataattttaatattcttgagaaagtaaagtaaagtatacttttaccgtccttgagaatatagtaaaatattatatttttatataaaacttagtaaatatatacttcgtacctccaaacactttctcaattgccgtaaaatttcagtaaagtgtaaggtttgcattgcatgtactgtatgatatatctggtctcatgatgaagatggagccccatatggtgtggtcatcagcctgcacataatactctccatacaacatctcatctggtaaagcttaggattccccttagcagagtgcaaccgtcagaagaacaatactaccactcttccggagacggattctaatagctcaagtggacgtccacccatttattgcatgtcaactaaatggttaaaaaaaattttcaaaaaaaaattgaca

SEQ ID NO: 72146 - DNA, 664 bp, Oryza sativa
atttagaagttcctttcacagaggaagagataaagagagcggttttccagtcaagatcagatagtgccccgggcccagatggtttcacaggtggtttcttcaaaaaatgttgggaaatcattcaacaggatctagtccaggctgtcaacagggccttctcctccccgccagaccgtcttagactaataaactcagcatacatcatcttattacccaaaaaagagaatgccttccgtgtaggtgatttcagaccgataagcctaattcatttcttcgggaaactgctctccaaactactagctaacagattggccccgagactacaacagatggtatcagcaaaccaaagtgcgttcataaaaggcaagaacattcaagacaacttcctctttgtcaacaacatggtaaaagagcttcactcctcgaaaacgccggcgattttgctcaaactagatatagccaaggccttcgactcggtcagttgggcctacctcgtagatcgactaaaagcgctaggctttggtcatagatggattgactggatcatttctatcctggcgagctcttcctccaaggtgattttaaatggcagggcaggactcagcttcatgcatggtaggggccttcgacaaggcgaccccctatctccgatgcttttcattct

SEQ ID NO: 72147 - DNA, 627 bp, Oryza sativa
atatgcaacaggtgatgcatccggacttcatagtaccaagtttcttaattttcatgcaatttttctctgtccaggctccagagcccctggcgttcttgatgttcatgtgatgttcttagtaacattttttgacttttgtgaaaacagacgattaccaagctgacagctcagtgcagtgagaaggcttttgaattagaggtgatattttaaaaataaatgtttcagtatgctgtctaaaataaaatttatcccataccaagtattaacttttctcacgattgtgcctttttttaatgctacagttaagatcagctgataatcgcgtccttcaggagcagctacaacagaaggtgctctccttttctttatttctttcttatcgttgttcagtttaaaatgtttgtgaatggtgaatgactgaatggtgcaatttcaatactggtttaacacaaaaatcacccctacttgcagaatgtggaaatcaatgagttacaagaaaaagttctacgccttgagcaacagctgacaacaaatactgaggcatcccctgaacaatgcacagaacatgagcttcatgatttgaaatctaaacttcagttgaaggttccttttctgatcctcatttcc

SEQ ID NO: 72148 - DNA, 2210 bp, Oryza sativa
ctactgccaaggcggcctgtacagcagtacaggcgtcacgggcgcgtttgattgttggcagttggcactgataatttgttccacctgcgtttctttctccaagtacgttgttgagtcaggttagtgatttttgttgaagggctcgtctagtgcgttgctgtgagcctgtgatctggacgtcgtgacgaagcttgtgaactaaaaggcaggtgtgtgataagctgtgttgctggcttgcagttgaagctggtgaggtttgtgcgtccttttctgctcctagttgaaagagtgcttgcacttgtgacttgtacaatctggttgttattgactcgctattacaagaccgcccatcggtgtctcagtctcactaccgacggatggtgagaccagccaaatcgttttttccacttggacccaggctaaaacctgccaagttataaccgggactcatgccctggtagtacttgcagttgcagaatcactatcaggtgggtgtccaattggatccttaaccagtggacgtttagtgttaaatttgaatcttccaaatgtgaaaatctagttaactcctgttaaaattctatggaatctatttaaaactcttacatccaaaccgaatttaaagatttgacgcttatatgcgaattacaaaatatctatagcaaagaatgcatcttcttcaaatgtacggcgtgccactatactgtgtaccgatatcacatatctatgatcgaagttgcaaacacttgaactgagagtgctctctccgtctaaaaaaaaatctataattgaatttaacatagtattccttcggggcccctttgatttgcaggaaaaatataggaattttggaggatttcaattctgtaggaaaattttatatgaagccctttgaaacctttgaaattcctatggaatggactatcctatagagattttggagaaaatttagtaagagcttcaacctcttgtaactttcctttgagtatatctctctcatcctgttcgtgcgtttttcctgcggttcaatcaaacggtcatttctctattttttcccgcgttttgctatcatctgttttacacttacattcctattaaaatcctacgtttttcctgttcctacgttttatcaatcatgcgattcaaaggggccctcagtctcgtaatataacaacaatcgaagggagtactccctccgtctaaaaaaagccattcctaacatctgatgtggagttagtggagatggagaatgactaaaatgaccttaatcattgaaaaaaaagtagtaaaagtcatgtgtaggtaaaggatattaaaatgataaaacttatcgttttacgtgttgagtataggtaggatggtagaagttattttttggtgggacaaaatttaaattgtaggagttgagtttttttttttttttttttttttacggagggagcataccgtgtcatatactactgcatcctcctatccatcaacccaaccaacggttctctcaatcaatctcaccatccgacggtcgcaacgagccaatcggagaagagaaaatcaaaataatcaatcaataaaacagaaaaaaagtaaaaaaaaaaaaagaagaagaagaagaaagtagcaagccggagtcgagagcctctcaacccatcggccatcgcccaccaccgccattcgccaccacctcgcctccgattcagatctccctcccccccttccattccacgcccatcggattccctcccgattccgctccattcctccccgcctccgcccccatctccgccgacctcgtcgtcgtcggcgtcctcatccaggcagtctcggcggcgattcgatcgccgccacggtcgccgatggaggccatccggaagcaggcgtccaagctccgggagcaggtcgcccggcagcagcaggtgagcccagattcgagattccctacccctcctcgtggattcctcgatcccagctcgccgtgtctccctccggtcgagatctcgtgctgccgctcgcgcgcgctctcccatggctgacacctcgggagtttcgcatcgcaggccgtgatgaagcagttcgggggcgggtacggcgcggacggcgcgttcgccgacgaggccgaggcgcagcagcactccaagctcgagaagctctacatctccacgcgcgccgctaaggtacttggatttgttcccttgcagttttacttatggtaa

SEQ ID NO: 72149 - DNA, 3097 bp, Oryza sativa
  unsure (1)..(3097): unsure at all n locations
caaccgcaatgctctacccctattgcattatctccttgggatgaaacaagtgactatcaaggtgaagctgttgattctgctctatggggtgtccaagatgaccaaaacaatgaaatgtggtcattgtcttcaccaacacctactctccaaccttcaggttaatggaaatacctttttttaatcactttatttgtttgcttgataatatttaatcttgagatattctacaggtattggagctgataccaaaggtgcttcctgtgctatagaagaggtgatagtagcccaaggaaatagtggtgttgttgaaccgtcaccagcactggagaagaaaaggattgaaaaagtaccaagtgcttccatagatcgtggagtaccagagcaggtaatgctaacttaaatatttaaatactaggcaaaattcatcagcattatgcaaagagaatcctagcaacatgatgtacccaagttttaacagcagttttattttgacttgtttaggtaaaaccaaaatcagatgctgcattatctccagaagagagcagaaaaccttcaggtttgcaactatcaagcacatatctacaagggagcacaaaatcttcaggtttgccaccgtcaggcacatctctagatgggggcatagaaccttcaggtttgctaccttcaggaacttctttggagtggggtacaaaaatttcaggtgtgcaatcctcggcctcatctctagaggggagcaaaaaggcttttgttaggcaaccatcaggctcttcactagagggaaacacaaaagcgtcaggtaggcagccgtcaggttcatctatagaggggagtaagaaaccttctgataggcagccatcaggtgcatctcaagaggggaatacaaagccttcaggctggcaacaatctgtgtcgtctcttgaaggtggcacgaaaccttcaggctggaaaccttcaatttctatagacacgaatacaaaagcttcaggttggctgcgatcgagctcatctcctgatgtgggcagaaaagcttcagcatggcaatcatcaggttcttcgcctgttgcagggagctcaaaagcatcaggttggcagccatcacctcgcgagagctcgaaatctaagcctaattccacatggggtgccggccaaagccgcaactcgtcttcgcaccaatcaacaacaccaacagctaaatactcatcagaaaccccaaggagacaaggaaacaacaacacaaattctgctggctggggagactctctcggaaacaagagctggcattcaccctcaggcaatgcgagcagccgaggcagccattctagccaccaccatgaccggcacaatcagagcagcgaaccatggcgtggtggctcaaatcattccaggagatcagatcatcgtcaagaacatggcaacggtggctcgtcgagatcatcgtcgtcgagggggcaatctcaaagggggatctgtagatactacgagaatggctactgcaggaagggcacttcctgccagttcctccaccgttgaaaacgccctcacatttttgtacagccctaaatgatttctcactcactccgtagtcagcacagaagtgacctttatttaaccttctcggcaccactcagctgttagtaagtatatacatatccatcagcacaggagtatgattaagttagcattttatgcttggaaaaacagccactgatgtacggccacgactgtagatccttctctttaggtgaatgatgcattttgattgatcctgttaggtttagtggaattatgagttcacccgctttaaatctcccttgatcgcgtatgcaagaagcaaaattttgatatgtttgcactgtgttgtctcgtctccagaatttgtaattcaggcagcttgtttacctgggttactagaaatcggaagctgccgggctannnnnnnnnnnnnnnnnnnnnnnnnnnnnngacggctcgccggagcaatcctggcgtcgccgacatgggcagctccaggaacgaaacgattgtgttactgtgggttggaactaatcctccacgcaatgcaacgtaaagcgaaataatggattggtatataattaattatatgttagtaaaaaagcttttgttttaaaaaacatacttcctccgttccgttttatattttatattgtaaatcgtttctttctttctgctcaaatttctttaagtttaactaaactaggtttatatatatatataaaaatacagtagtgctttcaacccaaacaaacatattattaaaatatatttaattttagatttaatgaaacttatttaacattttagatgttgaaataaaaaacagttagattaaaagaaaaaaagaaagtcaaactggcttttggaaaagcagccgtgggttttggcttttgcaaaagtagctttggaaaagcagctacgaggaagtcaaaaacctgtttggttgatcagatgtgacttttggaaaaacttctcacttacgactggaccctgcctatcagcctcactgcattcatcctcctcctcacacggttcgcgtgggggctcgttgtcggggtgcgccggcctaggctcgtcggccagccatgaaggcagcgtgggacgagggaacaggcggcgacggggaagagcagacgcgcgtggtttggaggaggccggcgacgggagtcaggggatgcggtaggggaggagcttgccacctcgccgcaggtcgccgcctcgccgggaggagaaggggtggcgtcgggcggggtcggcataggatgaggaggagaaggtgcggcgtcgggcggggaggagcaggggcggcgccggccatagatgcgcctctccacccccactgctgcacgctagcggtgcgggaagacgcaagaggagtttatcgaatcgtttttttataatggtagaggtgggaaattttttctctcaaaagccagtgaaaacaggggtagaggctgcttttggatttgtactacactaaaagcagctttggagaaaaacacttacttcctccgtcccaaaatgtaagcatttttgaggttggcacgggtattaagaaagtaggtgagaatgattgaagaaa

SEQ ID NO: 72150 - DNA, 3706 bp, Oryza sativa
tataaagaatcctataggagttaaaagttccactcaacaaagttttcatgtgttttttcttaaataaaagtgatcctaataaaaaataatcttgctaaaaggaattgaggagggacatgcaatgatattctcgcaacgagtaagagacaattcaacatttgtttttttattatcgtatcgctcgttttgcctggctatatgttttccttgctttcactatccccctatccaagacgccaaatttttttttaattggttcagggagtacctagacacatgaaaaactgatttaatttgatactaatgcattatgctaatcaatctggggttaccaaaataaaaaaatctagctcaaaataaaatattaatatgcgatgttaccatagtaggagtaaaatactatgcacagcaatgttacatttttagaattggtagccaacgagatctcttttttcacaataggtggcacagtacatattggccaacttgttagaatccttgttctctttttagcttatcagtttatttcccttttgaagggtaattggggtttgtcttgccacctattgtgtttttgttacattaaaaacttgtttcctatgcttacggcagagtttggactttggagatgtaaaatatttttattacctaaaatggcacgatgataactagtggctgcacgacagctacagctacagtgccagcaaagaaattgtacagcatctacgtagctacagcctaactactcctatacaggaaaaacaatatgaatgaatgatgttttcggaagaaaacaatggccagagaaaataccatttataatgataactgctgaatttgacattggtaattgtatataaacaaagtaactaaagatgactggataattcaaaaaatgtaaataaagaaaaggaaaaaaacccaattagcattttctcaaatattctggaggacaatgatatatattttcagaatttcctttcaagatagaagatacttcgagagtgaagaaccaaagtttctctaaattaaggaagatctctctggcaagaggctaacagcgtcggcatctcgtaactgattgaacacataacaaagtttcaacctcatggttagccggccagtgattagtaaatttcaggtttggtgcacttttcagttttggatatacttgaagatgctgcaaactgctttagtttatcggtgaaccaccatgatggctttggaaactgaaaagcattggggggtagttttaacctgaaagttttttggtagagggtacaaaaatatatagttcaaatccaagcacatatttaaacaattttcttccttttagggtgaactagttatatattacaactggatagtccatttgtaaatatagtactagtgtgttgtcgcagaacttgttacaattgtatagtcctttagttttttgtactaatgtcatattggcaacacatattccttgttgagttggtactacctgcatcagcaccttaatctttcctagtttgctctgctaatgatgaacaatgttatcaccaagttagagcagttacgtaactatagagtatttgttgtacaaatttcttagcctacttgccactaataatataatggcaatatattcactcttctttacgagaatacatccatcaaaatcagatatgatctttgtattatcaataaattgtttatctatggggtccatgaatatgtgattgtggcttaggtcgtgttcgattcagccgtctggcagtattattgtttgtaattagtattatctattataaacttaaaaataaatatacttaattttaagaaatttttatataaaattttttacacgaaatgtaccatttaacaattttaaaaagtgtacttactttatgagaaatgagtaataaagctcatccgagaatccaaaaagaacgaaccttaattaggccttgtttgtttcctattgagtttttgtcttcaacttaaagccaacgaaagcttaaggttctcgaaacgaaattgtagcttctctacttctggaagaggctaaaagccaaaatggaggttacaaatgtatctatcagctgtgatcgggcccacatccatacatttctttaaagaaaaagaagaaagagaaaaaactctgtagctagtttttttttttattttttgaacttttaaattttaaaaataaacccttataaaacttgttttcaagatctgaacattttcgtcacgttagccaaactgacttggcaaaacaacattgtcacgatggtttggctgacgtggcagcattatttagtcacgccggtctggctggtatgacaatgttatttgaccactccgccctcgatgacgtagcagaataaaattgtcatgcccattatgtgcgacgtgccagtgttgttttgccacgcaagacagacgggtgttgctaaaagtttcagattctggaaaaaaagttttggcaaggttaatttttaaaattaaaaaataaaagttcaaaaaaaaattgtagctagtatggaaggtgctgagaaagcaactgaatgcaattttccaaaatggaatagttatggatttggcggatacaatgaaaataagttgaaagtgaacatttgtatttgttttcttgatccatcctttaaccgtatatggtgatgtaaacagctagtcttaagaaaactgaaaaatatatggtgatgactgatgaataccaaatgctaatcgtgtacggtcgtttaagcatgtgcactaaatatacaaaaaggaaatgtatctgttcaacatcttggattagactaagcattcatggatcttcagcccaactgtagtattgattactatttgatatgaacaattccagacctcgtgttggacaagttcaccctgttactttggccggctaattgccagtttgccaattgccaccacttgctcagtcagttgtgttactcagctgtgctaacgtaatttccatgctattggcaaacctaatttgctgcaagatatggaagtgtcaataaaaatatattacttttaatagtaacgaaaatataataagagttatgatataggatacttcatatatctaaaaatatactaaattctaacgatgtatttggatatatttatctaaatactagtcagaagttactatattttgagatgtggatatataggtgtcatgaaaaatgattgaaggagaaccttttcgtgatatactgggacccactgcctaaaaatatagaggaaaaaaaaacgaaaatgcatgtatctatggaaatttgagatcctatactagtcttaaaccagatataaaaatatcattcctcacctactcctcccaactctatataaaccctggatcatcctaactttctcctcagctctacaccaagagcgcttataaacataaaaaacatctcaaacacaacccaaaatagggccaaaattctagaatattatttttgttttgaaaggaatttaagtttgtgtggtgtgtcatccatggcggacatggtgaagttcaccatggagtggcttcaggatcctctgagcctggcgatcgtcgtcacggtggccgtcctaatcatgcggatgcagcggcggcgcgcggcgccgttcccgccggggccgaagccgctgccgatcgtcggcaacatggcgatgatggaccagctgacgcaccgcggcctgg

SEQ ID NO: 72151 - DNA, 7706 bp, Oryza sativa
  unsure (1)..(7706): unsure at all n locations
taatgtgctcaaggctatagtttcaagcagttggaatctatagaactaccataccttcctggtagactcccacagctcctccttatctgaaactggtgcacctatcatcacagctctttcaacgagtccctctattcacaatgaaaggtcagccaaacaagctataaataaagtttcatatatgcacatagttaagaggtaccattatttcccaacaaagctagttcctccaaacacttgaagacaacacgtgcccctagggaaaacccgatgagagtgacaggcctagaaatcccagtaaaaaattagttccattgagaaatgaagtctactggattgtacattctaggcagagaattacctgcttccttgcaatcctctgagcagcacttcagcaagcattttcccagtcttatctgccctggaaacatctactcaattaatttcttgtgcgctcatgtaattttggaaaggataaaaaaagattaatgcatacattacagctttaagtttgttgcattttttcgtttttatcattgctcattagtttctttttcgcgaacgcattgctcattagtttcaagataattgtattctctgttctgttttcagcttttgtacaactaatgaaaaaaaagagaccagttttgtacagaaaagggaaaaatgcatcagcattagtttatgtaatgagagttcattatgtcacctgtcaatagcaatggaccatttactatcgataaaatctgcagcagataccaagtaagccggccatgcaaacgcagaaacaataccacttaacacagtttgcattgcaccttccctcatcaactcaattgcaaatcctacatcattaaccaacaaccggacaattttatgttgagtaatcagtaaagtatgaaagaaagaaataaacgcaaacactgtacacgtcgaacgccaaaattacttgatgccagccaatcgcgtattgctgtactgacgccaattatatgcttagactcccattgcagaatgtacctgccaattacaagtttcttgtacttaagcaaggcaaacatgttctagaaaatgcaacgatattgatagggacaacagctgcatgaatcttacctgtattcatctcatgtgaatattttggtttctaaacagaatgcaataggactatcatggctatgttaataccaaagtacttgcaaactacaaagagaactttttttttgaaaaagtatttcgtgtgaatgtcttttggggggttgtacctctctaagtttgtcttccatccttcccatggcttcatataatcttcctcggtaaaggcaaatccagtgaccaagatggcaactgctagccgctgaaatgtcaatcctattaagtgtcatccactcgaaaaagttttatcgaagactagggataacatctttgctttatgctctctgaacctttccaacatcgaatcaaaataacacaagagaacaaaaactcacaccctggttatggttctcgccgatagtgttgaactcaaattctctcacacaaccaattcttttggccattttggtcccagtcaacccagctccagcagctgattttcaagttaagatgctggttagttacagatcctgataaaagattcctgctgggttcagaaataaacacctccaaataaggaatagtatcaccaaattaatattcaaaaaccatctacgctcacctccgaatgatgcagcaaccgctacagagcctgcagtatgtccagcagcagtagctatagcagcaaacccactagctcctattaaagggataagtgtgtgcaatgttggaaccagagcagtgaatcctgcagcaattgctggagcagctaaacctgaaagttcagacgaaattattcagttacagaacttatcttgatctgacatttcataagttcatccaaatttctttcaggtcatatacccccggagatggccatcagcgttcctcccgtcaaggcggctgcgccgatgattcctccacgcttccagttctcccatctgcttcttggtgactcgcttccttctgactgttcttcctctctcgctgcagccatagcagagcaagcaaccattatctcgatagcttcctacaatgccaaaacgttcgattacaaaaacatatagtttgtgtccatgacaaaactggtagagagatcactgttcttagcgtgtgcatttacatgtacaactaggctttctttctatcctaatttcacatggacgagaatgctgtgctgttatccaaaaaaaaaagagaatgctgtgctaaatgtaccctgtcatgtgttctagacttctagcattttcatgaaaaaactaatctagtgatcacagataatgagactactggacactatggtcataaaacatttgatgcttaggacaagttagtcaaacttcttttgaaactttgaccatgaataattcctcgaaattcctagttaaaaaatggtgtaagcaaatttcccttgaatagtaatatcgtaacattgaaacttattgtattttataaactcattctaacaaaaaaattatatggtcatagttttacaagtttagaatcttgtcctaaacatcaaatcaaatactccatccgtcctaaaatataaataattttggctggttgtgacacattctagtagtacgaatctggacatagatgtgtcctatcctactccaataccttatattttgggacggatggactacctatgatcagagggagtgttagtgatcttatcttgtaagaaaagcaatggaatctctggacaaatcttaccatcttgatccacttgacgtcgagccatgtcgcgagcagccggagcgcgacgcggtggcgggcgtcgtagcccctcctgatgcgaggcgagcccatgccttcctccgccatgttcacgtcggcgacgcacgccgagaggagcatgtacagcaccgccatcttccggtaatccttggtgcggctgccgccggccgacgacgccgacgccagccacggccacccttcgtcgccgtcccccccggagccggtggccttgatcagctcgtcggccgcgactacgtcgttctccagccccatcgccatcgcctcgacggccttggcgagcgcgagctcctgctccgacctctccgccgccgccgcctcgccgtcgtcctcgtcctcgaacaccttccggagaaactgagaaggaaaaaaaaagtatgtcacgattgaatcgccatggaaatggttttacattggagattgcattggggcgcgtacggctccgatgtggtgcttgggctcggaggtggcggccgtcgtctccacgcccggccatgccttgtggtcgatctcgagaaacctgagagaaattcatcaatcaatggcgatccatcgatcgatttgatggggtttggagatggatacctgaggacggggcggaggaggccgtgggagtcgtgggtccagaggtggcgggcgtcgacggggtcggcgagagaggggactgcggcagcggcggccggggcgtcgtcgaggccgtgggatccgagcaggacggactggtggatctgcgcctggcggagcgcgagcgccaggagcgcccccgccgcgtaccgctgcgtctggctcagcgtcgacgacgtcgccattgccgcgatcggatggcttggctgaggctcgccggtgggcgtgggcgcgggcgcgaagccgatcgaggaatcggtgccactggcttagccgcggcgcgcgcgcggaggcgaggcgagggcgaggcgcgtgcgccgtgcggggcgtgtggcgcgtgtggcgcggtgggaatggctgcctggctcgatcggcgccaccccgtcgcgcgcgcggcgcggcatgtcgctcgcgcatggcggggcgcctcgcgaggtgcaagtggtgttcgcgtcctcgcgagcggatggcccagagacatttggatgggcctcaatcacggcccgtttacgtgtagccatacacttggatgggccgagattgaggcctagctaacgaggccgtaatgtgagatatttggaataagtttacctaccgtctctcaattttacatgagtatgtaggccatccctatcccaatatcaaaaatgtctaccctcaaatggtcaaagccatgcaaataggtctcatggcagtatatatgggtggctagtggttacagcgaatgagcatgtgtatatccaaggtaaagggcaagagactctgtcaattcatccaatgagtaagcaggacagttaagttagaaatcctttaagtccctcttgaatttaagtaaactccgaaggactcccagactagctccgcagtacgagccccatacggagccgcgcccttgtgatatgataagaagaaaaggggccaggccgccctcttttcttttccgcaccaagccttctcttcttgtaaaatcgggtgtannnnnnnnnnnnnnnnnnnnnnnnnnnnnnnnnnnnnnnnnnnnnnnnnnnnnnnnnacgtgacatcctagttagcaaggagggaataaaaaaaatttgtggaagcccacatgacatacttactcctccctctactctatccaacgtttgcctagaccatggtctggaccgtctagaccccgtctagacgcaagaccgtacataggtttttgtcttgtttagggcctaaacactattttcttgtctagatggtcaaagactgtctagtccaagtaattagaccatgctgagccaagtctagaccgaaacaatgatacctagaccatggatggacccaaaacatttggtgggtaggagttcaaattttctggcctaccaaggccaagatgatttaaatttgaagctaattgaagattcattattgcaaaacaaggtaaaccttaaatctcatcttttcttgctctcaaatgttctattgaacttttgacttgttgagtgaatttacatatatagcaacaaaatatgctggtagcataatatatggtatacactctagattgagagttaccgtccatctagcatctagcgtctaggtgaacactgactctatctcctctctctctctctccccccctctccagtagcgcaggcgggcggtgtcgggcaaagcgacagcgcacgaaacaggccaatggggcggagttgataataataataataataataataataataataataataataataataataataataaacacaaaccacaccacgtgccaataacataaaaatccaccgcaaaaaagaagcaaacacagtaacgtaacatcgtattctgactacactttgtcaatgcactatcaagtgtatcttaagatggatccgttaaaaccacataccttttgtcattgcactatcaagtacatcttaaggtggatccgttacgtagggcactcactgtactcttttttttgaagaaacactcactgcactctagcatcaaatcaaattaaagttccaaactatgatacagttccatgcatgcataccatgccaaatcaaactggacactttgcgcattcttcttcacatgcacatgaacacaacacagctatacgctatttggctgatagctggtctctcactctgaagaatatcagaacactaccacgaattgttcatgtcctggctagctttttgccgatggcttggcgatcgccatcaggcttatcatatcatgctatgatacgtagcttcaattttcgcccacctttccgacggtttgacgcggcccgtgtggatcgatcgccagcagatctcgccggccgatcgggcgccgtcgtcacgcctgaaaaaaaggcgacgagaagatggcagagaacgcatcgatctctgacgactaaatcccgaatattttcaagctcaaaagcgacctgtgtgatcctgaattcttcctgcgttgctcgcacggtagaattatattgtgccgtgcagcgacagagaaaacttgaaagaaaaatgatcgcaggcgttacatcagtgcgtgtcacgtcgggtttggtgcgatgctgtttggtacagtggcgaatctacgaaatttttatgagtcgagcctaacaataaattatatagtatacccaatttggtataggtcaatagattattttgggttgagttgagcatttactttgttggtttgtttaattaagtatgtacactataccattgcttctgctagtgactaaataattaggatgattaacaatagcaaagtaattagaattaatttactgaggcatggctctgcttctgccgctggtttggtagggtcgatgatcaaacagatcaaccgtatcgaaaacgttgagacgttgctacatacacacgatgaaaatccgaggcccacgatccatgagaaagtgacactgcgagaaaatcaataatttaattaagccatgttgctgaatttctcttaattttctcaggatttttcagcgccatctgaaattagatgcaattgatgatgaggacaagcgcacttgagctgtaaaactgacttttgattcaaatccgtacgcgttaaatccacgtcgtcggagaatggcgagaacgacaaaacacaacgcaccgaggacgccgacgccgtcgccgtcgccgccgccgccgccgccgccttttactgtcgataatatcgtctcgtcggcgtggaggtggagccggggccgcgcgctggccggtgcaggtgacgaccaagcctgccgtccattttgtgctcatgcctcacctcacgcagcccagctaatatgggtctgtttggttgcctgtaccaggcttggctcgtaccagaccatgcagatttggtatgtttggtttcctgcactggcccgtgatacaggatgaggcgatgcaaagagccgaagattgcctccgagccgggccgagcagaaacgcaggaatcgagcttcccaacttagcctggcttgacggatgcagtggcgctgcacccacgcaatagtgcatattgcacccgcgtgtgcaagggggagggggctagtcacctccccctcctcattttgcccgcgtaaagccacatggattgtataacggcaaataaccctgaatattaatgtgttataaagtaaaacaaaatcatcctattgatcattttaattttgatctaacaaagttatgagttgtttcatagtcaggtttttttaactgttatataatatattttattattttgatgcgatactaagctcatgattaatggtgtggcttagagttcctataccttccgtgggaaggttagtaccacctcacattagggcgataattgtaatgtgtgaattttatctctgtaatttgaaatcaagatttccaaatcttacggtaagatcgtggttaccaccgttaggtcgtgataactgtgctgtgaccatgatctttgacttgaaaaaagagagagaagaaaaccactatcatacattgtgaacaatagaaataccatatatgatatccacaactataataattaattatagtgtccacaagcatcaaacctttattacgaagcaaactctccttttagtcgtgccaaaatatggagttagctttgcattttttcacaaaatcaaatttatcactagatatcattattacaaatgctgtactacttctaggaaatttttaatttttccccctttttctccaaaatctaaattcatacaaattctaccaaac

SEQ ID NO: 72152 - DNA, 1199 bp, Oryza sativa
tgtcttgctaattgcatattagtaacagggaaaacaaattctgataaataccttcaccggcagcaataaaagaaagagcatgccctggagataaaacaacttcttcttttatgccttctacatatgttccctagagcaaaaaggaagcaattcgtaagctcacaaataaaagagccacagaagtagatatcccgtagaaaaagctatatgtgcatataacttagctagaacactatgtgaacaaggaaaagcctagcaaagttagatatgaaaatattatgacacgcacaatgaatataaattacaaaatgattaaaaacttttcatgttcatcaatgtctgaaccaaatggcactccacaaaaaacaggccacattttgactttaacgaattcattacaaaatgagaatcgcacaaactgtttccacgcatcaaaataggagtgaatttatatttcagtacacactacacaacaatcaaatcctctgttctgatatcatagagatctaaatattccgttagaagtttagaacttttaaaagaaccattgtgccatgataaaacaaacaaggtctgaaggaaggtagtttgtctgctacagcattatctatatcaacagaagagaagtttacttgcctaaaaaggacaattagatgtaacagttgaaagcaaaagaagggatctcaaggggggtatgcaaacaaataaattagagcaccgatattatatagaagtacatgccaacatgataaccaatgctgtagaggattaacctgtgcatcttccctcacacgcagattttggccagtaggatcaagtagatcatttatcacctgcaatgagagagaaattaaatccattgagatgaatgtacataactacatatagaatacaactaaatctaacaaacctcaaaatttgacaagacctcttaaataaatgtggcactgcccatagtcataggtatcacttggacagtatttacactataggattggaaatatgaaggctaggcagtaactaactgcaaagctggaaacagaagaatatagccagcagaaatggttgtggattacaagggcaatggtgcagccagtaaattctatatgtatatatgagaacaattttatgcacaatctgggtaggtcatcaaccaatcctttggtgaaggcatgaagggcaagttcaaaaataactga

SEQ ID NO: 72153 - DNA, 2519 bp, Oryza sativa
attcctgcagccttaatatgtgaatgtcagtactgcaagtctgaaacatctcagaagttaaaacactaaatgaaatgatatggacaacagcaacaaacattgtacaaggaaaggtaatttgttcaatatgatatggtagagaacagtttggaatgaagtgtgtgccatcatggtgataatatattacaatatgaccatagagtaactctcgaacaataattgtcctccatcagatataaataaatggaaaactcatgaaacaatgtgtcggacaatctaaataaggataggtgacataccatttataccctccatggcacctttaacaacaggccgggcagcaacatcatatacagcctcagtagttgttttaggaccaaaaactctatctgaaaagaaacagcagtaaaaaaatgattggttattaagtagaaaccagatgataccatagagaacagcatcacaaaatgtgatattgttcttaatatgaacattgaaggtttgcattgatttcagtcaagttgattgaccatgaccagaaacataattacagtcgccagaaagcacagaacaaatgcttaataactggttgagggagtaggccatgaaacttcttgaatgaaaacattgatgtcaatttcattaatcttatagcataccaaataattgcaatcgggaactagcagtcttctgaaagacgaccacagtacaagcagcatgaaaaggcaacaaggcaatgaaacctcacgggcagtgttttagattttagctggctatcaacttcacagtaaaagctgactcttaaaatgtcgcgaaaatgcaaaacgaagaactgcattttcaattttcaattaatcatcaagccttgtcccagcgctgatgcatttatgcctatccaaaatcctaagcctctccttagtgatttcagcattgtgcgacttatcccataaatctgcggctgtgaacatccgacattggctgaacccatgaattcaatcccaagccccaaaattacagaaagctcaaatgtactattcaaatcaccacattgccaaattaaccgcacaagcaactgaagcatagtacttaccgtaaccataagccgtcgccgggttgtactcgcagcgcacaagccgttccccatcagcataccacgagatctcgtcgccgcgctggatctcccgctcgctgcagccacgcccaaatccagctcaaatcagtcgaaatactcacaaccacgccccgcaaacagatccgcgcagctcacactcccagatccccctcacctgagcggccggaagcggatggtgacggatatgctgtccccggatcgggaggtgtcctcgatgacgagctcctccgcgctggggaacggcacgggcgacggcggcgacggaaccggccccaccaaggaggaggaggagctccccctccgccccggggtggtggacctcgagcctcccccgctcccacccccgccgccgaagaaatgggaggatgaggacacggacgacgccgtggagtacgaccgcggcatgaggcggcccgtgaggtacgagccggcggaggacgacgacgaggtcggaggccgcctgctccccgccgagaacggcgagctgctccgcctcgacgacgccgacgacgacggcctcgacgacatcccgcacggaaaccgaagcttccctccccccacctcccccccgcaaggcgacgctgcgcggcgcgacgcggcgcggcgggggagctcgacggcgagagcgcgcggaggcggaggcgagacgcggcggaagaggggaaggtatcggaaggtcagaggcttcacatggccttgctccaaaagaggcgagaggccacggcgttgcgagtttttaaagcgagacgccaacgcgacgcagagggaggtaggaggcgactgtactacacgtgtcagcctccgcggcgctgacgcgcggggcccacggtgcacgggcccacctaccagtgacggcggtggggctcggtaatttgaaatgcgtggacaggttgcgggtggtgggcgggaataactgcgaggaggggtgtttatttattttcggggaggggtaaaaagtgaaaagcggagaagcgtagggggcgaggtgaaaaaaataccccaaaaaagggcaggtggtgtgccggtgcggtggcgcaccagcttttgattggtttattgcacttttcccaacccgttggtttgttgtttgttgttgttttcgatgtgatttgaaattagaatttgaaatttttcgtgataatgaccggcgctcggatgtggtctggtctctgttttcaaatgggaggatgagaagttgacaggggacgctcttaacaagatggaaagtacagtttaaatcaagcgtttgtctgtttcttataacttgtacttcctccgtcgcatttcaagcataaccataatttttcgtatttaactttgattgtccgtctaattttaatttttttttataattagtatttatgttgttattagatgacaaaacata

SEQ ID NO: 72154 - DNA, 11780 bp, Oryza sativa
atcaaatatttggacacatgcatagtgcattagatgtggagaaaaaaaaccaatggcacagtttacatgtaaatcgcgagatgaatcttttaaacctaattacgccatgatttgataatgtgctgctgcattaaatatttgctaatgatggattaattgggcttaatagatttgtctcgcagtttacaggcggaatctataatttgttttgttattagtctatgtttaataattcaaatgtatatccgtatacttaaaaaataaatttggcacacgaactaaacacaacctcggtttatataagcagttgagccaccaccttataacttagtagttgtctgtggaacatatcaaatactcccttcgtccaaaaaaaaataatcaagggtttgaacttggacacacactgtaaatcagatcaaacaacacacaaaaattacatgtctctatcacaatgttccatagcaacacacatttccaccacaaattcacagaaaattatctatttaataaaattggcagcttaccggttcgttaaaaaaaacaaattcacggaaaaaggtgaagaagatgggtcaaagaccaacaataaaagagctcgcctgcattagctcacaatcgtcaagctcatcattggtcccgtcctctcccacctcgatcaacttctatcttggcgacttagcatggtgcggtggtggtagggcaagcaactcccaagattcgtcgctcctgagtttgcggaagtcgtcactacttgtcgagcctcaccgatggcagatccttggggatctgggcctcgacaaagtggctgacgcggcccttggccgtgacggggacggtaacaacatccttgatgccccaaaacactagcgggcagaaaccaatacatatacccatgtcccgcgtgtatgggtaacccagtgggctaagtaacatatgaataatatctatatggacaaataattaaaagtctttaacactgctagcaaagttcacaacaattgttaataatagcaggttttagagatctacgggatcttccattgtcatcacaagtagagttcttttatagccgttagtaccaccccaaaaaaaaaagaaacatacatatgggaaatatctttttttttttaagaaatacgttccgagacattttgatgtttttaaggaaacatttgacagcatccatcaaacggttacacttcacgtgcatagtctttaaaaaaaaagggaaactagtacacaaaacagaggtcacagtaaaccgtacagtaaaccatatcgcatttgtgatccgtcctgaaagacgggacagcaccaaatgccgggcggccggtgcagatcggaatccccaagttaggaggatggtgacgatgtcaaggcacaacgcgatgacagcaacgagtggacgaagagggatcaggcccagctggggcagctggtgagtcgatcgatccgcccctttctactgttcggggcgcgcgctgcacgagagccacaatacacgagatggaggaggaggaggagcacgtggtctcggccacctgatcacgctcgcgtccacggatcgttcggtggcgaaggcgatggaacggtagtagatgtagaactagcctggaccgtgcgtgtatactgcccgcttttggtctttgcgtgcagcgcccaacaatcgcgctgttgcgactcgcgaatgaggaatatatacgtcgctcccaaactggttctcgtggtgaaaacgttttctgaacgttcacggaactggatgagacctttttttttaattgctaaatcacatctgacatacattttgagccaaaaaatttacagactttcaacttcaagatctgtttcactattagtgctctgatgagcctacgtcctctcctccagcgctgatgacccttttcctttagctttgatgaccatggcgatcggtagcggagtgggagggtgcggagaggagggttggccagttggtcatgggaggcgttagaacgggcgggcggcgccaccttcgaagctgtggggttggtaaccggcggtgagctaatgatgtaacggtaacagtagggattgcaattgactagttataatataaggacggtggctgtgtttctccaacaatatgggaagatggtggggtgggacactcgccgcctttagcttggggaggaggaggagggaagaggttgattgagtgggcctcattggtgatgtcttttgatgcgggcaaggccaggcagtggaggaggcaaccaagcgaccttgcgctcgctcacatgcatatgggagaagtggagtaaaatgataggttgcttcgtgcacggttcaaaaattttgagagtggggttttcttattacatatataggtggtatttttctcttttaaggcttccaacctcgtttacagcagagttttagatgagatcctgatcgaagcacacgtttacagcctatggctggtgaattatgaaggagtgaaatgtacccaccatctagggagtgaaatctctcacccatgtactttgcttctaaatatttatacgaataaacgggccttaaaaaagaacttctgcttgtaatacaacgtttccatagctaaagtggccgtgaaacattttgtgcatgaacaatctaattttccagaaacgcataaaaagtttaggtttgtagatctgaagagcaaaactgaaaacttattatttattcgagtgggaaaagtccattttacaccctcgaactcttatgcttgtttaaaatacacccccgaactacaaaaccgggtataatacactcttgaattgtcaatatcggacacttaaccccccgggctgtttttaccgtggtttttgccacgtcagccctcgccacgtcaggacacaaggtaatatgggccaagcccatactctgttcgttcttctctccctccctgttcgttcttctcttcctcacgaccactggcggcagcggcacggatctgcgaggccggcgatggctgcggcggcggtgcggagctgttgcgagggcggcggtgctgcgaaggttgaatatgaaaacattttatgtttttgtaaatggaacctgatagattgaaaaaaaaaagagagtagaagaatgcatcactttaagcatttgatgtatttcctttgttcctcgaaatttgcagagaggaatcggccactaaactatcctgcttagccacaagaagatcggccctcttatggcacagcacacacatgcaaacaaccatcatcaatcgtctcaaacacaatcaatcttacaaagcacgataaaaaattcctgtccttccacagatcaacagcgggcaccgcctttcctctcagatcgaacacctccaccccctgcaccccctgcagagatttcgcgagctcttccaccggcgccgcagctgcctccccggtcgtccctacaaatatcatcgcacatatcaacggttcagcaccatgcacgcgaggggaaggaggagcggggcctggaggcttaccgacggcctcgggctttgcggctgctactggcgcaatagagaagcaaaggcggcgcgggtggaggagggacccgcactggcccctcgcgcggaggagactcaacaccgtagccggtcgcgagctggtagtggccacgtgtggaacggggagccgccgccgcagctccgtcctcacagccgtcaccgccctcgcagcagctccgcgctgctgccgctagcggacgtgaggaagaggaacgaacaggggagggagagaagaatgaacagagtatgggcttggcccatattaccttgtgtgttgacatggtgagggctgacgtggcaaaaaccacggtaaaaacagcccggggggggggttaagtgtccggtattgacagttcgagggtgtattatacccggttttgtagttcggaggtgtattttagacacgcataagagttcaagggtgtaaaatagacttttccctattcgagtagatgttgaatggaatttcattagcgacgagtaaagcatttcatcagttccattggatttgtcaccatccatttgtcagcaaggacggcccactacaacgcaaaaccagtgctggaaagcccagaatacacaggcagagatgccgggtagccattacgacccatttaaatggatttggactcctaatttgggaggtcgttgagtactttgaattagactccgagcccctgtattttcacgaattaaatttgaaaatatattcttcgttcttttttctctctgaaatattcttgatgcggtttttttgtcacaaatatatcttcgatatcgctgaaagtgatggtggagtgacgacgtgggtggtctcgcacggtgaggacacgagaccacgtggtgttggtcttgcgcggagagggtgcgaaaccgagcagtctcgcattatcagcctgcgagagtgttggaaatgaaatgattagtgattaattaatcattgattagcgtccaagaacagcatgctggctggtctcgcttgttggtcatgcaagactgacaccgagcagtctcgcgcgggaccgcaataccaactgtatatttgtgtcgataaaactacatcaatatttttgagaaaagaaaaaacacaatatactttcaaaattaattcgtattttcacttgcttggttgattaaccttggaaacaccgtattgaaatcaaagccaaacacaactttatgtggttttaaataaactagaagattcataaattcatattactaatacagcccatctaaattggacttggattcgttaatgttgtttgggccttttctcaaaaaaaaaaaacatatacgaaaaagtttagaaattcagattactaatacgacccatccaaattggattactaatttgttggtgttgttgagcaggagagtttgtggggtttggagaattggactccgacccccatattttcacatgtttggctgtttcactatgaaaacactgcattgaaattcgaaaccaacacaaatttatgtggttgtacatatatgaaaaagttcagaaatttagattactaatacgacccatctaaattggattactaatttgtcgatgttgttgggcaggggagtcagggggccgacccccatattatcacctgttttagctatttcacttaccgaaacgtaatggaaaaatgtgaacaaaaccacttgggtatggtaaataaagcgccgtactgaaattccaatccaagcatgacatctagaggaataattaaaaaaagagagaggagaaatcccgaaaattcagattactaagatcgttttgagtggtatatactggcacaaatcttgcatggatttacagcagaggggacatattttcatcacacatagtctaagcacaattttgctcagtatacattgcagagatcccatcatcattttgttaacgtctcactgacagttggctacgcagtttttgggacaatttttctcaattatcaatgtcggaacagggaaaattacacaatttgtcaaataggaaattaaataaaaccttacaccattcgcacagcaagatgcccatcaccccggtgcatcggcgtgcatttttattctgagttctgacacatcacacacaactcgaactattatactctgccgttctggacgaagcaaaacggggtttattacacgcccccaaggtctcatttgaaaaggcctcaaacccggcccatctacgtgaatggaccgaaaattttcaaccaaaatcacggcccatattcacgcggatttctcttggtgttcggcccatgtggaacaaggcccaaggatgacacgactgatttttttttaattggaagccatataatttgttcaggttaactacgtcgtgtataataatttgtttttatggatatggatttggatatgatttggatcagcggcggaagctgcgctgggggcgcggggtctcgccgttctcgtcgcggagcttcaccgccgtgtacacgccggcgccggcgaccgcgcccagcgtcggcgcgatcaggtatatccacagctgccggtagttgcccgccgccaccgccggccccagcgtcctcaccgggttcatcgaccctcctgtcgtcggcctgcaccgcacccacgccgccggttagccggagatcaaatccatccattttttttttgtttgttggaaccatgacaccctaattttgtaaaatttaaaatatgccacccgtatctcaatgacacgtaggaaccacataagttaatgtcatgtgggtcagggtgtcatatcacaaattttacaaaatttataaaatttgtgtggcatggttcaaattttcttttttttttggaaatccatccatttttagtgctcattgtttcatattataggtcgttttatttttttttcaaaatttccttttccaaatttatagaaaatagtttttaataaaactaacttttaatatgtttatttatgttagaaatgttactatattcttatataaatttaataaacttgcaatataacacagaggcagtaacgtgctacgagcagggttcaaaaattctgaaatgaaatttccaaaattttggttattttggatcccctatgtgattatttcggccaattttttttattttggtaataatttgcttaatttgactaaaatttgatccaaatttcggtatatcgacacgttccgatagaaacattcaaactgaaagattaaaacctggctacaaggaggaggaagaggattatacgtacccggcgatgaggatgttgagggtgacggcggcgccgacggcgatgccggcgagctcgccgacggcgcgggtgtcggtggcgacggcggtgacgacgaagaggaggttgaaggtgatgatgaactcggtgaagaaggcctgggcggtggagatggtggggtcggggacggtgacgccgccggagaggaaggggtggaagacgcccttgagggcgaagccggcgcagatggagccgagcacctggacggcgacgtacgccgggacctgcagccacgggaagtggcggagcgcggcgaaggcgatggtgagcgacgggttgaggtgggcgccggagatgtgccccgtcgacaggatgatggtcgtcacggcgagccccgcgcacgccgcgttcccgaacggcgagatcgcgccgccgtacttctggttcacgatcggcgccgccgtcgcgaagaagatgaggatgaacgtccccacgaactccgctccaagctgcaccgcagtttaattatttgttcagcgttaatctcccagcttaattaacacactcatacagattactataatttacgagttcatgaattcataacggagctctcttttaaaaaaaaagtgaattcataatagagttaaaaacttgtttagatctaaaaaaattttggccaaaaacatcacatcaaatatttagacacatacatggagcattaaatatgggaaaaaaaccaattgcatagtttgtatgtattatgagacgaatcttttaaacttaattacgccatgatttgactatgtgatgctacagtaaacatttgctaataatgaattaattaggcttaataaattcgtctcgcagtttacaagcggaatatgtaattaatctaagtttaatacttcaaatgtgtgtccgtatacttcaaaaattttacacctaaaaactaaacacaccataactgtaactgtatatgaatcgtgtaaatttgcaatcaatttaagacactctctctttgatgattaatttactgtttgattgatcaatcaagcaaattgagctggacatttcagtttcagaagtactttcaaaagtccatccaaaagtctatggatactttcaagtgcgtctgattgattatgtggcaatgctaaactgcaaaaaggtgtaatcagacacaaaagtttgtgattgcgtacttctgaatttagcgagattttggtcgtgacaaaaagaacagtaggaatgtgggatcatcaggcactaatcaaaagctgaaacgacatatatgtttataaagttttgtttctgtgcatgataacaaaattacccgcttttagtccaaaagaatcacacagcaatgtcccgttgaaattttacactaaaaccatgcgcttttcgcaaataatcatgaaccaataattctgcggcgattatgtcaaatcatgaactgattaccctcccagaaaaagaaacgaaaaccagggacagattagacatgacaggcacatagcaaagcaaccactctctcctcacggatggatggctcgaagcgatcgttgagtcaactctgaattttggacacggccctctcatgtcacatccaaaaaaaaccttatcaccaaaaatcattgtactttctcgctcgcacgtttttttattttaaaaaatgcatttttgtcatcgacttcaacagtgccattgataggagtagtatttaattttctttttccaaatggtaagtactccaaatggagtacaacatgaccaaatttttaatcgaatcatcagttctggatttctgaaattgcgatgggttatgggacacacagggatggcgtgaacagtaaacgcggacttgacagacaaaccgccggattacgcgcgccgccgccgactgacgccgagcaaggccaagaaaattcagcatctttgcaggttttatactcacaaaattaatcaaacatgatgtaggctagctaggacctaatcgccttaggtagtactgtactgtttgatcccatcagtgatcattgacaatataaaattcagcttccaaagatgagcattgcgtgttttctttgtagacggcaagataaatagtattagttaaatggagtacatggaccttcgattaaggacatccacaatgtactacaaaaagtagtctataggaaataaactattccattcagccatctagtaacataaataatattatctatctctacttctctgtcttctcctaatattacattgtatctatatacattgtgaggattgctatagttaaagtttattatatgggtcccatctatatagaccacttttgccatatacattggtgatgtcctaagggattgttttgaagataagagttccacggtaatttggtatgtatttcattgtaatttggtttaacttcgttataacatcattattggttttcttcacttatgcttatacttataagctaaaatttaaattctaaaacttaattttgaaattcgtaattcattttacaacactagcttttaaatactaagaacatgttaaaatttttactcccaaatttttatttgtttgctaataaaaactacgaatatgcataagcaaaagccaattgatgactccgtaagtttgatgacggcaatatcttcacacaccacacatgagtttgatttcaacgttcgaactgaattttgaaacttttaaaggtttgtttgaaacacactgaatacaatgcggttgcttgaatcgtcagaatattttaaaatttctcacggaggaccattgccagagtggacctgtgtaaaattttgagtctgcaggttcggatccaacaaagctctgctgacggcacccctgattccagtgtgttagcactgtgtaagtacagatctaaccactgtcacttccttaattaatcacctactgaaaccgcgtcagtgtgatgttgctcttttgtctccatacgtcactgttaacacatttcatttcaaaaagtacatgtaccccatgtaacatccaaactttataccaccgttatataactttttttagcaattttacggtccttaaagaggtaccatgagttattattttttctattgtaaatttggtacctcttggtaactaggtactatgaggtaccatgagttattaaattttacactaaaattttggtacctcaaggaccgtagaattgctctttttaaaaaatgattttgcatgatatatggttttctgaatgagcactttggccaaatagaagagcatgttggtactctatatatcaaccctccatttttatttttgatttctttctaagaagagaaatataaggggagaaactgttcaatatttagggggaatatacggaatttttttcctcttagagactaattaatcgtcacttatttagaaatggcacctagtaatttaaaactaaccaaaaggacattggatcatacccaacttggccgtataatataccgtgtatattacggaaaaaaatactagtactattcagcaactagcaataggacgatcgatcagttcctctgacttttttatttctgaagcttcgtgacaaacaaaaatcatgtgtttcattgtctgttgtgtatactctctttgtctcgtaaaaaaaaaatccagatttattgcactgaaaaaaaaaattcctgctaggaataggacgatcgatcagttcctctgactttttatttttatttttctgaagcagatggatgccagagagtatttttgtaccggatgcatgtttgtacatcagtacatgtctctgacattataccgtgctggttgtgtacgtacgactacgtctacgacatctcgcgcacaatttcagaagcagagtaaaagtacaccaaaaagtaccagcacgttcaactccatagtacaaaaacaccccaaaaaaccattttaaaaacatacaaaaaaaggttaaaagatgaagggttagtcatgttatatccagcttattaatttacccaattattgatagattatttgctcgacgctcaaaaaatacgatttttttagtcatgttgaaaaactttttttcattatattgcttatatctcttgtttggagctatttattaaatttattttcaaaaatattttattcatacctacaaatcaaaccaatagtcctcagcaataatccactgaataatcaaatcacatagctgagtgggagaagagagctagctaagagtgtccaaacattttctttaaaaaaggtaaaaaaaaatggatggaactcaaataattgcatgtatatcccctccataaaaagaaaaaaaaatcaatcctacctgtaaacctgatactagttttttctttttattttacagagtacttcttgcttaaagttgatttattttaaaacgaaccgaagcaacagaagaaagaaaggtgcctaaatttattttgagacgaagaccgagtttagctccaaaatttttctttaaacttctaactttttcatcatatcaaaacatttctacacatataaactttcaatgtttccatcacattattttgacgtgaactaagaacacccaaagtgagaggagggaattgaaagaagcggtgggtgtccacgtgggggcgtcatgtgcatgggggcgcgtaccttgcgggtgagcgagacgtccggcgccgggatctccacgacgcagccgtgcgccgacggcgcccacgcctccgccaccgccgccggcaggcacttgcaccgcggcatcgacttgcgctcgtacgacagcgagtccacccgcggccccgcgaacagcggcgccggcgtccccggcgtcgccggcgccgacgccccgttcaccggcgacgacatccccgccgcgccgcccccgttcggcgccgccatctccattaatatatcaactctttcttgctctcctcttcttgcaacttctttttttttttgttcttgtttttttctcttttcaggcgaatgatgaggtagaaataggatgggttttta

SEQ ID NO: 72155 - DNA, 6466 bp, Oryza sativa
tcctaaatagcaagattcagaagggctatttaatagccctccggatccaaacagggccattgtgcggtgtcacttcgtgttcctagctactccaccttaccacactacattgtaggttttgttggggaccaagaaaacacgtactccctccgtccaaaaaaaaagacaaaccctggtttctgtgtccaacgtttgaccgtccgacttatttaaaaaaattatgaaaaaaattaaaaagataagtcacgcataaaatattaattatgttttatcatctaacaataatgaaaatacgaattataaaaaaatttcatataagacagaccgtcaaagttgtacacgaaaactcagggtttgtttttttttttttgacggagggagtacacaaaatattccgtagctctatcagagttgagctgatcgacagaaaccacacacggaactcgatcgactccaagaaacgtctccattcattcggtagctttagatttaggtcccccaatcttaatcgttgttaatactccgtgttacgtaaggaatcggagtatataacatggcttaattggaccatcaatcggttcttgcaaaacactaagtacttgaaaaggatgaaaacgcatggacgggatgatttgtcgagcgccacacataggtgatcttaactgttgatttgcgatttctactatcagtaaatatatatatatatatatatatatatatatatatatatatatatatatattactagttattatgatggtagtataaatagatataattcattaaattagaaaatataaatgatctagattatgtctgctactgaagaaaatattgtagaacaccttttaatttgtcgggttttttctgaacgaattaatttgacagttgagtcttaaacaaaagaaaaagggaaaaaaaactcaagtagtaggtgaaatttaggaggttaacctcacaatttttgaatatgaattgattgagctacggatgataaaccgtagaatatgaatggaatagcttaaaaataatttatgagtaaaaggtttacatttttattattcgcgatttaaaatacaacgattgaaaatcaatgaaagaacctcaaattcaacctttaaaattaaatttgaaaaaaaaataaaatttggttacaacagtaatccaacaaacaaggagataatgaagcttgccccctgactctggcctgtctcaaactctaaacatccaagtcaagcctggtttagttccaaacttacaactttttcatcacattaaaatttttctacacatataaacttccaatttttccatcacatcgtttcaattttaaccaaacatctaattttagtgtgagctaaacacacccaagttgcatgagtctcctctacaatggccgagtttagttccaaattttttcttcaaacttttaacttttccatcacatcaaaacttttctacacacaaacttctaactttttcagtcacatcgttccaatttcaattaaacttttaattttggcatgaactaaagttgggaactaaaccacaagcgtcagtgaggatctttttccagccaagccatggccatatcaaccccgcatgcaggcagccatgcatgccatgcacgcatcggcatcactgtccaaacggcagctgcactctgcaaaccgttcctctcgagctcgaagaagtttggagtttctcccctggaaggtactccctccgttttataatagatgatgtttttaactttttattcgtaacgtttgaccattcgttttatttaaaaaattagtgtaaatataaaaaaagataagtcatatgtaaagtacttttgataataaaacaaatgataaataaaataaataataatttcaaaactttttgaataagacgaatgatcaagcattgacaaaaaaaaactcaaaaagacaagtaatataggacggagttagttgcagcatctcgctctcactctcgtagtagtcagtctcgtcacgaggcacgagctagtatacctggaatcccaaaatccagcgccccaatctcccctccctgaactgtcatgtcacctcaattctagcggaatctccccgtgctgtagcatggcaacgcccgctgctatattgctatccgaagatctggcgatttttggccggcaattcgacaagttttttagatcgctggccaatatagtgcaaggatcttggcgaggccattggcactgggcagggggggcccgtggatgcatgtggcgttttccatcggttttaggtcggtttggtactttggttgtgtgtttgtttgatttgtcttatagtttggtttggtactttgatttgatagttgcacgaccctattgattcacttatgtttatacatgtaagaaaaaatttaaattttaaagcttaattttaaagttgattttgtagtatcattaatcatggtttattttatagcatttattttttatcgctaagaataagtatataaaagttttgagtaaatttcacaaaactacatatatattgaccaaaatatcacaaaactacagatttaaaatgatgcatcacaaaactacatatttaacacaaaatttatcacaatactataaatttaaggtggaatatcgtaaaactacagatttaattacaaagttatcacaaaactacaggtttagcatcaatttaattgcaaaacatggttttttaaactcaatcataacattagtgctaaggatttaaacttgtcagggttacgggtaaggtataccctctacccttcgatatacgtcacacatcgataaggtatacatacgcgtatacggacgttttcggcatacgttaaggaaattcatcatggagttcacagatggaaggagtcctactcggacaaaaccgggtcatcattgtatcgtgccgggtctgatgtctccgagtcctacttggagaccagttgacctgcgatataaaagggacccccgggaggacctaaggcatcgaatctcatagccaggacaaccaccatagcctatgaagccggggcctataggattcaagtcgccgggtgatctagtcgaatcaactcgactacgatctcgtcggtatcatcgagttccgcttttccctttgtaatctgtggtttccatcatataatcccataacaactggattatggctattacctatcaaggggcctgaaccagtataatctttgttttctgcctgcttgatgtcgtattacgtagatcctcgtaccagcgtaccccaataccctctatatccggtctacgggtatcccccgtccatcaaactccaaaacatatagttttctgataattttattattaaacctgtagttttgtgatacatagtcttaaacctgtagatttgtgataattttattgttaaatttgtagttttatgatacatcaccttaaatctatagttttatgataatttgatcaaaatacctgtagttttgtgaaatttactcaaaagttttttttggctaataagctgtacaaatatgataagcgaaacaatggggccatggtttgtgtagataaaattgagttacaacaagtaacccggaaatgaattgaacaacccaaatcaatattttataggtaaaacttctattttttttactagcggtttaaaagataatataaaaatagactatatggaataattttaaaatcaacttaaaattaagcatcaaactttaaatgttagctacacggctgataagataaaaagctaatgataagaggccttcctgggtttaggataaaggctggcgtagacacagacagtaagcacatgttgtttattcggagaagaaggattctgatctgctcgtgggattgaatcctgatcagggttattttgatctctgacagaagcttttgtgattgcgagttgtatattctgtgcgagttttatattggtcacgaatatatccagcatctgggatcatttcttaattggaattatcttttcttagctaaagagtgttttagacaaagtgagatgcatcatgctgcagtagtagtaagctaggtcaaacaaacaagtattggttggtcaaccaagtacacagaagcaaatttcttccttgcgtttcatcttcccaagagcaccaaattctcaattttgcacagcaattctactctaccattgtttgaaattttcttccatgttatgaaaaagaaatgatcacggcgattgggtcaatagctcaatcagcccagaaagaaaataagaagaagaagaagaaaatttccgttgttctctgacattattcaagccaagatatccgaaatggtcagtttaatcaatctttttttttactatccagtgatgaaagcatagaaaggtggtaataacatactccctccgtcccaaaaaaaagacaaaccctgatttccgtgtccaacgtttggccgtccgtcttatttgaaaaaaaattaaaagacaagtcacgcataaagtattaatcatgttttatcatataacaataataaaaatataaattataaaaaaaattcatataagacggacagtcaaagttggacacggaaacccagagtctgttttttttttctttgacggagggagtaaacttgcaagtgacgctagaacaaggaccaccacctgacctgtctgcaagaaaaacagagcacttggagcaagcaagcatcaattgtacacagtccatttcaagaataaattaatcaaatattgcaaaaataagaatggatgcagccattaaattttggtattagataataataatggaagacaatgcatggatagatagagagatatacacgacatgaatccatatgtatccaaaataaaaagaaatcacccataaattagtgctcatttattggacaacatatcctatgcacacaggtcctcacgtgtacacacgtgcacaccaactaaaaaatgttaccaaaaaatctagaaaaaatcatacacatactttcaattgtattacacctagggttaaatcttaacgtcaaattcattatattttagccgtaacaaaaaaacaaaaaatctgacagtgcaattttgtcagaattttatcttttttgttattctctatgtagaatgaatttgaagatgcgactttgcacgtagatgtaatactattgaaagtacatgtatgaatttttctaaaattttttgtgataatttttagttggtgtacactgtgtgtacatgcgaagacttgtgtgcataggatacgctcccccatttattgatgcatatcttggagatatgcaagattggaagggcgtatatttagagcactacatttaagagtgccttcaaatactagaatacatttaaacgtagtcgtatctgtttgtatttttgtgttgaatacatgagagaaaaaaaaatcccgtatttcgaggggggaaaattgggtcacatggctttccgcgtgggggatgctactgttacttcagtgagggaagggaggggacacggacctagagcgcctatacgcgtagggtaatgacaggtggggcccacggagggtggggcccacatggcagtgtcaggtgtgccactgaccacatcctccctacgccatggatgatggattgcactatgatatgatgatcactcgcataaatccagttgaatcgcaccaccaaagagagcaagatgatcaatttgatcgacggatgtatcatttgatttttcacgcggttgaaatttcacctcctctatcaaaaatgatatggtttaatgatggctcgtgaattgttttacaatgtttcagtggtagttagtcttctttttctagataaaaatgaacgacgtaacggtttaaacggtaatgacgatggtgtacgctcgttatcttctagggcatcgcttgtataacggaatttgtcgtttgacgtgcatgagttagatacacaactagtataacggaaagttggattattcgtgctcgtaaaacctaaaaaggtagaatatgagtaacggtatcaacgatcatattgatattgaaaattatataaatgagacatatacacctttgttgggaatcaaaagaaatcctactcacattaaaaaaaccacgtgctttttaaattatagccgtctcccttacaagagttgcaatgcaaattacttgaaccgtttaatgcttagcatcccattctcatcaaaagtaaagacacaaaactccaattcctcgcaccccgttcaacacatatccaatggtctcacgtccatgatttcaaataacaaatgtcaccgaccgatcactactagaagacacacgagaacatgtgtcgctagccacaacaataaagagagttagagaggggaaatccctaaaagccccccattaaactcttggaagcattcttccaaactcgtcagccgtatctctctgtgtacatctgtacaacggctaaattcaa

SEQ ID NO: 72156 - DNA, 5877 bp, Oryza sativa
tgtcattacagaggtagatagttcctctcaatcaataaagatctaagcagcggaaaaataagataaacggcgcagacgactccactccacaggcagcttgaccagggctatacctaatcctccacaccatcagcatcactgtagaactcctcctctgatgaatgattgcaaggtgagtatatgacatactcagcaagccacgcagcaaatatgcaagtgcacagggtaacaaaggatggcatagtagggtttcatttgcataaacaacatttaataaacatttcagaatttaataaaatagttaagtagtaatttaagcaatattaatccaacgctatacaacataccctgttgcataggcccaaccattctgtacaaccaatcctggctgcacagttctatctccaaaccaggaatataccattccaaaccaggagctaatcaaattattaccagttatagcatcttttattatggtgagaagtgtgagactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcggaaaggagctgtgacagtacccctcgcacaacacaatccaccacagtgcaccattcctagatcataatcacccccttataaacaaggcatggactccccagcgacccccgtgggattatctccaccacttctcagtctggtgctccgcaatgaaccatgctatacaaaaggtaaagccgttgcccacgctggcttgtggttggcacggttaatgtttcacaactgaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagcccaactagtcaagttataataacccaaggtatcaaggaataaagtaatcaagaacaaaaggggtataacaaacaataggttaattccacccaatgacattcgaaaataaatgcaatagttgaatagaaacaatagctttaaacgggatcaacatgctcaaagggttgtttgggatctgtgtgactttccttgctgcccttggaactcttcaaattcttctcctgcgaaaacgaactcttcggaaatgtcggaatctaaacagaaaagagcaaaaacaccaaaacagcacataaacaagcatgaacaatacatgtggatatttttaacatgtagatctcaattttagaaaaatttagagacttgaaccaactaaatccgagctaagatgaattagttatgaatttttaaagattaaatcagattaaaacacttatatgggttttaattgaattatggcgcaataatgaattatttttgaaaaggaaaaaggggtttattgcgtcagcggctagggtttgcggtggaccgggtgcacggcggcggctcacggaaacgaacggccgagatcgatcctaaccaaaacgaacggccgagatcgaccggtccacggccggaccacgacggacggcaacgatgacgtcagcggtgacgtcaccaccggcggcggctcgggcgcacaagctcgccggcgaacgacggcgcgacgacgcgaacggagggcaccagcacgtagagaacgacgcggcgaactcaccggtgaccaaaacggcggcggaagatcaacagacggcgacggcgtcgaggaagaagcggcggcaaacttcggcttgacgacgacggcggtgctccggcggtatacagcaatgatggaggggcggacgaggacgacaacgcgacggcgaccacgacggcggccttcccgagcaacggcgacgactggagcgatggcggcgcacggctggagcagcggcaacgacggcggcgcgaggctacacggtgctagggttctaccggcgacgagagacgaaggcgagggtggcggcaggtagcggcgggcttgggggtccttttataggggcaaggaggcggcggcgaaggcccacggcgaccggcgacggcgaaggaaggtctagggttcggggagagagacgaatccgattcgagatcgaatccacggatttccaaacgattttagccgacgattccaaaagagaaaaggtagaagagatcccgaagatcatttcccctctattgatttcaccggaaaaggaaaggggcagccgaatttggaaagagacaacggcggcgcggcgctagggttcgggcggcggccggccggaggtagacgacaggcctgacaggtgggccccacttgtcagcggcagcgagcgcgcgcggcggctcggcttgactgggccggcttgggccaaggaggagagagagagagttttgggctgactttcggcccaaagccaaaagaagactttaaaaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaactagatcttcttttctaggcttttaaaataaattctaataattccaattaaataacaatttatatatatttaggatttttagggtgtgacaaacctaccccccttaaacagaatctcgtcgtcgagattcgaaagaactggcgaacagatgcggatgagctgacttcaattcatcttctcgttccgaagttgattcttcttccgagtgattactccactaaactttgcaaaaacggataactcgatttctggttcttctctcatctatttccaagatacggattggtttctcaacataggtcagatcctcttggacttctatctattcaagattagcttcttcggtaggtacccttaaacactttttcaattgcgacacatggaacacattatggactcctgccaaagattgaggtaactccaactgataagcaacctctcctcttctactgacaatcttataaggtcccacaaaacgcggtgccaatttttctttggtgtgaaaacgatgaactcctcgaagaggcgtgacacgaaggtacacataatctccttcgtcaaaacttagatctctacgacgattgtcggcataactcttatgacgagactgggccacacgcaatctttcttgaatgattttcaccttttcttctgcttccctcaggatatccgtcccgaaaacctgacgttttcccgtttgatcccacaaaagcggagtgcggcacttccgaccatacagtgcttcgtaaggagccatctgaagactagcttgataactgttgttgtacgagaattccgcataaggtagattcttatccaacttccaccgaagtctaaagcacaagctctcaacatgtcttccaaaatctgatttaccctttcggtttgtccgtctgtctgcggatgataagcagtactaaagttcagcttagaacccatccgcgcggatccggatggttgccaccgtcgccgcccggctagctccccgggccacccaagtgcgcactgggcgaagccccactgccgccgtccccgcgggcgcgcggctttgccggcggccgctcaggcggcggtgaggcagaaaaggaggggaggaggaggaagaagacggcggcggcatcgcttctcgtgtcgcccgtggggagggtgacgcgagagctttttttctctctgcaatctgattgttagggctttgctcaggagttttggtacactgtacaatagcgagatgggtctgaaatctttgatatgaactggcgttgctgtttttggcagcagggtgatgtaggattggttaactccagacagatcaatattatattctcatcgaaaaggttactttagtcttgtaattagaagtttctcacttcgccattggtcattggtcacgaccttccaatatcactttgcactatgttttaactttgtgctttgttcgatcttaacgctaatatatttaatcgctccgtccgggatatttcggctaatatatataatccctccgtcagttgtgaacttgtgtttgtatagtactggatttaattaaaccccggcatagtatgtatcattaaaaaaaaatttctcaacaattaaatagacggcatctattcaggaagattagatcgccaaatgagtgtggccactgacacttaaatgcgcacgagtcgatctgattagtgggtccccgtccagtccagctcttgtcgtttcggtcagcattacaggaatgggcaagtacgtttattttgattactagaaaaaaaatacccgtacattgccacgagtaaatacgtttttcctagtaatattgggagccaagaaatcacttgaaatattatggttgctatacactataattgaaaaggttaatcaaaatattttcttggttttgagccgaaagcccattatttttttttatttttagcccctgcacaatccgttgtctcctaggtcctacctttctcctctcgaccttcctctcttcggcttagctagcacagtcggttgccccacacgtttcagtaggttcttcaacctccggaagataatcccgtgtgcccgtacgatatcgaagctgatgctccccatcaaatttagcgaatctttctcgatcacctaaaattggttaaggacttttgatccactcgatgtcctctttccgtttctctcgaaattggagcgaatccgtaaaactcaggataaaaaggaacgggaagctcgccgtctggtcatcatttctaccattcaatagagattaaatccgatgaattaaaaccgaattgaaaaggaaaatcatgggaaaatgacgacggaggagtgagaaatcgatttttgtaatcaattagaggaggaaacgcacggggaggcagatcaatatggcggcggataaagattaaatccgaagaattaaagtcaaattaaaagggaaaatcatggggaaaataatgagggagaagtgtggaatcgatttttgcaatcaattagaaaagaaaacgcacaaagagacaaatagatatggcggtggcggcagacacttaaggctcgtgtgaccggacgtcgtacggatgatgtaaaaaatatacggaatccttccgtatttttttatcaggctagaaaaatgcccgtgcgttgtaagggtaaaaataaattacaataaacatcagatttgcagtgttcaagttttgtcatgatttaaacacatatcctttttacgtggagttaccaattaacctatttagaatagtataaatcggcaccaaattagcatgacttctgcttggtattttcactaagctaatacataatgcacgctttaactgtgagatatataaattttttaaataagacgtacggtcaaaagttgtacacgaaaatccgcaactgcacttaaaatgagacggatggagtatattggaagctttgatgtcacgtgttaaaatgtgtaattctaacagcaagcaaacatcatgaacttcagcaaagcatggttgcaacagctagcaaaacttctatcgtttattgttcatcttaactattatggttcaaccaattggttgagtcaagccatatgtaaacagtaccatcgagttcaacattcacatacttggttccatcg

SEQ ID NO: 72157 - DNA, 2493 bp, Oryza sativa
  unsure (1)..(2493): unsure at all n locations
atatgatgatggaacgacgagacgttcctaagcaagatgtgctcccgaattatgcgtgctcgatggtcttatcagttctcgaagaaaatgcttgtactggctggaacgcctgcccaaacctgactgagaccataaagaccgtaggcatggaaccgatgattctgatctagatacgtatggaaactggggagcaccacgtgttcccggacatggcgattccatttttggtactgttggaagaagaggatgtgtggtttctaccgatgactgacgaagacgcccaagggggcatacagctataccggaggagagcagcggcaactctgcggcgcgaagtcgccactggtggagaaaccatctttcgtcggtcggccgatttccacaatagtcccggatgcaataaaaaccggggctaaagatgatctttagtcccggttcaaaagggaaacgggcatatttgatctttagtcccggtttgtgtcccaaaccgggtttaaagatcatgcttagtccgccttcgaatgctgtcagcacctgtcaggccccgccgggatctttagtcccggttggtagcaccaaccgggactaaagatcttaactttagtcccggttggtaataccaaccgggactaatgatcccggcgatctttagccccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgtctaaaaggtttgcaatttcatcctccaatgttttttttgtcatactacatttgcacctatgttttgcacacctttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgacacatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggagaaaatagctgctgatggtaacgacgttgcggatgatcttggtcagatgttgcaggacgctagggaggactgcgaaagtaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcattaagaacattcttnncgngggaaacaaaattgccgagacaacgtacgangctaagaagatagtctgccccgtaggacttggaagtcgtaagattcacgcatgtcccgacgattgtatcctatatcgcggtgaggagtatgagaacctagaagcatgccctgtttgcaaagcactacgatacaagattagacggaccgatccaggagaagttgacgggcagctaacaaaaaagagaattcctgctaaggtgatgtggtattttcctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaaca

SEQ ID NO: 72158 - DNA, 1622 bp, Oryza sativa
aaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgcaaggaacatcggtaagtccgatgcatggattacacggcatcacattgatactttccccgcgtggctacgacaacatctcatgggtaacgagtcgatcaaccaagaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtcctttccaatgatgtaacgcaagtctttttcgtgaaggacatgtctagcaaaggaaagaagggcagagggtgtcgcgtcccaaaacgactctaaaattcatcctcaaaattatgcatagaataagtaaaatccatgtgaaagcctccaacaattaaaatgtgcaaagttaaaagtcaaataaggcttggaggatttttgtatatttcctaaaagcctaaaatgcgtaaataaaatttagtggaattttcagagcacaaataataattattaagaaataaacaaagttaaaaaggttttataaaaagaaaaaccctaaaaagtcctttttccccttcccctcttgggccggctcggcccacctccctccctctctctctcttccccgtggcccaatgcgctcctccccgcgcgcgtgccgcagacgggcgggcccgcccgccaccctcgctgacgggtggggcccacccgtcatcccctacctcg

SEQ ID NO: 72159 - DNA, 916 bp, Oryza sativa
tgtatatatatatatatatatatatatatgttacttcgcatttatcctaatacatattttttatcttgtagaaaagacgtgctgtaggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttcttatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatactgaggggaaccagcaagggcacgtggaaagggatgtggaggg

SEQ ID NO: 72160 - DNA, 5226 bp, Oryza sativa
gttattcacccgggactaaagatagcgatctttagtcccggattggtaccccggtttggaaaccgggactaaaggggggttacgaaccgggactacaaagggtttctccaccagtgcgcgcgaggcgagcgcaggcgggcagcgggtgtgtgcaaggcgaacacgcgtgtcagatgcaatcggacgcaattgagcccatgtgcgagccaggcggatgagacggaatcagcgaaaccataaaaaaacgcctagatttttaccggacaagaagacggacggatttttttacccgaagccttacttattttttaattaccagaacaaatgcccgtgcgttgcaacgggtaaaaacatttttggatcgctatatattttattttttggttttggaccaaaaactcatttcattccttccttgtcaagtggagctataggtcagctcgcatagcccactgtcgtttccaacctccgaaagacaatgtcatgtccgtacatgccaaaaccgatcctccccatcaaatcctccacatcaaatttagtcaaatctttctcgatcttccaaaattggttgagggtttttaatacactcgttcttctctttccgtttttattaaaatcggagcgacaaaacttgggataaaaatggtgatttttaaatggagattaaattcagtgaattaaagcggagttaaaatggaaaatcacgaggaaaatggtgagggagtagcggggaattgatttttagcaatcaattggatgagggaacgcatggggaggtagattgacatggcagtggcgctagtgtttggtcgcgcgacaaaaaaaatatggcacaaatccttaccgcgtgcggaaaaatgcaactaaaaaaacagcaatgaagaaaaaacatatgaaaaaaacccggaataaaggcaaaaaaaaagtaaaaagcagatcggttttttccccggtttttttctgtccgagtggtttttttagcacgccgtttttccctggtttttttccgtccgattttttattagtgggtcgtgattagtggttttttttgggtccggttttttcattgaatccacagagtcctatacggttacacaaagaaataaaaaaaaacagatggagaaaaaaaaggaaaaaataacgaaaaagaaaaaaaatgacggacgaattttttttttacggaaacattgcttactttttaattaggtatagatatactagaaaaaaaatacccgtgtgttgcaacgggtaaatactatgctagaatagggtaggatcgggtttatttctctttcttgccacgggaatgacacacgcgataacatgcacatgaatttttgagcaactatagacagaaaattttttgacgcacgtggcaaatattctaacgcaagcaaagccggacaaaaaaaaacaacaggaaaccttacgtattagatatataaattcgatcttatctttttgtgattaagaatttagattgtttatttatttttttaggaaaaaaaaggagaattgaaggtgccaagagggggccggggcttgcgctcgcgcttctgggaggggatttctcgcgggtaatgtcgaaacatgaattcggcaataataaaaggggtagcgcacgagacctaaaagtggatggatatggagacaaaggatttagacaggttcaggccctctcaatgagaggtaataccctactcctgtttggagatttgaatccgccgagtgtagtatagatctaacgatcatatgtgctcatgccccctagagggcctcctgcccaccttatataggatgagggcaggattacaagacagaaatcttaaccaatacggcaatattatcaaaccaggacttaaggccgttccgtaatatacagaaaacgtaatacccaagtcatgatctgttacatattccatagatataagttatcccctataactagtcggataaccatgccgtgtgggtatggggtacccataatctccacagtagcccctgagaccttcacagtcaaaaagataatcttctctcgaactagattactccaaagccgagtgcttcaatcatctttgccatggtctcccgagtacttttaccaaatctgaagactgtggagggctgaaaaataaagtcaggtgcatctagtctatgcacctaataggtgtagccctcgactatgtggttaattgaacaaaccaagcatatagtgaaggaataaataatccaaccaaccgagtggtttcgataattgtagtcaaccaagcgacttgatattaatatgtagcatatgcggtgtgaatccctaaataatataaaccaagtgatataccgactgctttaacatgatgcgtacaacctaaagttgactacatcattgaaaatttacatagcaaaaatagctataaagaaccttgtatgctgtgaataaagaatttccaaagtattgggcatatgccatgcgcacactgctttaacagatgtgcttaagtccctaaaagacacatggtttcaccacacccagaaatatatggcatatgtggtgtaaaatccgagtaaataaactcatgaggatttaccaaccgtctggaaaatgaccaaaatatataatcagcctaagccataatattggtcaataaaaatgcacatttacgtggcaaaaagcaatgatattgtatccaatcaattgcttgataaacccaaacagcgccatgactatataaaaaagtcagcggggcagctatataaagctttattgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgataggccacacctgaaaatataggctgcagacatattaggcctaggccaaaaaatatgccttcgacacactttaaaggatgacgcatgtaacatgctcccaagtaataaatctttcgggtgatatagaccaagtatagctcatatgaatagcttctgatctgagtgattatcccttatgggatactccaaaatagatataacaattgaatcccgattggcgcaagtattcagttgataacccttacggggaataataaatagtctagtcattgagcatagaaaatagacccatggtcatgagttgatgttgcatgtatccagaacaagtccaaattgaaggtatgatacttgtgtttgagctagtaagcccctgagcatatagcttgtccttctgtcgtaatcacaattgtccattgatggtagctgacgcagttggcatagagacaagacgaccaatatagagataatattgcctaccagaggtggcaaaaatattggtggtagtgaagataatgataccaatcaaaagtgatgaatttgcacacccgtggaagcgaagaaaccagtcggtagcagtcaggtcagccagcaatgaatatgaaggcgcccagcgataaagttgtgtagccatggcagcgaaataatcagtcgatgacagacgaggcagctggtgaagaagatgaagatgcccattagtggcgacataataagccatccgtgaagacgaggataccaatcggtggtgacgaaagcaagccaacggtgaagatgtagacacgcatcaaaggcaatgacgaaatccaccaatcatgaagatgaagaaaatagtcggcgacgacaaacgcaaccaacatgatgaagatgacgatgtcagtgatccagtcaatagcagtgtagcaaccaatgataatgacgaagacgctcatcagcgtttgcatagtaggtcatccgtgaaggcgaaataacaagccggcaatgacggaagcaaccggaggcgaagacgtagtcatccattagcaacggcagagatgtcagggccgatgaagtagaggtgctggtgatgaagtcagtgacaataatccatcaaactgttgagaagatatcaaagcttaagtaattttcttgatgtgtgcataaggaagattgatgcaacaccaccttgtaaagatggtaatagaacttggagttgtagctattgcagatgcttcaattgaaggaaagtaaatgctgttgtccaactcatcaaaactgagctgattggttgataactctaaactctcggatatgtagatagaatctcaaacttgatacttgaaaattttggagtagattgtggcggcatgaagaagccaaaattgccggtgtaataattggagtcgctgaaattaaatgccggctctgaagcaaagataaatataataactccccgagttgactcgtttattgattgattgcttcatcttgacataaagcttgtcgaattttgagtcttgtatttgtgtagcccccgactctttggttagttgagaactgtagcttcttgtcatcgagtagccatcacttgagtgaatatatgcattgagtatgtctgagtagaaatattgaagattggaacaccatttgttgtagtaaaataacacggcattaaatctagtggtgcatgccgagatgtcgaggctcttgtatacatcgtggttggtgaagtagaaaaacttgcgaagtagcaacaattcggtttgctagtgcagaagacaatgaagatgaagttgctccaccatggtgacaaagttgcatagccgtgatgaagtgaatacgagtcggaggcaacagaagcaaaccggtggcgaagacgcatagtcgtgaagatagaaacaccagtcggcgatggcaaaaaccagacggtgaaaacaaaggcatccatcagcgatatcataataggccagccatcaagacggagacaccaatcatcggcggcgaaggcaagctggtgataatgatgatgcccatcaatagtaacgaagacgcgtagccgtggaggcgacaaaccagtcggcgtcagatagggcggccaacaatgaagacgatggcgtccatcagtagttgtagcggtataaaccagctgtagaggcaagggcactagtcagcagcagacgagacgaccggtggtggagacgataaggccaatcaacactggaagaatcatgcagccatggaacgtgaagaaaccagtcggcagcagacgtagacagcttattagcggtggcggcgacgtggccagccgtgaagccgatagcatcagttggcgtcatacgaggcagccggtca

SEQ ID NO: 72161 - DNA, 6691 bp, Oryza sativa
gcataataggccagccgtgcaggcggagacaccagtcggcgacggacaaggcggccggtcggtgaagacgtagacgtccaacaacggcagcataatagaccaaccaaccatataggcgaaaacaccagtcggaggcggacgaggcggccggtcggtgaagacgtagacgcccaacaacggcggcataataggccagccgtgcaggcggagacacgagtcggcggcggacgaggaagccggtcggtgaagacaacgacgcccaacaatggtggtgtgaccacccaaccgtataggcgaggacaccagtcggcggcgacgacggcaagccggtgatgatgttctgactgatccattcctggagcgtaggagataagcttaaagccatgaatccctcttatgcatatctagatctggatcctgcagaacaaacatataggatgagtagtatctgatgtaaatacaatactcgaggaaaattcaagcattttaaaatgtttataaatatgtatttctcctcatcgattttgatttcctcgagcagatgactccttacgtttatacactctgccgactagtcattgcccccatgcatcgggagtcggccaaggcacttccctgacatgcaaatgggtgacatgagttcgtcattaatggaacaaagtttcacggatcagagtttactactcgggtacttttgcaattgttaagagaagaaaataaatttatcttatctctatgcttttgatttattctgaataatacttagcaccttgcgttactcggtccatccaacgagtccccgggtgctaggaatcggcccaaaggcaactatccatcgacaaaccaaacggaaagcataggaagatagaactccataactcgataggcacttttgtactcagattatatcgcaagcaatcaagataaatattataaaaaatgtttaaaaaatatgatataacatctgtagccccccgactcactagtcaacggcgaactagttgacatagtgaggcagaggaaaaggaaaatatcatataaacaatgaaataaatgatgacttagcttttagtattcccgttggtgacagcagaggtagccgatgtaggaacaaagtcatccatcaatggcaataaaagcaccaaccgtgtaagcagctgaggcgaccggcggtgtaggtaaataaatgcccatcaacggtggtgtggccaaccaaccatgcaagcgaagacaccaatcggcggcgacggaggcaggccggtggtgaggtcgtagacacccaacaacggcagcataataggccagccgtggaggcggggacaccagtcggcggctgcaaaggcaagtcggtcggtgaagtcatagacgcccaacaacggcggcataataggccagccgtgtaggcggagacaccagtcggcggcgacggaggcagaccagcggtgaagtcgtaaacgcccaacaatggcggcataataggccagccgtgtaggcagagacaccaatcggcggtggcaaaagcaagctggtcggtgaagacgtggacgcccatgagcggtggtgtgaccaaccaaccgtataggcgagtataccagtcgccggcgatggaggcaggccgacggtgaagttatagatgcccaacaatggcagcataataggccagccatgtaggcaaagacactagtcggcgccggcgaaggcaagccggtcggtgaagacgtagacgcccaacaacggtggtgtgaccaaccaaccgtgtaggcggaaacaccagtcggcggcggacgaggcggccggcgatgaagacgtagacacccaacaacggcagcataataggccagccgtgcaggcggaaacaccagtcggcggcggcgaaggccagccggtcggtgaagacgtggacgcccatgaacggtggtgtgaccaaccaaccgtataggcgagtacaccagtcggcggtgactgaggcaagtcggcggtgaagacgttgttgccattagcaacggcggtggtgaaggcaagccggtggagtagactcatggcctactaatcgcatagcgagacgcctcgagtccatgaccaacgcccatcgcctcaatagtgccatgtaattatatgcaaacaataacaaaaatagcaagagattaatctgaaattagaaatcaaactaataatatagaataataagttggaagagataaaactcgatgaattgacggcgccagttgtggccatgacgatatttgtcatgtgatcaccatccggtaaattgtaggcagctgcatcccatgtgtggccggtgatgaagacaacgccacccagcaatagtagcaggattgctttaccggcttgttggatcagaacgatatctcagggccatagccatctatccatggaagtacatgtaaatacgagtcaaatcagattagtaaacaaaagaagatgcatgcatacagctgcatacactcctatagattaattgactcatatgtgtcgatagctgcttattgaataattggattcaagcctttgaatgttggtagcagcctagctataaacgcagggctcctgattggttggcctattggctggcatgtatacttgcatatatggcggtgatcagtagatgcatgcgatcaccacggctgttccggagcccctgattacgtcgccacgaggggaagcgtgctagactggagtactttggcaatcaaagcagtcggccgggccaaaacatctgcagccaaccggcaaccgcacaccatgcctgttccgatgacaggggttccagcatgccgtgtatactcccaggtagctccatatgcgcctatcgacgatctcgtcgatagtagtactacaataataatagtacaccaggaaatcaatctatcatagacattgttaaaaaacactagatagattgaaacgacaaacccggttattctttgtagattaatttgatcagaagatgattccagcgattggagttgattccatcgcgctcgtcgacgaggtactcggcgcttcccctacttggcgcgccaactgtcgaaacatgaattcgccaataataaaaggggtagcgcacgagacctaaaagtggatggatgcggagacaaaggatttagacaggttcaggccctctcaatgagaggtaataccctactcctgtttggggatttgaatccgccgggtgtagtatagatctgacgatcatatgtgctcataccccctagagggcctcttgcccatcttatataggatgggggacaggattacaagatagaaaccttaaccaatacggtatcggtttcctaaatctactttacaatattatcaaaccaggacttcaggtcgttccgtaatatataaggaaacgtaatacccaagtcatgatctgttacatatttcatagatataagttatccactatgactagttggataaccatgccgtgtgggttacccataatctccacaggtaattaggagacgagggattaggaaattgacaccgagaaaaaaaggaaaaaaaaaagacctcaacgtaaaaaggaaaaaaaaaggaaaacaacgacagtaaaacaaagggacagaccaaaataatacccggaagccttaattacttgaatttaattttaattaaattcttcatgattaaccacactctctatattttatattaattttgcaaagatgaattgttaattttaataatacaaagataattttaataattaattttaaatacaaacaaactaaaaccctcttctaaaactgggccaaatctggcccattcttccctcctcctccctgagccgtgcttccactcctccatcttgggccaccatccctctctctgttcgggcccagcagccaccccacttcctctcctctctcttgggccaccatccaagtgtccgctcgggcccagcaaccgtcccagcccctgaaaagaatgcggaaaggaataaaaccgagaaaaagggccaaaaaaaagagaaaaggggcgaaaaaaaacggggacggacgaaaataaaatcagaagccttgcgtatttttttaattaggtatatatagatatagatatattaggtactccctccatactcataaaggaagtcgtttagaacaatgtttaagctaaaccttgagaatataaatcatgaataactctcaagttctttagtttgaaaatataaaaagtatatgaatagatttgtcttaaaaaatattttcataaaagtatacatatatcacttttcaatacatatttttatagaaaaaagaagtcaaagttgtgttttggagaccgtgtcgatgtcctaaacgacttcctttacgagatatagatatatagatatagatatagatatagatatagatatagatatatatatagatatagatatagattagaaaaaatgcccgtgcgttgcaacgggtgaagtatattttaatcttattattgttatagaaaaattgctcatgcattgtaacaggtaaaattatttttgtatcgttatatattttactctttggttttggaccaaaatctcatttcattcctcgtcaagtggagctgtaggtccggctcgcatagcctgtcctcttcaacttccgaaagacaatgtcgtgtctgtacatgctaaaaccgatccttccatcaaatccgatcgaatctttcttaatctttcaaaattggttgagggtttttgtcacgcctagaaattcccgaatagaattccaagcagaatgtgcattaaaacccccgtctaggaccggccggggtacacaaacgacaaagttgacatacagatccacgtcttacaaacatcataaaagtcttacataaatgcagcggaaaattaaaagataactggagctaagccttgacttggaccgtagcgggaacaccactccacaggcatcctcgacggcacagacgaagcccactcttcagaaaagccaccatctgacgcatactcaaactctggggttttggggaaaatagagcaagactgagtacaaccaccgtactcagcaagtcataccggaataggagtatgatgcaggatataatcaaaggatagctagagcggttcatttgcataaaacgagcatttataaacagtagttgaaagcagtaaaactgttataataattaatcaatattaaccatccactgtccaacgctacaccacgttgcaataggcccaaccacccacctgaactaatcaattccattagactagactagggtgagactaatcaaggtgaatctagttgaccgcccataaccgcgggcacggctattcgaatagttttactctgataagaggtgtacaactgtacccacaagacacagccccacgacacgttaccgtgcgccgacatgccaccacgacataccggaaagggaccgtgacaggacccttcgcataaccccctctagccaagcacaccacacctcagggcgatgggcagtcccctctcgtgcctaggtgaatccggaagcgacaaaggctgtcgcaaggcctgccccgctccatgacgcccacccttacctagatgcatcaactagaggaaagctacactacaagcccagccgttgcccacgctggcttatggtaagtacgataagttcttccaaggcatcccgtgaaccggtccttaagtgccatgggcgcgaccatcaaaaccatgcacccacagcccaccatatggtatattttaattgactaacaccaggacgatggccctaatccaacatcaacactagaacctgaagtctatgcattaatgtgattcacccattgtgtactagttgaactaagcatggctaagcaatccctagtccaatatctagtcatgttatatcccaagctaacaaaggagcatggtacaaaaatagcatggctgtaacagtaggtaaacatcccatagtaacattataaaataatcagtatttaagggaaacaataggacatttgcaatataggatcaacatgttcaagtgacaagcatgacttgccttgctctgctgctggaggaacctcagcgactgtttcaaagtacaccggagcgtcgggagagccggaatctaagcgacatacaaagcaaacaatacaaacatgccataagactactgaaacagggaacaaaaccatttttaatggattctttgcatttttcttgatttactgagacttgaatgggcttaaacggagctcgatgaattggatatgaattttagaagattcactgcgtttttcctataaacagaaaaaaatccttaattgatttattgtgaaataattaaaaccctggagagagagggggcggcgctgacatgcgggccctacacgacagtgactcgaggtggcggtccgtggtggaccgggtccacggaccgggaagaaggcggcgcaccacgtggcgccgacacggcagccacgcgggaggccaaacggacgaccccgggtagatcggacggcggtgggagcgcgcgaccgggcgcgcacgggcacggatcaagccgacccggcggccatggcgcgcggcggatctaccgcggggcggcgacggcaaacggtggcgaccgacggcgagtggcggtgcacggcgaccgacggcggcgcgaccccgagcggcaaggggcggcggcgctaggagggaaggggaaggatgat

SEQ ID NO: 72162 - DNA, 13813 bp, Oryza sativa
  unsure (1)..(13813): unsure at all n locations
attggttaaaattatttctagagctctgaaaattccactaaaaatcttgttagcatattttgacatgtagaactcaagaaaaatccccacatatgccatttcggattattattgccattaattcctttagggtttctctcttgcttttacaccgatattttctcaatgttatttataaattaaatttaggcttgggagaagaacttcagggtgtgacattttttgatacactcgatctcctctttccgtttttatgaaaaccggagcgataaaactcgggataaaaacggtgatttttaaatagagattaaattcagtgaattaaagcggagttaaaagggaaaaacagaaaatcaattggaggaggaacgcatgggaaggcagatcgacctagcgacgacgctagtgttcagtcgggcgataaaaaaacatggcacataaaaaaacaaatccttacctcgtgcgagaaaatacaactaaaaaacaacaacaaacatttgaaaaaacccagtaaaaaggcatagaaaaaaaagcgaaaaaagacagacggaaaaaactgggaaaaacgaaaaaataaaaagagtgaaaaggacggaaagaaagaaaaaaaatatacagataaaaaaagaaaaaagaatcggacagaaagaaggaaaagaaatggacggagaaaaaaaggaaaaccggaaaaaaaaaagaggaaaaaacggcgaaaaataaaaaaagacggacgaaatttttttttacggaaaccttgctttatttttaattaggtcggtacagagatgtataaaaaggactaatcaggcgccaagattgagaaaattaaggaagagagcaaaaagaaaaaaagtaactctggcaggtctcctagctagttaacttggaaattcatgagagaataccctcatttagaaatgtacaaattttatggaaattgatggagattaaacaagtcgctatagaatttataggagccatacttaattgtgaaattgagaatacttattctatttgtgggtgcctaaatttttcttacatactaccagctagctagatgaatttacaccatataaacttttacaaaaaaaaagaatataaatatagattttagtacgttttttatattttgatacgatcgcatattaatttacacatatatgtgtgtgtattattttctataatgacttaaagagacacaattcatttgatatttaacatagttcgttacattacaagaataaaaaggtaccatatgagttgctggatattgttcctatggactatggttaaaacaaattagatagatacatttatactaatataaaaaaatatttttatagttatgtagtaataactacacggttaatacacataaacaaccatttctactatttgattacaagagcatctccagcaggggccctaatcacaaagctcaaactgatcttagggctaaaaggaaaaaaaaaacaagctccaacggggccccaactatagggaacgcccccagattctcctccataggcctcgttcctaggggttctatccacagcccccatccaaattttttggcgtatccaaaattttttttgttcgtgcattcggcctctcctcccttccatggtcacgctacaacactacggactctattcctgtcggttgcgctcctgccgccggtctccctgaatcttgtgtgggtgggtcacaatcctcctcgatgtctcctgcaggttgtcttcctatggccctccgagctcatctgataactgactactcccaacagctacctatcagggttatcgatacggcatacctcttattcttggggttatgaaatatatgaacagggtatacccttaagtacacaggaaggttactttagttacaaggaattggaccaatgcataaggaaaccaactccccaaatagaaaggtgttagaatcctatttcagaggaggtgttagaaaccatctcgtatatgcaaagttctctccgagttctacttggaagccaagccggtttgaggtataagtatttggccccagagggtacgggatcatcgaatcataatattgctacctgccataacagaagcaacccggaggactcgaaaccaactcgtcgattgatctcgtcctcaacaaaggtgtaatcggtaactcgtcggttctgttgttatctattgtaatcttggttattctcttcataatcccatataaactggattatggctattaccttacgagggatctgaaccagtataaatcttgtcttctgtgcgtttgatgtcgtttcgtgtagatccttgcttcaacatacccccaataccgtcaggatatggtccgcaggtatcacccgccgacactaccctcgtatagaggctccagggctgcgcttctcctctaccggatcgtcctcactactcccacagtgtcagggttacggataaggtataccttctacccttggatgtatgttgtatactgatacggtatacctgcgcgtatacggatgtttcctgtacacgttaaggaaatccatcacgtaacagaaacagagtccacggatggaaggagtcctactcggacagaactgggtcgttactgtatcgtgtggggtccgatatctccgagttctacttggagatcaactgacccgcggtataaaagggaccctccgggaggacctaaggcatcgaatgtcaccaccaacacacccaccgcatcctacgaagtcggagccaacaggagctaagtcgccgggtgatctagtcgaaccaactcgactacggtctcatcggtatcatcgagttttgctattccctttgtaatctgtggttttgctcatataatccataccaactggattaggattattacctatcaaggggcctgaaccagtataatccttgtctttttgtttgcttgatgtcatattacgtagatcctcgtaccagcgtaccccaataccctatatatccgatctacgggtatcccccgtcggcagtggcgcgccaggtagggggacttggtgctcaaggttctgctactatgccatcaagcctcgtcgacaacaacgtcaaccccggcatcaaccaaggagtttcaacttcaataatgctggtgtggactcaagtcggcgaaatcgtcttcccgatctacaccacggtgccgatctcgactggtccatcaatgaccggaagcgagaacgccgtgcttacgatcccagacgcctttatgtcgaaggatcctcctgcggaagtggagagcagaacatcgacgacgtctgagcccgagaaggacccaagtgcggccatatctcgtcctcccgacgagaatgacgagccgacaaggacaacttccaaggtaacaaggtcctagtgtcctatccacaaaaccggaaaacacaccttgcaagcttgctgggtttttctcgacgtacaagctgagatccgtgcctgcaaagagcatggaattcagcgtacttctccaactcgtgatgtctattgtcctattcacaagacaaagaatcacgacctctcaagctgcaaggttcttctcatcgctatgaggacgtcatctcctaaggtccagcagtcacaaatatctcttagagaagcggacaaggaacgaggagcgacagttatctcagatcgattcgttggggtaatcgacatcgatccccatgagccattggttctacacttgctcgaagaccaggcctcatcatcaacgagtacaccacgtgatgtattcgcgatcgaggggaccagcacttctgcgcgcgctaacacagaagcggaggatcaattggctacaccggcccagcacattaggaccatcaacacgatacttagggaaaccccttatgctcccgttctgaacgatgacctcgcacagtggacagaacgactacgagaatcagtggccaacctcagcaacacgttcgaggaggccgctgccagggtcctattcaatggcgaattgcctgagcagcgagtatcacctcgtcaagccacccttccgcctcgaggcaccagtgaccaccgtgaccatctaaatggccaccgagaagcacgccgcacgcgagacaacgaaaatcattcctaacatcatgtctcttcgcaacatcgcgagaacgaagaacaacgaggacatccgagcgagaaccgagaccttgataatcgccacaaccgccgtgaacacgatatcgcgacaagcgaatgccagcgaatactggtccaggtagccgccgtaacaacgccgacgacaaagatcaacatcgggacaataacggcggacgacgacaggattctcgagaacccgtccgccatccctgtaatcgtacaccggaaccgagtgactcatcgtcatcatcatcatcatcatcgtcttcgtcatcagatagacacccacggaggacacatgatcgccgacaacccactgcccaggcgacggatgtagagctttcattcgtgccctgcgagatgtccaatggccggagaggtttcgaccgggagcgatagagaaatacgacggaagcaccgacctggaagagtttcttcaggtctattccacagtactctacgctgccggagcagacgacaacgcactggcaaattatttgccagcggcgttgaaagggtctgcacgttcatggctggttcacctcccgccctactcgatatcttcatgggcagatttgtgacagcagttcatcgccaattttcaaggaacatacaagcgccacgcgatcgaggacgacctacacgcgttgacacagaatccgggcaaatcattgagggactacgttcggcgctttaatgagtgccgaaatacgatccccaagatcaccgatgcttctgttatccgcgctttcaagtctagtgttcgagatcgctataccacccaggagttggcgacaagatgaatcacaactgctcgtaggttattcgagtttgttgatcgatgcgctcacgtagatgacaccttgagacacaagaacgacaagccaaagacagagggagacaagaaaccagccaaggacacaccagagtcaagcaagaagaagagtcgcaagaatgggaaaaggaaagctcaaacagaggtcctcgtggcagaatacgcggacccacccaagcacccagacccacaaggcgatgacacgaagaaaatatggtgcaccatacacaagtcggacagacactttctggaggcttgcttcgttttcaaaaaggcactcgcaaagcaactagcgttggagaagggaaagcgggtacgtgtagtcgagaaggccgccgaagcagctactcagtactcagactcgacatacccagactccgacctccatgttttgcacatcttcggaggttccatggcgtactcctcgaaacgagagtacaagaaagtggagcgcgaagtttattcgacatggcagggggctgcgcccaagatgaagtggtctgaggagaaaatcaaattctcagaggcagaccaccccaagactgccatcaccccagggtgatatccgatcgtggtcgagcccactattcggaatatcaaggtcgcacgggttctcatcgatggtggcagcttcatcaacctactctttgtcagcaccttggacgcaatggggattccacgaagcgagttgacgcccactgatcaacccttccatcgaattacctccccagtcatcgtccaagccattgaccaagattacgttgcctttgactttcggccaagcaaacaattttgaacagagcagatcacttttgatgtcgctgaatttgatacagcatacaatgccatcatgggagaactgcactcgtgaagttcatggccgtatctcactacgcataccaagtgctcaagatgcctggcccgaagggaacaatcactattcaagggaacacaaagctggtggtgcagtgtgacaagcggagcctcgacaggtcgagcacacgcccaaccctcccaccacagctgagccacccaagaaagtgagcaaaacaaacaagatgccgaagccagacggcgcaatcaagatcgttccactctccagtgccaaccccgacaagaccgtcaagatcggggcgtcactggacgagaaataggaactcgcgctcatcgccttcctccgtgacaatgcagacgtgttcgcttggcagccgtccgacatgcccgggtccctagggaggtgattgagcataaacttatggtgcgacccgatgccaagccagtaaaacaaaaactgcagagatttgcaccagaccggaaacaagccatacgagaagagctcgacaagcttctcaaagctggcttcatcagagagattctccatccagagtggctagccaatccagtcatggtgcacaaggccaacgggaagtggaggatgtgtgtcgacttgaccgacctcaacaaggcgtgtcccaaggatcacttccctctccctcgaatagaccaattggtggactcaacagctggttgtgagttgttaagctttcttgatgcctactccggctaccaccaaatcagcatggcgaaaaaggacgaggagaagacagccttcatcatgccgtttgatgtattcatgccgtttgatgtattctgttacgttaagatgccgttcgaactgataaccgcaggaaatactttcctacgcacggtccaaggagcacttaacaatcaaattgggaacaacgtcgaggcctacgtcgatgacattgttgtcaagaccaagacaagcgactcattcattgacgatctccgggaaacgttcgacaacctccgacgatatcgcctcatgctcaatccagataagtgcacgttcggagtaccatcgggaaagctgctcgggttcctcgtctctggaagagggatcgaggcaaacccaagaagatcaaggcaatcgagaacatgaagtcgcccacaagactcaaggaagtccagaagctaactggatgcatggcggcattgagcagattcgtcgcttggatgggagaacgaggacaacctttcttcgctctgctgaagaaacaagacaaatttgtatggacacaggaagtcgaggaggtgttcatcgcactcaagcgctacttgtcaaatccccctgtacttgttgctccccaacctaatgaagaattattcctctatatcgccgccacaccatattatgtgagtaccgtcattgtcgtcgagagagagaaggtgcaaagaccagtttactatgtcagtgaagctctccacgacgcaaacacaagatagccatagatccaaatgctgctttatgcagtaatcatgacatgaagaaagcaacgccactacttccaagcccatagggtcacagttgtttcctccttcccccttggtgaagtcatgagaaacaaagacgttgtcggccgcattgcgaaatggatagtcgagctaagccaatttgatgttcattttgtgccatgaacagccatcaagtcccaggtcctcgcagatttcgtagctgactggactatgcctgacaacagggcagacagtcagaccgacaacgagacatggacaatggcatttgacggtgcactcaatagccaaggagcaaggacagggttcatcttgatgtcaccttcgggagatcagttcaagcatgcaattcacctcaacttcagtgcaaccaataacacagccgagtacgaaggactactcgctgggataagagcagcagccacactaggagtcaagcgactaatcgtgaaagggtattccgaactagtcgcaaaccaggtgcataaagactacaaatgctctagccccgagttatccaagtacctcgcagaagtcagaaagcttggaaaaaggtccgacccgtatatcgcaaggacactatcgaccctgccgacctagcacagcatgcatctagacgagagccactcgaacccggcaccttcctggacatcctgacaaagccataggtaaaagaggcaaccggcgaagatagcacagtggtccccaacacaagctggggggctacagaggcagaacatgtcgttgccaccatcgagaccacagacgactggcgaaccccacccatcaagtccttaagtagttattagttgcccgaggacactgcagaagccgagaaaataacctgttaagccaaaatctactgtatgaccggcaacgatctataacgatctatacaagatggcgccaaatggggtacttctcaaatgcatctcatccgacgacggcaagcatctcctccttgacatacacgaagggaactgtgggtcacatgccaccggtcgcacgttggtcggaaaagcttttcgacaagggtttttttggccgaccgccctcaaagacgcttgcgacatggttcagcggtgtgaagcctgtcaattctatggtaaacacacaatgctaccggcgcaagcgctccagactatccctcttacttcgttgttctcatgctgggggctcgacatactcggaccattcccacgaggacagggcggatataggttcctattcatggcgatcgacaagttcaccaagtggatcgaagcgacgcccacgggggaaatcaaggccgacaatgccattaagttcattaaagggatattctgcagatatggattgcttcaccgcatcataacagacaacggctcccagttcatctgtgccgacttccaggattactgtattggattgggagtcaagatctacttcgcctcggtttctcaccctcaaagcaatggacaggtcgaaagggcaaactgcatagtattacaagggatcaagacccgtgtctacgacagactcatgtcacacaacaagaagtgggtcgaagaactcccctctgtcctatgggctgtgcgcaccacatcgacaacgtccaacaaggagacaccattctttctcgcgtatggcttagaagccatgcttcccacggagctacgacatcagagcacacgagtacagaagtacaccgacgaggatcaagaggagcagcgaaatgacgatgtaaatctactcgaagagcatcgagaaagagttgccgtcagagcagccagctaccaataggcccttcgccgataccacgagaagcgcatcagagcacgcacgctttcgatcggcgattacgtcctccgacgggttcaaagccaagcagggcgtaacaagctctcacccaagtaggaaggaccattcacgatcacgccagtcttgcggccaggtgcattcaaaattgtagacggcgatggtcgcgagttagcaaattcttggaacattgatcaattacgtaaattttatgtgtaaatcaatagtatccatatttgtaagacatcttacgacttcaataaagttgatttcaggtaaagactacgatcaacgtgttccttcccgacgatcccttaccacgacgacacctagcgttgaaacctatcctcatgtccctttacgccgtcttgacaaggcctctgaggaacctaagggaacttcggctagggacgctcagagcggataaggccttgtcggatcatgtagagacaaacgaccatgtaagatctggtcatgtaagagttctcgccattcgtattaaccaagccgtgtaatcggaaactgagttttccaacttcacggctgggggctaggatcaatgatttttcaaccaaggcaagtcaagggtccaagagccttatcctccgagaacgtttctccgacgacaaagctgggggctagggagagtgcacgactcaagtgactgatcgaagtcgcgaatgagagaacactcacacatagcacatccagagtaagaaaacttagttagatagattcattttctatttcacaagtacttcttacaattcataattgctccaaaatatattacatatctccttgaagataatttttataggatacaaagagtaccaggacggccaacgccaatccatagactgaaaaaccttctcggcgagcggcgccatcgacttcgccagattgtctatctctgcgggagtcctccgaaaccgagaaaacccttcgtggaggaactcgaggtgcagctacgggcggtggtctcggatacaggccagcacgtgccctccggcatatcggctcgaccgacgacactcctgctttagggcctcgtcgatgcgcttgccgatgccttcaagctgagcgcaggccccattcaaccatgagatatatccggtcgccgactccatggggttcccgcgaggtactcaaagttccctgcagactccagccatggctgtaccacagctcctgaggtacgagttgaaccacacctcgcgacctcggagtgcttccacggcttggtcttttttcacttccaccacagtcctctcgagttcggccacctcgaacttcatcctccaatattggattcgacgatctcggtcggccaacgcaccctcgaggtctgctcaacacggaaatgactaagtcaagtcgttctcctctttcgagaacacggcaaattaagtcgatccgaacaaaagagtaaatgagatgaagaccaaagcaccaacctaaggaagtcgtcgccatgcccgcctccatgaacaggctttgatcgacatcgtcccgtggcacgtacggctcaagcgcaagtgcctgaacgactaccggcgactcaggctgcccgcgctactggacatcctcgatatcgacatctctacaacaacaacaaagtactcggaatcaacatgctaaagaaaatgaaggaaacaactgcatacacaaaggcagtttgaacctacgaaagttttacaagcataattgattaaggagtaccagggaaataaaatcctactcttcaaaaagatggagaatagactctcccaagtcatcgacttctcccatcatgtccttgcgcgcgtcattggcggccccctgatccagaatcctctggaggtcaaggtcagggtacgccaacctcacgcacgcgaggacgtggcacgccccggtatagatcccattagacgtatcctcgccgatcctggctgcatgcttggaggggatctcatccatcgccacaaccagctccacgagtgaggacgtcagcgagaactcgtcgagagttgcgggatggtggtcgtgacccacacttcccgccgaagttggtgtagggtggtgtaagacacccgcagcgagccgcggatctcggcgaggttgttctcgaactccgacatcnggtgctcgagcccctgccgctacctttcgttgtcggccaccacttctctcatcttgaggaggtcctcgtgggtctccgaaaaatcgcgcgccagctgctcagcgtgttgggttactgacaacgctgccgccctggcttcctcgatctcgcggccgacgccgcaagcaccaacctggaggatgcgctccatctcagcttggagctccctccaggtgagggcatcaacaggtgggccccgagcgggcacaagatcgccagcgggtccactcggcgtcgcctcccggtccctagttgtgaccacgacatccgtcgaagctgccataggtgacacgctggatgtcgcgccggacccgtcttgcgccgccttcgcccgcgccgccctatgaaggatttccacaatttcatgaagacaggcaagcaagagtttgcgaataggatgacttctaaaacatctacttacttctcgccaagcgtcaccagcctttgccttcactggggcgggggagatgcatccgaggcctaaacaagatagcacgatatgaggtcaaaatattccgactacatgattaagaaacaagagaggcttaccgacggagtaggcgctttccgacggtttccgctttccgacggtttccgagtacagaggagaacttcctccctttcttcggaacgttgctgccactcgttgtagcagcagcagcagcaatgtcagatgcctccttggcaacgccctcctttaacgacgtcgccgtctggtgatccgcgagcggcccgataacgtccgtcagagggagagcctgcgtacatgaagttacaatgcgatcccaggaaagcttaagtaaggtagccatcgagtacacccacgttgattgcagcctcgcgctcggccgtccccttctcgcaaagggggacgggggcattgctcgccgttgtagggccgctgatcattacttgactgacgcaacactccactgtttcgctgttcaaacctgtaggatcgagaaccagaactcgataagtcaggaggaacatgcacataaagaatgaaatctgaaatacaagaaaaataccccgatgagaaacccaggtcgtgtcctccggcccagaataatcaaaggccgggtgggctcgggcctggagtggttggatccgcctactgatgaagtcggtagcgacttcataccccgacaaccctcgtattcggaggtcatcgataatgtcgatgaaagactgaaaggagggagttagggcgggtttggcggtccactctgaaatcttgtctggttgctcctcagggacaacaaagactggatccgagttttctatctgaagatagaaccacctcgcccgccatttgctacgagaagaggggcactggaaggggatgaatcgcgacttcaggccatcctgaagtcggaaaccgacacatccagataccttttttggttccatccagcgcaactcatagtaaaagcgaaagagatcaacaaatggctctaccccaatgtaggcctcacaaagacaagagaagatactgaggaaggcgatggaattggggttcagatggagcaaggaaaggccgtagaaattcaagacaagaagaagaaactcggaaggcggaggaagaaaactgcaaagaatataatcctcaaccgcaaccatgcggctcaagacaggttctggttcagtacctcctgtttctctctccatggtcccgcgaccagggagggcaccgtcgtcctgcagcttcttcagggacgcattggtggaggtggacttgtcgagatccatcaccgccggagatcgttggagaatagaccgagatgagcaaactagggtttttctgcggaagtggagaagacaaggggcgcttgaaggctggaaagttttgcagcaaacggtcttcaaaatggatccccaaaactcccttaaataagcgcactactgacggtgtgaattccaaggaaaggagagagatggccgctggaaatttctgggtccgttacgcgcagcagttttcaaacttcaatttaaattcactcatgaccgttgaacttcgtgcaatgttatcgataactctatgtctctacggttatcataccgagatcgaccagttgagagcgataacgattccgacatcagaagtcgcgattggtcacatgagtttatttaagcagaagtcgggtgctactgtatcgtgtggggtccgatatctccgagttctacttggagatcaactgacctgcggtataaaagggaccccctgggaggacctaaggcatcgaatctcaccaccaacacacccaccacagcctacgaagtcggagcctacaggatctaagtcgccgggtgatctagtcgaaccaactcgactacggtctcctcggtatcatcgagttttgctattccctttgtaatctgtggtttttctcatataatccataccaactggattagggctattacctatcaaggggcctgaaccagtataatccttgtctttttgtttgcttgatgtcgtattacgtagatcgtcgtaccagcgtaccccaataccctctatatccagtctaccggtatcccccgtcgacacac

SEQ ID NO: 72163 - DNA, 16161 bp, Oryza sativa
taaaataagagttattgctagatactccctccgtcccaaattataaggtctttatctttttacacggttttcaatgatatattttgatcattaatttattctatgttttgttcccaacaaatatgaaattagcattacatgaaagtactttaaattatgaatctagtgatataacatgcataatacttaacatattatggttagtataattattagtcagaaataccgagtttgattttccttataaagagggcggcctataatttaggatggatggagtatgctataaggtcgaggccctgaatcccctgtaagtattaatttctacattaacttttgagtaaaatatgtcgatagtaccacaactcgtgatgtgggtgtaatttagtgacttatcttttaaaatgctcaaccaagttacttatttatttatttatttatttttttgcaaatcacataaggcatgtgctttgtggggatatcgaggggtgaaaatttttggcgtgtcacattgtatatacggacacacatttaaaatattaaacatagactaataacaaataaattacagattccgcctgtaaactgcaagacgaattttttaagcctaattaatatgtcgttagcaaatatttactgtagcacaacattgtcagatcatggagcaattagtcttaaaagattcgtctcgcaatttacacgtaatccgtgtaattagtttttttcgtctatatttaatacttcttgcatatgtctaaacattcaatgtaacagggtgaaaatttttaccagggatctaaacaggccataagttggatggagtattggtttcttttgccaacatggccagacacgatcacgaataagtcaactctaatgcgagtgaaaatttaagatgaattttattattgctctctaactttattgaaaacacacaagtagcaaccagcatagatgaactagcatcgaccaattggggtatcaatagccaataaatgccgtacatattgaggtgggctgagtagtactactatgagttaactagtaaaaattaagagtaatagcgagtacaagagcaggctataagttagctgtaaacacatatagagagaagagaagagagaaaaaaagtgggctttagatttgtagtcagctgcagcacgaactctaatacgttgtgtgtgtacgagagatgggaccatatattaatggtgtagtatatgtttataggtaactattgtatgaataagctattagattggctatagataatttgaagatattagttggctatattattaaacttgctctaaatgtatcagcggtatcctctcttactaatagttatatcccactaattcctaatacttaacatgcaaagatgccacatcatcatccactatcactaattcctaaaacttaacatgcaaaaatatcacatcatcacccactaacaattacggacaaggcatacctcatatcctacgacttatgaaatatacggatacaacataccttcgtgtgtacggtatgtttccgtatacaataaagaaattagcaagagattgtggaaattatccttacgagtaagtgaatagtagagtcctactcggagaggattgggtctactatagtttacaacctggagcacatgaagcctacacgccggaagatctcgtcgaaaccatctcgacaaggatctcgccggtaatctcgggatcatcagttcactattgtaatatgtggtatttccatatcaatctcatataaactggattagggctattaccttacgaggggcgtgaaccagtataatccttgtctttttgtttgcttgatgtcgtatcgtgtagatcctcgtaccaacatacccccaatatcctattcatctgttttacgggtatcccctgttgatacctatatacctatatagttcatcctcacttagttcatgttatttttcttctctcattaagccaggtcatctttgttagcccttagatgaatggtctaaattatcttcctactttctttctcccataaagccacatcatcttacttttatatttgaattattattatatatacaatgcaaatttaaatcacatcaacttatctctactactttaaaatttcgtagtggtgacggtaactccaaccctgacatgcacgcgtaaagacaaccatcggatcgccagatcgaacggcctacatttcctcgctcatcccctcaattgcggatcaactcgcccctccctactgctccgcctccctcctcacaaccgcatgtcgccgattccctgccgcatctgctcgtcgcccctcacgcccagccggccactccgcccagcgccgtctgccgccgaagcccgtcgccatcgcgtccggccaccggcggttgccaacccccacccctggcgactactccgccgtccacgatttgtcgcagccgcccatcgtccgcggccacatagccgcgcgatccctcatcactatatccccgtcgcgccgcctaaccatctccagatcaccacgacgattcctccagattagagcgaagagctgctccccatcctcggctcctccgttgggaccgagaagctatgtggcgaacctccaaccaagcatcgccagagaggacagagctggggccgaggtggggagaagaggagcacacgccggtcggcccgtccgtcactgccactgggctcccacctcccgctttcgtgccgactgccgctactcttccggattggcagagcccaagcagtaggaggcaccgacgaaggtgatgaagacttgagatgaggcagtatgcaggcttgcaggtttggacctcttccctctgatgttatttcagtttgctgcggaaatccatgtttaattgaagatcctttccattaagagatgcaaattaggtgctaatttcttcagggcacccttcttgcagcaggaattgctcaaatcaggtttgtctcgattgctattattacctactcttgtagtcttgttcatatcttgtgactgaattcagaatgtaatattagatgatcgattacttcagtaaattttatgttacataactgattgaatgaaggttgtatgtatatggtggaacatgggttgttccaagatgaacaactggcttacttgctcagaagattatcaactgagattctcaccaaaccactgtacttaacatggagaagcaaaatattttaatgctggcctgaattaacaagctaaacacaagcatgcagtattgttctttgtacagtaagctgttatgaattataaccctgcaagctaggtgggcaaaactgatatttggataggttcaagaaaatgcagtaaaatatctgaaacatacgctatggcaatctgaacagatatgcatatagcctgattcacaagcaaataattaatctgaatagaaaaacaagtggtggcaataaaaattcagagatggccattccctcttatacatgtctgagaaaaaaactgctaattaattcaatgaatacaactacggatctgtaggttgaactttgctcaatttatttgtctagctatagctatccttaggcttcctttatttcctatatacaatcctgtagatttctaacttacatatactgaaaattagtagtcatgtacttctattgtatcttgcagcactcaaagctcgtgagtcatgaatacacactccgctgagtgaacattaggagtcatgtatcttgcagcgggtgcaggagcacatgccaagttctgacaagtacatgtaaagttcttcttttattgaacaacacttgattagtgcttactaatcagccatgtagagttatgtaatcaatccttttgttttccttttactaggtttttgagacttagcctgagagatgttccaattatgaataagttcatgatttaaaaccgacctgatgtatgggaactactatagaagacggttccaattgtgaataagctcatgatttaaaactgatctgatgtatggaactactatagaagtgtggattaattaaaattattggcaactcaggccttcattttacatttttaatgtacgctcgatgacaacagaaaattgctggtgtgcgcttactcgcaggcttacattggtttggtttagaaaaaaagaactcatgtgtgatggatgatgtcgagcgctgcaagggaatgacagtgtaagggttgaaaattgtttctaagttggatcaaccttcaaaaaaataagtgaggggtaatatttttgccaagcttaaagattgaatttgatccatgtgacactgtcttcaaggtaaacatgatttctatttttaagattgcattttggtttgcagtagacgtacacattataactattgttttacttttagttcatccatgcttattaaagctccatttatgcatacagaatctgtatttttcgacacctccccccccccccctctctgaaaatcaggtatcttttgtatgcaaatatagtgagttagaaagtttcgcaaccatataatcatattagagttcagaaccatatgaatcaaccataaatgatggatggccttagtagaatagtatgtgtgccgctgccatccaattaatttttgtaccatgccaaattttaggtatgcacaatgattttaagaaagtcaagattcacaaaaattgcactccgtacgattgtaaaacacaagggggaagtgtgtgcttgttcaggtaaagtaatttcataatccttgtgtggattctggctatttgtgctgaaaccatgatcagatggaaaagtaaaagatcgaaagaagtgaactataaactgaaattttgaacttcaactcctttgtaagatgataaacccagagcccggaaggtatcacctaactctggtgaaaatgccatactcttctatctccatctgtatcccctgcaaatctgcactgcctggcccttctattcattttcataaatatgtatcagagtttagaaatagctaaagggtgaattcatatgttgaacttctctcttgggataacaaattagtttatgccatctggtgggaaatcttttcccctcctaaaactcgtttatgccaccatcaaattaaagaagtgtttgtccatgatgagtcctaaaatttctaaaagagttatatttttcccgttgcaacgcacgggcacctaactagtgtaacttatgtttatatcagactatattgttcaagctatcttacacattatttttacttattgttattaaagtaaactgccgcaacaacgcgcggggtttcacctagttgttaagaaactaactacagggtgatctcatccatataagatgggatcagcaaccgacggcaaccgtgccttctccccactcggtgctccttggaaacgggcgcgatggttcctaaccattgcgtctacggttgccacccctttcccatctatatgattgtcccgcattgatcaataaagtaatatctttgtctcgctcaatctctctcaaactttctataatgcgctatcagcacttccgctctctcgcgaaggagaaagagaaggagaaacaaaagggaatcaacagagaagatgtctaaggatattgttccgattggagaggaattatgtcttgtggataatggtaccacaaactctatatttagggagctcaaatactttcaaactctcaaaaaagagagaaggcaaagttttgaccatcgctggatgccttattgtgatagttggctctggacgagcaactattacattcccaatggatacagaaattacaatgccttactgtgtcctgattcaacccctactgagttatagagatatccatcaaaatgggttccacatttttttttgactggaaatactgccaggactttgcctcgcagtgtaattttataaaatgaaaaggttatttacaaattacagaaagaaaacaaaaaaaaagatcaaggtatcacactgtctgtaaccaatcagaaacaatctgttttagtggatccttcattctgcacaaatgcagaagaacctcagctctgaataaagccctccaagaactgaacgagggaagctcattgcgaaaaattttcccattcctttgcttccaaatatgccaagcagcaatgaagaaaacttccaagaaacctttctaattaaactgaatgcgagccaaaaccaccatttgaaaaaattctaggtcaggattccacgtaattcccaaatgctgccagcaaagtttactaaaagggcaaaagaaaaaaagatgctctcttgtctctctgatattattctggcataattcacaagtgaggtcatcattttcctttgcacaatgtcgcctatccagcatgtctcttgtgttaagtctgtctctgaataaaagccaagcaaaaactttaatcttcattacacattttgttttccagatccagacaaaaggcctaggcacaaaatgggttccacattgaaacccaatatgtataatcgagaagaatttcttctataaactaaacaaaactgatatggaaaacacatttgcgagaaaattccgtctctcacatcgggattgtactatacatacattaagcctgttgcacatggtgcatataaagtaatttttcaaaatgttgatgcattctacacttggcatgatcgacttgggcaccccggtatcgagatgatgagaaaaattattagcaattctattggtcatcatttgataactgaaaaatttcccaaatcctctgattttgtatgcactataggtgctactgggaaactgattttgacaccttcttctctcaaaatagagctgagccacttaaattccttgaacacattcaagagaatatttgtggtcctattctgccaagatctggactgttcatgtactttttagttttgattgacattgttggcggatggcatgaggcccttcaaccaaacctgccgaaacccatggcgaaggctatggagcaagaacggcgcaaggcgaagagtagcgccaggccagaggcgtctcaggcgaagggtgcaaggcgaagactgtctgccgaaggaggatgacttcgccttgacaagttcgcccccgcgagggccgaggaagcctttccggcccatcaggccggcgatcgccagacggcccatcaggggcccatgagcccctataacattatgtacccctgtaaatgtctcttctgtaagggtaatcatgtaaattcccctgtacaacctaaaccctagtagtaagaacctgtaatggggctataaatagtcccctagggccatgtaatggggggatcccaagtgaaattcaaaatttagtacacttcatttttccaaccactgttgagtaaccacgtcttttgacgtatgcagttgtcgtttcgacaacagctggcgccgtccgtggggactccgagcgaaaccactgagagcgaatgccactgaagagggtcgtgaaggagaaggttgtcaggcggaaggagagcgatgccggaccggacatggccgccgaggaaggagcagagccttcggcgttcgtggccgaagatggagaagcacaagcgccatcacagccgccttcggcccccgcgccaccacaaccgtcttcggcccccgcaacctcagtgcaagtgccgaacacggccgacgtggcgaaggcggctgcggcgggaaggacactccagaccaaggtggagatcctttcgactaaccaactggtggtgcctcaagccgccccgtcgcagccggcggcgccaattgcgctcaccgttgtacaggcccaaatcagcctggaccccgaagcgcaagccgaagccgacatggaagccatgcggcagaacatgacatggctccaagacatgcttcgccaaatgcaagaacaacaacaagcatacgaggcgacaaggcggaccaaggccacgtcggctccaatccttcagtattcggtaggctatgccctacctcaagtccggccgcaagtggtgacccatccctctccgccactagccgcatagccgccggtgtacttcgccgggtagcatcaaccacctggccaagcgccacaaccagtggcggaaggggcttcggctctgcaggcgcaactccaagctttccttcagcaactcaaccaaccccactacatttcaagcacaaccccatcggcttacccggtggggaatacaagtcaaggtgtgcccaattggttgccaccaattcagccaggctcgggaccttcgccgtggagtcaaggaccgcagttcgacttcgtcaacactgctcaggtgccaaccgttcggcagcaagttccaaccccaggcttcggaacaaacaacgcaccaatccaagctgccatgatgtggtcgcagccaatctttgaccaatccatggcggcccagcaagtaccaccagttggagccgggcagtcgaatgccacggcccaactccacacacaagctgtgatttcgcccttcgccacaccgtaccagtaacaaggtgcggtaaacagggcgggaggcgaaaaggggctgccgctgagtgggggagtcaagactcgtccaatcccgccccagttcaagttcccacctgtcccgcgttattcgggcgaaactgacccgaaggagttcctctccatctacaagtcagcgatcaaagcggctcatggtgacgaaattaccaaggcgaaggtaatacatctcgctctagacggcatcgcccgctcttggtatttcaatttaccagccaatagcatttactcatgggagcaattgcgtgatgtttttgtccttaactttcgaggcacctatgaggagccgaagacgcagcaacaccttcttggcattcgccaaaggccgggggagtcgataagggagtacatgcgtcgcttctcgcaagcccagtgccaagttcaagacataaccgaggcgtcggttataaacgccgcttcggccagtctgcttgagggcgaactaataagaaaaatcgccaacaaggagccgcagacgctcgagcacctacttcgcatcattgacgggttcgtaaggggtgaggaggattctaagcgacgacaagctatacaagctgagtacgataaagcctccgtcgccgctgctcaagctcaagcgcaagttcaaattgccgaaccacctcccctctctgttcgcagtcttagccggcgatccagggacagccgccaaggcaaggccaagcccccatgacttggagaaagttcagaacagatcgggcgggcaaggctgtgatggctgtcgaagaagtgcaagccctccgcaaggagttcgacgcccaacaagcaagcaaccatcagcagccagcccgcaagaaggtccgaaaagacctctactgcacctttcacggacgctcttcgcacaccacggagcaatgccgaaatattaggcaacgtggcaacgcgcaagacccaaggccgcagcagggaacaactgtcgaagcaccccgtgaagcagttcaggagcaaacaccctcagccgaacaacgccaagatacacaacgaagggtaatccaagtgattacaagagctgacccgccaagccagttgtcaaaacggcagaggaagatgcagatccgcatggtccacagcatcacttcggcgggtgagggggcgccacagtacgtgaaccagctgatctctttcgggccagaagatgccgaaggagtcctgttcccgcatcaagatccactggtaatctcagctgagatagccggttttgaagtccgacgaatcctagtcgatggagggagttcggccgatgtgatcttcgccgaagcatatgctaagatgggcttgccaacccaagctcttacaccggcaccaacgtcgctccgggggttcatcgtagaggcagtgcaagttcttggccaagcatttttgctgatagctttcggctcgggagaaaacaggcgcgtagagcaaatactgttcgacgtcgtcaacatcccatacaactacaacgccatcttcggccgtgcaaccctgaacaagttcgaagccatttcccaccacaattatctcaagctcaagatgccaggcccaacaggggtgatagtagtcaaggggcttcagccttcggccgcttcaaaacgcgatctagccataatcaacagagcagtgcacaatgttgagaccgaaccgcatgagcggccgaagcacacaccgaagcccacccctcacggcaaggtaacaaaagtgcagattgatgatgccgaccccacaaagctcgtatcactggggggcgacatgggcgaagaagaagttgagagcatactaaaggtgctcaaaaagaacatcgatatcttcgcctggagccctgacgaggtgagggcgtcctggcggatctcatcatgcattacttagcagtcaagccgaatattaagccaagaaaacaaaagttgcgcaagatgtctgccgatcgccaagaagcggcgaagaccgaagtacaaaaattactccgggcgggggttattcaagagattgaccatccggagaggttggcgaatccagtgctggtacgaaagcactgggagtccagcgcctgctaattcgaactgactccaagttggtagcaggtcatgttgacaaatccttcgaggtaaaaaaagagggaatgaagaggtatctggaggctgtccggtccatggaaaaatgcttcaccggcataacggtcgaacacttgcctagagaccagaacggggaggcagacgccttggcgaaatccgctgcttgtggtggcccacattcgccgggcatctttttcgaagtcctgcatgctccaagtgtgcccatggactgctccgaagtcatggcaatcgaccgggagaaacggggcgaagacccacatgactggcgaaccccatttgtgaaacaccttgaaacaggctggcttccggtagacgaaacagaagcgaagcgtttgcagctcagagccacgaaatataagatggtttcgggttagctttaccgcactggggtacttcaacccttacttcgttgtatctcatttgccgaaggcgaagaaatggcaaaggagatacaccaggggctatgcggcgcgcaccaggctacaagaacagtggcctccaaagtatttagacaaggagtttattggcccactgtgttgaaagtctgtgttgagcaaatcaagaagtgcgaaagttgccagcgtcatggccgaagccaagccatgccccagtatgatctgcagcccattgcgccaatatgacccttcgccagatggggactggacatcattgggccgttcccagtggcgcgaaacgggtataaattcgcaattgtagctgtggaatatttctatcgatggattgaagccgaaccccttggggcaatcacttcggcagcagtacagaaatttgtatggaaaaacattgtttgccacttcggcagcagtacaaaaatttgtatggaaaaacattgtttgccgtttcggagtgccaaaggagttcattactgacaacagcaagcagtttgactctgataagttcagagaaatgtgcgaagggcttagcctggaaatcaagtttgtgtcggtcatacacccgcagtcaaatggggcggccgaacgtacaaatggcaagatcctagaagcactgaagaaaagacttgagggggcggcgaaaggcaaatggccagaggaattgctatcggttctctgggctcttcggacgacccccacaagaccaaccaagtttagcccgtttatgcttctgtatggcgatgaggcaatgaccccagcagagctaggggctaactcaccaagggtgatgttttccgggggcgaagaaggacgcgaagtatcgctcgaactcttggaaggagtaagagtcaaagcgctcgagcacatgcacaagtacgccacaagcacttcggcaacttacaacaaaaaagttcgacccacggagctcatacctggtcatctcgtcctaaggaagaaggcgaacccagtagcagttggcaagcttgaatcaaagtgggaaggaccatacctcatcaagcgcaagtctaggacgggatcttttcgcctagcgacactcgaaggcgaggagttcgaccattcctggaacgccgcctccctcaagcgcttctatgtctaaattgggtggcacccaaatcgccaacttgtaaaaatgtacatactgtcatgtaagcctttcggcactatgtaagactttcggcaagaaaaaaaaaggagaaaaagaagaaagagagaaaaagaaaaaaactggatgtagggctattatccaccatggaggcccgaaccagtataaaatctctgtgtcctccgccttcttcttacttttcgtgtgattgataatttatggaaaaaccccaaggcaaacgcctgatcagcgaaaaaggccaagggggcgaaacgaatcggccgaagcattgctcgccgaacgttgaaaccgcaatagcttgtctcggaaataaatagccgaacgacgttacgaccgatcggcataaaagcaaaagcgtttctctcgacacagaacgctacagatcgaaaacaaacgacgaaaagctgaaaagtcagtacacctatttcgctaatatatgcaaaggggccggcatgttctggcctaacaaaagcacaaaatgtgacgatgcgaaaaatagcgaaaaggaaataaagcacgttctttattagcttcgaaaaaataatcgaagaatacaaggtttacaacccgatacaattcattttacaagtaaattacattttcaccccagtaatcattatccctccctaaggaatggttggacgaactaggttcgtcatcactactaatatcatacacaaccttaagaggagtagggggcgaaacacagactaaactgtaacgacgctgagagatcgattcctggcgtttagtcttctgatggtttcgccaaaagcgagccatatcttccaaacgtcttgagtgaacaagatcgtaatcttctaaggttcgcccggggtgcgcacgtagccagctggcaaccttgataaccttatagctgcgaccgtttatctccatttcgcgataaacaggccgaaatggatatcgcgtcttcggcagccccttcaatgccacaaatttctcgttttgactttgccagctcccaaaagggggccgaatgcatgattttcggcggaccccctagtagacagtgcagaaaaggcaaaacacatcttgcatggtaagagtaggcgaaagaaggggaaggtatggcataatgtgaaacgagtaaaataaaaatatgccaaaaaagcataccaaaaagccttttttaaggttcgccacatctagcgaacaccaaaagaaaactatgaaaatctaagagaagggcggagggccttacacctcttggtggttctgggcatcgcctccaccccctccggccgtcgcgccttcctctaaacaaaggtccgccgcctctgctttcgccagctgctccaaaaggcgcgccttagcggcggagctgccgtccttctgccaaaattgttttcgccacgcacgaagtgcaggcgaaatgtcttgcgcactgatttcccaatcccccttcgtgtacttagggaactcggcgatgtgctcgcagccgaactgctgcaggaggcccatggtaaaggccgctgacacgcgcgcacagcagtcgccgtacgcggtggcgcagtccgaaaccgatccaccggcctgctgggtctactccgagaagtcgaaggctgaggcatcctcggtagggaccccgcgcaccttcgcgcccatgtcggtaagggcgaggcggagtgtttggcaagccgttctcgcagattcggtggtcttcgccatctcccgcgaaaaccgccgcgactcctccgcggcgctcgcttcggccctgctagccttctggcgaagagactgcatcttcggctcagtaaggttgctcgacgaccgaaacatcgccgatcatcctgcgggcttcggcttcggcctggtcaaagggtcaacactgtaaaagaagagtgtgaagctatgtcaaaagtcaaataaggcgaaataacaaagcacagcagtatatagcaaaagaacagtcttactgttcgcccccttaggaagtatcaggttcggcaaaccgttgacctcttcgccttgttcaaccgcgacttgccatgactgggagatgggaaaaatgcgaagcatacaaaattcctccaccaagtcacggtagctaaggcgggagcaaaccttccgcagtagaacgaaccgcgcctccatggtgccgtccacagcaatcttgggtctccggttcggcgcaatcgccctgcgccggcaccggagggctttcgccaattcagaaccagcctagaaggggatggtgtggtagaaccacctcgccatccaatggcgatcccacttcgacatggcagcgttcatcggccagagatcggaccgctcggggcgaacgttgaagttcacgctcccgaacactgtttttttcgttccagccggggtaatcaccgtcttcgagttcacggtggcgaaaaatatggcgccaaagagctcggcgttaggctcaaacccggaagtccggcacgcccagtcgaagatagcaatccgaacaagcgccgacgggctcagctgcggaagttctacctagaagaggcgaaggatttccggcaacaacacgttgcagggaaaccgtagccctgcctcaaaaaatacggcgaacaccactgtctgattgtcgacaggtttcggcaccacggttttccctggggcgaaagcctgccccttaaccaacgctccggagctgaccagcttcgccagctcgacgtcgtctacaagagagacccccagaaaggcggtgctgttgtcatcgactcggccgggatctggccctttcgccgaagtaggatttggcttacgtggggccatggtgaacggtccgtttgcggtggcgaaaaaagagattcgacgaaacgcctgaggggtcgaaagatgctgtgaaaggaagagacgaaggaagagagcgcgcacggtaaaatggcaagtggggcggtgaaaaggaaagagcagcaggaatatatagcccacccaggcggccgttcgcctacccaccagtaataaagcaccacgtgtcgcaagggtaggcgaaacggtaaattcctatcgaccgagcggcacagtgaaaagcccacgatataaaggcccaatactgttccattcgacccaggaaaaaataatatatataaccatcaatcgcaggaggcgcagcgcggcaaattaataccagccgcacaaataacaaacttcatttgtaggaataatgtaggtttcggcaggagcatcggtcgaaaggggccgccgcataccataccacatggtttgcacggtctcggccgaagctccaatttcacccttgcccgtgaggggcttgttggcggatggcatgaggcccttcaaccaaacctgccgaaacccatggcgaaggctatggagcaagaacggcgcaaggtgaagagtagcgccaggccagaggcgtctcaggcgaaaggtgcaaggcgaagactgtctgccgaaggaggatgacttcgccttaacaagttcgcccctgcgagggccgaggaagcctttccggcccatcaggccggcgatcgccagacggcccatcaggggcccatgagcccctataacattatgtacccctgtaaatgtcccttttgtaagggtaatcatgtaaattcccctgtacaacctaaaccctggtagtaagaacctgtaatggggctataaatagtcccctagggccatgtaatggggggatcccaagtgaaattcaaattttagtacactttatttttccaaccactgttgagtaaccacgtcttttgacatatgcagttatcgtttcgacaacagacatatctactagatggtctaatgcgtgtcttctatcgacatgaaaccatgcctttgctaacgaaatatctcaaattgttgattgctatcaagttgatccagaacctaactctgactagtgtggcagcattatttggtcacgctggtttggctagagtggtagcgctatttggccacatcaccctcgccgacgtggcaggat

SEQ ID NO: 72164 - DNA, 10919 bp, Oryza sativa
ttttagtacactttatttttccaaccactgttgagtaaccacgtcttttgacatatgcagttatcgtttcgacaacagacatatctactagatggtctaatgcgtgtgttctatcgacatgaaaccatgcctttgctaacgaaatatctcaaattgttgattgctatcaagttgatccagaacctaactctgactagtgtggcagcattatttggtcacgctggtttggctagagtggtagcgctatttggccacatcaccctcgccgacgtggcaggataaaactgttacacccgttatgtgtggagtgtcaatgttgttttgtcacgcaagacggactggtgtggctaaaaggttcagattttataaataagttttggaatggtttatttttaaaattaaaaaaaataaaaggttcaaaaaaataaaaaaaaaatctagcatgtcctatgccttcttttttttttgaggtgaacctcaaaagaggacagggagttcttgtttttatttaagaagaagagaggtggcccagtttttagggaaaaccgggcccgaaaacctcacaagtgcgcggttaattgagggaaaccggccaaagacccacacgaggaacagaacaggacacatgcagcagcactactaaagttcgaaacaaaagtcatcgttgccaagctcagaggagcagctccgacttcttaagaacaaactacgaactaggcgaccacaaagacaacgtagggcagggtcttctagacgaagcctccaaggagaagcgtcggagacgcaaacaacgtccgtccgagaatcggaacaaagttttcacctgaagaaaaggagagcaagcgacaacgccttcaggaagggaatggtgcccataggcgtcgacgttatcagccgtagtccaagaccaagtagggctttcacccgtgctctcgctccctgacaaccacgaaaccaaggccgccacaatgcttcacaacccttagacgcttccaaggacgagataagggggttatcattgccgagcttgccaccgcaagcagctccgactccaccctagctcaaccacatggttgcgccacaagagcttcgagcaccacacacctcactgctgcaaggactttgaaggcactgacagagtggacggtctcccgatcttcaccaagcagaaccttccaacctaacctgtgtctctctccttaacatggggcgccccacgactggagtaggccagtctaagaagggaaggggctccaatggacaggaggagggaacaacagccagttgggaggaaccctcgccgttgaccaggacaatgaccacactgctgatcatcgtgtcccacggctttccaacaagcagaactgcagcaaacgatcggcctctccaagcggcgactccacctaacggcacctgctgcgcctatccggccatcttctttttcagcctctccgccggccacctctactagcaccttctgcctgcctcccccaacttcactggccttccccaactccttatggccggcctcctccctccgggcatggaggcgaccagattcggcataggccggattgaccgcctcctccacctgccggctgccagcttctcccaacagccggccaactccaccaccacgcctcctccaactccactcccgctggccttccccttctggatccaaggtggaggcggccagatccgaaaccggttgaccgccccctccatatctggccacacccacaccgccacacgccgattacaactcgccactgccaactcttctcaccgcctcctccccgccgctgtcgctggagcagctcgccgccgggacgccgcagccgccgctaggacgtcgtccctcatcccccgcgcagaagaggactcgtcgcttcacggctgcctaccccgtcgccgccgtccttgctcgccgagccgtggctcggccccgcttgctctagcggtggcgaggtggaggatggaggggggaaagtggcggcggctagggttttttccgcccgcccggtcgcccgcgatgggagcgacgcgagcggggaaagacgaattgtcctatgccttctctttctctgtttgatgtcgttctattttttttgttaatacatatatataccttgatttacgtgcaaatcgactagtaagaaagaaaaagccagtcactcgataattaaggctttctttggcaaaactctaaatctcatatcacgatagatttaaagtttatacgttaaattatagtggttgaaaatttaaaattttattaaaatggtaacaaaataatttatctaaatgctatcaacgttatcacgaatctaaaatctatagaattgcggtgttagaaatatccaggtttaaaaattttggatgtaaagtttgccaaagatgacctaaatagcttctttatatttatcgaggagtgtacgttccgcacatgccaaacctctttgcaaatatttaacctgataatctcgctgcatgcacgctgcaacttgcatgcgacgatggtgtttgagatatattaagataaaaataaagttagcacatgtaaaacaagaaagccactagcgcatgatgatcaaatgaggtataattattttaaactctaaaattgaatttatctaatatttttaaaaagttttaagtagaaaatttttatatgaaaatatcgtttatcagtttagaaaatatgcttaaaaaaaccgaggtaagatgtcatgaatccctggattgcgaagtacatataatatgatatatcacgctgcatttgtctaatcgttcgatggctcgctcaaagccatatcgatggcgacgcacagcgcacgcatgttttctcaatcatatatacggtttggtttgtttgtatctcccacgtgtggatggcaggatcgatcgtgccaagaattgtcagtcagaggtatttgtatgggtcaaactgaattttgccgaaagcctctttttagacgcccgaattgaaaaggcagctagtccaacgcttcacacttgcaggtttcaacgtgttaaaagtacgacggaatcgtccgtatcgctaaacaaaagtatgtccttttctcgtaagtttaaacttttagatgaatcgattgatgcgagtgaatcaatacgatgacttttggtcgagataagagcatatatatagacagtcattaatttagagttgttattaatggagaaaaggatagctaaaagaaaataaattattagttatattcactaagattgtaggagtagatatatttaagtcatatttaaaaaaaatagtcaaatcatctttaccctataacttacattatattttttggtatttacattgtattttattatctccttgtaagaggagatataagagatcgaaacatacttatatcatatataggaatagcaatcaaatatttaaaaattaaaattaaataaactttttttggcaaatccaaatattaatttgattcatcaatgaccaggttaattatcttctgaaattatttgcctgcaacgtacaccctccgttccattttaggtgcagtattttgtttttttttcaacgtttgatcgtctgttttatttaactttttatgactagtattttttttattgtcattagatgataaaacataaataatactttacgcgtgacttattttttaacttttttataaactagagaggaagcccgcgcagatgcgcggacaacttatttattctttattaaaataatgttacaagatatttatcatatattgtttaacgacggtagattatgttattatcataaaaaagcatctctaccttgaaattaaattgatcatagactttgatacaataaattaaattaaattacaaaaatgtctctcatattaaaaatgatcactatgtcctggttatataaaaactccctatcacaattattctctcgaattagctaagtgcctttttaagagatagaattgcttattaaaaaataaacttaatataatcatctccatttcatactgaagtggccatgtctcacttgtgcctgaatgtataaacattttaaaataccgcttctatcaattattgagagaaaatcattaaaattagatataaacacttgtctaacgtgtgaagttggccatagccactaaggatttattctctaataccttgaaacatgggtcctgcatcgacgtagccatgcccctcaagattaacgtcgatcacaattttaactcctagctcactatctacaccgttataaagaattgtatcaataagtaggctagttgagctctactgctgaaaggagtcatataggactcaatggactgattatatgtaggaatgtacaaacataacaacattttagttttaaatttgaggattaggagggaaagattaatagttattttcaatcgtatgtgggtatgtatgtttctcctttttttgatgaataatacttatatctggtacgtaaatgagagattatcaggagagactacattaatacatctaatttaatatttaaaaataatgggtctgattaattcaatgctagatgttttgctttttttctcatttttttttatattttctagacatcaggtgctgccttaggatcatttgtagaaattaagagggagtgattagtttaacagatctaatgtaatagttaaaaatattgaatccaccagttttagtataaatcaatcgctagatgttttacttttttagaatttcttagattttctctaatttattagagcacaatgtggtagcttaagattgtttgtagcagggccacgtggcggcgtaggagtgtttgtatgatgttcaatggacttttagaatataacaatgttcttatctcaatgattagtggatagctatacgcacgtagaagtgatacataggtttgagtgtgcacatagaattgacacataaatttaaccattcatgagtcaagtacattggatcttacatactatgtactccaacatgtactccaacctagattaacttaagtttaaagtcgagagactgaagagaaaataatcaacatatatgcctcctattgtctaattgagacatatcgatccggttcatttaatcatttattttttataatcatttaaatactagagatataattatatcaaaataattatctggacgtatctatattaatattattgtgaaatttatattttaaagtggaggtaatattttttatgctaatcacaattagagtattattgcttgcgacattgtggattgctttaaatattaaaggtattattatatcaaaatatttttcatgaaagatttaagtaacattattttattttgtgagaaataataatattttagcacatcaatattttagaacagtggtattatttttgggagtgctaatatcaactaattagagtattttattttgtgatattatatagctaatctaattatgcatgattgtgaagtgatatatgatgatatgatctaatttatctattttattcacaatctttttttttgttgtgatgagatgaaaaatgtcaggatatgatttgaaataatagaggaaatatttttgtttttgtttttgtcaaatctatcataaatttattaatgtatgttttgcaaagtgatctatgatcatataatatacattgttatttttttttctaattttatttaacagcttaatgtgcatgctaaggataggatatgataaaaattaaatatttcttatgagttaaagaatttagtaccgttctaaatggttaattaagcacgatgaatccgataataattaaagaatggtaaaaaggttgtgtaatctaaaggttaagattatttctctatacataaattattcaaaaatattatttttaattgtaagaacttaaaaggagaaaagagaggagaagatatggaaggggggaggggggtaagcaacgtacatacgtacgtacgtgggggtggggaggaggatggactggtggggggagagaggtggactgtgggggtctgttttttctaaaaataaatttaatagattaaaaagtgggcctattagtttattagagagccacatggcagcttatgagtatttgtaggatgctacgtggcagtgtgagagtgtttgtaggaagtttaatggacttttattatataatagatttttaaaataagatgaatggttgaaaaaaaacaaaacactgcattttaaatttaaaatgagacgaaagaagtagtgcatagtgcacggcaatgcagacgtagcttacacaactaaaaaacgatttttctgtataagtacctctttagattgcagacagcccgtaactggtcgcgttaacaaaaatcgtcattcactttcgcgtgcggaaccttaagagggccgcacgcgaaaatcagcaggcaagcctctttaaggctccgcacgcaaaaataaaccaatttttacgagcggaccacttaaggggccgtacacaaaaatctattttcgcatgcagacctcttaaggatcctgcataaagtttacgttccctcctcacacttcaaaattttttatccttatcctctcatcacctctctcactctctcacctcttcttctcacaatatcgctcactctctcactttgcgcagctctcctctctcactctcctcgcgtggccggtggtgggctgcgcggccaacaacgggcggcaggcgcggatggcagcaagcgatgggcgcggacggcggcagacggaggactcggccggcagcagcgggcggctcggtggcggggggatctgccttcgccagcctcgcgacgggaggcgggtggcgcggtcaacggcaggtgactatggtcacgggcgacgacgaaggcggcagctccctcagccctccccgcgcggatccggtggtgggctcgagcgggaggccacggcggctctcccccgcgcggatctagtggcgggcggcacattggcggcaggtgtcacgcccagaaatttagcccaaatttccagactattttgtgtattaaatccctgtccaggaccagccagggtacacaaaacgacaaaacgacaagtaatatacagttccaaacgtaaataaagcgtaaaatacttacaaaagaggcacttagttctcgcaccgaaacgaaagcagcagcagcggaaaagggcgatcctagcgaggcttcagctccactccacaggcaaaactcaactggggtctgagccttggttctctaactccatcttcagctcagaagcactacacttctgaaaagggggaatagtagcaagactgagtacaaccaccatactcagcaagccacaccaacgatgcagatgtgcaaggggatacaaggacggtttgtggttatttgcataaaggcggttgtaaaacattttattgagcaaaacagtaaaaatgttgagtaattaaagtaacattaaatctccactgatcaacgctacaccacgttgaacaggcccaaccaacccacctgaactacagtgcattgagtcgatttattaagatggaactaatcacggtgaatctggtcgaccgcccataaccgcgggcacggctattcgaatagttttactctgatcagaggtgtacaactgtacccacaagacaaagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggacgtcgcagggcccatccaaactccatcacgcccacccttgcctagatgcgtcggctagaggaaagctacgctacaagcccagccgttgcccacgctggcttgtggtaagtacgataagttcttccagggcatcccgcgaaccggtccttaattgccatgggtgcgactagcaaaaccatgcacccacagcccaccattcagtcgcattttagttggataattacgaccatgaagcatggccaaatgtctcgagcacgcagctcaacaagatactagaaaggtctaatactgcaattaccccatcaactgagctagtggtaattaagcatggctaagcatatagttctagctaggtcatcaaagtaacacaagctagacgatttattacccatggttgacaaaggacagatatcaagtaaacatggcacaagcgagcagataggtaaaaccctgaccccatgtaattagcaaaacatgcatatttatttgtaaacagtaaaacatttgtaaattaggatcaacatactcaaggggaatgtgtgacttgccttgcttcttcactttgatcttctgaactcttatccttgcgaacgcggacttccgaaacgacggaaactacacgctggcacgccaaacgagaaaaaaactctaataaaaaccaagaaaacagtacataaaaagtaaacaaacatgtagagctcaattttagatgaattttgcaagttgaatggctcaattcagagttcgaatgaattagatatgaattttagaagttttgagccatttaaatgaatttctagaattaaactcgatttattgcgcaattattatttattttcccaaaggaaaagacggttgctgacgttagcaaaggggagaggcagcgccggcaagcgggccccaccggtcagcgacacaagggcgccggtccaccgtggaccgggaccaccgagcggtccaccgccggtccacgggaaccgacggcccggatcggcgcggctggggcacggcacggctcaggccggcccagccgagcgatggcgcgcggcagcgcggccatcggcgacgacggccggcgacggcgcggggaggagaggagggatgctcaccaagggcggcgacggcgagactacaacggggaagccggcggcgggctcctcgggaggcaacggtggtccggcggcgtaccacgggcgcaggcggcggacggtgaccgggacgaccggggcgtggagagggcgatttcagtggttcccggagacgacgaagcggtggccggggtgcggctcggagttgccgatccgagggaggaaacggcgcagtccggcatcaaccggggaggcggggcgacacagatggagacggcaaacacggcggcgatctcgggttggtggtgaagttggtgctcgggcagcgagaggcaacaaccgagcgtgcggccgagcttgactttgaggcggcgaaggtactggcagtggtggcgcactggggccacggctaggccggcggcggcgcgcggttggagtcggtgaaaggggcggcgtcctcgggtgtgcggtgggagtggtgctcgaggggtggagagggggaaataagaggcggccggacttccccttgcagtggcgaagctggcggtggcggcggctcggcgtggcgacggctgtggcggcgggaaacggcgaccggaattcgccggagtgtgacagcgcgtgggtgcggcgtggggagagcgagggagagtatgccgggctcgggaaaaatggggaaatgtacgaggggagcacggggatgctttttataggctagggaaggcgggatcgagcccgggagaggcggcaaccggcgacggagtggggcggcatcgtggcgggtgtggcggctcggcgtggcgtcgattcccgcggggagagagggggagtgggcggatatgtgtcgcgaggtgaaagggaactcgggtccaccccggttgggacgagggaaggcgtgggatcgccgaagggagtggcggccgtggccaacggttggagctgaccgaaggttggggatgacaggttgttgggaaagaagatgacaggtgggtccttgggtcccacctgtcggggagagagaggggaaaacgggcgagggaggtaaagcagacttgagggagagagagagccgagcgggccgagggagaaggccggcccgagagggagagaaaaggggcgcgcgggccgcgggagagaaggaagacttgggccgaaaatggcccaaagagaggaagggggattttaattgttttctttttattttaattgatgcaatgatctttgtgctattaaaactatttctcgagctccgaaaattcacggaaaattccggagagtacattagggcacaaagaatattacaaaatattcccgaccaatgatttttaaaggaaattttaatttcctctataatttcacttgattaaattgattaactttttatttaatttctaggaaatgcattattaaatgatttttaatcccgaacgaaaatcggggcgttacagcaggcgcgggctccggtggcggtgcagatccagcatccacgcgcgcggatccaccggcgacaacggcgacggcggccagctagggttagggctaggttttgtgttttggacttttttatcgattttctattttcatgtgcggatggcttaagcgtccgcacgcaaaaatcctatttttgcagaccctttagtgccgggtagccatgctgcacgcgaaaaccccttaggccatctgcaatcggtaccctcaacccatgcccttgcaaatggcgtcttctttccgtcgttgggtcgtcccctaggagagaggcgcgacccctggcagaggaacgcgcgtctcagctgcttttctggagccaccgctcgaggctactcgttggaggagggcgtggctcgtggacacggctcccgctccacaaatttccccttccaccctcggtctcatcgctggcagtggggaggagtcggaggtgacggcggcagtgacgaacccgcggccagcgcgacgagcgacggccgccaccatctcctcccagat

SEQ ID NO: 72165 - DNA, 752 bp, Oryza sativa
aaacaaacagttttttcgtttggctttttaaaaccataagccactctaatactattaagccaaaagctaggttggtggaacttttttggcttatatgaggtagatatatgacttcaccactaaattcaggacattaaatctaccggtttataaatcatataagccaataagttgaattaaaagtttaagggcccctttgaatcgcagggtagaaaaaacggaggaataggaaaaacataggattctgacaggaattgaagtgtaaaacagaggattgcaaaacacaggaaaaacacaggaatggtcgtttgattggagcgcaggaaaaacgcaggaatcggatgagagatagactcaaaggaaattttccaagaggttggagctcttgctaaattttctccaaaatctacatgcaatgtgtcattccataggaatttcataggatttggaaagcttcaatcctttgaatcaaagggccaaataggaaaatttcctataggatttgaatcctatgaaatttctacataaatcctttgattcaaaggggccctaagctaataaacctaagattaaacaaagagggccataatacccgatgtgacacgccaaaactttacacccctgaatctaaacatcccattagtggcttataggagaagagtgtgacaattgggccaatcattttatttagaaaaaaaatattaataatattgcttagcatccatgttatgaaaataacgccagcaacctat

SEQ ID NO: 72166 - DNA, 5223 bp, Oryza sativa
atgttatgaaaataacgccagcaacctatctccaagcccgggccggcccggcccgagccttgctccgcgcaagggtaacgtgccgcacgattcccgttttccccgtctcccacacttctcctctctgaccacagcacacacgcaacaccgggacgggcgatccggaaggttctggaaccttctagaggctcgtaggagcctccggcggaacccctctcgcctcgcctcgcctccgatgggctcgaagccgccgccgccgccgcagcccagcgtctccttcaagctcgtcctcctcggcgacggtacggctatctccctctcccttccgatcccgcgaaccctcctcccccccttctcaacccccttttctgccgaattcccgatccttcagtttggggttggcgtgcgcaagaaaatagccacggaatctgggtgaattttggctgctcttgtggtgcgtgctgagccctagctagggttaggggaaagccgcagaatcatttgatctggtaccctgtgtaggtagctaaatctatagcttagacgagggagttgagcggttttgagctaagcttaccttttacttgattgccttcgaggcttagcggagtccaggagatgattagaccgagagggctactcatagaaacaatctaacaagtagaagcatattcgttcttatatagaagatttgtctagtgctagctgcagcggggactgctgcaaattcatgtggacacaaagtggcagctgaagggtggccatggagctggtggcagggaattcgtcttatgcaataggggtggataatatttcattttgatccgtgctctctgtccgcttttaagcttggattgtaatgtccagctgatctagttctatattaattggtggttttacttttcttgtcattaccttaaccaacccttgaaggcagggtcctagaaaaaaaaaattcagtatgactcagctttttggtcatctgtgtatgatgccatgggtcttacccatgttcctctagagaaagtgatgtgtgcctttttggaaaaatgatacagtatgtagtttgggaggagggggttttgatgggaaagtactacagtctttatttgggcatgcttcttagcaagtgcatgtaagtcatacatgggaatgtcaagagaatttttcttgaaaccaggcacgggtgggcattgatctaacatggtacacttgcttttcctagcattgttgaacattgactcattttgatttaggatcagcttacttatagcttagaagcaagcttggaaatcagtttgtgcattgccaaagcggaatcacgtttcatttgaagttggctaatttcaattttggaaaagaaaaaagttggagtagttttgaactgaggcaatgagcacaatgaaagaattttttaccacagtagacagtacttgataagtgatagcgccagcataatcaattgctgaaactctttaaccatgccttagtacttggctttacattttttgaatgaagatatatatgtgtttccatgcataaaagcattgttgatagtcttgtgggcatgtatcttataggttgggtcattagggtttgcttattgttataactttctgtcattgatttcagatttttaatggaagaggtgtttaggctgtcttgtaaccagtcctctgttggcccagcctatcaatgtgaaaactgataaacctaagtttaacttaggatgaattgatcataattatatgctccattttttcaatttcattgaaaagacatgtgattgaatacatttcatatttattaacacaaacaataacttttacttttctcttggcacagggagagtaggcaaaacatctcttgtgctgcggtatgtgaatgatgtcttctcagacaaacaggaagcaactgttcaagcttcatatttgacaaagcgccttgttgttgaaggtgtgcctattacgctctctatctgggtgcgttgtcatctctttgatttgcgataatttgttcaacattttttacctctttcattttctcttatgtcagttgcacacacttgtttgaagtaattgtttactaattttgctgttgggatgatattcaattatggtttcaaatcccacttatatgtgcccttgtatcagaaatcctagtaggagtcagaaaaggtgaaaccaacccaattttgttggattataatacgagattgggaatatttagagatatgtggacttagttcttcattaaaaaaggagtaaatttcatagaactacggatattttgacaaaactatcacagaactacagatttaaggtcaaatttatcccaaaactacagatttaaataaaactgttacatggtttgcttccattatagctaaagtccgagactctgtgtacttgaactcatgaagccaaacattagattgcttggacatgttcagctggcatacaacttgtctacaggtttcacggaaatgggaatgattaggtttattactctcctgttgattgatttgactctcattttgttgattgcctttttaatttaagtaagattttatcagtatggttgtgttcagttttttactgatgtgacggtatccttcatggaaatcttaaatctttaccagaatactgaaactagactttggtcctccttttggttagtttgtaggctttgcttgttctatcaacaaaagtatatttgctaccagtgactgccttctataactgagtaataacttatttccacgcgctggtcacttggttgtctcctttactttaagttcttcctgcaagatttttttagtatttaatttttcttggtttgcaggatacagctggacaagagaagttccatgcactaggccctatatactatcgtgatgcagacggtaatattcgtcttcttgttttgaattaaatatatcgaggtggatcactaaattcttttttatatcttttgatgactgcagctgctcttttagtatatgacatcacagacaatgatacttttcttcgtgtcacaaagtgggtgaaagagcttaagcaaatggcaaataaagatattgttatggccattgcagcaaataaaagtgacctggttagatcaaaacacatagacactaatgaagcagcaaggtattcttctttgttatcagttacaaatactacacagccaaaatatgtaatattgccctggtacttgagttagcaacttagcatcgttagtctttgagtagaacaaaagaaatatatgtgatatatactttatctgttgattaaactatttagatatatcagcatagtttcaacatataatctgcaatccttttatgattgtacagtttcttgaaaatgcgttcttttagttccatatttcctcttctctatctatttcatctaagtaatattgttactacatgtacatctccagctatgcagaaagtattggggcaactctctttgttacttctgccaaagctggtactgggattgatgatatcttcagtgacatagccaagagtaagtcttattgtgttagctattgctttcaattcatctccacatttttgccactttaacaaatactgctttgccaaaacttataagttgtaacattcagctattccattagaatgcggggtcatcaacgatagcatatagtttagttaacaatttcatgtttcactctattgagcagatttcgtttatcaaactcaattgttattcctcagattaatccattgtataacactcaatatttgcgaattccctcttcatctcaataacaaggtgggtatggacccacatgtcattggtatagaatgctgtattcgaagtggctatgttgtatgtagtttgtctagagctattcttgcaatgacataacttgcaataaatggatatgtatgcattcttaatcctactgattttctggacttgtcaccagggaattcaaacactgctaacatggaactatttatttccttttaagctgttgaaaatcgtatgtccctaactgattggtggttttcttaattgctatgccctcactaccgtttgttgtaggattattagagagaagaaaaaacagctccgatggcttgtcactggctcatccaaagaaaggcattttaatcgtcgacgatgaacctgagaaagaacctccaccaaagtgctgctcatagcgagattccaatgcaaatcacgtgggcataatgtcatagaaacctgcaattgatatgtgaaggatcaaatccttgcattaactttgctcatgctcttttggagctcaggagcaatgcaagtgtatactggttgattatttttagcttgtgtaaatactaaactcagttcatgaaattgttgtcaaatatagttgttcgatgatgacgattcgatatgccgaagaagttcatggccctttgtatatctgtaactcacaggttgcttatttactagctgttgttttgagggggttattttgatcatgtgcgtcgaaataattgtgtcgtgttgactgctgagtgtacatgtatcgtggttattccatctgaacctgcaatgtaaagcttccgtcccaattcccaacttcccaatgttttaggaaagtttcgtctctgtcgttttctttaatccctacgaacaaggatgttgaaatatggagaaaaacgaaaagtccactcttgactaaaacattcctaaagttccagcttgtgcgttaggccatgttcaatgcgtagcccagggcgtaccctcactcacaccgcctgtccgtgagctgtgcctctggaaggaggcgcgacccccacgaggggaacgccgggaccgagcgaggagtcgcgctgggtcggccatggctaggggaggagcctgtggacactgctctttcccccgttttcccctctaccctcccctcctctgctgctctcccctcctcctcggtatcatcgcctcctccgccggtggtagctcgacgaagatggatccataacggacgaccggggatggagaagggagagaaatgggcgctcgcgggagcggcgggagctcgcgctgcccaccagatccagcggcggcagtgtagtgggagcgtgtgctgcccatcagatccggtaaccgtaggcggagggagagagaggcggcgatgatttggggaagaggctgaccggatctcgctctgccgcgtcctcatcctgctcgtgctcca

SEQ ID NO: 72167 - DNA, 4681 bp, Oryza sativa
aatgtgcttcatgtagtatagagccactcataccacaaatacatgagacaaacaccccaatgcatggtgtagttcgggtcatgcatagtaatatgcactagttagcatgttgggaaaaaaacatgtttactaatagcggtatgatattttgggcattatatgttcccgacatgataaaaatatacacaatgtcatatgtaggctgctgtgtaggatggtctttgaaatgtgtgtggcaggatgcccaatgctaaggccctgtttgattcagcttaggattattataatctggattattaggagtaagctgaaacaaacagatagcttattatgatagattattataatctataagccagattactataatctggtaagccactctaaaagtgcttattttagattattgggtgactagcaactaacaaacatataataatccagagaaacaaacagctaccagcttattctatgttggcttattataatccagcttatagtaatctagttctataatctagattacaataatcttaaactgaatcaaacaaggcctaaatctcgcagctaagtgtcgagaatatttttagaaacggtttttattgaaggtctatttgtaaaaatatatttttaaaaacaatcaagattaaaaaaaagaagagcttatcactctccctattttcagttttgaccctctcatggtctcacattgtttctgttttgttcctcaccaatataacaattccttctatccttctctatccctggacactagtgcctctcccctcttctcgactatccatagaaaccactgttggaccaacacctcatcttaggccgtgtttagtttcccccctattccctactttacatcacatcatatcacatcaaaaactttcctatacacataaacttctaacttttttttcaaactcctaactttcttcaaacttccaacttttttcaagaactaaacacacccttagtcgtctagatatgcccgacattacacgctagccctgtgttcggatttcagggatgggaactcatccctcccacatgaaaaacggaaagatctattagcacataattaattaagtattagctaattttttttttcaaaaatagattaatttgaatttttaaaacaacttttgtatagaaactttttgtaaaaaaccgcaccatttgttagtttgaaaagcgtgcgtgtgaaaaacgaggaaggaggggtgggaaagttgggggccgaacacacttgaattaataagcgcataggtagacataacatgcacccatgagcccatgagcttgtcgaaagctagatttaaccatgagctatctatcttctttgagcataacctcacattctcactatgtgaagctaccatcgtttcaatagtcattgctcgcggcctatgtcaatctgttgctcgatcgactagtgttggccaagcaaaccacttgcgggcgacatgagtttaccccttttgacctctttattttagatcgcacttttctcctcaagctattctctctacagaaggcacacttaaccccaattaaaaaacaccatctcgccttatctctcctctacatggtgttagggttcacaattccagtggaacccggtttggattcgatgaaacccgagctttccggaccgtatcgaaaacacaaaccactcatttttcggtcaagttaaaaaaaacaagctaaactttaaatttttgacaaaatttattatctggattctattagtctttgtcggtttaacaacgaattccacgaaatccaattgtaccactcatgagcgggttttgatccgatatcggaattgtgaacccaccgtcttgtcccacgtagctcttcgaggccaaatgcctatttgaaacggtggaacgaaaacatggttttatcaaatttcatgatttatagttttaaataaatatagtagtacgttcatgtattacaacggatatatatatgccattggaaatggcctagatgtggatctagtatcgggacgactcaaatcaagcgttcaattttttttacgttgtttttactgctactagaggaatgtttcaccactatactaaaaatgtttcaacctattaaaatgctaaaacaaattcgaatcaattttgttcacattgatgaaacatcgaaattcaattgctgaaacatcaacatatctgtatgcattaaggaccaagttatgaaacactatctataatcctactgcaacatgtcaaatccaacgcaaagaaacaaaaaataaaccagctaaaacataaaaaaaaaatctcaacacacccattctcgtactcatctcctgcacactcccgacggtgaggcgccagcgtctacacagacctccttgagtgcaagatgaaaagggtcgccaccatctggtccatcagcttgacacgaaggtcgcctcatgctgctgcctcacacaacgtcttcctcaatgctggccaccacgctgccattgcatgttgtcttagtgccggacctcactctccttggagcttgcagcatatgcttggggaagagagagagagagagagagagagtgtgttgagtggaacaagtggatgagaatgatagatgatggatgagggagatgaggctggctggagtgcatgaagagataaggcctctcacagtgcggtgagctggaccggtgctacacggtgccagctcggattgaagcatacgtggcataaggaatcgcaccctagcagagctcctcgcccccaagcagagccgcgcgaaaccttgccaaaacgagggcgcgataaggagaggaagacgcgaggcgcgcacgctgtggggtgcggttcttggccgcgccgtgccctcgcgccgcatcgagtggagaaaaccctgattcgcccacgattcttcccgccaccgaaacaccccaagcaagaacgcagaaaaaagaacttgatctatcccaagaacacaagaggaatcaccaagaagcaaaagaaacaaagaaatctcgatccgtcccaagaacacaagagaaatccagggcccagatctcatattaaccaatgaacaacacatcccacatgcacaaaaaaaacaatcaataatctcgccgccgcgcgcccgtttcctcctcgccggggcttcccgtcggcgtcgcgccgtccgctcccgcccccctccccgcggccaccacatccgctgccacgacccccaaatccagcggcgaatccgcggccccgcgccgatgaccgccagcacaactcggatccggacgagccaagaaccggcggccgcccgggcaccggcgagccgccgccaagatcaagggagaggaggtgctgatgagcctccgaaagaccactgaagttgccgctgacgaccgccgcaactccgaaagatcacgccgccgactgctgcttgggagaagatgagaagaaggtggcgcggcggcgtgggaggcaaggaggcgcggcggcgtgggagaggagaaggaggcgcggcggcgtgagagaggaataaggcagaatagtttgaatggtatgaaaggagtgtctgaaaatttggttatttaaaagaagtgtatgaaaatttggtttgaaagatatcaaagtggcaactaaaggaataaggcagaatagtttgaatggtataacaatatatttttggtaggtgtggtactagcgccacaaatcaggaaccagtctacctcttattaacctaaccttcaggttaattggattatgctattataatttttgtgatttggaaatataccaataatattcaactatttagacttatgccattacaatttaatagttatttgatttataccattacatacccattgtattttttaagatttttagaccaaattgtccttatcttctttctccatccctctttcctgttcattttctccccattagatctgacagagcttatgcatatgtgataagtgataatgtgaatcgaatgcgagcatgctcttgccggtcgttggctaacattcgttggagggatggatggcggcacggcgcgaggtcagcttggtccttctcctcacaacacctgcacactgcgtgggttgagctcccctctcctctacccaacagcaagccatcaccacaggaatggattcattggagccccaaccagcagcagcaactgaaatggaacgattccctgatcccaccaagaaatcaaaccaaaaccattccccaacaaaaaaaattctccaaaatagaacagactcatgctagtgaccaccatcattacaacggctattaggcataatcaagcaagtgagcgaaccaaacaagaggcaaccaaatgcccaccaacactagaagcagcagtgctttggcgacaaccactaccgtgaagaaaaatggtaatttagttcaaaaaaatatttttagtgtagtgaagggatgagtagtggcatgtttcaaatacatgctaaattgtaatggtatgacaccaaatagttgaatagtcgtttcaaaaccatgaaatttgtaatgtcatgtatccaattaaccctgatttttagcatcttcgaccttggttcacctccaaaatgaactggcgcacgattttataaatgggagttcgataaaatattctatttataaataataaattatctcattattatataaagaaacgt

SEQ ID NO: 72168 - DNA, 6587 bp, Oryza sativa
ttatcatcaaatccaatatacaacgattatttggatgattaaatgaaaagggaccacctaatcgttaaaaacaaagttttaacattcatgaacgataaatgtacaccgtatcacgttaacgaactgttatactaccgttaacgtatatacggccaattaatcgatcggtacgaccgttttccacgatactgagtaccttatataaatcagcaaaaataataataattatttactcatgtaaaaacaaagataatatatattacggaggacacacatgagctagctactagtattcatgtgcaagtaatagtgctgattttagcaatattattatcgaaaataatgaaggacgagaaaacaagaagatggaacaaaggaagaatataatgttaaagttttagtttcacaccgtattacgacaaagaacaaatttaataatattagtatattatcgattaatatgagtataacccataccatagatgtggacaacgttttctctcgtgtgtttgagctagtgattaacttttcctttttcttaccttctattgaagttctcctaacatgtttaggtaagaaatgttttagtttcttttttgagaaaatccattatgtgccattgactttgtccccaatatatgtaaaatattagtccaaataatatattaaaaaattgaaaaacaatatgaaagatttaggggaaataccaacatagttatatatatatactaatagatagtcatcatatatcatgtagtgagagaaagagaccataatggaatcctttattattgagcaaaattcatggtattatatttttatcttttttgagttgaatatatctaaccataattaattaacaattaacctgtgttagtagaagtctgtatcgtcatgcgtcaacatatcatgatattattagtaatggctaagtagatcgacccaaccataaaagtgcagagacaatgataaaactgtagtgggcttagcatagcacgagactatcatctaatggacaactcatcttttaattgtgctagaggaaaacaattagattacagtttgttctatgtaatctttaaccattcttttcatttacacaagagctaaatttacatttcaattttcaatttggaccactccattatatccatctccaagtctggtgactccagtcactccaccacagctctatctccaagtccagtggctctacgacaactccacacactaactctctctccttgttgctccgataaaaaagggagcccaaatctagtgtctctgctctctgtcgggttggttcctgcctctcgagtctcagcaagtgtgtcacctctggtcccaacgacaaccattacaataccgtgcatgatgatagcggaggagaaaagacatgttgatgcctaaagggtgcggctacacatgcgaaggcagagaagaggaacgatagtggcttatggagaaagaacggtgatggcagtgcatggagcaataactaatagttgccggtggtctaaaaaatttactatcaacataatatgtaatcgagtttattataaatttttaagtaccgctgacatgtggatcatccatcatcataaagaatgggtaacataggaaatttgagagaagttggactgctaagtgtcctccctccccttcccttctcctaaaagaaaatctcctgtctcagtctcctccgctccttgcgccatttcgcagcttgaacaggggaggggcgcgggcgccgagctccatctggcgagcagggtaggggaggggaagggatcctggtgtgcatctacatcctcattctgattcatctctctcccgacctatttttgtcttgaatctgtgcttgcgttaaccctagcttcctcctctagatctggaagaagctcctctcttaatttcagagtcttaaccttaatgcgagtagcagtttgtttgttcccccccaaaagtttgggggtttaactgaaccccaatgtcccaagttggatccgcccctgacgtacaattgtttgctaatttgaaataggcatgtatgcttataattattccgcataatcaaaacttgtgaattttaggagaaaaaaaaaggggcaaatgaatcctgtatttcactggtcagaaatggttactaatgtttttccttgatataatgtttctggatatgtatccatgcttaacaatgtgggtcagcaatattgaactatgcaaaccattactctgtacaatcttttcttttcaaatgctggccacattgcgctcgagcttactgctcatgtgtgcagctcatggaccctgagatctagacgtcaacgtgcttcctggaaagagagaggctcaggcatgagagcatacctctaaaataatgtccgtgcttacctatgtgcttgataacataggctcatcctgtagcagatctcattctttaagtgaggctgaaacagccgaaaatgcaaaagtaagttggcactcaggcttactgaacaagtaaatgctaactcaattcttgatttgagagttgccacatttgatttcttctaattcagctggtaacagtctgcagacattgacaggtgaattttgcaagagacaaaagcagagcaacacatccacaagctcttacttcttggtattgctaactttcccaaattttagtggtcattttccttgtcacaattatctgcgctacctttagtatctattggttcagaaattaattgtttctgttgttcctatttacctctataaaaaaaacctttctcatgttatttccaaaaaaaaaagaagataaataaatgtatcctagaaatttttagttttaacttgttctcaatttggatccatccttctttctctctctcaattgcttctgttttaaggtgcgggagaatcagggaagtctacgatatttaaacaggtgatgaatgctatattccatggagaatcataatccgtacgccactagttagtctgatgtattcttactgttcacctgcagattaagctccttttccaaactggctttgatgaggcagaacttaggagctacacatcagttatccatgcaaacgtctatcagacaattaaagtatgcaatactggaaagggtgtgtcttttttttcttattgcaaagtggggattatgtaggagattcgactagggatttgtattctgttcataaggaaatgcgttcatacttttcctttttgtcgagtaatgtgttaaatgttaacagatactatatgaaggagcaaaagaactctcacaagtggaatcagattcctcaaagtatgttatatccccagataaccaggtttgtgcttactctttactcaacagttaaagctaaatctgtgcatatgaacatgtcttgttaaatctgggaatacaaacattttgatttgcaacatttctgttgtagtcaagctgctcggctctatgttttaacctgttaagaccttgtagactgtgctcggctctattgtagtcttatgttttacacggtcattctataatgaaaacttgaaaaagatatctattgaaccgtacaatgtactgaacaaagtagaaaagaacaatgagattttgtaacatttattcttccttgtttatttgattgcttcagacaattgttgatatgctaaaaataacttggtatcaaatgtgggtgttataagattcaatttttttctcaaccaggttaaaaaaactatacctttgtgcatttaccttgttccgttgctttggaacttttaaggaaaactgacttttcttagacattgaaagacaaatatcaccagtttcacactgtacaccttaccaaccaattttggttctaagatgtcatttactttgtcatatcatcacgaaattggagaaaaactatcagatattgatggcaggttggattatccactgctgaacaaagaacttgtactcgatgtaaaaagggtatggcaagacccagccattcaggtgaaaacaaatagccattcaaatcttttgaagttatatagttttcctggccaggtgtgctgaagcaatgctctatattgtaggaaacttacttacgtggaagtattctgcaacttcctgattgtgcacaatacttcatggaaaatttggatcgattagctgaagcagattatgtgccaacaaaggtgtgctgtccatgttcatagacaattatttacatattctcagatatatgtgctgacaccatttcatgttgatttttagtctacttagtctgaggttgtcaactggttaactatgtgtactgagtcaggggttgccaaatagttttaaaagatgggcatatgcttatccttatctttttaaataatattaggggctaaaattcaatattagggaggagaaactattattctaccattattacgcagtctacattactaaggtaaaaaatgtccctgtgaaacatatggtttaaaattgctgtgaataaaactctagcatattaatcttatgaccctagcatatatatttttgttcagttccttcaataagttgcaaaacacaaatattatcattgtaccgtcctcttttgcaaccatttcccgtcatttcttaagcatagggaattgcttgtcagttgttcaagtccacactgcatcaaaattccaattaactttgtggtccaaagcttagtctcccggagtttgtgatcatgcaacatttcttcggacgattcactgctcatactgttgttttccttgatatggcagttggaggggcctttatccatagaaccatcgaggaaggaaggggaattttggtgagaatatccgtcaattaaacaactgaaccaccttatgaaaactcaataaccaaaacacccttagctccaccaagagatagccaattcccctcccaagccgataccgccaaaatccttatttgatgaaccatttgagccgatcccaacagacttcatgattttacaaaaaaacacacctcctctcctttatgaacccatcaaatatatactatgtttttcccaagtatgtaaatgctcagttgttgcccattgaatggagtgtacatcaattagtgaagatcgtgcctcaagaccacgactctgatgaattatggagtgcaatacgtggtgatgattgtgtcgagtatggatatgttcacccagagtgccgtagacaatgacctaaagttgatagtgtttactctatggaagttctcaggacaccagatttgacactgtaacatggatttttcgacaacaaatgtgaatgatttatcctcgaagtgtagaaatatccatgctatcagaaataacttcaagtgcaagtaatatttgtgccaatatttatgagagctttaaccattctataccattatgccatggcaacattaaggctccatctccaggttaagctattgcattgttgctaggaattatcagcaaacaaattaagtgatggagggagctccatctccagattggctacaagaggaaatgctccgaggtcaagctattgatccaaaacaagcacttccggcaggtaacccgatgtttttgtttatttccattatcgcatttgaacttactttcatcgtatatttcatcttccaaataaaataaagaggtattttcaatcatgtaatggaatcaaataaaagaagattatgtttggccccggtcggccagataacccgttggtcggtgcccctgtatgttgtaacatttgtcacatatttacagagtcaaatcaagggattaaccagcctggcccatcattgcacagcctagacaaccatgtcatagcttggctgagcttgtcgtgatttggccaatcgtgccgttgctcgatcggacaatgactagattgaccaatcaccaagttggcctgctaaccatatccttgcccgattgaccgtgtcttaggtcagcaaggccgttggacctccccactagttcgaccagccactccaagcccgaccgaccttacccatcagctagccgacttgaccgttggcctactaatgttgcctttgtctggctagctgtgtatagagcatcctatggattgtccaacctcatcaaagctcgatcgtccatgccatggattggctgaccttgttggtgcccagaaagtcatgtcttaacctagcaagccatgccaaggcctagcagcccttatcagagattggcaacccttgctagatacttggcaatatctacctaggtccaatcatcctggtcattgtttgtcaatcatgtctaagcccgagtagatttgtaaggctcaaacaaccctacaaacgtccagctggtcttactgcaactcgattgactgccaagttgcggctagcttagttaaggcctagccgagcttgccaagccttaccagatacatggcttggttggcgtaatatataaaatcattgaaagtacactgaggaccgtagaactcgccgggggcaggggtgaataggaggaaattataccttaccaaacaatccggtgccattgtggacagtccgacaatgcacaatgttagacaatccgatagctagggataatgagccctat

SEQ ID NO: 72169 - DNA, 2242 bp, Oryza sativa
ccctccaatgaatcttgctctaccaagcatccaccagtatgtagcactacttccactatgacttctttccttgcggaggcaaggtatcaaccttcacaaacatctccatggcacatcacactccacttggttggtcttgggtttctccttctccttctcttaattacaacctcaagttctccaacttgaagcacacaaactccacatcactctcaattccacactctagctacacttgaacacacttgagatggtgggagatcttcatgcggcagtcttgatcttcttccttccaagccttgcctcacacgcttcttcgacaacgaagatttatcctcagcaacttgtgacttcttatgacctcgaccggtttgttggtgttgcatagagcactttctccttcaccacttcatcgagtcctccagcgctaagcctccacttgcccttttcctctacatggtctatcgcgtagccaagtcttgccaaccctacattgcattttgcaccttcagtcatttgtagccttgtatgacaatgaacctcacatacgaagtagattaattaagacatcaatctaccaagtgatatggtattgttttctatagaataatattttctcgtagcatgtgcttgtgtcataggtcagtttgatcgataggctattgcatggggacacgagacatgtctcatgcacgtatgtgtgtgtatcggttggtcaataccaatcctaatcggacatgtggaacgaagcatgtgtagattgactttgtcagcaagtcagattttccactcctcgggtgtgtgtcgtgctcgagaccaaaaggtcacaggaggttgcacgaacaggcagaggccagcgttctggcgttccctactaaactaatggtgtaacaccccggaaaaccacataagcctgggatgccactaaacaaccatacaaaagtgccaaaacaagcaaatttcggcaacaactaccttagacaagaaaacatcacgaaagcatcaacatatagattaagtttatgatacatcaactgactgacatatagggatagcctttgaaaagtagttaaccaatggtcaacaactctagtatttaattagctcattatgtctaaacacaagaaatcttatcagcataatacaatactcatgactaagtgagatcatgttgtgtgactgtgtatctaatcccatcccttcatgcaaacatgtcacagcgagtacctgaaaagactataagggggtgagaataaatctcagcaagcaaacggctttaacaagctatttaaaccacatgtttattatatactaattaaataccaagttatgattcacataaagaaagttcaatatccaaggactaaaacatcatagcgtcaccaatcaaatccatatagtcacaaatcccagagaagaaaacacttctcaaagatattttcgatcgataattctcataacatcctgcaatatgtgcatatgcaatgcaatgatatgtactcctgctttcacacccaacagggtgaataagtgcatatgcaatgcattgatatgtactcctgccttcacacccaactaggtgtgaagctacatcgtattacagcaatatacgatgctgtaccggtacggtcgcaaccataggttcacgacatgacttcaaatgcaatgcaagtgatgcaaatgcagtatgaattccagagtataacatcggaaccacattccttcgatggagatcagtataaggttattataaccaagagcataaagtatatccataaacagtgtaaaatcaataagtatgatttagataggtaaatcctcggtgtaacatataataatcttggttgatgatatataatttcaacgtggaggttgttggtatttaatacggttacggataaaatccgcaagcgcacggatatacagatgtagcacttcccctacggattattccaagggtatcgaatccaagggaacgtgtgtggtcagatcttcctccggttcatccaaggacaccaagcaaatgataggccgggatagagaggattcactagtgagaaacagtgtctagggaaagtttaactttaatcctaacgcaatacttcaggcactggcaacccgctgttcctagatgtcgctctactacgtacctggacagggaggacttaagtgatctcgagggctgtcaccacctctacacctacctcaaacgtactatgggatacacaacaattactggata

SEQ ID NO: 72170 - DNA, 697 bp, Oryza sativa
aagtgccctccagcggtcatcaggcatgcatttggtacgtccacgccaaaccccacatgcaacggtgaaagtggtggttcgcccgaccagggggtcgggccgaacctgggctaggccctcctggcctggccttcggttggtggactccctggaccttcctctatccatttctcggagttttggattgatttaccgatgtttcaacgaagttctcaacccctccttgtatggatacataattctcctcactttagtctgattttcctcccaacttcagggtttatcatctgcatacaaatatacaccaacactgatggaatatgtgagattaagcacctatttctatgttggatgttttattatatcgactttatgcagatgctggcggtatagaatcggcatttaacagccgccaacagaggtagaatcaaataacaactcaaagctgtagcaaaccaccgctacgtttacttgccttcaccgatggcgagatgaactctagttgcattccaaagtggcatcacctgaataaacaccgactcagcctcaaactacacacatataatcattcaagaatcacacattcactttctacgctgggaacccaccccaaacaacataaagaaaattaccgataatcttcctataaaagcaacatatattaacaactcgatacctccaattctacatcacataa

SEQ ID NO: 72171 - DNA, 723 bp, Oryza sativa
gcagcccgggtgatgatgtgatatttttgcatgttaagttttaggaattagtgatagtggatgatgatgtggcatctttgcatgttaagtttgcaacacgttcgaggaggccgctgccagggtcctattcaatggcgaattgcctgagcagcgagtatcacctcgtcaagccacccttccgcctcgaggcaccagtgaccaccgtgaccatctaaatggccaccgagaagcacgccgcacgcgagacaacgaaaatcattcctaacatcatgtctcttcgcaacatcgcgagaacgaagaacaacgaggacatccgagcgagaaccgagaccttgataatcgccacaaccgccgtgaacacgataatcgcgaacagcggatgccaggcgatactggtccaggtcgccgccgtaacaacgacgacgacaaagatcaacatcgggacaataacggcggacgacgacaggattctcgagaacccgtccgccatccctgtaatcgtacaccggaaccgagtgactcatcgtcatcatcatcatcatcatcgtcttcgtcatcagatagacacccacggaggacacatgatcgccgacaacccactgcccaggcgacggatgtagagctttcattcgtgccctgcgagatgtccaatggccggagaggtttcgaccgggagcgatagagaaatacgaccgaagcacccaccctggaagagtttcttca

SEQ ID NO: 72172 - DNA, 1160 bp, Oryza sativa
ctcctggcgcagctccaggatcttcatgttgttctcgaccatcccgcggcgtaccatctgatggaagtcgatacgagccgcgtcgtacgcctccaccatgcgtgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagggtgccgatggcgaggagagcggcgctctggcaagcggcggggaaggagtctccacccgcggtgactgccaacgaagcccgctcagaagagccggcgaggatcactgcggtgacctcccacccagcgtggggctccgcgtcgtctccctcctgatccggaagcggcctggcctggtagtccactccgtgtggataccccaagaccacgcacatgcctcgcaactccaagacgaagccagtcatgtccaaaccatgacgggtgacgctgccggccatctacaaacaaaaacaaaaagagaaacaacattttaaaggtcagattttgatgataagtgaagcagcaagacagagagagactagacagttttcacaaataacaaaggatttttatttttgaaaatattgctaaggcttgggatctacggctcgtcctagggtcaagggaggctctgataccaacttgtcacgaccggaaataacccaacgggcattccttacgtgcgtgcatgaatccttgtcccaggaggcaaggtacaccaaaagttgatacaaatcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcagggctattttgtaaacacgatcttagaactatacaatattattaatc

SEQ ID NO: 72173 - DNA, 675 bp, Oryza sativa
aaaagacttttagggatttttctttttataaaccttttcaactttgtttatttcttttcaattattatttgtgctctgaaaattccactaaaatttgagggctccttttagaccaaggagaatttaacaaaaattctccgggccacatttgaatttttcttgtacgtattttagggtttgccaatttcttttcgaattttaattaattctattattcctttttgaaaatgatttttattttgggatgaatttatcaggacgtgacagtttgagccttttcttttccgttggtcgtgtagacgctgtagcttcggaagatccgctcttcgtggaagttgaagacggtgtttgggaaagcgagcaaggcaagacacatcatcttgatcatattgaatcccagtttataaacttatgttgatttaaattattgcattatcgctttatttaaattcccgcgttatcactgttttatttagccatgcctatttacctttgttatgaccttattattattgctattggtattattaccttggtcaccctagaataaacaaaaccccaactagtggacactctactcgtggtatcactagtatgatttaggtagatgcttcccaatttaattaggtaacattaggtgggtttacaactttagactttgggatattcatatca

SEQ ID NO: 72174 - DNA, 5280 bp, Oryza sativa
acagttctatctgatgaagttctgaacttctgacagagttgggggtgcaaagaaaacaaccggttgttctggccctcggtacagagtaacagtgcgtctcgcgcaatccactactccttggaattgtgccaaccaattcatcccaagaatcacatccaagttcttggtgtctagcagaatcagatccgagggaaaaggaatcccctgaatttctatagggacggcagggctataatactttgctgtcataacccctccaggggtggtgatgagcagagggtttctaagcctttctacccccaactgatttctccccacgaatcgcacagatataaacgagtgggaagctccagagtcaaacaaaattgtagcagggatggaatgaacgaggaacgtaccaacgatgacgtctggagttgtcagcacgtcctcggccgtcacatgattcacacggccccgaatgacattgtcacaccctgaaaattcaaaatatataaattgttgtttaaatggaatttttagaaataattttaaaagtcttgaaaagaaaatctatgtttaattaataaattccaatataaaattgggccagataaaatttcattaaatactttgcttaattctataattcctagatttttctgggatttatttgagctaagaaagtatttttaataaatggaattgcatttaagaaataattttaattgaaaaaggttttaaaaagtcttcttttggctttgggccgaaagtcggcccaaaacctctcttctctctctcctcggcccagccggcccagtccgcagccgcgcgcgcgcgttcggccgctgacaggtggggcccacccgtcagtcgtcgtcttcctcgggccgaaaccctagtttcgcgccgccgagctgccgtcgccgccgctttccaaatccggccgcctctttccttctccggccgaatcaatagaggggaaatgatctccgggatctcctctaccttttctcctttggaatctttggttaaatcgctttggaaagctttggaatcgagttcgattcggatcggttttccctctttccaagccgcgagtttccttcgccgttgccgtcgccgtgggccttcgccgccgcctccgagcccctttaaaaggacccccggtgtctcctctacccgtcgcagccctcgccttcgcctctcgtcgccggagtagctctagcgctgtgtgccctagcttcgccgtcgccgccgccgcttcagccgtgctccgccgtcgctccagctgtcgccgccgctcgggaagaccgccgtcgtcatcgccaagtcgccgccgtcctcgtccgtcccttcgcagccgtcggaacccgccggagcttcgtcgccgtcgacaacccaaaggtagccgccgcttccttctcgtcgccgtcgccgtccgttgcttctccgccgtcgttttggtcgtcggtgtgttcgccgtgccgtccgctacccgttggtgtcctccgttcgtgccgtagcgccgccgttcgccggtgagcgtgcgccgcccgagccgtctgcctcgccgagccgccgccgccgtcggtgacgtcattgctggcgtcatcaaggccgtccgccgtgaaccgccgtggactcgatcaatctcagccgtccgatttggatcggatcaatctcggccgtccgttagcgtgaaccgccgcccatgcgccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttatattaatttgactagttgagctttatttatattggttcaactagatattagatataattgcttagccctgcttagaaacattagtacacttatgggataactaatgattcactattattttatgatggcttattgatagttcacgatggtcaatcgtgattagttaattaattattgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattataaaagatgctataactggtaataatttgattagctcctggtttggaatggtacattcctggtttggagatagaactgtgcagccggggtggttgttcagaatggttgggcctatacaacagggtatgttgtatagcgttggcttaatattgtttaattacttaactgttttgttaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctacgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctaaaaatattggaaaagtagaactgttctcctccctttctcttttaattaaccaaactaatggcacatgcacttcataatttttttttggttctcattaaaaatttattccagtgttattagtactgtacatctattactgtactaatggctcatttatcagcaaaagttttacaatattgttttatttaatcttgctgcaataaaataaatttaccatgttgattttataattttctttcatttcttttgaaaccagttattcaaaattacaaaatttatgatctcgtttccaactgttttaatttatttcgcaaagcttggtttactttaattacttacctttttactttgattttcaaactttattcaaattaatccaaaaacttgtgctattaattggatagatgtcttaactctctcctttcacttgtctttagatgccgtgttacaagcctgagtacctgtttggagttgaaggttttgtccaggagttgcgtacgatgtcctttgtcattggatttgggaatgctcctttttatgcccagattcgtcatgatcgtcatgaagaaaagtgccgagtcaaagtcaccttgaacagcaatagtgaagatatcccctcagtgatgtttgaagctggaggaagaaactacatccatgcatgtcaggaggtggcaaggattgccataggagagcttcgtgatcgctacagtgatcagttggccgacactgagtatcgctatcatcctcgccaaccccagggaagtgaccgtggcagttaccttgagactgaaggaattgagaatgatgttaccacaagacatttggttgagatgttgtgggctatggatgaaagtcgtgcggagactgtgttagcagctcaagatcgtgaagatcggaatcgtggtaagatttgcaagctagaagacaaggtggatcgtttggagaaggaattagccgcattgaagggagaagcaccgccgcagaaggctaggattcgtcttaccgcaagaaagagagctttgtttgtccctcgctatcaattggcgccaaaggtccgcgtggtggagaaagaagttgccccagcaaatcctccggtcatcatcataagtagtgatgaagaagaagaacccaagcgcaacaattccaagtttgagtgggtagctatcaaagatgaggaagatgagccgaacgagccttcaatcgacctcctatgctcggaagaactagaatgacttgttaagtcgttgtcttagatcgttgtgttagcttgtgtcgcgtcccaaatcgactctaaaatctatcctcgaaattgtgcaaagaataattaaaattcatgtgaaagcctccaacaattaaaatgtgcaaatgtaaaagtcaaatgaggcttggaggatttttgtatatttcctaaaagcctaaaatgcttaaacaaattttagtggaattttcagagcacaaataataattgaaaagaaataaacaaagtggaaaaggtttataaaaaaaaagaaaatcctaaaagaagttctttttccccccccccttccttcttgggccggctcggcccacttctccctccctctttctctctcctccccccgcgggcccatcgggcctcccgcggcgcgcgcgccgttgacaggcgggcccgcccgccgctctcgctgccgggtggggcccacctgtcatcgccttcctcccgccgcgcccgccgccgcgcccgtgccctagcgccgccgccgccgcggattgc

SEQ ID NO: 72175 - DNA, 21470 bp, Oryza sativa
cttcgcttctaaggctgcaacgaaacctctattgacaattcccaaatttaatctttcaaattccttgcataattccaatggcaactgtcgtccatctgtcacattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtatgagtaccgaaaagataatgacgccaaatctttaatgcatgaacgactgcagctaactcaatatcatgagtagggtagttcttctcatgcggacgtaactgacgagatgcataggcaaccaccttcccatcttgcatcagaacacaacctaacccaagtttggatgcatcgcaatacacttggaaacccttctttggatcaggcaaaatcaaaataggagctgatattaagcgacttttcaactcttgaaaactctgctcacattcttccgaccacttgtacttcacatctttctgaagcagtcgtgtcatgggcttagcaatcttggaaaaattctctataaacctccggtaatatcctgcgaggcctaggaaactgcgaatctctgaaactgtctttggttgcttccaattggttacggattccacgttactaggatcgacggcaactcctccggctgagatgacgtgaccaaggaatttcacttcggacaaccaaaattcacacttgctaaacttagcatacagttgatgttctcgtagcttctccaatgcaagacgaagatgttcctcatgctcttctttggttcgagagtagataagaatatcatcaataaagaccaccccgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgataataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcatacccggtaaatcatctgggaacacatcaggatactcccggactataggaatctcttccaaagttatctggttcagtcttgaccttaaagactcagatgacaatgcatgaacggttacaactcgaccatcatagctggtgagagttacttttttgttggcacagtctatcacacctttatgtctggctaaccagtccatccctaggatgacatcaaggtctttggattctaacaagataagattggccagaaatggtactcccttaatttctattctgaccgaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcagtaactgagttaacaaggaacgtacccaaaaccacatctggagcatcttgagcttctgcagcagcaacatgattgacacgggcctttgatgctggtacagcagagttattctggacagggacaaccttcacgcgtcggggcttcggacacttgtcagcataatgtcctggatctccacagttgaaacacaccacgggcttgctgccttgctccctcttggcaggttgttgctgtgctggagctgcaacaggacgtggagcttgattacggatgttgttgccagcattgttgttgaagaactgacgttgcggacgaacaacagacgaagaacctccctgtggcatggactggggtcctaaggtaagacgcggcttttgattatttccctgttgtgtcttgaattgagcaatccgacgtttcttctgctccatgcgattgtacttgtcctcctgacgaatagccttatccactaatttctggaaatcagggtaatctccaaccataagtgggtaagaaagctcatcattaagtcctcccaaaaacttctcctggcgctcttcatcattgcgcacatcttccggagcataacgagcaagacgattgaactcgtgcagatactccgtaacagagcgagatccctgggtaagcgacctgaactccttcttcttgagagacactactcccgatggtatatgcgtctttcggaaagcagcggtgaattcaagccaagtgataggttcagcagtagtcctgttaaggcggaagtgatcccaccattcagaggcagggccatgcaactgatgtgatgcaaatgagaccttctcctgatcagtacactgaagtaaatccaacttcttctctatggcatgtagccaatcactagcttcaacaggattagtggtactagagaaaacaggcgggcctcacacgaagaaattctgctaacttgttctgtggaggtgcatgattattcccttggttttgctgattctgaaattgctgcatcatcatgttcataagctgtgtctgttgagcaagaacttgggccagagtgggattctctccattgttgttattattggggttgttgggaccattcccattgctacgagtgttcaccatctggtatggacaggataagaagagaaaacgggggaaactacttagggcagagaattcctttaacatttattgatcttaactgagtttcattattacaaactgaagactctcacaccactaaactcacccacttcctaacactcaaaagcaaacaaacgcatgcacttacatcccaccactgatgtaaatcacatgcgagacccacacacacaaacaaacttaaaacaagcaagctgtcacgaccggaaatcacccaacaggcgttcccgacgtgcgtgtattattccttgtcccaggaggcaaggtacaccaaaagttgatacaatacagagtttaacaagcggaagcgtatataaaattattacatgggcaacgaaggcccagcacactcaaagacaacgaaaaacagcggaagactagggcgacgaccacaggcgcttgacggcaggcacgagctagacaccaaagccttcatcttccaggaactcctcatctgggcttgggaaaattaagcaagactgagtacaaccaccgtactcaacaagacacacccacaaatgcagaataaatgcaagggagtacaagggaattataatataaagggttagggttgcagtaaacagcatttaaagacatttagttgctcaaagctattttgtaaacgcgatcctagaactctacaaagttattaatcaaggccgtgaacccacacgaacctgccttaacccaaggcctatgatgattcagaccgaactggcaacccgaccctgggtcccagctcgtcccaagccaacccaggccaaccattccacattttagttgttaagcaagttttaagaattaaaacactaacttgggtacattgctcggcttgcccataaccgagggcgcggctattcgaatagattatactctgatcagaggtgtacatctttacccacaagacacatctttctcacgtgcaaccacgtgccacataccaccacggtatacaggcgaaagacgtgacatagtttccaacccatcctagccatagacaagagtaccgacccaatcccgcctacggccggaacccccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttaagactagactgagccacaaactaagccttacccactagacatgtggaagtacggtagtgcgttgcaacagaggcccgaagaccggtccttatatggccgaggtgctaccatcaaaaccatgcaccccgagcccagcctaaaaccattttgggggcttttgaatagagggagcggtgtgaagccaattccacaataatccaacaattccaaagtgcccaggtgatatgaatattcccaaagtctaaagttgtaaaaccacctaatgttacctaattaaattgcgaagcatctacctaaaatcatactagtgataccacgagtagagtgtccactagttggggttttgtttaatctagggtgaacaaggtaataataacaatagcaataataataaggtcataacaaaggtaaataggcatggctaaataaaacagtgataacgcgggaatttaaataaagcgataatgcaataatttaaatcaacataagtttataaactgggattcaatatgatcaagatgatgtgtcttgccttgctcgctttcccaaacaccggcttcaacttccacgaagagcggatcttccgaagctgcagcgtctacacgaccaacggaaaagaaaaggctcaaacactaataaattccacataacagcagaaacaaagcacaaaaatgggttcttcacttcttaaggaaaaattagagacttgaacggtccaattccgagttcaaatggccaagatatggccatttgaagtttatatgctctttaaatggatatttgcgaatttcttcatttaaattttaatttaaaaatcgaattattgcgtcagccgagagagagggcgcgcggaccgggtccacgggagtggggcccacgcgtcagcctctcggtccacggtggaccgggagcacgcggctggcggcggtcggcgccgtgggtcccacgcgtcagccgcacccgcgggcgcgggcggctgacggccgggtcccacctggcagccgcggggcgcgcccgaaggcggcctcgccggcacggccgacgggagggggcgcgcccgcgccccgatggtcaccgccggcgaccaccggcgcggcggagcggcgcccgagagagcggagagaagagggaaagcgaacggcggtcctcggctcaccccgggacgacgagggcggcggaaacgacgaccgaagcggcgagaggcggcggcgcggttcgggatgacgaggacgacggtgctccggcggtcggcgggcgaaacggaggcgcggacggggtcgacggcaacgcggcgaagccgatggaggtgacgccgagtcgggaggaagtccggagcgacgacggcggcgaaccggagcacggcggcgacggcggagagaaagtgcgacggtgcgggctcgattccgacggggagagtgagcggcgagtggcggaaacggaggagcggagctcggggattgattttatagcgacgggagagagagagggcggccggagagaaaggaaaccggccgcggagttctcgggctccattgaagacgccggcgacgattgcgggattcaaatcggacgaatccgagggagagagagagggaaaagagggggaatcgggagagggaatcacggggagtaattcgcccctctttatggcgcgcggggaaggcgggatgcggcggaatcggcggcggcggcggcgctagggcacgggcggcggcgggcgcggcgcggggttggggatgacaggtgggccccacccgtcagcgagggtggcgggcgggcctgcctgtcagcggcgcgcgctcggggaggagccgatgggccggaggggaggagagagagagagggagggagagaagtgggccgagccggcccaagaaggaaaaggggggggaaagaagacttttagggatttttctttttataaaccttttcaactttgtttatttcttttcaattattatttgtgctctgaaaattccactaaaatttatttacgcattttaggcttttaggaaatatacaaaaatcctccaagcctcatttgacttttatctttgcacattttaattgttggaggctttcacatgaattttaattattctttgcacaatttcgaggatgtattttagagtcgatttgggacgtgacagtggcggaggaccgcccaccaacacctaggtgctgccgtgccgtcatgaccaagttggctacgtcgtccagccaacgttgggctggagactccgggtcagggacgacgggcgggtgacgtaggagcgcgcccgcagcttggagcgcgccctggggcgtgctaccgtcgccgtagacgaggaggcgacgctccccatctcggcgcccttctccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagagcttgtgcgcttttgcttgtttagccattgggctgaacaggaaaagcttggcgcacacgaaagagtatgagagcttagaaaaacacacgcagaaccccctacatggcgcgtcagatgacggagcgtggggctcctcaccgggagaccgcgcaggtccccctttgccggttcggccgggggccctgggtgaggttctaagctcctagtctgtggaatgttcgcgaaagtggaaacacacaagacacgggcaatgtatacaggttcgggccgctgagaagcgtaataccctactcctgtgttctggtagatctgtgtacgaagaagctacaaagagctggagaaccagagagctcaaactctagaaacccctttcctcctttttgcctctcgtgggatcttctcctggatcctccgggagtctccaatctctcctcccctggtcctctggtccggatcccctccctaagtgggcaaggtcctccttttatatctcaaggggataccacatgcaccacttctacctatttctctttttggtggggacccatcctcttttcactaaaacttggctcgcctttccttcataaatgggcggagatttgtaatggttgccgtccgaatgaccttctgatgggacggcccatacctacctccacttccgccggaagcaggtgcgacgtgggaacatggctgtctgccaacgacatgaccagtgtcagaccggtcacaaatcggtcattcttgtccaccacgcgtcagtttatcaatctgcatgttcacccttcttcatacaatgtcttgcttgtaacggttgggatgaagcctggcatatatctgaccgggaccaacgtgtcatctccaggagctagcacgctggctccggctagggacaagtgcctggaggctcttatcctgacgggatggggcgaggcgtgtgtcagaccgcctgttgccacctaacccacgatctgaccggtctgtgaccggtcacagaccggataaacgagcgcgctgcactgcgttacatgcggcgtgacgcgctcgttcaaaccgcaataaatgcggttaggtgagccccgccgtgctcacctaacctatacacgcggcgcaaaacccacaaggggtcggggcgcctcggccctcggggccgaaacgggagtggtccgatccctcggggagacaaagagaggggcggcctcatcaccttcgggcccgacccccccgagggggtcaggccacgtgggtgattgctcctgcccaaacctctagtcatgatactcccggtcccatgtcaccgacatcatgcttcccgaagaaaccatgatgaatttatcatggttacaacagaaacatccacatctacataatggtagtactagtattgttctattctgcacgtattacattctgtgtgcggaactcaacacgtactgctcgagtacaatttctgagcagaggacagggaaatgaaaagaatgcctaccaggtatagttaagttaagggtgtgtttagttcacgtcaaaattggaagtttggttgaaattgaaacgatatgacggaaaagttgtaagtttgtgtgtgtaggaacgttttgatgtgatgaaaaagttgaaagtttgaagaaaaagtttagaactaaacaagggttaagaagaaataaaataaaactatgaatatatctgctagtattgtacagttatgctacgagatgttgaattcaaatctcacatactattatttttttttacttagtatgcatctttactacatgttgtttcaattggtactaattaaacatcaaaaagtttagtctcgattactagtctcgaacaggtattaaagatcgtttctcgtgcatgagcaataaaaactgatataacaagaggaagctccacgagaaaagcaaagaagacggaaagagaatctcatatcacctgtgccatggattgatgtcacaaaatcgccgttgttcgctctgaatcgcccgttgacaacctgatttatcgatcagggctgtcgagagggatttatatgcgagctcaacattgtttcgattttccgattaccgcggacggaaatttgtccaccgcgtgtggatccggtaacgggcttcatcggggcttgcttcgatggacggtcaataggagcgggagtatgtactccctaggagtacccattttcatatatatactgtactcgaaaaattggctttgagttgaacctgactcttattttgttcttctggattttaatattttgtaaactattttctcaaagataatttaccaagttgagctatcattcatagcaagatctctcgctgcaacacccagggtccttttagagaaaattgcaatattgggacaacaaacattagggcttcgctgtcttgacactccgagtggatgacaaatgggtccatatgtgtctatgaaatatgtgtccagtatcattatagcaaaggtcaatgtttgcagtgtcattattgcaaatctcccgtcatttttaccccgtttcatagaaaaatattatatcttatgaaattaaatcttataaaattaatagacgagatatagctacattggtgtacatctttaatgcatgccatccaattttagattaccatattactttcgaacgaatggagtaagaaatgctcatctggttggcatcaatattttaggcgactggtgatatggaagatgttctccggggttgattacagccgtagttcctcgttccatgtcgtagacacacagcgctttcccattgaaccccgagtagtagatacagttccctctcaagcctgttgtccgtgcatcaagtgacgctccaaaacagcctatctgaacgaagaacactctgccacctagcgaatccaccttcacccacgctgatctttgctcctgcgtcgtcgccatgctcagcctgtaaacgccaacaccagcgacaatccgatcacatccaatcgggtgagagaagagaatggagtgcagctccccgttcgattccacaaagatgctggtacgtttcatgtacaccgccggcctcctgtcgtcgtcgtctacggcggtcacggtgaacgccggctccagtgagaactcgaggacggcgacatggtcgatgagatcggtgtagaactcgccgtccatcgccgtgagctggcgtaacgccaggatgacgatgccgcggtgctcgtggtgaggcggcccaggctggaggtactggtgctgatgcctcttcacccagtggttgtcgccggggcggcaataccagagcaccgtgtcggcgtggtcgatgacgagcacgacgcagctggccgggtccatgggaccgcagcacgagaggaggcacctccggcgatggctgctgccttcggcggcgaggacggtgccgtcgtggtcggggggcagcccgacacggcggccggtgaaagggtcccacaggaaagtgcacggcgagccgcggcgcgccatgagcagccagccctgcgccgtggtccaccaccggtggcctctcatcatgtcgtcgacgccgccgtcgcccaccctccttggcagcagtgctctcgccggcacgctgtacagggacgtggcgtcgccgtggccgaacagaagcagaggagcaagcttgggatccagtactgctgcagatgcatcgcctgcctcctccatgattttgatggccgactgtcccacaggtaggatacggccggtcaattgaaaacgaacgaatttggcggtgctttataaacgaggagaggctttgagcagtgcaattactggcatataggaaagagaagcgaagaaatctgcacgcctacgacctacgattactagtaccaattaggacatgaattcctacacgacatcaaaattcaaacaaattatagtactagtactttgggccggtaaatcagtaaaaggaaacagtaatctgggccggggataaagagggatcaccacatatgcatctatggagattggatagcaaccaacaaaaaccaaccgtgccgggtatacaaactacaagcagaagcggaagccgacctatatatgagtccggaggaaacacgtcaagaaagcagagctccgtagcagcacaaaacgcagcgcgccaagcaggccattgcggtgcacgaaccctcgagattcgccaagcagatagatggaggccactgcgacggcggcgcagggactacgggactggtcgtctctcccgttggacatgctcgtgctcgtcctggatcggctcgggtggtcgacccacccgagcttcgcattgacgtgccggcactggcgctccgccgtgtcgcccttctacccggcgtggatcacgcctctcctcctgagcgccgccgacatcggcgtcacgaacgtcaggtactacagcccctactaccacaggtgtttcgagatcgccgacacgctcctcaaggtgcccaaaattgcggctaggatctgctgctccagtggacaacacctcacgctgtgtctacctagattgatcctccaagccgatctcgtagccggcaccatgtatgagctgccagagatgcctttctattcattcgagtttattgtctacgatgagcacgcgcggaggatgtattgcgtcaacacgacgtacgcgctacagctcgcccgtgcgacccaacaagacgacggcgagtgggggccctgggaattaacggactttgacgtggaaggaccgcaacttctggcggcgccgatcagcaacccggtgctccatggtggtttgttgtatgttcttggtgaagacgggaagatggcggtgtatgatccatgcaaccacgacaataattttacagttcccgataaacctaagggctttggaatcaaacaccaagttgatagccacctgtttgagtccgaccaaggcgcgctcatggctgtcctcgtcggctacagtggtgcgcctatccatgtcgtcaagctcaacgaagagacgatggagtgggagaagatgcggtcattggaaggacatgcgttgttcaccgggacatacacgacaatgttgaggaagactaagcttagattgatgcaaaacaaggtgttcctcccgaggctgtatgactggcctgagactatccatgtcgacattgttacacgtgatggcgaaacagcatttgtaccaaagtcatccagttcgtctaacaccaaggagatcacctcggacataaatatttggttctacgagtttgggcagcaagacgcaagagagttttggggatcggagagagtagattatagtatttgggttgattttagtactaattgacacaaattgacgttgttagctcttatattttcatatagtgaatcatctcacaatgaagttactcttctttcaggccaaaatcaaaatcgacgcaaatgaaatttgatataatatttctttgttggttgaaacatggcgctattaatattatgcactcagccaatgcaatttttgcatgaattgatattgatatttgtgcacagtaatttatgaggatttaagggaataataaaattataggcttggatgattttctcggaaaatttgaatttttttgggagggaaggatttagggtttgggtgattcacaaggatttaggcaagttttgaatttcaaaattcgaaccttgggatttgtaatggaactttgggatgaagtttttgggatatcaaggagagacccaccgagatcttttggcacacttaagtccttgaggatacagaaagatctaaaatttttgcaattaggatttcgttttatacaaaataagttagaaaaataattcattcgactgtgagttgctgaagatatggtggtgttatcggaagacttgaccgaatagccatcactgctaaatggtggcatggatctacttaatccacaaatagactttcccattaaaccaaccatatgactgattactcccttcatttcaccaacatccattatccaatgcatgaatcgatttaaaaccaaaacgtatcacatagagctagaagaatgaggaaaacttcaccaaaagcaaagtagttaacgtacaggtgcaagtagttaacgtacagtatcaatgatactggttggtgacgttggctttcatcatatacttggttatcttcttcttcgccttcttgtcttccgactcacacgtcttagcgtgagccagaagtgggtttctcgccctggccgaagaaggttcaagaagaatcttcttgtagccttttccgcagatccaacacttctttgggtcgaattcctcctgctgacgcacggccacctgatggcccgttgcagtggcatcgagggcgacctcgtcggactcgatgactgcgccgagagaaggtttgggagcgccgtcgtcagcgtcggcattggcgctggagttgggatcgaccttgtcgtcggctgcgacagtgccagtgggatcgacctcatccgtgacggtgttgttggcgctgggagtggggacgagctcgccgctctcagccctggcactgccgctggtgtcagccgtggcgctggagtcggccatgacgccctcgtcgcttgtgtcgctggcaccagccggcgcagcactggtgctggcaatgttagagacggcagtgccaaatccagcgggatccaccagctggtactggaaggcgccgggcttgaactgaaccaggatgacggtagtgttctcgcccgatgccaagccgaactcaacaacctcctcacagatgacacgcagctctgcaccctcctgcatagcaatattaattggtcacagcattattggtaacagcagttttaacagcgaaagaatcgaagtcaaagcagatggcagtttgtcagccaggcatgcatattcagtgctaaactaacaaatggttttgtgaggtttagggcttacacagtttttttttaaaagaaaagagaaaatcaggatatttacattgcttgattgaagtcatttcctagaacagatagcatgattaacaccactaagatatcttgtcctgccaagaagacaaactgagggaaagaaaagactcaccaccgataaacggtcatgtatgtaagaaaccacgtccgcactgtccacgcaagacctgcagggggaaaatatacagtagtcaatgcaattagtatggaactatgagtgaaactatatatgaaccaaataggaggaaaaaaaaaaaagagaatgccaatgagtactggtgacataaaaatgatccaatagttattgacaggtattttttgctgaagagttaccacttaccagagaccttgacttgcaataacaagaaactccatgtcatcagttatgtcatcctgacattgaaagggcaattttccatcagatcccaacccggcaaaactgaacttcatattctaccaaacggacctatttacacttagttacacttacagcgaggatgtccggatcacataccagcatttgtttttcacgatctaaatctttgttcttcttgaaagcaaagtcacctgaaatgtaagtaggtaaaacgccaatcacagtgtaatgtgcttctttttgtgctattacatgcaatcaatgaaaaacagatccagacaagactataccaattgatcttgagattgttacacctcccccaaaatcaccgaggacccattgttccttgactacataattccccattacttgttcacacctaagtccaagagatctccctcctgcattttgaactctctctctttcagactcagttcttgtgcatggtttgtgatcgaaggataaatcaatagcctattgacaaaatggaaacaagcacaaatgttaggcaccacaatgaacgagcttgcaaattaggtattaaccagaaattcaatagggaaacaatcactataccaggccaccctgtcttgagagtacgcaacgagaatcaccaacatgtccaacaatcatttggttacctctgatgacaaccacacatgctgtgctcccttcatacgctggcccagtatatgtcgcctgggaaaacaacaaccaaactgaagtatataacacagaatcacaacattgttagaaggaaaaggctaccaaaaaatagctcaagaaagccaacaggtatagaaaaacatttctgaaaaccaaaccaatgtatgaaagaaataaccatcgaagggatatcgcaaacaatacctcaatttggatagcatagtatgataagaaccaaggtgcaatgagaacttaagaacctgttggcctccaactcagtaaaccagccaattgatatgtaactaattgaaccttttttaataggagcaattagtcgagattagggttaaacatatctcctccaactccaaagtacatcacaagaaagaacaacagtctcgatatcaaacacattcttccatttcctttttcatagatacaatatgcacactgtccaacaaatacaattttgagtaacttcttcacgatatgaatatttgaggatgctaggggttaaaagattactacctgtgggaaaggcttagcacagacaccagccttgagaaaatacatacatccattatcatgaggaataactaactctctccaagcatcggactgttgcaggttctcatccatgctgcagcaatcacacgaacaatgatatcccacatttccaagtgcagctataaacaaaattatgtaaagtaggccaaaataaccttaaaaacacattgtccagtgcattaatcagatcgttgtgatagtcttcatgattgcatagctcaatgtgaaattgttttgcgcaatacaatgctacttcagctcctgagatagaaaaaaacaattcagtatggcgtctcgctcaatacgatggatcaagattacttctattgcatagaagcttataaatcaaaacactgttgtgaacattagtagcagaacaacacttgaataggcatcattaaaaaaaaactaacctgttaatctgtaattatcctctaaattatcatcaccatttatattactagtaactcatattcatgcagtgttttatctctcatgaattaaaatttctttttatgtagttcatgttatccttgcaagcatgccacacgaatgtgattactgattagctaacttgttcattatccataactgtagcatcatatttatttgaaaattgacaggtaaatgtttcaacatataccacaaagttttcaaaacatgcgcagagataaacaaagtgatacacacagacaaacatagcatgacataacagttacgccaacaatttggagggtttgaaattaaaaaaaaaatgagaatgaaagcaaacctccatggccatcataaacaccaaagaaagacgtggacgtggcatcatcaagatttagaatagctgcatgctagagaatatagagggcatatgtcagtcacagtattttgcagaactgtccctttttttttcatacaaaaggctgcaagtttactcacagcatcttccattttctcaccccatccttgcatagacgacacaacatacttaattctgtcattctcttcttcaaaagtgaacttcgattctacaggaaggctgttacccatagcggaacttgctttgctgaaaatttaacatgaatacaaatataaaataacattattaacaaaaacggggaaagacacttaaacaataatacagatcaattaaatgccagaaagctaggttacatatgaaataaagtgaagtagaatcatcaaacttgatatggcactacttatctagctcaaagcacagggtgtaattggtgctttcattcagggcccttaaatgcttaaatgcatttttgagatatataacatggaagtatcaatcttcagttgcagtgctgcattattttacacctaaatcttattttattactgcgaacaaaatacacacaaggttttctacaaacgcgatataagctttactgacacatatcataacaccaaatttcaaagtgagataagaagaggaaacgagcgcataaagtgtactgtacaagaatgatcgatttcctttagatatggcactgcttcggcgaatcaaaacttaaacaattgcaaacagagaatgaagaacagaagaaaaaaagcaagaacaacctaacagtacagtacggcaccgaacgccatcacagagaagtgaaaaacaggttacagacaaaaaatgcacaatatctcggtaagggagaaggaagccaaatcaagattcaagagatggaagtttctttgataggtaaagaatcagaagatttacaagtaattcaatggagcgacacatgcagaaatcattgaacgaaaaaatagcatcgagtaaacaaagccacaataggacagagagttctttcgaggcagaaaacagagagacgtgtagagaagaagcatcctgcatattgcatcaggagcagcgaaatgaacagaagaaggcatctagctaatacaaattcagaaactggcacttccgcagcataccaaaacagaacaaactgaaaagagaaacgaattgatgtggtttaatttctcgagcttgcactggtagaaatagagaaacggaaggcaagatcaagaccaaatagagaaacggaaggcaagatcaagactaacatgttccgaggagaggcgaacgagatcaccatgaagcttccgtgctcttcaacctcctccaagaaactcacacacccaacttcaaaagcatcaagcaacaacaacacgggaaagggaagccaagaacaggaggaaaaaaatgatcacggccaggtaaaatcttagcaaatttcggattccgaaacgccttaaaattcgagaagagaacgaggcgccgttctacttgatcaatacgtaaggaagacgggcagattgcatcaggaacagcaaaaagaataagaagagggcatttggtttatacaaattcagaaactgacacctccgcaacacaccaactgcaaaacaggagccaaaaaaaaaaacaaagcagagaagagaaacgaattcatggcgtctaacttctcgcgcacgcattggtcgcgccaggaaccgtcaagatcaacgtgctccgatgggagagaggcgaacggagaccaaccatgaagcttcggtgctcgtcgacctcctcatccaactccgagaaaaccacgcctcaaatgcatcaagcaacaacatcacgggtacgggaagcgaagaacacgaaaaaagaggaccagaccgcggtaaacaggaaccaaccaagacgcagggtgctgctcgattcagcgaagacaagaacgagagaaaccgcgacaccaaacactccaagcaaacaaacaccaccaccaatggagcaagatcgaagaagagtagggagaagaatctcacggcgctttcggagaagaagtagggtttagggatggaggcggcggatgaaaccacagaggagaggaggatgaagtgggagagagatctcacctctcacctttgccgctgctcttgagacgcgagagagagagagatgcggaaaagtggttgtgctgcgaagcgcaaaaagttgtgcttaaatacctggaccggacgaatctcctccgtcggatcgtccctcgcggctgatccaacgctcgaggagtggccccatcctgtggctggtggtccccacggatacctcgcccctgcatgactcgtccaattctcttttactcatcatcatcaactattagtcagttcatcaatctgggtacaattttcatcaattctctttaatctggatcaggacaacttccatacaatctccacacgaatcgacaaaaattctagcattttcaaatcccagattaaaaaaccctgtaatatgacaatatcaagcctaatcagaattagctgacctggaatttctaatattacatggcaagataatatatgcttatttacaacttaatctagtacatcgatcacatcatgttggcaaatggtatgatgatgttatcaagcttagaaggtagcgacctgctgctgctgctgctggccttgctgtgatccgccgattccagtgctcgtgatgtctgaagggccatctcagaatgaagccgcaggcaggtcatagccatcttgaagacaaacatgccaatgggaggagttagatgacagtgtgaaaagttactgagtttccagcttatactgaattggtctcttttaagtaaaaactggtttccagcttataagtaaaaatatgtcctgtttttcgttacaaattgctgaaaagagctgggtcactgaatttgtatactgaaggaatgagagaaatgagtaggttacagaaaactaaagcatataagggtaggttactgaaatgattaggcgatgcagacaaactttgatacaaaaccagcataactgtactcctttgttcgtcaaaaaatgacctattattattgtgtgtggttttaagaaacaaatgtcatcctattataccataattgctctctacgtcgacgaacaaaacacgaacaagtgatcgataacagatatagaccagagtacttactgatgtgcattctgtatcaggatctgtttctgcaacatgaagagcccatgtgcgtatccattccaaaccagtagaaacatcctgatttccttctataagagatgatgcaacatacgacggatgcagcgctatcagtatgcaagaagctgcaaacaacacagacctcctgacgtatgcttcgggatgttgcgaaacagccctgcagaaacaaaatccaatgtcaaaatcgtaccacttggttataactaagaaagtctttaacacggaaatgcttgttttaggcttggcatacctagatctgatcatatcaagaagagctggggcaacagctgatgcttctggatgcattgccatgcacttcatacagacaccaagcatgtatatcaatttacctaggacaacaaagtcccgattgagcaagtcaacaccatgtgatcttttatcatatccttgcataacagggagcataaaagcagcagcatataaaggaaatctgttttttgaccactctgtctgcaaatctttagcttttccaagaccccatttacgagattttcctgatttaacttgaccagatctagatggaacttctctttcataccggtgtgaccaattcagaagtgttcctgattctgagacttccctccaaggacctgcaccagcaggtccctgatcactaggaactagccaagagggagaggtgtcggatatcaagtttccatgccgcagctctctccttacaattttagtttccgcaagctcctgtgcggcctcagtcataacatcaataatcaaaatgcgctgacttacatccacgcttgatgagtacagcaacttggtgagaacatctaatggttcaaatgtgcaggttaccagcaaggcaactaatgccttctgtctcttttcttcagcagaatcttcctctccttccattgccacgtcagaacatcgaacatgcacaagtgctctaacaagatcacctgagttgtggcgtagttcatcaggtgatgctctcacaagcttttcggcagaactcagagcgttttcaaccttgggtaaaaaaaaagggaggatgatcagaattttacaataatttgctctggaaagtacaggtagcactagatagaaacttacaccgtctggatcatcaggttttcgtagtgcagcagcaagatcttttaattgggtgaatttcttctgcaaatctgagtcatcgtctgacagatcatatggctccagggatgaatcactggaggcatcaatgttcattatttcctcatcacattcttcctctccgaaatgcccattcacagcagaaccagacgtttcacaagaatctagtgatttgatctcaatgatttttgccctgttctctgaagtatcatgtttaatagcctttgcccttctctcaccagcatgtttcttgttctcaggcaaagatggtttcagtttgcttataagttctacatcctttgaaggggctgtgatttccttcggagataaaaccccaaagtcccactcaacattctcacaacagttatcatcaaggtatagaggtttgtttggatcaccaactttagaaaatgtcaatgcaatagcactggccatcttccggattaaatcaattggactctctaacctacctacagcaaaagagcattcagtattaccataataataatatgataagctaatgcagggggggtggggggggatactcacagcttacaccttcaagaatattgttcaatacatctttagttgtttctaattctctttttgacatcttctccaaacacaacccaattgctgcagtgatgtctgagtgttgtttaaggggaacaagtcaaatgataatttgcaaataaaaagtgtgtaatgtaatacagttttgagtgcctcaaaggatacaagcttgttgctccactgagtatgcctggacaaactctttcttggaccaaacactgactaaagtgtgcagtgtaccaaggaagctcgatgtcctttgcttctgtgtttctatgcctgaatttggtggcaattcaaagacagcatagtgaagaatccatctcagacaacatagagggaatgttttccaacgcaaaaatttgtcaacaaacattgccctgaagaaagcacagagaattaaaggatgaaagaaaagaaaagaaaagacgcgttgaagattatttgatcaatcgctgcatgccaattatacgctgaatagac

SEQ ID NO: 72176 - DNA, 4465 bp, Oryza sativa
gcccctttataagcacccccgagctctcctctatccgccgccacctttgccttagcccgccgtcgcgtctagcaccgcctccgcgtagccctagccgtcgccgtcgttgccatcggttcagccgcgccgcgccgccgttgcagccgccgtcgtcggtcgccgtcgccaccatcgggatcgcgaggtcgtcgccatccccgtccaccgcttcgccgccgccgaagaccgccggagcgccgccgtcaccgtcgacccgaagaccgtcgccgcttcttcctcgtcgccggcgccgtctgttgctcttccgccgttgttttggtcaccggtgagttcgccgcgtcaccctctacccgttggtgtcctccgtttgcgtcgtcgcgccatcgttcgccggcgagcatgcgccgcccgagccgtcgccggtgatgacgtcatcgctgacgtcatcgttgccgtccgccatagaccggtcgtagaccgtttagatcttggccgttcgttgtggatagggtagatctcggccgttcgtttccgtgagccgccgccgtgcacccggtccaccgtgaacccgagcccgttgacgcaataatcctcttttccttttcaaaaataattcattattgcgtcataattcaattaaaatctatataaatgttttaatccgatttaatctttaaaaattcataactaattctttgtaactcagtttaatgtggttcaagttgcaaaggttgtgtaaaataaagatctacatattaaaattatccataaatagaattaaatttatttaattctttttaaatgggctttaattagatttaatcttgtaaaattcgtaataaattcatttgaagtcagaatgaggccgttcaagtctcataattcatctaaaatcatgatctacatgtttgtttactttatattactgtttatttggtttttattagtctttttcttcgttttgcgtgttagcttgtcgtttccgtcgttgcgaaggttcgcgagtgtgctggaggtattcaagaagattaattgaagaccgattattgcaaggcaagccacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctttatatattggttcagctagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtataatatgattcattgcggagcaccagactgagaagtggcggagataagcccacgggggtcgctggggaggccatgccttgttttataagggggtgattatgatccaggaatggtgcattgtggtgagttgtgttgtgcagagggtattgtcacagcctctattcgggcactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatactatatctggtaataatttgtttagctcctggtttggagttagatctgtacagccgggtatggttgttcaggatggttgggcctgtgcagcatgggtgtgctattcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggattggagctgaagccatcgctagaccgttattccgctgctattttcttttcttttgtaagcgtgtaacattattattaagatggatttgtatattaaattgtcagtttgtgtacctcggctgattcctggacgaggattttatgcacaaataagtttggaaattactagtgaatttccgggcgtgacttacagcatagtcaacctgatcttgaatgttgttgaactgcaactgcgttgcattgtcgtcttgattaacacctccaccttgaactccctgtgaaccatcaccttgaaccccctaaaaccatcaccttgaaccccatgtaccccttgagagttgtcaccttgatttggtggaaaaccatctgtagcacctttgtcattcagttgagccgagccatcttgagtttgttttccttctccatccttagaggaaccagtctcgggatcgtcaagaaccacctttattttatacttctgaacaagtgtccccttgcgagtctgcatgaatgagttcaagaattgatcacgtgctgcctgcatcatcgcttcaaaatctttcttttgatcaggtgtgaatttttctggatcgatgggtacgacgttcccttcattgacgtcggtcaaacctaacttctggatcttctccttgacagtgcctgaactagccgaagatggtgatagcggtggtttctcggccatgagaaggaattgcttgtctgacttcttatcggtcccatcgggcatgccaaaagagtgttgacgtaaaacacgaggcctgggagatctgtttaactccagtgcaggtccaaaactcgccttcgggtatgctagcgtaccagtcgatttgatcggcagctggaaatagataataaaggactaaatctattcgatcggctgtagatattaacaatatataatttttacatcgatatatatttaaatcaagtgattgggatagatcggtcgctatgccgagacaatataaatcacttagatcgaaatatatattaataaccgaactatatatgtttacagcatagctgatcagatagatctagcatgtatcggctaatactctgatacagttctatgttaagatattaaaacaagcagaatataccaaaccaaagtttaatatacgtagatgcaataatatcttgacataaagggcagatttaacatgtcaacgaagcatatagagcaaatgtagttaaaccagataagatcggctgaaactccaatactaccctaatcggcaactagaaggcaggctagagactgatattctaagcacgacttaatagatcaaactcaagtgatgcagcattaagtatgaaaagaagaacaatatctagacaatcaagccgctggaagtttcatagagtggtggagatcttatataatctaaatcaacatcaaaatctaacctaatcggctgccctctactgacagatgttagtcgattgtaggttagataatgatattgccagagattatgtaagatatatgataactcgatgaattacataaacatgattagagtatcataaagatggaagcactaatcccgagaacgcaagccatcataacaagttttacctcttgttgaagatcgaaaccgatgcagctcaacccgaaagcaaggactcgtcgaaataaaacaaaagcaaaagggtggtgatgcaccgaaattgtattgaacgagtgtgttaactgattacatggggttcgtgtcacaccctgaagtttctttcccaagcctaaatgaaaattataaatcacctagagaaaataccggtgtcaaagcaagacaaaccctaataaattaatgcaaataataatcggaattggcatgtgggatttttcttgagttctatatgtcgaaatatgctaacaagatttttagtggaatttttagagctctagaaataattttaaccaattaaaaatgagcaccagcattatttaatccttggaaattcttttctttttttcttcttcctttgtcccctcctttttcccaaatgggccgccggcccatttcctccacctcccgcgccgttgctgggccgaccgaaggccacagcccatccgctcgcccgagcctcccctctccctcgggcgctgacaggtagggcccacctgttaggcccatccctaacctttggccgcccaccgtctgcagacgccgcctcgcaaccgtccgcgcccgcct

SEQ ID NO: 72177 - DNA, 4661 bp, Oryza sativa
ccacgtgtgcaccacgtggtgcgccgctcctccccggtccatggacacggtccaccgtggaccgccctccccgagtcactgccatgtggggcccgcatgtcggcgccaccctctctctccccgggattttatttattacgcaataaatcaattaaggatttttctgtttatagtaaaagcacattgaatcttctaaaattcatatctaattcatccgagctccgtttaagcccattcaagtctcagtaaatcaagaagaatgtgaagaatccattaaaaatggttttgttctttgtttcagtagtcttatagcctgtttgtattgtttgctttgtatgtcgcttagattccggctctccggatgctccggtgtactttgaaatagtcgccgaggttcctccagcagtagagcaaagcaagtcatgcttgtcacttgaacatgttgatcctatattacaaatgctctaccgttttactttaaatgctgcatcgttttataatgtcaccatgggatgtttacctactgttacagccatactagttttgtatcatgctccgttgttagcttggggatataacatgacttgatattagactagggattgcttagccatgcttagttcaactagcacacagtggggaaaatacattaaagcatagatatctgattctagtaatgatgttggttaataccaccgctccggtgctggttaattaaaatatattaaacgatgggctgtgggtgcttggcttcgatggtcgcgcccatggcacttaaggatcggttcgcgggaaacccctggaagaattccacgtacttatcacaagctagcgtgggcaacggctgggcttgtagtgtagctttcctctagctgacgcatccaggcaagggtgggcgtgatggagccgggcgggccctgcgacggcctctgttgcttccggattctcctaggcacgagaggggactgcccgttgcccgctggggacgggggtgaaacctgaggtgtggtgtgcttggctagatggggttatgcgaagagtcctgtcacggcctctttccggtatgtcgtggtggcatgtcggcgtatggaaacatgtcgtggggctgtgtcttgtgggtacagttgtacacctctgatcagagtaaaactattcgaatagccgtgtccgcagttatgggcggtcaacgagattcaccgtgattagtctcaccctagtttagtctgatggaactgattagttcaggtggttggttgggcctgttgcaacgtggtatagcgttggacagtggatggttaatattgattaattattacacctgattttcctgctttcaactactgtttataaatgctcgctttatacaaaagaacctctctagctatcctttggtaatatcctgcatcataccccctgttccggtatgacttgctgagtacggtggttgtacttagtcttgctttattttccccaaacccccagagtttgagtatgcatcagatggtggtttctctgaggagtaggcttcgtccgtgccggcgagaatgcctgtggagtggtgttcccgctgcagtccaagtcaaggcttagctccagttatcttttaattttccgctgcatttatgtaagacttttataatatttgtaagacgtggatctatatgttaactttgtcgtttgtgtaccccggccggtaatggacggggattttaatgcacattctacttagaattctattcgggaatttctgggcgtgatagttcggggtctatttatacccgaaaattacaaactatgtccatatcggacacgactcttatctctaacaaactctaagataccataagtctttgcggcagactttttccctaaacatatctctaaggaaattacataaaatgtcctaattaatagatacaattgccttctcaagactctatccatgtgcggcaaccatcttgaagcatcttaattcaacctgatatcgtataccaagtcgtattatcagaatcggctatatcaacttactcagtccgactcggatccagccgatcctaatcgtagccgatctggactccagccgattcttgctctattctcgaatcgatctccgccttcgactccacttcgatctaatcctcttttccgatgctgatattaccaaatttggtcgttaacaaggggaagcgttgggtcggcgatgaggagggccctcgcgccaccgtcgccactccctccctctgctccgagcccggcagccaccggcgccgccgctccctctgtccgcttcaagcacggcagctgccgccgacaccgctccttcctcctgcgcgccgatgccaccgcttcctccgtcggccgcagcactcgccatcgccggcgactaaaaactgaagatgtggggattgggaatttgggatggagaggtggggatagggttaattagtaatatgggggtatttttgtcactttggggtagtatgttttttttttcttttttctaaatgttgttccaacggtgaagtctaaacagagtcaaacggaaacttcaatttcaaaaaagagggtcaaataagcaaacctgaaaaagtaaggtcaaattggtagttgggctttaaaatagggtcaaataagcaattgtcccaaaaactaatcaagaatctattagaaatgaacaaatatcaatcgtgttgggataatttgaggactgcacgacttttcttctcgtcggagaagacgaaagaaaggttacagattaatttttatttgtaaatatgccgtttcttattcacttaataagccaaatgatgggggcctcgacctttattagaactcaagtgtacagcacctccactcttcatcatgctatagtttataagagctcatatgttggtgaaatatgaagagtggcagtactggagacgatcataatgttttccagacccccagttctctaagctagctagcatgtatttatatttttcaggtagtgcgatatcttttgtaccaactagcaaccaaaatattgatgaaagaattagcaacagcaagtgtgatagccaccagcagcctcaggttttcttgcatcaacgaacatctcctcacagcagacagcactgttgttcgttcattagccacatctgcttgtcttccgtcttcagcttcagcttgccatgaatcaaattcccagccggtttgtccccagcagccagcccgccatccatggttggagctagacatcatttgcttcctgctttaacgggtggataccgatgcttctcttctctatgcctctcattccttagtcatgcccagatgcaggccaagctaacgagattgtctaacaaagagcatcaatgtcctttgggatgtttctgcgcagttcttatgtacagtagaaaagatgaatatgaataggatgattggttgaagcaatttaatggtactactgcgtgatcacggggatttactggacaatgactgccactgcaacccttatactacatctatcttccacgcaacaatgactgcaactgtaggggtgaacgatgaatgcaatatgaaagtttattaatgtaattttagtgctacaattgtactcgctccatttcatattataaatcgtttgaattttttcttagtcaaacttatttaaattcgatcaaatttgtagaaaaacatattaatattttcaataccaaacaaatatattatcaaaatatattcaatattaaatttaatgaagctaatttgatgttatagatgctactaaattttccaataaacttagtcaaacctaaagaaatttgtctaatgaaaaagtcaaacggattataatatgaaacggagggagtacaaaactgtagggatactcggtttgagtacggtatcttgaaatcacccatgatcgtccaggattttgatcgtgtacagattgataaacaaaatatctttcggtacatatatttgagattttacataaaaacattacatatgagtatattagagtaggttttaggggccgatagaccaaacttacaacgacacactccctacaaatagaaaaaccatacacaacataagataaaataacaaaacaacacaggtgttgcctgagagcggatcgacctagaacgtgaactcgtcagcaccgaagaaatcttccccttcccgcgcctcctctaggaagagccgatcatttgaaatatgtagttttgtcatatttcaccttaaatgtatatgttttttttataaatttgatgttaaatttatagttttgtgatgcatcatcttaaatctagttatatgataatgtggtcaatatatatgtcttacttaaaaaaaaaaccttggtatctgcttggaaggcgtcttggacctaaattcaacgtacatgacagccccagttgggctaaagaacgttttttagatggtaatttctataattacaaccccagttgatcctagcctacctaaaaagtaaatatctcctaatgccacaaagaaaagacaggagttgtcaagggcaaatccaccctgtgtcgtgaaccataagcttcatggaggccatcacaatcctttcgtaggatccatcagtccatggcaaggttctgaattgctgatgccactcattccaaagccggggctgtttgtgttgtcct

SEQ ID NO: 72178 - DNA, 1584 bp, Oryza sativa
ttatagtatgtagaaaactaccaatccacttgcaagctagtggatgtgattttcctattcattcgtttgaacgggtctgtccacttcatgggagtacgagttatcggtgttatatggagattaaccggtaattcatacattaccataatcctacggggatcaacttattcttccggaagtcattttctctactatgagaaatattctcgcttctaggagaaaaactcttcgtgagtcatcgtaaactcttctacgagtcttgcaattctcttcatgaaaatatagtgtgcttcatgatactaattagtatgagatttacatatatgttgcggaattgttttctttctagtgaaaacttcatatggattttcataacccataaactgcatatcatttattcattcatgacttttgccagcgatatatatagtggaatttaatacattcatagtaggagaatatcggtcttttccatgaccaaatgagccgtcgcttttcaccacttcatttcctattaagtctgaacttccatgttcacatagacttatttagcgactatggttcaacctcattgctttcttcaatagacctgatatgagtgctactatgcaactctgccatggactttggttccggatccggattctcattagagaaatattagtaatcatagaggcgatgttgtcgacaactattattttctccacatactcattccgtgaagttaattcattataaacaatatcttagtcatttccaaacataagatgtatggttgttccgcaccccagaattagatagatgtgcgttctgggttttcatcttcatgatgaacctcttcatgaggcaattcaccttcatggtgattactctacaagagttgtaaggagttattaatgggtacattgaaaatagtcattagatcttagaatccgcacgtgttcccgtagattttagaacattgactaacatgtcactctgcatttgtggatatactattcaaaacccggggtataccactgttagcagaaagtttactacaagtaaacataacttctgattactcctttaattcataattatctagcaagcttccgcttctggcttacacgagaataaactaaaccttctagtttagtttggcttgtacgttattcttacttataaagatctttttcttcttgaaaatataaggcatctttaacacatgggcttttctccccctgatgctgatattcgatctttatctaatagcatatcacaaaaatcccctatcataggcactggattaatggaattcggtccatttgtatccccaacttcatgtggaggcccatatatgtatgctatggtggtgatatatgagggaaatgttcattcattgaacatgcacttatacaaaataaagggggtaaagatattatatgcagtgagctaacataaaaattaatgcaatggcatgaaaaattgcacatccctaatattgtaggttatcccaagtcatagagggttattattctgcgacaatgaagcccaaacaaatatccactagtcgacaaaattcctctattttctagctttttt

SEQ ID NO: 72179 - DNA, 8805 bp, Oryza sativa
acactatggaatggttggattattgtggaatggaattcacacctccccctctattcaaaatcctcaaaatggttttaggttgggctcggggtgcatggttttgatagtagcacctcggccatataaggactggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcatagggccggtgtcctgctgataggggctcagtcctgcctacctgtcccaggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttataggcaagccgagcaatgtacccaagttagtgttttaattcttaaaacctgcttaacaactgaaatgtggaaatagttggcctgggttagcttgggacgagctgggaaccagggtcgagttgccagttcggtctgaatcatcgtaggccttgggttaaggcaggttcgtgtgggttcacggccttgattaataatcttgtatagctctaggatcgtatttacaaaatagctttgagcaactaagtgtcttttaatgctgtttactgcaaaccctaaccctttatattataacccccttgtactcccttgcatttattctgcacttatgggtgtgtcttgttgagtacgttggttgtactcagtcttgctcaatttttcccaaacccagaaaaggagcccctggatgatgaaggctttggtgtttagctcgtgcctgccatcaagcgcctgtggtcatcgccctagtcttccgctgtttcccgtttgtcttcttgtgtgctgggccttcgccgcccatgtaataaagtaactatttatgcttccgcttgataaactctgaattgtatcaactttcagtgtaccttgcctcctgggacaaggaataatacacgcacgtaaggaacgcccgttgggttatttccggtcgtgacaagttggtatcagagcccccttgaccctaggacgagccttagatcccaagccttagcaatattttcgaaataaaaatcctttcttatttgtgaaaatcctctagtctctctctgtcctgctgcttcatttatcgccaaaatctaatctttaaaatgttgcttttctcttttgtctttttgtttgtagatggccggcagcatcaaccgtcgtggtctggacctgactagcttcgttttggagctgcggggcatgtgcgttgtcctggggtatccgcatggagtggattaccagggcaagcagctcccggagcaggagggtgacgatgtagagccccatgctgcttgggaggtcactgcagtgatcctcactggctcacctgagaggacttcgttggcagtcaccgcgggaggagattctttctctgccgcttgccagaacgccgcactcctcgccatcggcactcttcaccagcgctacccggacgagttgcagcactcgccctaccgctaccaccctcgtcgcggaggagcccgcgactacgccaccttcagggatgctagctcggaggatgacgctaccatcatgcacctggcacgcatggtggaggcgtacgacgcggctcgtatcgacttccatcagatggtgcgccgcgggttggtcgagaacaacatgaagatcctggagctgcgacaggagaatctgcagctgaagaaggacctagacgcagtggaggcgcagctgtgtcagctcaagatcgcccagggagaggtctgtcgccccaagcgccgccgcgtctgccgcagcctgaagatcaccgcccgcaagagtacctccaggcctgagcttgttcgtcagtccctagcgtggacctgctttgtcgagacccctcgtgccgagcccgcgcccttggttcctcaggaggagggagcctctggcgtgggtagcacgaaagatgcgctactgctcaccttccgccctggcccgtcgcagaagtagacgagcagttagtaggcttgcacgtgtgttcttctcgttggtctttctgcttgagtcgtgtggggcatggttataccggtgtggggtataactgtatcggagcctgtctttattttatttgcttaagcaacttgaaccttaatgaaccaatttaatagcagtaataaattcaagaattatggtagtcgtggctagttagttttaatagtcagctctctctgtttgccggttctgtgtgggattttgagattgtgacaaccaggagaagtgctgctaccggtgaaggcagtcaccccgaaggcagcaaccacaacaaccatggcagcccacctccacctcctcccctgcctccaccaccaccaccagacaccaactccatcctcacccaaatcctcgcccagctggccaacatgacgactgctttcctccaccacatccaaaatccgccacagcatcatgctccacctccaccaccacccccacaacactctaaactcgctgagttcctccgcatccgtccgcctaccttctctaactccaataaccccgtggatgctttggattggttgcatgccatggggaaaaagttagacaccgtgcagtgcaacgatgaggagaaagtcatctttgccgctcaccaactgcaggggcccgcatctctatggtgggaccactaccaggctacgcagccagaaggacagcctattacttgggcccgtttcaccgccgctttccggaggacccatgtgcccgccggagtcatggcccttaagaaaagggaattccgagagttgaagcaaggcaaccgctctgtgatggagtatttgcatgagtttaacaacctggccaggtacgccccggaggatgttcgtgaagatgaggagaagcaagagaagttcttggcaggaatggaccctgagctgtccgtgcgtctggtctccggggactatctggatttccagcgtttggtggacaagagcatccgcttggaagccaagcacaaggaactggagtcgcacaagcgtcgcctgacgaatttccgcaaccaacagggggctaaccaaaggatccgctacaccaatccctatccagggggatcctcctcgcagcagcagcaacagcagcagcaacctcgctccgtgccccaacctcaattcgtggtgcgcgtcccacagccgcagcagcagcagagtgtcacatcctgatttttgtttcaggatttataaattatttaataaattaataatagaatttatattaaatgatctttaatttacaagtgaagttaaatgtgggaaataaaattttctaaatataaagcgtcgatggatttaatttttaaattctccatgattaagtcaactctctgaaattttctcggatttttcagagctcaattcctaaatgatacaaagaacagttcagtaattatttgatcattaatgatctaattatatttgttaagagcttttcttgtttaaaaatccttaaattataaattgttgtttaaaaggaattattagaaatgatcttaaaagcctaaaagagaagatctaattttaatttgctaaatctcaatataaaattgggctagataaaattttgttaaataatttgcttaattctataattcctagatttttctgggatttatttgagctaaggaagtatttttaataaatggaattgcatttcatgaataatttaaattgaaaaaggtttttaaaagtctgttttggctttgggccgaaagccggcccaaaaccctctctctctctttccctcggcccagtccgccgcgccccttcctcctctctctctcagccgctgacagatgggccccatctgtcggagccgtcttcctcctcgcgccgccgccgccgcccgaaccctagccgagccgtgcgccgccgctttccaattcggccgcgtctttccttctccggccgaatcttttgaggggaaatgatcttcgagatctcctcttccttttctcttatagaaactccggtcaatttcgtttggaaatcgacggattcgaggtcgattcggatcgacttttctccctccaaccccgacctttccttctcgccgccggtcgccgtgggccttcgccgccgcctccttgcccctttataaggatccccgagctctcctctacccgccacctccctcgccttcgtctctcgccgtcggaagcgccctagcgtcgtgtgacctagcgccgccgtcgtcgccgctccagctgtgcgccgccgccgttccggtcgtcgtcgtcgctcgggaagatcgccattgtgatcgccaagtcgccgccgtcctcgtccaccgcttcgccaccgccggagaccgccggagcaccgtcgccgccgtcgacccgatctccgccgccgcttcttcctcgtcgccggcgccgtccgttgcttttctgccgccgttttggtcaccggtaagttcgccgcaccgcgctctacgtcctggtgccctccgttctcgtcgtcgcgccgtcgttcgccggcgagcttgcgctcccgagctgccgccggtgctgacgtcatcgctgccgtcatcgctgacgtcatcgttgccgttccccgtgagccggtcgtggaccgtttgatctcggccgtccgttttggatagggttgatctcggccgtccgttcccgtgaaccgctgccgtgcgcccagtccaccgcaaaccctagccgctgacgcaataaatccctttttccttttcaaaaataattcattattgcgtcataattcaattaaaatccatataagtgttttaatccgatttaatctttaaaaattcataactaattcatttgaactcagtttaatgtggttcaagttgcaaaaattttataaaataaagatctacatattaaaattgtccataaattgaattaaatttatttaattctttttaaatgggctttaattagatttatcttgtaaaattcataataaattcatatgaagtcagaatgaggccgttcaagtctcataattcatctaaaattataatctacatgtttgtttactttttatgtattgtttatttggtgtttattagtctttttcttggttttgcgtgttagcttgtcgtttccatcgttgcgaaggttcgcgagtgcaccggaagtgttcaagaagattaattgaagaccgattattgcaaggcaagtcacacagatcccaaacacaattcctttgagcatgttgatcctatattcaaattctctatttatttcaactgtgcatttatttttgaatgtcactgggtggtgtgaacctattctttgttatggcccttttgtacttgattactttattccttgataccttgggtgattataacttgactagttgggctatatatatattggttcaactagatattagatataattgcttagccatgcttagaaacattagcacactattgggataacttattattcactattatttaatggtggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcatgggcaacggctttacctttcgtatagcatggttcattgcagagcaccagactgagaagtggcggagataagcccacgggggtcgctggggagtccatgcctctggtttttgaggggggtgattatgatccaggaatggtgcactgtggtggattgtgttgtgcgaggggtaatgtcacagctcctttccgaggtaccgtggtggtactgaggcacatggtgacatgatgtggggctgtgtcttctgggtacagtggtacacctctggccagagtaaaactattcgaatagccgtgcccgcggttatgggcgggttgagcaatgtttttcgtgattagtctcacacctctcacaataattatggatgctataactggtaataatttgtttagctcctggtttggagttagatctgtacagccgggtatggttgttcagaatggttgggcctgtgcagcatgggtgtgctgttcagtgttgataaaatttctgattaattactccactgttttacttctcttaaatgttttgctaaatgctgcttttgcaaatgagcctatattatgccatcctttggtatcctcgtgcacttgcatatttgctgtgtggcttgctgagtatgtcatatgctcattcttgcaataatcaatcaacctcagttgaagaaaaagaatccagaaggagaagacgtttggcttataccccagttgagctgcctgtgggagtggagccagagcttcgctagattttattttccgctgcagttttcttcatggtgaggactaagtgcctcttaagtaagtatttatcgttttagttaatttgatgaatctgtatattaaattgtcaatttgtgtacctcggctgattcctggacgatgttttcatgcacaaataagttcggaaattactagtgaatttccgggcgtgacacagagtcagcaagggacccgtgcgccccatcctcctacgccagccgtgcagcctggacaaggccgcagagacgttcaatgtcagcagcgtctgtgcttcaactgcttcgagcccgggcacttgcggataaatgcccaaagccgaggcgccagcaaggccaagcgcctccccgccccaacaacggtggtaaggatgtcattcggggtcgtgtgaaccacgtgaccgccgaggatgtgctgacaactccagacgtcatcgtgggtacgttcctcattcattctatccctgctaccattttgttggactctggagcttcccactcgtttatatctgtgccattcatggggagaaatcaattgggggtagaaaggcttagaaaccctctgctcatcaccacccctggaggggttatgacagcaaagtattatagccctgccgttcctatagaaatccagggaattccttttccctcagatctgattcttctagacaccaagaacttggatgtgatccttgggatgaattggttggctcaattccaaggagtagtggattgcgcaagacgcactgtcactctgtaccgagggccggaacaaccggttgttttctttgcacccccaacctctgtcggcagttccgaacttcatcagataggactgtcggaaaccctcatcgtcagtgagttcggagatgtgtttccggaagaactacctggtatgccgcccaagcgagagattgagttccggatagatcttgctcgaggaaccactcctctgtacaagcgaccctaccgcatggcagcaaatgaactagtcgaagtcaagaaacagttggaagagttgaaagaaaaggggtatatacggccgagcacttccccctagggtgctcccgtgttttttgtggaaaagaaggacaagacaaagaggatgtgtgttgactacagagctctcaatgaagttactatcaaaaataagtaccctcttccccggatcgatgatctgttcgatcagcttaaaggtgccactgtcttttcaaaaatcgatcttcgctccggatatcaccagttgcgtattcgtgaagaagatatcccgaagaccgcgttcaccacgcgatacgggctgtatgaattcacggtgatgtcgttcggtctgactaatgctcctgccttcttcatgaacttaatgaacaaagtgttcatggaatacttggataagtttgttgtggtcttcatcgacgacatcctggtgtactcacaatcagaggaagaccatcagcagcatctccgtctggtgttgggaaagttgcggaaacatcaactgtatgccaagcttagcaagtgtgagttctagttgtccgaagtcaagttcttagggcacgtgatctctgctaaaggagttgccgtggatcctgaaacagtgaccgccgtcactgattggaagcaacccaagacagtcactcaggttcgcagctttttgggtttggccgggtactaccgaagattcatcgagaatttctccaaaattgccagacccatgacgcagttgctgaagaaggaagaaaaaattgtgtggagcccgcaatgcgagaaggcgttccaaactctcaaagagaagctggtttcctcgctagtgttaatcttaccggatactcgcaaggacttcctggtgtactgtgacgcttcgcgccaaggattggggtgcgtgctcatgcaggaaggtcatgtggtagcctatgcctcccggcagcttcggcctcatgaaggcaactaccctaccaatgatttggtgttggccgctgtggttcatgctctaaaaatctggcggcattatctcattgggaatcgctgcgaaatatataccgatcataagagtttgaaatacatctttatccaatcggatctgaatcttcggcagagaatatggttagagctcatcaaggattatgatgtgggaatccactatcaccctggtaaggccaacgtggtcgccgacgctc

SEQ ID NO: 72180 - DNA, 3814 bp, Oryza sativa
caataccctactcctgtttggctattgtatccaccggatgtatattaatctgatgacctaattatgttatgtccttggagggcttcgtgctctccttatataggttgggggcaaagttacaaagggaaacccaatcggacataacatggatttccttatatagttacatacactactacacaaatgattttcctataagagcaccctaatatattgtaaacgggtcataagtgtccacgtctggaaaaatcgacctttatttttatttttacacacaactcgttaagtggcctacatggaaaagactattttcacatacaaacatcttaaggagccgtatgcaaaaatggggatattttttagacgggcctatcaaagaaccacatgtgaaaatcattttcgcatgcgggcaactcggagataagtgggccacacgtgtccccgcatccctttttctcctcctcgtctctaccacacatttcactcctttttattttctctcttcccgttcaactctcactccacatctcctctcacccttcctttcccactccacctcatatcttttcctttcctctcctcgttctcttctccaccaccggtggctaaggcggagatgacggcctcgcaggcgggctctggcggcatgcagagacgaaggtctctttggcaggcggcggaggcagcctcaggggcgggtggtgacagcacgcggattcggccggtcccatccacgagagcgacaacggtgcgcggatctgtcgacagcgattgtgggacgggtggctccgtcgccggcaaccgcagggagggccgatctgtcgccggagaccgcaggacagacggattcatcgtcggcgaccgcggggagggcggatcagccgctgacaaaatcggggaaccccctccccctcccgcacatggatccgccgacgacgggaggggtgatgacggcagtagtggcggtgggaggggcgacgacatggtggttgtggcgacggtttctaggttactgttctgtggctagggttttgatttctggaattttttttttgcgattttctattagcacgtgcagacggcttaagcgctcgcagtcgaataagccgtctgtgtggatatatgaaacccgtaatctccacatgtagtttctacaatgcgaacgtagcaatgtctggactgggcgatctccgtgggagatcatccggactggtataccaaaacctttaagtttaatggatcaatgaattaatggagatgagggattgcttgtgagacggaaaggctgaacgaaatgacaggcagctcacatggcagaccatctgggctggtaaaccaaaaccttaggtttaattgataggatagggtcaattaaaccctagattgttcagtcccgcacattgtacttccatgcagatacctgcaatgttggttaatctagcagttatttctatcctgaagtacttactacagaatttaacaaatatagtaactaatatcttggaaacaaaacaaccctcaggaccttcttggaacacaagttttggaacgaaaatcagtgtaaattacagggctgaaaagttataagttgggctgaaaaactttgttgttcaggtggggttgcttgtcgcattataatctccgattgagcccaatccacccataaaagaaatatctcctcctggtaattaacacaaagaaagaacggggtaggagtactaatctgatctggttgcaggcgagcctgcggcctcatggtgaaccagcagctgcatcagcaagaaacggagtgtacacgacgtcactcgagaggacatggcggaccatcgcctatggcgacacgggctccttgttgtcgccatgtgtattccagaggacactcaacgtggcaggttacttgaagctccctcttgcaggattcaccaggcaatggcaagattctgaattcctgatgccacccattccaaagcaggaatagtttatgctgtcctatggggatgatcagcaaaagattgcgattaaaaaaaatagcgtctcaagacttttgtgttctccaacccctgtgtctttttttttgtgccaatttaagggaagtgaataatgatcgggaggggttcatatatatagctgagacagtgagacaagagataattgatcagcatgacagggatgagagagtaatgacccacctacaacattgcaggatcgatgaagtggatgaattttttagataatggaaatggattatatctccggcttctgtcataagacacacagccataagtttaatagtaataaaaaggtaagataaaagtaaatcaaaatgagaaataaggtgatgggacaaatccccaactcccctttattattgactagcgttcaaccatatagaatattttagctagcaatttttatggaacaacgccacccatagtggaataagagacccttggctaccgattccaagagtgtagcaccattgcgcatagtatcctgctcctcctgtggtagcattgtagaccaaaagtggagccagtaggaagacatgaagataacctacatagggttagataattgtttaccattaaaaactttatcattgtgacaacgccaaattgaccaacatacagcactagctctaattagaatcatcttcttaatggacctagatacccctctaagctaattaccgaaaatgtttttggacctacatacagcactagctccgattagaatcaacttcttaatggacttagatacccctctaagctaattaccgaaaatgtttttggcgttacggggtgcggggatattaaaagcaaaaaacacgcatctctaaacaaactaagcaacacgatactcaaagaaaaaatattggattgtctcttgtacatagcagaaagaataatgtttgtctccccccattttcttttaggagtaaattgcactggcggtccttaaacttgtgaggaggtttcatccaggtccatgaacttacaaacacggggtcaaggtcactaatcttgttttattgtatcaatccggtctagagaacgctttgacccgtttcgtgcatacgtggacagcaacgtgttgcgacacgtgtgatgccacaccgcaccgccccgcaccgtgcactttttaaatctaagcccctcagttccctcgaattctccaaaccttagccctctcttctctactctcttctcccctggacagcgaagcagaggcgatcgccggagaaattgcgggctgtgatcactggtgagatagggattgagaggttgcggggagggtgcagagacactggcctcccggaggtgttgaagccggcgaggaggcatgttgttccggctaacaggagagccgccgccggtgtacggtatgtacaatggacccaaaatttgagcttttttttggttgattgcagatgggtggtagttatgctagctgtggtctatttatttgatgatttcgagtgtggaagctgtggtcgaattttgttgattatttagggttttggtgacagccatcatagcagtaatctttgctaattaggaagacaaattttgtaatgcagctaaggattcgggtacattcactgctgagatacaccatgggggtttctttgttggctatggtagcaacagggcatacatagatgagaacatggattggtttgataatgttgaggcaaaaacttggtgtgctgttagtttagatggtttcttagaaatgcttgggtatgataagagtctaggcttcaaggcatattggttgctaccaggcaaaactcttgaagatggtcttaggg

SEQ ID NO: 72181 - DNA, 5045 bp, Oryza sativa
ttacctggcgatcgagcctgcggcttcatggtgaacgggacaaacgaagccatcgcccgcactagcaacacgcgaagtgaggcaccccacagcttacacttgaggcaggatcagcaggtgcaccagcatgaaataaaccgagtgtccacgacctaactggggaggacattccccgcaaaaaaaaaaaaaaaaaaaaaaaaactggagaggacattgcggcccatcggtatggcggcacggctccttattctccccatgtgtattccacacgacattcaacatggcaggttacttgcagctcctttttgcaggatttaccatgtaaatgcaggatcgtacaacaaaaactaagccaattagaggggtcaaatggttggagtaaccaaaaatcaaaatttttaacggaattaaaagttagcctccatttctctttatagctgaggtaggttgcctaaaaccatgaaccaaactcatacaagaagtcctaatcctctaggaaaccatgctggacgagaaacaaactttataaactccaattcacaactacagaaatgtagattggtactggttgggaactacacaaaggtgctggatttcccaaccgacaccacgaaaacggcactgatgagaagactccaagatgccggtttaggaaccaacacctttgatgtatacgatttgtaaagaaaagagtaaatttcactttgggcctgatttattggccaaagtttcaccataccaggtataactctaccttttcagttaacaccaggtatgattaccttcttttgcagtttggactgggtttcaatacttttgggccaccatgttggcttgagcctggtgaactcagttcagcgcagagagttatcaagggagactagcgcacgggaaaggaggaagatagtgtcgtggaggtgggggtggaggtggacttgctcaacgcctcgatctccaccctcgccaccggcggctcccggccaagtctccggagcagcacggcgtggcggcggcgtgaccttctccggctccgaattggcatggcggcgtgctcttcagcttcgtgtggtgttggtggaatgaatctgtgttgtttctaaatgtgtatgcaagtaagatagagctgtcaattttgccactaaaaacatggaaagaggttccaagttccatatgtacatgtacctgatcatgaggtacttgtgataatttccctttccagtgccttctctttagtggtacttatttacaatacaattagctaataattcctactctaacttggtgaggcttttggaatcctcccattctgccgtgagctgaaggagcagtgcgtgcaccccgttgccggcaccgcggtcgagcagaagaagagcatgccgccgtcctgccgcgccggagccgaagaagagcatgcacggccgctgcgccatgcctcgccagaaccggagatgtgcacacggccaccgcatcgtgccgctccgcaggcgtagaagccaccggtggcgagggtggagaccgaggcgttgagcatgtccgcctccgcctccacgacactatcttccttctctcccatacactagttttcctcgataatttctcttccccgaactgagttcactaggctcagatcaagccagcgtggtggcccaaagtcttaaaacccggtccaaactgcaaaagaaggtaatcatacctagtgttaactgaaaaggtcgagttaggcctggtttcatggtgaaactttggttaataaatcacgcccaaagtgaaatttactcaaaaagaaaaaaccaggagccgagccgatgcttgaaagccaccaaacataaattaaaaatctaaaaaaaggaacaagtacacatcacacaatcaacaagttcatagatcacaataaacaagttcatcaatacatcaagaacacggtctaaaaaaacaacatcaagaacacagatcaagaagtactctacccctgccgccgtcgccagatagaaaggaggatagggggaggggcgagcctccttctccccttccactacagccgccgctgcctctgctttggcgaaggtgtgggtgctaccattgccgtcgtggaaggccgctttttcccctcccaccggatctggcgaaggggagggtgccacccctgccgcatctcctccatccatcagagaatgcagatgcctctcctcccgccgtatctggcgaagggaagggcgctgccccttctgccgtcggaggcagtcgacgcctctcctcccactagatctagcgaaggggcggcggggtgtgaccgctaccgctaccgcctccgccgggccactccggccgccgcgagagatgagagagagaagagagagagagagagagagagacgcgtgagatagataagatcaaggggattggagagaaagagataatgccgagggctgggctcgctggcttggctcggtttgttataaaacaaaggcacttatagtataagtataggttttttctatttttagtcagtggaggtgggaaaaacactatatgtgctggttttagctattctagcccctatagtgccgacttgtatgtgccttttttagtagtgattgtaccaaatttggactccttccaaattcaactccacatcccatacgcacaccatatctccgtcgtatgtcatatggaatctataccaaccacgtgcattgatgtttagcttaaacatcccacatgatatcctaattatccggacatcatcttctcccaggttgactcccgatccatcactgacaacgctctcccgaggcatcaagacttacctacacatgaacctacaaagaagccatgcatattggagcataaaatctcttcaactagactcaacattagcacaacaatattacatacgcttgttaacgaccaaatttggtaatattagcatcggagatgaagattagatcgaagcggaatcgaatataaggattgtcgcggaaacagagtaagaatcggctggagtccggatcggctacaactaggatcggctaagtccgagtcagactgggttaagtgatacagccgattctgacaatacgacttgtgtacgacatcgggtttgagttgataagcttcaatatgattgccgcgcatggatagagttctgagaaggcaattgtatctattaattaggatattttatgtaaattctttagagataaatgtgggtaaaagtctgtcgtaaagacttatggtatcttagagattgttagagataatagtcgtgtccgatttggacatatcttgtaattcttgggtataaatagaccccgagccctatgtaattattaacacacactatcaatacaatctcggcgcatcgccacccttttacttttgttttgtttcgatgagttcttgcttttgggttgagctgcatcggtttcgatcttcaacaagaggtaagacttgttatggcggcttgcgttctcgggattagtgcttgcatctttattatactctaatcttgtttatgtaattcatcgagttatcatatatcttatataatctttgataatatcgtcatctaacctacaatcggctaacatctgttaacacaaggcggccgattaggttaaatagcgacgttggcttagattatatcgatctaagtgatttatactgtctcggcatggcgaccgatctatcccaatcacttgatttaagtatatatcgacataaggattatatattgttaatatctacagccgattgagtagatttagttcctttttattcatttatggctatcgatcgatgtacatatgacatcggcccaaaggtaaatgatatgtcatcggcacttagccgatcgactatcatttatggatttaaccacggtttctttgtctttatttcttgttgattgtaggatcaaatcaactggcatgctcatacatccgaaggcgagttttggacctgcactggagttaagcagatctcccaggcctcgtgttttctgtcaatacgcttttggcatgcctgataggactgattagaagtcagagtcacaacagcagttttcctcatggccgagaaaccgccaccgtcaccgtcctcggctagagaacctgattctgtcaaagctaagatccttaagttgggtctgtctgaggttgatgagagcaacattatgcccatcactctggataaattgacacctgaacagcataaggatcttgaagcaatgatgcagcaagcaaagaaccaatttttgagttcatttacacagacccgcaagggaacgttggttcagaagtataaattaatggtggttgcggatgttcctgggacaggttcttccaaagatggtgaactaaaacaggctccagatggtatggctcagccaggtgatcaaggtgttgcaaatggttctcaaggaaatcaaggcgatggttttcaagaagttcaaggtcttggttctcaaggtgataattcccaaggattacaaggtggaaatcttagtcagaatggcaatgcagcacatgagcttttcaataacttccaagatcgggttgactatgccgtgcacaatgctttgatcaatcagtctggggtgttagtcaataccttgtcaaacatgatgaaatcaatggttgatggttcaatggctgaatatcaggctacaggcccagtttatttgcaaggaggtgtctttccagattatcggcctctgatcaccaatactcagccatctgttcaaacagttcctcccaatgcgccatcagctcagccgacggcaccggtatcggctcccgcacttgctgcgtctacgtcggcaccaggccaactagttagtcctcggttgttgatgagagaacaaccacagcatagggggcaggatgtgaatcggctacgcaagatcaggttgcggccatgttcttaccacctcaacctattgttgttctagtccagcagcagccgattcagcaaacaccgccaaggcagcagtttgtgcaaccagcttagcaaacacccccaatccaacaggttgtgcaaccaat

SEQ ID NO: 72182 - DNA, 5881 bp, Oryza sativa
  unsure (1)..(5881): unsure at all n locations
ccctacccctttatattataattcccttgtactcccttgcatttattctgcatttgtgggtgtgtcttgttgagtacggtggatgtactcagtcttgctcaatttttcccaagtccaaaagaggagttccttgaagatgaaggctttggtgtctagctcgtgcctgctgtcaagcgcctgtggtcgtcgccctagtcttccgctgtttttcgtttgtctttgtgtgctgggccttcgctgcccgtgtaataattctatttacgcttccgcttgttaaactctgaattgtatcagcttttggtgtaccttgcctcctgggacaaggattaatgcacgcacgtcaggaacgcccgttgggttatttccggtcgtgacaaccgtttaggcaggccccgggcgggtttgagtatctgtatgtcgcgatcgacaagttcactaagtggcccgaggcttatccggtcgtcaagatcgataagcactccgcacttaagttcattaagggcattacagcccggtttggggtgcctaaccgtattattacggataatggcacccaattcactagtgaacttttcggcgatcactgcgaagacatgggcatcaagctctgcttcgcctcccccgcccaccccagaagcaatggccaagtggagcgcgccaatgcggaaatcctcagaggccttaaaaccaagaccttcaacatcctcaagaagcacggcgattcgtggatcgaggagttgccagcggtgctctggccgaacggaaccacaccaagccgagcaacgggggaaacgcctttcttcctagtctacggcgcggaagcggttctcccatccgagctcaccctgaggtcccctcgggccaccatgtactgcgaggctgatcaagatcagcttcgcagagatgacctcgactacttggaggagcgaaggcggcgcgcggccctccgagccgcgcgctaccagcagagcctgcggcgctaccatcagcgccgcatccgggcccgatcactctgcgtcaacgacctcgtcttacgccgcgtccaaacgcgtgctggattgagcaagctctcaccaatgtgggagggtccgtatcgagtgatcggcgtcccccggccgggctccgttcggctagccgcgggcgacggcacagagctgcctaacccgtggaacatcgaacaccttcgtcgcttctacccctaatagggttcgggtgtcaggtttcgggctcgggccaaccccgtacccccctcgggcgtgcagggttggccgggggctaccacacatgcatattcttatttctcttctatctgtatttcaataaaagcattttcgatttcctaaaggctgtgtctgtgctgttgtttccttttgaagaatcttgacttgaaataggtcactcgtgctcgatcctgccctcgggggctcgagtcggctaaaatcgccaaaaggggcccagaaccgagccgtgccccggggcgtggtgaactccgggggggaatcggcaaaaacccacaaccgggtcacccataaccctcggtcaccacgctcccggcctggccagtctaaacacgtggatctccccaggcactagccccgacccgagccatttgaggactgggacctgggcacgagcccttgttcgagctaagacacaaacgaccatggcacagatcatcctcgttctcatacacacagtaaaatgaaattgacacagaaatttctttattttgattgcagagtaagttaatctatacaaaaaggaggcccgaaggcttcggaagaaagaaaagaagaaaaaactatttaaagattggcggggacctggaggctcactccgatgcacccgggtcgccagcctcgtcgccactgtcgcccacaccgccgtcatcgccctcctcgtcggagctgagggcgaacgcgagccgaggggccgaaccctcgaagctgtgaacgatatggttggcggcgtcctggaaccgcgcgcgcgcgccgtcctcagtcccgggagggaactcgtccagcgccatccatggggagaagtcggggtccctggcctggtaactcgccagtacgagctccaccgctcctcgggcaaggtccctcgaggatgacttaatcgtcctctcgagctcctcggggagccgttggagagtcccggccatctccgagaggcgctgagcgaggcccccctggttggcggcgtacttcgcagtccgcccgccccagagacccgcctgccgcccggcgcggtctaaacgggacacggcgtcgcgaagcatgctgggccctatctcgcctgccagacgaagggcctcgacctccccggtggacgaattcagcgcgccctgcagatccgcgatggtgtgttcggcagctgcgaggcgggcggctaagtcgctgtcgcccgtggccgccccaccggtacgcgcccttgcatccagctcccttgcctgcgcctcgagttcagcggcccgttggttcagtgcggccctctcggcgcgggcaccttccagattgcgacgcgcttgttcctcttgcgcagcttcgcggagggacgcgctctccgccagcctttgcgctgcggcctcggcctcctcgagggctcgctcccgctcggtgagcgcatcctcgcggaggcggagtgcggattcttcttcggcacaggcggcttcgtgcgccgccagtgtgacctcccgaatggcaacggcggcctcgcggtccgccaggtccctctccacgacgcaggcacgctcttccagcgccatggcacgggcctcaagggcttcttcgcgccgccgggatgccacctcggtctccgccgcccgccgttctcgggcagcggcagcgtcaaggaccccccgggcggcgtcgagcttcttccctagctccgcctcccagctcccgtattgaaggcggaggtcgtcctgcgcctcgttcatcacggtagtggcgatgagggcagccccccgctcctcctccacctccctggcgatctcctccagcaccttccgacgggcttcgagctctgaggcatgccggcggtgtgccttgcggctcacctccaccatggcctccaccgagtgtcgcccctcttcgacgcgcgcccatgcggcgtcgagctccgcccgctctgcttgcagggcttccatctgggcacttaacccgtccaacaccgtggtgtttgcgacggccaaggcctgcaaaaggggctctgcgctcagtggggcaacggaaggcgtggggaagagccgcctcggtgaggatgccgcgcggcccggcccgccgatggacgtgccgggctcggggacgtcccccggacctggcttgtcctgagtgttgcccgagggagtgggcccaagcgatgtgcccgcggcctcgtcgcgagctgcctcggaagttgtcgccgcctcggcttggcgaagtctggcttcctcccgagcggcttcttcagcctggcgagcccggacggcctcccgggcggcctcctcggcttcccgtaggcgatccgtggcttctcgccggtcagattctcgcctccgggcctccgcggtcgccgtatcctcggcctcagactggccggacttggaatggcgggagggacgcgacgagatctcgctgaaacagaagaaagaccagaagacaaacaagatgggtgagtgaaaactcgcgttgggagaatgaatacagccacaatgggcgtgggacgaacctgcgagggggtcggttaaacgactaccttggaggggaaataaggtttccccgggatggttctgtccccccatcttgcgaagccggttcttcttccgctccccctcgggctgcggcgtcggcgcggccccctccgggcgcctgctgttgacacgcgcccgcccgccccctcggggaagagatggggaggaggaaccctcttgcttcctcttcccttcggcgtcgcagggcggcaagccccccgagcccccgtcacgaagcccggaagcacgaccccctcttggggtagattgttctcccntcaagctcccgccggcgccatcatggcctcgaggagcctgctcctctgaggccccgaccgccttcatgatggtcaggatggtggcgcgatctggatcgctgcagaggggnaggactccttgggggatgagcgatgcctccgcggagctgagattcagcacccgttggatcattaccttgaagtcttcagggacccagtcccatttgaccccccggtgggtcctcatacagtcctcggacccggtgtactcccaggcaccccgggcgcgccgctggagtggtgcgatccggcgacgaaggtagtccccgtacaccatggcccctgtgagcccctgggatcgcaggcccgccaggcggtcgaggacggcgtcgtagccatctcccagatctaccggcgcccgccagctggaggcctgcgccgggggctggttcggaagtcgaaggcgcgcttcgtcggcgaggggggtgtagaaccagtcgctcttccagtcatcccacttcttgtggagcacgcaaggaatgtagcggttcagcaccggcccccgcggctggaagtagcagccaccaaccaccgacggcggcgacaccggctgtacggtgaagaaccaccggaacaaccgaagggatgggcgcaccccgatgaacatctcgcacaagtgcgcgaagatggccaatgtcattaccgcgttgggggtgaggtgcgccatctgaagatcgtaaaactccagaacatccataaagaaagaagaaaatagcggaacaagccctgccattgcgaaaggaaggaagaaaacggtccgccccgggtagcgtggcgccgggcgtccctcgcccagcgtaactatctcctggccggtggcagattccggcaggaagcggcgcggcagcccggcctgcctctcgctcacgatgcgggaaagcggcagcacgctaccatcgagtggagcagagccccgtgccatgacgccggaagaagagatgtttgagagcgagcgcgtgtggcgagggtagggcacaggaaacaaggagttagggcgcaagcggcgaagacaaggggaataatggcgagaggaaggaagcaaatctcttcctcggtgtctttatacccttgccaacgctgtgcccggctcctcgcttctcgcgcccactatctcgctccctcgtttctcgcgcccacgcttccactaatcccattcgcccgcttgcggcgcatgaggtgaatatgcggctgtggcagtcgagatggaacatatcgtgcgcgcgttaattgcactcgccgaccgaagtgccatcaccatatctccaggcaaaacgaaccggctcgtcccgattcgtgtgctactcgagtaatgtggcagtcttgaagaggccgctcattattgacagtcgagttaccattgccgatgtgcgtgatttgcgaccgttgggtttctgcccaactgtagagaccagccccacttgtcaccaggcctaagtaagtggcgtcacgcccgaccgcttccctcgaggagggtgatcgccctggcataacgccgggggctactgtcggtgacatgggaccgggagtatcatgactagaggtttgggcaggagcaatcacccacgtggcctgaccccctcgggggggtcgggcccgaaggtgatgaggccgcccctctctttgtctccccgagggatcggaccgctcccgtttcggccccgagggccgaggcgccccgaccccttgtgggttttgcgccgcgtgtataggttaggtgagcacggcggggctcacctaaccgcatttattgagggttgaacgagcgcgtcacgccgcatgtaacgcaacgcatcgcgctcgaatatcccgtctgtgaccggacacagaccgg

SEQ ID NO: 72183 - DNA, 2475 bp, Oryza sativa
cccaagcaacaacagtcgcaaggagcaactcagcaacgaccgtgggctgatgtgattaccgatgtgatgagggaacagttcgggcttaagccgaaagatgctggaaacttgtatcggcaaccttaccctgagtggtttgagagagttcctcttcctaataggttcaaagttctagatttttcaaaattctcagggcaagatggtgtgtcaacttatgagcacattagccgatttttagctcaatgtggtgaagcatcggctgtggatgccttgagagttaggttgttccggttgtccttgtctggatcggcttttacttggttttcttctgtgccatatggatcaatcaacacttgggccgatttggagaagcaatttcacagctatttctacagtggggttcatgagatgaaattgtccgatttaacagcaatcaagcaaaggcatgatgaacctatgcatgagtatatccaaaggttcagagagatgaggaataagtgctatagtttgaatttgactgatgcccagttagccgttttggcttttcagggtatgattgctccgatcagggaaatattctcatctgaggactttgatagcttgtcacatcttatacaaaaggtaaccctgcacgagcagaggtctgcagaagccaggaagaaccctaaaagggttaatcatgtttgtccttacatatatggatcggataatgatgatgatgactgtgaaatagctgcagctgaatgggtaagaagtaaaaaggttataccatgctagggggtaaagaattctagaaaagaggagaggtatgactttgatataaccaaggctaacaagatttttgatctgttgctctgagagaagcagattcaactccccgctggtcatacgattccatcggccgaggaattaggcaaaagaaggtattgcaagtggcataactctgggtctcattctactaatgattacaagtcttcaggcaacaaattctagtagccattgaaggaggcaagatcaaatttgatgattccaagaggccgatgaaggttgatggtaatccttttcctgtaaacatggtgcacacagctggccgaacagctaatggaggacgtacaagaggttttcaggtgaattcggctaagattataaacaagtatcaaaggaagtacgacaagcaacaggagaggcgttatgaagaagataatggtggttttgatcctcattggggttgtgagttatttaggttctgctataatgagggtatgaggctgccatctatcgaggattgtcctgggtgcagtaatgttgcagggagatcaagccgatcgtatgatggaggcaatcggctgaagcaaacaagagttcctattcatcaaaggttgggcccggtgaaccaagactatagccaaaaggatgatggagacaggaagattcagtggtgtccttctggtatttttacaaaaaatcaaaagagaagggttcaaaggttgaggaatagagaatgcttttaggaggttgagcaggaaatcagtcatcggctgaagacaaagccgaggcaggagtggcgcgttaagaatcaagctcctgaagccgatgacgccacagccgacggggcgaagaattggcaaaagggaatagtgttgtaacggcatcagttaacatggtttttaccttgccagccgaattcgagatcaaacaaaccgatgttgacaaagtagaagaagaatcggctaagttggttctatcaccagaacaagcaatctttgagaagcctgaggggacagaaaatcggcatgctaaaccattgtatataaatggctatgtcaatgggaagccgatgtctaagatgatgatcgatggtggggctgcagtaaatttgatgccttaagctacgttctagaagttgggcagaaacgctgaagatctcatcaagacaaacatggtgctcaaagactttggtggcaatccatcggaaaccaagggtgttctaaatgttgagctgacagtcggcagcacaaccatccctactaccttttttgtcatcgatcggaagggttcttacaacttgttgcttggtagggattggattcatgccaattgttgtactccttcaaccatgcatcaatgcttgattcaatggtaaggcaacaagatttagatcgtgccaaccgacaggtcagtcaatgttgccagtgccaatttagctctttgggagatggatggtcttgattgcttatctggaaaagtttgggatggagattttctaaaatagtccgattctgatatacagccaattgaagatggagaacccaattgaagatggagaacccaggctattattttgaaggcgttgtggagggttcaaacgtctacaccaaggatacagtagatgatctcgatgacaaacaaggtcaaggtttaatgtcggccgatgatttcgaagaaatagatataggtccaagcgatcggccaagg

SEQ ID NO: 72184 - DNA, 2460 bp, Oryza sativa
  unsure (1)..(2460): unsure at all n locations
aaaggcgagccaagttttagtgaaaagaggatgggtccccaccaaaaagagaaataggtagaagtggtgcatgtggtatccccttgagatataaaaggaggaccttgcccacttagggaggggatccggaccagaggaccaggggaggagagattggagactcccggaggatccaggagaagatcccacgagaggcaaaaaggaggaaaggggtttctagagtttgagctctctggttctccagctctttgtagcttcttcgtacacagatctaccagaacacaggagtagggtattacgcttctcagcggcccgaacctgtatacatcacccgtgtcttgtgtgtttccactttcgcgaacattccacagactaggagcttagaacctcacccagggcccccggccgaaccggcaaagggggacctgcgcggtctcccggtgaggagccccacgctccgtcacatgatgtcaataatatgaaatcgaaatgtttcttggttgtaatgaaagcgttcgaaagttcgagcttgttttcgaatcttatagagaatcatgcactcatgcttcgtatttggcagttggttatactcgctccttccgcttttgatgcataattcgactactgagaaaagttagttaattgctgtatcgaggaaaagaagcaagttagttttatagcaggtacaatagcatactataagagtaagtttaatagtatagtccactactagctccaattcatccatagccaatctaatagctcattcatacaatagttgcttactatactattaatatatgggcccagtcatacacacactcgtgtttggagtccgtgctgcagctggctacagatctgtagcccgctgctattctttttcattttttatctcataaaaatatgtttatagctaactaatgggatgctattggacctgctctaagccagctatagacatattttaaaaagataaaagaggatagagaagtgcagggggctacagaattatagtcagctggagtatagtaacaagaggcaatgngagtatgacacgcgggaccagatattaatagcgggggatatgtttctagttaactattggatgaattactattactcaatccttcccaaattgatcacatgtaaaagaatctaaaaattcttaaattgatcatcatataactgcatggacacggatttcagcagaatacagttaatacagcatggaagaatgtgtgcatgctatggtggaagtggcatgaggttttaatcgatgcatggtgggagaatgtgtgtatgttgtattgattgatgtgatttaaattatccttggttttggtgtataaaatcaatttgggaaggaaggagtagattgactatagatgatttagagctagtagttggctatactattaaacttgctcttagcagctccaattctatccttataaaaaaacttagaaataataggagtaatatactactggtatcatgaataaaagtacaattgacattcgacattcttaattccttcaattatttttttggtatctcaaacacatcttctctaacaaaagttcatttgcaaattttgatattctcaaacataccccaaaattttatcttagccaacggcagtcaagccgggtaaaactgttatttctcctccaaacaaaaccccctaattactcttgctccaaaacctccccttctcaagcgctctctcttaggttcgtcgtgtgtttcccttcaccctcccatggcgagcaacccaagcagctccgcggcgagggctgcgggctcccagggcggcggccatggtggcgcgcgcctcgaagacctagcactggacaaggtggcggaggcggccgacgcggtcgccgccgcgtcgagcgccggcgaggtcgtccgcgcgatccacgccgtcgccgccctcgtcttccccgtcgactccgctgccgtagccggtgaggctccgaatcctaatccgacatgctccctattcccatttatctcattcgccgtcacttggggtgtctgatggcctctcttgtaggtaccgtggacgaacccttcaggagccaggtgaagctctgtgctaattttaggccttttatttcgtccatctgagaaaaattactagtagttttatcatttgctatttttggttctggcataaacaatgatgtgtgatttctaataatcatggaaggggtctgtgataaaaaaaatggggaagtcttgagtttttgttttgacctgcaatcacaaaggactgtatgccgaaatggagcagtaattctgccacaaaaaatagaaatggagcattaagatatcatagtgaactattggttatgtggacaatgtttcagccgctgtaatgtcataattgtggtgcatatatttgaggaaattgatctctggaaggaattactccgaaactggattgataagatc

SEQ ID NO: 72185 - DNA, 1482 bp, Oryza sativa
cgaacctgtgaaggcggagattaagcgtttatatgatgctggttttattcgtccttgccgatatgctgagtgggtttctagcatagttcatgttatcaagaagaacggcaatgtgagggtgtgcattgattttagagatttgaataaagctaccccaaaggacgagtatccaatgccagtagccgatcagttggttgatgctgcttcaggacataagatattgagttttatggatggaaatgtgggatataatcagatctttatggctaaggaagatatttataagacggcttttagatgtcctggtgcaatcggcttatttgaatgggtagtaatgacttttggattaaaaagtgctggagccacatatcaaagggccatgaactatatttatcatgatctgatcggctggttggtcgaagtctatattgatgatgtggttattaagtctaaggaaatagcgaaccacatagccaatttgagaaaagtttttgagagaactaggaaaaatatggctggaagatgaatccgataaagtgtgctcttggcgtatcggctggccagttcttgggatttcttgttcatgagaggggaattgaaataactcaaagaagtgtcaatgcgatcaagaagattaagcctacagagaacaagacaaaattgcaggagatgatcggcaagattaattttgttagaaggtttatttctaatttgtccggaaggttagagccttttacaccgttgttgagattgaaggccgatcaacagtttacttgggggacagagcagcagaaagctttagataatattaaggaatatctaatgatttagcccaaggggcatcgggatataagccgatgatcaaagatgttaagattgaagttgctgccataacagccgatgattggagatatgatgtccatcagtatttacagaatctgtctcaatcggcttcttggaagttaagatataaagcgttgaagtatactttgttagataatgagctttattatcggacgattgatggggtgttgctcaaatgttttagtgccgatcaggctaaacttgcaatcggtgaagttcatgaagggatatgtgccactcatcaatcggctcataaaatgaagtggttgcttcgacgtgctggatatttttggccgacgatgctggaggattgtttcagatattacaagggatgtcaagattgtcagaaatttggggcgatctagagagcaccggcgtcggctatgaatcctattattaaaccatggccatttcgaggttggggaattgatatgatcggcatgattaatccaccgtcaagtaaagggcataagtttatattggtggcgaccgattattttaccaagtggatagaggcgattcctttgaagaaggttgattctggggatgctatacaatttgttcaagaacatataatctatcgatttggtattcctcaaaccattacaaccgatcaag

SEQ ID NO: 72186 - DNA, 2742 bp, Oryza sativa
attcctgcagcccgtcagtggctgagaaggcaaaagggaaggtgtttgaggtagtacgagagagtgatagtgatgatagggccagtgattctgattatgttgatagtgactatgatttgtctgattctgatgatgacttgtatgtggacaatattgatgtggaggtagaagacttaagctggaaagaagaaaacgaatagtaagaaagctagaggcagtgaactgaagggcaaagaaatagtagtttgtacaaattcagagggagatgatgaggactatgacactgatgaaggcttggaggcagctgattctgatggggataaaagtggagttaagtttaagtttaggtcatttagtaaggaggatgtcaataatccagtgtttaaggtgggcatggttttttcttgtgtagagttgcttacgaaggcaatcactgaatacagtatgaagaatagagtttatataaagcttcctaggaatgatcagcaaagacttagggctcactgtgcagagggttgcccttggaatttatatgcttcaaaggacagcagagctaatgctttcatggtgaagacctacaatggagagcacaaatgctagaaggaatggatcttgaaaaggtgcactgccaaatggttggctggagagtacattgatgcatttagagcaaatgagaagatgacacttggtggttttgccaagacagtgcagctggaatggaatctgacaccatctaggagcaaacttcagagagctaggaggttggctttcaaggccatatatggtgatgagatcaagcagtacaaccagctttaggattatggtgttgagctaaggaggtctaatccaggcagttgtttattcctgaacattagtgatggctgctttagcacattgtatatgtcacttgacgcatgcaaaagagggttcttaaagtgctgcagacctcttatttgtttggatgggtgccacataaagacaaaatttggtggttagattttgacagctgttggaattgatccaaatgattgcgtatatcctataccattagctgttgttgagactgaatctctaagctcttggaggtggtttctacagaccctgaaggaagatctaggcattgataatacttatccttggacaataatgatagacaagcagaaggtagttctctaagctcttgatttatttcttctaaatgtcaccaaactgttttgtgttaattgttgttcttggtttgtgcttgattgcagggtttgattccagctgtgcagcaaatttttctagactcagaacacaggttttgtgttagacacctctactccaactttcaagttcacttcaaaggtgaaaatctgaaaaaccagctctgggcatgtgctaggtctagttcagttatagagtgggtggcaaatatggaggaaatggctactctcaatcaggatgcacatgattggttgaaaaaaatggaacctagtacatgggttagagcatattttagtgacttcccaaagtgtgatatactcttgaacaatagttgtgaggtttttaacaaatacatcttggaggctagggaattaccaatgttaagtatgttggaaaagattaagcaacagttaatgactaggcactttaacaagcagaaggaggctgcagaacagtggaaaggtcctatatgccctaagattaggaaaaaagtgctaaagaatacagacctagctaacacatgctatgctcttccagctggcaaaggaatctttgaggtccaggatagaaactttaagtacattgttgatatcaatgcaaaacattgtgattgtaggaggtgggatctcacagggataccttgcagccatgcaatttctagcctcaggtaccagagaatcaatgctgagtcagtattgccagtttgttatagtgtacaagcattttcaaatgcatatgagttcaatatttggccctgtcaagacacagctaaatgggaaaagacaaatgggccacatgtgaagcctgctgtctatgaaaagaaagttggcaagccaacaaagtccaggaggaaagcaccacatgaggtccagggaaggcatgggccaaaaattagcaagcatggtgtggagatgcattgcaagtactgcaatgaggcaggccacaaccaaaggggttgcaagttgaaaaaagctggactcaggcccaatcagcaaccaaagaagtctattcaaaaccctgaagtcatcacaacagaggtaatgccatcttttattcaatgatttccttctaaaatcaaaacttccatttaccatgacttctctgtaggtgcaatctcaatctcaggtgcaaactcagtctcatgttgaatctcagtcccagcagttgctgacacaggttaacaatgcaatggtatctcagatgtttgaggagtcctcccaagttactcaaatgaacttggcacctaggcctctgcctgacaaccaatttgtcatggcaaacaaaccaacagccaggccaatgcctctaaccacaacagcaaaggaaggaaagctgagagcaacaaaaagaaaggctgcaggtgatggtcctgaaaagagagctaccaagaagaagtagaattgctgatagaactgcataagagctaggctagagagctatcagtactttcttttgtaatgacaaatgatagtgtcaatctgattatggctaccatgtctccttttataattatcgaagaaatggctggcatctttt

SEQ ID NO: 72187 - DNA, 557 bp, Oryza sativa
cacggatctgacgtaaccacttcaaggcaacatctggacaaccaaagtgtgagaatgggattataactgaaggaactttgcaactgacctaactgtgatgaacaatcaagaagttttgagtgtatagtaatcaaattgtagagatcgataaacaatacaaatgaagtatgacttgtatgactggcagataacattataagcaaacaggagagttgtacatgtaaagaatatcaatggtacaaagtatatatgcagtgatagattcaagagtaaacttacggccaagcaaaatcttagatatagtaggaaatgctggaccatggtaaaaagcatgcctccaagatccccgttcatcattgctgaggcttacgccattaattatctgaaagtacagaaaataattctccctgttacatcatggcctaaaaggatggaactccaattggctatttggctgaatcatattgaaggaagcatgtgtctttgaatatccatactaatttatctctcaagcatgaaacatgatcttctgtattctgaatgcattatcaaatgac

SEQ ID NO: 72188 - DNA, 3708 bp, Oryza sativa
agctccttgaaatgtccaacatcgggttccttcttgaattcctgagcactgctcttcttcagctcatctccatccttcattttggcctctttcagcaactctgcacaggcagcttcataaatgaagccactcctcttcaggaatttgatgtaggcttcctcccaataccagaaattacaaccacttccatccttctatacatttcacagattgcaacatgtaaatttcaagcaaaatgacaaaaatccacaaagggcactttatcagaggcaagagatttatcacgtggtctggacatgtgaagaaaatgcgacctcgattagcttccgtggtcgcggttagctccaagatctgcttcaccccgcatgaagggcacttaatcagcgggattgagggcctcctcctcttgcgactcgagtggcttgagctgcttgcagaagccatgccgacgacgatgaacacacctcggccgagtgccctccctcgccgttgactctcagccggaagccctccctcgccgtcgactctcagccgccctcccacgccctcactcaccgtcgactctcagccgccctcccactccctcactcgccgtccaggggaaaagagagcagaaaagagagggctagggtttggagaattcgagggaactgaggggcttagatgaaaaagtgcacggtgcgggacggtgcagtgtggcatcacacgtgtcgcgacacgttgctgtccacgtatgcacgaaacgagtcaaagcgttctctggaccggattgatacaataaaacaagattagtgaccttgaccctgtgtttgtatgttcatggacctggatgaaacctcctcacaagtttaaggaccgccagtgcaatttactcttcttttagccaggttatctttcgttagaattactttcttgtgaagaaaccacataaagaccattgaattactttttttcgttagaattactttctttagatgaagtggatgaatgaagctaatatgtcaacaaacgattcatgaaaacataattaagacttttggccccaatagctatacatagctaggtatgtacgtactccctccggttccactgcacccctgctcagcttcactgttttctcgtgtaatagaaatcaccggacgttatgaccctgaaggcctgaacctggcatttctgggaagatggcaatcagcttccctcttttcttgagtccatcctctgttttttttccccctgtggtttcaatctgtacactaattaagaacagaggaagtatgcaagtctgtaaaatgcaaatttggaatggtgcatattatgtactacttgacaattagattacttaaatatctgcttggatgttttcataataaatgcttatcataaacactaaccaaagagtacaaatcagaaccaccttgctagatcaaatccctctcatgagtcatgagaatatattatgttggaagatcttatggtcatgaacccttgacatgttaattagcgcgcgcgtactacgaaataatacatgaatataatccgggttttgtggataatagtaaaatgttgcaacaaagccaaataatactgatgagattcggttgtatcactggtgaccttttatttcgtgattgaatcatcgctgtatgaaaaaaaaattcatacaactgaaattagtttgcgccaataaattatcatgggtagggagctacacaccaatgtgataaaccatgacatatgggtcttttccatgccaactaccatcagcacatctggcggatcagtaatcctcggttgagcaggcagacatctgactgttctgagatatcattttcctgatcccgcgcattccaatcagacattcatatttcaattgaaatggaattaaatgtgaaaaatacccccctacaaatcacttgtgtttcttctttgcctactactacttgatttcgtacattaaacctccacacaagacaatttctcctaacaattgtggttggtctctcgcaacctccttcctcccttctagtatctgccttcccaaatccctgtatgagctaagatgatggcagaacacgatggcacaacttgtgcgctagctgtaatttctataataccaacctatcgaggtggcatgagtttctattgtcccatgacgctggaggcccatgcagcactagaaattgaaataactaggtgaaataattgacaatgggactttggggaagttaggacataaattaacttgttgggaggattttctgtataaaattgagttgtagggggaaatagaaaaactagtgagttgtagggggttatttggaatttcactggaattatattatgagcaaaataaggcggatttcttttttgaatatttaaatgtcatgattcagctcctgttgtttttgcgtgctctagggcgcataattcctctggaaactcaggatgtatcctggcagaataagagagagaatgtggggatacgtgttacggctactgtaccaaatatgacaacgatgaacccgatcaaagtgaggcgtgttccacacatgccaggcttgccaatgttcgccttggtggatccggatgggaagatgtgctaattgtaaaggatgcgactatataagcaccctggagtggactggaagcttgaaaattaccgttggatcaaaaatagatgtccgagattcgtcaatgtcacggttaaaattttactcatagcaaaatttttactcgtgatgacatagacaaatatcagacgtctatttttcgatccaacggtagttttcaggtttccactacatatgtactttgcaccatatatttttccgggttagacacagatggattgggttagtgatcatattagtataggatgctgctagccaacagatggggaattgaggtttaaggaattactaagctaccattattaatattatttgttgtttctagattatcctttcgaaatcaaaggtgcatattaattcatttaggaggtacctgggtacctctcaagcacagtaaaatcctctcagaaatgtatgttgatatgagattgatcaggtagtgaccaacgcagtgtttaattagctttcttttgtgcttacgttttgcaaaaaataaatgaatgaataaataattagctcagatttgtcattttggtcttatacaatggtcatgatatatagagtcagaacttttgaaactttaactatcattagtttttctaatgctcattttaaaaaggaaaaaaatagtatatatgcttagttttgccttgaaaaagtattatcatggtataaaaacttattagatattctaatacaaaattgatagtcaaagtttgtaagtgagagattttacggtctggaggtaccacattttacctctcgttgtgtttggtactaggagctacgggtacctcttagtaactcttgagtgctagctgtaaaatttcaagtcaaattttgttctaaatattaagtatttatgaccggatggtgtatatgatacggatccgtatcctcaatacttcatgcagtttgtccttgatataaagttctgaaaaaaaaaaccttttttttggttggggcgggggggggggggggtgggacattgacctgctgtcttctctgctctgaacattcactacccacagatacacaccttctgctcttcttgcccgatcacctatcccttattatt

SEQ ID NO: 72189 - DNA, 3726 bp, Oryza sativa
caacctatcgaggtggcatgagtttctattgtcccatgacgctggaggcccatgcagcactagaaattgaaataactaggtgaaataattgacaatgggactttggggaagttaggacataaattaacttgttgggaggattttctgtataaaattgagttgtagggggaaatagaaaaactagtgagttgtagggggttatttggaatttcactggaattaaattatgagcaaagaatggcggatttcttttttgaatatttaaatgtcatgattcagctcctgttgtttttgcgtgctctagggcgcataattcctctggaaactcaggatgtatcctggcagaataagagagagaatgtggggatacgtgttacggctactgtacaaaatacaacaacgatgaacccgatcaaagtgaggcgtgctccacgcatgccaggcgtgccaatgttcaccttgctggatccgaatgggcagatgtgctagctgtaaagggtgcgactatataagcactcgagaggaggctagggccgcatagaatttgtaaacagcaaactgaatccccaaactaatcctctgtctcctcaatctatctctgatttatttctgcagttaagggtaaatacaacaagacctagatccgggatttcaaaaaattcaccggttatagatatatattttggtccaaagttgtcaacgctggttcatttggtgcaaattaggagtaacatgcatccgaatggtgcttaactagtttctcttttgttcccgatctgcttaattaaatgcttagcgattaacaagcccaatatcttcttcaatcatgcaagaaattaagcgcatcgattttgcaagaattcaattacttcaaacttttcaattccatttaacagcctctgagccaatcaatgcttaacaaaaatgaatcaatgctattctgtaaccatcatgagcaggcatcatccatcaacaggattcaacaacaatcacattagccatggtacgtgtcagccggttgccacagatgtgcacgctggcgctcagctgccccagctcctcacttctttctcttagggttagatacagatggagtgggttactgatcatatcgatatagaacgctactagccacaacagataaggaattactaagctacctttattaatattatttcttgttcctaaattatcctttagaaatcaacggtgcatattatttcgttgaggtacctgtatatgttgatatgctgatatgagattgatcaggtagtgaccaacgcagtgcttaattagctttctcttgtgcttacgtttttcaaaaaataaataaatgaataaataattagctcagatttgtcattttggtcatatacaacggtcatgctatatagagtcagaacttttgaaactttaactatcattagtttttcaaatgctctatttaaaaagggaaaacaatagtatgcttagttttgccatgaaaaagtattatcatagtataaaaacttattagatattctaatacaaaattgatagtcaaagtttgaaaattgagagattttacggtctcgaggtaccacattttatctctcggtgtgtttggtacgtactaggagctacgggtacctctagtaactcttgaggactgtaaaatttctcattaaaatttcaactcaaattttgctctaaatattaatacttatgagttatgaccggatggagtatatgatacggatctgtatcctcaataaaaattttaactcaaattttgttctaaatattaagcacttatgaccggatggagtatatgatacggatccgtatcctcaataaaaatttcaactcaaattttgttctaaatattaagtacttatgaccggatggagtatatgatacggatccgtatcctcaatactagtgtatacacatcgttcttcatgcagtttgtccttgatatgaagttctgaaaaaaaaaaacttgcggcggttttttaacccattgacctgctctcttgtctgctctggactttcactacccacagatacacaccttcttctcttcttgcccgatcacctatcccttattgttacaagtctcattttatttttcttattaccccatcactgcatgctacaagtgataagctactgcttagctgtgaattctgttaagagtattatgtgtttaggggtatattagtaatttctcatatctattgtactcatatatgtcctttgggctaactcaatggcaattgttaatctccaaatcttatctcaaagtgacatggtatcagagccctaatccaaaatcgccactaaatccgtcatcaccggcgagccatcgtcgtcgtcctccgccgttaatcgttgaagcatcaagcaccagtttttggcctcaaccagcagcagtgaccggtcgttatatccagtactccgagactgccgcccgttgccgttcatcgcagccgctcgtcacggcgccttcttcatcgctgcaggtcgcggcactcgtccctgctgctcctccaccagtcgcatggtcgtcccgcgccatcctctcggccccaaccacgcggcgcttgtctcgctgcccgtcgcgtggatcgaagcaacctctgcgatctgtagcagcaacagcagcggcataccatcgtccagttcgccttcaacacttcaagcagtaaacaagtagcagcagcaaatcaaaatccccttttcatcatcattctctccaaatctggtgatgttctctggcaccgatcgaatctatgatccttgtcctcgagctcctcttttcttcaaacagtagcagcagtgaagttccaagatgcagcaacaagtctcattcccattgtgaatattctgttcttcacccagtggttatcctctccttctccatgttcattcactctctacactaattttgcatatttctgttgtggctctgtgctgctacagcctactatttgattagtagaggagtacatgccatatcatgacataattagtttcattgctcgtcataatcatcttgtgcagctgcctgttccctcaattaattcctactttcagtggtagaatttgttaaaatcgtccccttaatttatattgatccctactgtcaccatcagtggcttatgcatctatcaagggcagggcacttctttcgttgctcatttccatagcagtcaccaagctcatcgcctgtatatatcctcagcattgtgcttgcttgtacactgctgctgtcaaccatctagtagtatatatcctgtgtccttttgctagtatatcaatgtcttctacaaatcaatttcccatgtttcctataaaatctgtcaaagtccattgtattgttcagtccgtcgaagtcatgctagtcaatcttttcccagctccaagtcggagttggtcttcatcataatcatcataccatcgtcaactccatgtcggagttagtattcgtcttcagtttaccagctccatgcaccaccaccctcatcaatcagtgaaggactgaagaacagtctgtgaagttccttcaccatcattgtcaccgtctttgaatcaatgaaaagccaaagaacagtttgtgaaggcttctggtaccaagggctgaataacagtttgtgaaggctcgaggtccacttcattgaggaggggatggttttctcttgttcttcatccaagagcaatgcttcgacaacatctttaaatagg

SEQ ID NO: 72190 - DNA, 1341 bp, Oryza sativa
ttggtaagccctcacgcaccgagcacctcctagtgacctagaagccggcagccctcccaatttgggctatgtgccgccggagccataccacctccggccgccaccgcgcctccgtcgagctccccgtggagagggcgaattcaaatgcaacctaggctacatttttgattaaatggcaaccctactgattctagatggtgaaatcgtgctcggccgacgttcaactcttctacttttgtgccatcgccgtacacgcataaccggctgccaccgcgcgccgttgcgccgtgtgctgggaggccgccgcgcttcgccgtcccagccggggtcggccgccccaggcgggtgcgcgccgccgttcaccgaccgcgcgccgagccgtcccggctcgggtcggccgcactggccgcatgccgctcctctgctccgctgtgagcgtgaggaagaagaagggtatgaaagagatagagagggagagttggagagatgtaagccctactttctattagcgcatagtaattaccatgctaatgatggttagttgaaacaatgacatgtgggcccgagcaatcaggaatctaattaaaaaaacaatttatatggtacccctatggcatgtgggtcccaccgggattaataagaccggtttgacctcggtcaaaagaggcaggcccaccagtcagtgacacgccaaatttttccttagaggaataaagccagaaaaaggaaatagggatggcctcacatgtcagccactgagacttagggatagagttcgattaaaaaaataaatcaattaggaacaatgctgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccgaccccgagggccgaggtgccccgaccccctgtggggtttgcactatgtacataggttgggtgaacacggtagggctcacctaaccgcatttattgcggtctggtcaagcgtgtcacgttgcatgcagcgcgctcttttatccggtctgtgaccagtcacagaccggtcggatcaacggttaggtggcgactggtggtctgacgcacgcctcgccccgtcccgtcaagacgagagcctttaggcacacgtctccagccggagctagcgtgttacctcttagagatggcacgttagccctggttagatccaataccaggcttcatccaaccattacaggcaagatgctacaaaaagaagggtgatcatgcagatcggg

SEQ ID NO: 72191 - DNA, 3348 bp, Oryza sativa
gaggattcactcaatccggtggtttgcttcccattggggatttaatctccaagaatcgaacatgccctaagggtgtctgccacagaaacacatggtaagcaagccagggtcctaagaagcagaggagcataaccaggacaagctgcagtatagatggccaaaaggcccgcccggcacggccaggcccaggcacggcccaccagccatcgagccggcacggcccggcggccgtgccggcccatgggctgcgcctcctgcccaggcacggcccaccagacgtcgggccggcccgaaggagcgggtggcccatcgtgctttttttaaataagtctattttctgtccctcctctatgggctgtgacatctatataacgaaaataagtctattttccatccctcctctttgggctgtgacatatatatatagtgaaaataagtctattttccgtccctcctctttgggctgacatatatatagctaaataagtctattttacgtccctattctttcaattgtggcatataatatgtctatttttactccctattgtttatgtgtcgggcctggcctgcggcccatcgtgccgtgccggtggagaggcccaggcacggcccggtgattgggccgggccggcacgagcccgacccttgacgggccgtgccatgcttgggccgggccaaaacgccatgccatgggccgggccgtcgggcctcgggccttttagccatgtataggctgcaacactaagttgatagttaggttaaacaaagaaactgggaattggtttgtgagcacgttcatggatgggcacaaccatgacctgatatctagctccgacctgacatgtgttatccggtgtcaacgtattgtcacctacgtgcctccttgcaaggtgggtatcaatgaagcactgagctgactttataaaaaaaaccaataggtgataaatatgcgaagggatatctggtctggtggtaatagattttcccagcaacaatcttacttttccggaatcccatatagtcatttttctcgtgtattagtggatctaggacatgatcctcacttatgttactattaaacactagaagaccaattgacagtggcgactcatagcgacgtgagaagcaggccacggcggccagtcgtcaacgcgtgcaaatgttggtcaagcctcctatttcttcagtcttccagatgctattgattctctttttctttcgaacagactttcttgtgtgtacatcttgattaatcttaagaacaaacaaactataatattgatgtatttgattttcatttattttaattaatcttaagaacaaacaaacaaacaaacaaactaaaatagtaaaaatctgaccattgattttcatttaaattggtgggtctattaattttgattgttagatttattttacaagaaaaaaaaatctccgcccggagtccggacgtcagccttcatgcgcacgtatgtacgatccctccaatgttccaaccaccgttcctctcttttttttaatccccataacaattaaaattaaatatttttatgggcctaaaaagcccattagcctattatatctagccaactctttatatattcaaaagtccattaaacttcgatcaaacgctcctatgctaccatgtggcatactataaacgctctcgagtcgccatgtgtcactctaataaaatagtaaaaatctgaccattaattttcatttaaattggtgggactattaattttgattgttagatttattttacaagaaaaaaaaatctccgcccggagtccggacgtcagccttcatgcgcacgtatgtacgatccctccaatgttccaaccaccgttcctctcttttttttaatccccataacaattaaaattaaatatttttatgggcctaaaaagcccattagcctattatatctagccaactctttatatattctctcctaataaatagtccattcaatatcaaataaatatttctaaacaatgtccagatttgttgttattggatatatcccatcatattctaatttgaatttttataggacggaggaagtatatagcactcttaaattagaggaaatcttaaagaaaaataataaaacattcgacaatcgaaattttaggttattagttctatctttttttttaaaaaaaaacatcccaaatctccctccgcactcccatgcggccttaaagcaaattaaccatcttataaatatttttaaaccacccagtgacacttctaaattagaaaaaatcataaaaatttaagaacaaaacatcaaactatggtttcgacgtaaatcgatggacatatcatttaggttgttattagatttttattttaaaaaactcccaaacctcatttcctccctccctgcccctacaatgttaatgacttaaaactacattaaatatcttataaatatttctaaaccactagcgttaaatgatattgttttttgtcataatgtgtaccacatctagtgttaattttttatagacaacataatgaaaataaaaacatgctcagttgaacatcatattgatcgtacaagcatgtaggttggaacaaagaatcttagaagtgaaacaatgatgaggtggccttaccaatataatgagtcaattccatataggaattaaaaatcatgttcatttatttctttttggtagaacttgctacgctccgttgtaaattcctaacatgtagtgtagaacaacttagaaatgtgtatttattacatgacctctatttttaatatttcttactctattgaagtgagataatttagaagagatgactttacctcatgtttgtaggctcgacccacttatgttttcaacccaaattacagagatcaaataatttcaaagatgcttcatagaatggaattctccaaatttctttaaaaaatggacatgaaaacaaacaaaatttatctatttttttaaaacaaattggttttaaaaaccattctaaatagaaatatttaaaatttttgctgcgctaatggaatgaaaatatgtaaaacatcaaatagcacctaacaaaaaaattggacattttgagcaaatgttggggggggtaagatatctacgtaggaagtcaaaattccaaaaatttactcatagaaactacacatattttcgacataatattttctcataaattgagaagtgtgcagtctcgagtaattttagtttagtatttatgtgctgaaggggtaatcagaagaaaattataaccagcattcaaaacacattaaataagttcaatttttattttatgtgcattacaaaggatatttgtaataaaattttacgt

SEQ ID NO: 72192 - DNA, 2027 bp, Oryza sativa
atacaatttagaaataactgaaatttgaaaattaaaaagtgtaatatgaaaagaatagtcaatcgtagtacaaaatacgagattaattaaaattagaataataaataaataaatttcgaaattagaaaaatcaaaatatgagttcatgtatacaatttatcaacaactaaattcatcataaaaataaaaactattaaaacaacacaagattaatgaaaaaccgggataaaaattttataaattctgaaagttgacaaataaaaatgagagtttgagaatgaatattatttacaaataacttaaataggaaatagatgaaataacaattcatatagactacaatacggaattaactaaagttagaaataaaaataaattaaattatgtgattagaaaaactaaaatgagggttgagtaggaatataaattataaataacagataagatattttaatagaacatattacatctataacataacggtggtaagtgaccataaatgcaaaagggacatcagacaaaccataaagatagggttggtagaggttgatgggatattaaaaataaaaaccaaaactcctaatgattactagattcaatatttagaaaccaaaggatgattagaaggaaagattttgggtaggctgtaaattaaaagagaacggtggtgatggttgacaggacttcttggaagtaaaaagaaaacgaaaatccaactataatcatgttccatttcataaatcctaatgataataaagaggttgaaagttagtacaccgtagaggagtacaatgttgacgtttaaagggacttccaaaactacaaatcaaaattcgacaagacaatgaactagacaaactatccaatttttaaagtataataaaagctgtggcaggtcgggcaggagaaaaggattggcggctaacgtgacatttaaaaattataaaataaaaaacttgacaatgataaaatttgatcttttgaaatcctaatataactatatggctacttaacaaattttaaagaaaaatatatgtaaacaaaatattttatacggatgcttgccgcgcaattacacgggccacactcaactatgtaattatgaatcaatctaataatagcgtttgttaagacacatgatgttgcgtgcaaaacacattaaattcattcatcgtgctgtacaacctaccaggagcagtgacggctctgtagatggactctaccatggcattgacctcgtcctcgctgatgggcctgagagcctccatccgacgcggcgcaaagagctccaggttgcacagcttccgcaccttgacgtagtgcgggccatagtccgcccagatgaggtccgtgccgccgcggcttaaccgctccgccgagtggttccgcgggcggtcggcgagctgctgatcattgtacgttcttgaacacctctctggctagctgcgacgtcgacaccacgatcgacggcgacgtgcccagccagaccgtcatgatgggtccgtacttgcctgcccactccatgaagcaccggcaccgcaccagcgtgatgtcgaacaggttaccaccggccacgcccggggcccgggggacagcctgccgaggcggatccgattgaagatcaagaaggatggtgatcgggatggcaacaagggcaagcgccaacgggagcaacgccggggtgtccatggctgtcggtgtatgtacgtgggcaaagtggttcttgatcgtcggccagaggcttggagggtttatatagagcaagagcaccataacgcctctgaattattgagggaaaaaaataagaaagagctagcgagcagcaaagtagaagtagagggcggataggttttttatctagatatcatggcaaccattatttctatacgacttaaatagttataaaaagttaaaaaaaagtaacatctattgggatgctatgagtctatagacaaacatgtaagattaaatttgatctacaactcgagaaacacacataataaaatcaggcagtggatatttacttg

SEQ ID NO: 72193 - DNA, 3438 bp, Oryza sativa
atggccgatattgttatatcgtccttagttgtttttatgttgtaatcggttgtggtttgccgatatacaatggcggatattgctatatcgccctaagttttaaactataattaaatcaatgcttttgacattgtaaaattaggggggcacatatatacaccagttacaaattttgacaatttttgagcaaatttggaagttatattaatcggcacaaaggattatcaagataaacatcagtagtatcttagccgattacaaaaatttctaaggtctattacacagaaagttaccgagacaaatagcgctggatagccgatatagctctttgcctaatttgttctacttcttcgatggcttgggcatcttgagcatcggttccagggatgacttttaaagacttggttagatcagcaacattttttatagccgattttagtcttgctttctgcttttcaacagattttgggagatcggctagctttttatgttccatgtccagattggcactgcattcttgaagttgtgccaggagctcaatctttcgagcttcaagccgatcaatattagacttgatcggaccttcagataactgatcaagcttggccttctcttcatgaacaagctgccgattggcctaaattgtggcctcgatgtctttgcgctcccgacgctcgactagtctcagcttggccttctccagcttgaattgatgctgctcgagatagacagctggagttaggacatcggctagctcatctgggatcagagcttgaatctcatgtagccgagtcctaattgagccacaatcaaccactaagctgtctaacgatgatgcctctagccgatgagagatatcttcaagaattttcttcacatcatcggataagggggctaaagctttgcttgtggtatcctcttctccttcatcaagatagtctctaatgtcaaaagagaaaagatcggctaagacatgcaataatgatttaaagagaagttagaggtcaaatagacatagccgatctgggtattttgtgtcaaagaaaagcttaccaggatagcaggagcagtcggttggacttcttcttcaacatggtgaatccctacagctgatggagtctggtcacttgatgactgttgtacaggagaaggaggaggagactgtaaaagagacaagtgttagacaaaatcggctgagatcaactaatgaaagaattaagatgtcattatagccgatttcttcttcacagcagtcttctttttctacaactacaaaatctgtgagtaatcggccataaagtaaaatgattgcaaaaaggatcaaagagagctgcttactcttgaaaagtgagctggagcagaaggagttggaggggtctgcttgggtgaagccgatggtgttctttctgtgtcgcttactttggctgcggcttggtcaacgtcttcttcaatttcctcttcatccagagcttgttcaatggatggatctagggcaggcagatcatcagatggcttagttatctttgtcttggttttcttctttggagctggggctgaagtatctacagccgatgatctggtttttcttttcttgccggcatcggctggttctctgatgagcccttgaagaagagctgaagtcttgggggcatcatagccgatgacaggaggagatggtccacctccatttggaattaatcccgaggcatattcaatgttcctgccactgttactttggcgaggaggagagaactctgttgtctgcaggtcgaaaggaaagttagtcaaggttagtcggctaagcaactattcaaatgaaattgagtaaattaagacatacctgagggacaacatctggaaagagatctgtcatatacatagaggccgattgatggaatagatgcatgcaccattcactccaccatctgtcgaatgctctgctcctgaatgttaccagctctatattatcaatgctgcctatagggggtccttggaggttaagcagccgatccatcattaaggctgacgaaatttcccctcagcactggatcttatcttcaaagaataagccgattgggagttggcccattccagactgcctggcagaacttattggatgataaaattcataggagacttagatgtttcttccttgatgaatgccgacaggaaggatacatggactgattgcagctgaagaaatttctctgggtttctgatatctttcattgttgatgtcttcgaatatgaagtccaatggattttctagaagtgttgaatcttcatagaggaaccaaacttgagtatgtttttggaaaccctcataaaaattgcagaaccagtctttaagcagctcggccgatagctttgcttctgcatcggttggtatggaggcatattctccgtaagatgtgcatctccgatgagtacgttcttctccatcattgtctacaatcggctccagtcttggaaattcagcttctgttacagatggccaattgacaaacttcatgactaccaaattcagccaggactgcaatagccatcatggtccacctgctccgactactgagccgacagctaacttagccgatgcattgtttagcatttggtacaagtagccgagaagtatttttcttaaaggaaattgtttctttgcttctaaggcttcggctacaaactgccaattggttgtagggccacagcttgatccacaaaagaggaatttctctagccacattagcaagaaagccacatgttctcgaggggtgacggaaccctggcccatgtatgctgctacatagcctgaccagccgcctatgctcttggtcttgaagtcgtattggttcttcgtgttcaagctcatagagttagccgataaggtgacatccagacccgtgatcatgatgatatctatgagagttggggtcatcggcccttggttgaacaagaaggcgttgatggtgttggaccagaaataagaggcagttgccattaggggctcatccttagctgagttggctatggtgagatcgagtgcttggccgattccaatctcgtcccaatgaactcttttgctagccgacatgctcttgaaccatgtgatccaacttttctcgggtcgagttttctcgagggatggccaggatttgaaggtgtttttccagtgacctagatctgggttggccaatctaaaaggaatcctattggtttcaccaataaagaactctgtgggatcagggttgccgactgggccgagaaagtagtagttttcatgcgataggctgggaattgcaactaggttggagagatgctacaaatccaaagtaatcgagaaagggaaagcaatataaggcgagagaaaatcgatctgatgctaagaaaggggatctagccgaccgggacttacctcagtgtactcgccgacggcgtggcaga

SEQ ID NO: 72194 - DNA, 2247 bp, Oryza sativa
ttaacgaccaaatttggtaatatcaatatcggatatgaagattaaatcgaagcggaaccgaagataaggattgtcgcggaaacagagtaagaatcggctggagtccggatcggctacgactgggatcggctaagtccgagtctgactgggttaagtgatacagccgattccgacaatacgacttgtgtacgacatcgggtttgagttgataagcttcaagatgattgccgcgcatggatagagtcctaagaaggcaattgtatctattaattaggatattttatgtaaattctttagagataaatgtgggcaaaagtctgccgcaaagacttatggtatcttagagtttgttagagataatagtcgtgtccgatatggacatatcttgtaattcttgggtataaatagaccccgagccctatgtaattattaacacacacgttcaatacaatctcggcgcatcgccacccttttacttttgttttgtttcgacgagttcttgctttcgggttgagctgcatcggtttcgatcttcaacaacaggtaagacttgttatggcggttttatgatactctaatcttgtttatgtaattcgtcgagttatcatatatcttatataatctttgataatatcgtcatctaacctacaatcggctaacatctgttaacacaaggcggccgattagattaaatagcgacgttggcttagattatataagatatctatcactttatgaaacatccagtggcttgattgtctagatattgttcttcttttcatactcaatgctgcatcagttgagtttgatctattaagtcgtgcttagaatttcaatctctagcctgccttctggttgccgattagggtagtatcggagtttcagtcgaccttacctgatttaactaccttatcttatatgcttgattgatatgttgaatctgccctttatattaagatcttgctgcatttaagtatattaggcttctgtttggtatatcctatttgctttaatatcttaatacagagtggtatcggagtattagccgatacatgctagatctatctgatcggctatgctatgaacatatataatcttgttgttaatatatatttcgatctaagtgatttatactgtctcggcatggcgaccgatctatcccaatcacttgatttaagtatatatcgacataaggattatatattattaatatctacagccgatcgagtagatttagttcctttttattcatttatggttgtcgatcgatgtatatatgacatcggcccaaaggtaaatgatatgtcatcggcacttagccgatcggctatcatttatggatttaaccacggtttctttgtctttgtttcttgttgattgcaggatcaaatcaactggcacgctcatacatctgaaggcgagttttggacctgcactggagttaaccagatctcccaggcctcgtgttttctgtcaacaacgcttagtattcatctagaaatcataaacatgatttatccacaaatatctacagaaaacaacctgaaaccgaaatcgacacatattcggccgatcagaccgcgggctgaccggtctgaccgcgcaacacacgccggtctgatcggcaaccacagttcgctctaactggtccaaactgacagcagtccctatttatcatctgaaaatcaaccttctccaaaaccacttcaccaataatctaaaaatatcaaaacaataatctcaaatgataattgttcatcacaaaataataagagtaaagtccatcaccggtccctaaacttgtaccgctgtgtcatcccggtcccgaaactcgcaaatcgactgttcaggtcctcaaacttgttcaactgtgtcatcccgatccttaaacttttagatcactcgtttaggtcctccaacctgttcagttgtgtcaccccggtccctaaacttggatttgaatatcatctgggttaaataggacggtctaaagactttatatttaaaaatagttcataactttttcatgtgaactctaataaagacaaactttatatcaaacttgtagtcctcgacgcgatctacaactttttagttgaatttttttttattttaagtcattttttgtcccaaaatgtaattttaaaattaaaatttcaaaatctataaacatgcaacaatattttgggaccttaaacaattttagttcaaaaacttttcaactacaaagttataggtcgcgtcgag

SEQ ID NO: 72195 - DNA, 1923 bp, Oryza sativa
ttgatttacaactcgacaaacaaaaataattaaatcaagcggtggatatcacctgtacaacgaagataaattttggtttttcttttaacttgcacgattgtatagtggtttatactacataatctacaagcatacatataggtgacatgatatcatgggtagaaaatacttttccaaagcgaagcagctagctaacgcatatagcagtagtaatgcagctgcccactggcattggatgtactggtttacaaagcacactggtttgatgtttttttagcgaagttagaaaaaaaaatacatgagtgtttatagctaagttcataatagagtccaacaagtaattgtcaagtaattgtcgcgaagatatactatatcacatctatcttatggaacgacgtgacaagtacagtgcaactgattttttttataattaaatagtaaggcccacaaggtgtctatatgtacagtaacatttctaagtgtgctcttgacgtgatgtggcaaaggttaatgttcttgggtgctaaacatttgggatgctataagtctattgacaaacatgtaagattaaatttgatctacaactcgagaaaccaaaataattaaattaggcagtgcatattacctatacaacggtcataaaatttggttttttcttttaaactgcacgattttatagttctttagactatataatatatatgtatacatctaggtgacatgataccaggtgtagaaaatacttttccgaagcgaagcagctagctaacgcaagcaacagtagtaatgcagctaccagctggcgttggactggtttacggagcactggtttaatgttttttagcgaagttagaaaaaaattaatacaggagtgtttatagctaagttcataatagagtcaaataagtaattgtccaaagatatacgataccacatctttctgaaggaacaacgtgacaagtagagtgcaactaatatttttctaattaaatagtgaggcacacaaggtgcctatatctagagcaacatttctaagtgtgctcttgacatgatgtggcattggtaaatatacctacataagtttgaaaaatataaaatattcaacatagtggtatgatataattctacaattttcacaagtgttggtgtatatttggatacaagtgacaaactatcaaagttgagacgaattacatgtaaaagaggaggctctcacccatcgagtattgggcccacaaactcatcgaaataccagaaattgggcgaaaccaacacaccactaggccaaggactcaattgctaaagtccaggagacaacccacggccaggggagctggcagggtcggcggaccttgggtttggccgacctgagcctatcccggtccaaccacaactgccttctgacggttgctaccgacatccttatggctgttgtggccggtattggtgctcccaactgttattcacttgctatataagaacctctcctccttcacttcacacacaccaagcacgagctaaattagaagtggttctttgtatcttttattgtatacttagaaaatggagagaatgagtgagaaagagtcggaggaatttcagagttgtcgatattgttctatttacctttttgtaccttgtcaattactctacttaaattgataatatctttatcgagtaattgagatttactttgtgcggtttacctacgtgatgtctatactgttgaatacctatatttgctgcgtattcaacagttcgtttgaggctgatgtagaggtggtgacagctctcgagatcacttgagttcatcctgtttgggtacggattagagcgcgtgtgggtagcaacgagaaagctagtgcatgaagtagtgtgataatgttaaatttaaactttcttaagaccctggtccttactaga

SEQ ID NO: 72196 - DNA, 4835 bp, Oryza sativa
tggagaagaattcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccctggcttttactgggatggggattaatacactagcgttcgggaaaatgtatttttctcggtcgcgacaaatacaagtcaaggtgcgcctaattggttgccaccgattcagccgggcctgagagtttcgctgtggaatcagggaccgcagttcgacttcatcaacgctgctcaggcgccaaccgttcggcagcaagctccaactccaggcttcggaacaaaccaagcaccaatccaagctgccatgatgtggtcacagccaatttttgacccatccatggcggctcagcaagtacctccagttggagccgggcagccgaatgccatggcccaaccacacgcacaagctgcgatttcgcccttcgccacaccgtacccgcagtagggtgcggtaaacagggcgggaggcgaaaaagggctaccgctgtgtgggggaatcaagactcgtccaatcccaccccagtttaagttcccacccgtcccgcgctattcaggcgaaactgacccgaaggagttcctctccatctacgagtcagcgatcgaagcagctcatggtgacaaaaataccaaagcgaaggtaatacatctcgctctagacggcatcgcccgttcttggtatttcaatttaccagccaatagcatttactcatgggagcaattgcacgatgtttttgtccttaactttcgaggcaccaacgaggagccgaagacgcaacaacatctacttggcattcgccaaaggcagggggagtcgataagggagtacatgcgtcgcttcttgcaagcccggtgccaagttcaagacataaccgaggcgtcggttataaatgccacttcggccggtctgctcgaggacgaactcacaagaaaaatcaccaacaaggagcctcagacgctcgagcacctacttcgcatcattgacgggttcgcaaggggcgaggagaattccaagcgacagcaagctatacaagctgagtatgacaaagcctccatcgccgctgctcaagctcaagcacaagttcaagttgtcgaaccacctcccctcttcgttcgccagtctcagccggcgatccaaggacagccgccaaggcaaagccaagcccccataacttggagaaagttcagaacagaccatgcgagcaaagctgtgatggcggtcgaagaagtgcaagccctccgcaaggagttcgatgcccagcaagcgagcaaccatcagcagccagcccacaagaaggtccgaaaagacctctactacgcctttcacggatgctcttcgcacaccacggagcaatgtcgaaacattaggcaatgtggcaatgcgcaagacctaaggccgcagcagggaacaattgtcgaagcaccccgcgaagcagttcaggagcaaacacccccaaccgaacaacgccaagatgtacagcgaagggtaatccaagtgattacaagggctgacccgccaagccagttgtccaaacggcagaagatgatgcagatccgtatggtccacagcatcacttcggcgggtgaaggggcgccgcagtatctgaaccagctaatttcttttgggccggaagacgcagaaggagttattttcccgcatcaagatcccctggtaatctcagctgagatagctggtttcgaagtccgacgaatcctggtcgacggagggagttcggccgatgttatcttcgctgaagcatatgccaagatggggttgcctacccaagcccttaccccagcaccagcatcgctccgcggtttcagcagagaagcagttcaagttctcggccaaacacttttgctgatagcctttggctcgggggagaatagacgcgaagagcaaatactgttcgacgtcgtcgacatcccgtacaactacaacgccatcttcggccgtgcaaccctgaacaagttcgaagccatttcccaccacaattatctcaagctcaagatgcccggcccgacaggggtgatagtagtcaaggggcttcagccttcggccgcttcgaaaggcgatctagccataatcaacagagcagtgcacagtgttgagaccgaaccgcatgaacggccgaagcacacaccaaagcccacccctcacggcaagataacaaaagtgtagattgatgatgccgaccccacaaagctcgtatcacttgggggcgacatgggcgaagaagaagttgagagtatcctagaggtgctcaaaaagaacatcgatatcttcgcctggagccctaacgaggtggggggtgtcccggtggatcttatcatgcatcacctagcagtcaagccggacattaagccaagaaaacaaaagttgcgcaagatgtctgccgatcgccaagaagcggcgaaagccgaagtacaaaaattgctcagggcgggggttatccaagagattgaccatccggagtggttggtgaatccagtgctggtgcggaagtcaaacggcaaatggcgcatgtgtgtcgatttcacagacctgaacggcaaatgacgacttccccttgccgcgaatcgaccagctcgtggattcaacagctggatgcgagctcatgagtttcctggatgcatattccggttaccaccagatccacatgaacccgctcgacatccccaaaacatccttcatcactccattcggcacattttgtcacctcaggatgcctttcggcttaacgaacgcaggagcaacttttgccaggctggtgtacaaggtccttggcaagcagttggggcagaatgtggaagcttatgtcgacgacatcatcgtaaaaagccgcaaggctttcgaccatgcgatcgacctgcaggagacattcgacagcttgcgcacagcaggcacaaggttgaatccggagaagtgcgttttcggcgtccgcgcaggcaagttgttgggtttccttgtttccgaaagaggcatcgaggcaaatcccgagaaaatcgatgccatccagcaaatgaagcctccgtcaagcgtacatgaagtacaaaagcttgcaggccgaattgtggcactcagtcgattcctctcaaaggcagccgaaagaggtttgcccttcttcaagaccctccgaggcgcaggaaagtttaattggataccagagtgccaagcagcattcgacgtgctaaagcaatacttcaaagcccgccagttctgataagcccacccccaggaagcgaactgctattatacttagcagcttcgccggtggcagtcagtgctgccctcgtccaagaaacagagttcggacaaaaaccggtgtacttcgtctccgaagcactgcaaggagcgaagacaaggtacattgaaatggaaaagctcactgacgccctagtgatggcatcgcgcaagcttaagcactacttccaggcccacaaagtcatagtgccatcacagtatcccttgggcgaaatactccgaggcaaggaagtcactggccggctcagcaagtgggcgacagagctatccccgttcgacttaaattttgttgcacgctctgctatcaagtcttaaatgctagccgacttcgtagctgaatggacaccggtacttgcccccgaccccgagcccgccgaacaattctgggtgatgtgctcagacggctcgtggtcgcacaggggagcaggcattgcggcagtcctatttttgccgaatggtgtgccgattcggtacgtagcaagactgcagttcgacacaaccaacaatgcagcagaatacgaagccgttctcctgggcctaagaaaggcgaaagcactgggagtccggcgcctgctaattcgaactgactccaagttggtagcaggccatgttgacaaatccttcgaggtaaaaaaagagggaatgaagaggtatctggaggctgttcggtccatggaaaaatgcttcaccggcataacggtcgaacacttgcctagagaccagaacgaggaagcagacgccttggcgaaatctgctgcttgtggtggcccacattcgcctggcatctttttcaaagtcctacatgctccaagtgtgcccatggacagcttggaagtcatggcaatcgaccaggagaaactgggcgaagacccatatgactggcgaacctcatttgtgaaacaccttgaaactggctggcttccggtagacgaagcagaagcgaagcatttgcaactcagagccacgaagtataagatggtctcgggtcagctttaccgctttggggtacttcaacctttacttcgttgcatctcttttgccgaaggcgaagaaatggcaaaggagatacaccagggtctatgtggcgtgcactaggctgcaagaacaatggcctccaaagtatttagacaaggagtttattggcccactgtgttgaaagtctgtgttgagcaaatcaagaagtgcgaaagttgccagcgtcatggccgaagccaagccgcgccccagtatgatctgcagcccattgcaccagtatggcccttcgccagatggagactggacatcattgggccattcccggtggcgcgaaacgggtataaattcgcaattgtagctgtggaatatttctctcgatggattgaagccgaaccccttggggcaatcacttcggcagcagtacagaagtttgtatggaaaaacattgtttaccgtttcggagtgccaaaagg

SEQ ID NO: 72197 - DNA, 4520 bp, Oryza sativa
  unsure (1)..(4520): unsure at all n locations
cagataagtcaatattgtactgaagtttcaagtttcgaatattttggagacgattctgcacttctttgagttctgctgctattctgcgcaatggcatcacactttcagattttctgaagaagttcttcaacaattccacagatggggtttcttttctgccaaaataatagacaaattcatccaggatgtcttcaacttcaaatgctatctgctgaacttcctgcagaaaggtttcagcctgcctgctggagctttctttttcttggccatcttgcaggaaagattgcatcaacctaaactcacttctaatttgctttacaatgctttcaacctcaattaaaactgatacctccttccccagatgtgaaactaatgcctgcgtcagatgtgaccccaatattgatccaattttgcataggattccaaacaccacagactctgccattcagtgctcgatctctcagttcagatattttcaaatgcaagacctgaaacaaaatgaacaagcatccaataataaattttcatcctacaaattactttgtaccagagttcttgaaaaattgcattaagttaaaaaataacagaacggttgtcatttcagacttatttcacaaattttttggtgccagatgtatccatgtaacaattcaaataagaaaccggtgaagtttaagtggcatataaggaattttctcttcaaataaacagatgctacacaatctaatttctggtccaatcgaaggcaatatactctttctttttcagccttttttatgtaaaaaacatggaacccaaaccacaaaaccacctataagcctatacataagggagagaaacagactaaataaggcaagatagaacggagaaggtacatgaattacctgtgtttgctcgccgaagcttttctcgcagatgggaattgcaatggcaaagtagacgccctggaggcatttgatcgaacagttggcgggtggttgaactgacgaccggccagagtgtgcgccgtggtttgcacactatcaatgggaacctggtaaacccatagacacaccaataatagtgatgtcggtagtttatttagtgtttagcatctaataaaaagtggcaacttgcaccttcgaagaaattgagagcaagaaagctgcatgtttcctaccgaaatccccattcgagggacaaccgatcaagatgtcaattgcagcttggaaaggggaaatggtttaaatggagagagtgggactggcgtgtcagcctaggacaagcatataatatactccctccgtcccataatacaagagattttgactttttacttgcactgtttgtcccctcgccttattcaaataaaatgtgcaaatataaaaaatgaaaagttgtgcttaaagtactttggataataaagtaagtcacaaataaaataaataataatttcaaaattttttgaataagatgaatggtcaaacagtgcaagcaaaatgtcaaaatcccatatattacaagacggatggagtattttattaagagtgtatttttttaagttcattttgtcttaatatttatgttggccactttccattgagtaaatttcacggaacactacaattttcagggaatctgtatcactaccaaaccacattcaactatcggttacctgataagaaaggctcaccggtcagtgactagccgtatacccccccttgtgcgtctgatacgcaggcattcgctggagccgaagttagcgaatcagaaacgacaaaaaaaaaaaaaaaaccacgctaagcttttttcaggagtagcgtcaccagacccatgtgcacaacacgaagacaaccaactctttttgaagctcacgtttgcttgcctgcctacttcggtagttcggtcttttggttttcggcccaactcgagtttacgacgtatataagaagttccaaacctagtatttgcaatgatgctctgattttctgcatacatatacatgaatatattttttttatctaaagtgtgatttcaaatcttttattaaagaaattagttactataaattctattactagatataaattttatcttagggatgccaagtcttttataatattttcttattatggatgaaaacccacaatattttttaaaaattatttctatatgtattttatgtatgttaactttacatgtataaactttttatatgtaaactttatatgtacaaattttatgtatataaactttacatacacaaattattggtagaaaatagtttgcatacaaatcacaaagctgcatccgcccatgaacattttgcacttttgaaagatcatgggaaaaaaagaaaaacaaaaggtgcaaacaacgggagagggccaatgcaggaaaatgtccatccatttagccctaagaaaacttcaacgcatgcagaccatatgctgaaatccagaatgggagacggcccatgtgcttaaatgcagaaaatagaaatagcatgtttgcttgttagacttttcggaatcaaaccaagagaggaaacagaacgctatagttgaaagagaaagtgggacgttcgcgcgtgtgactaatcaggaatgcgcattagtcgttccgccgcttccttcctatatgccattcacccgttcgccccgaaaaattatgtagttgcaaacctaaaaactagtctatagtaagataaaaaaaatggggcaattacgcatctgagcttgttttgaagcctaactactaatttgaccctctttaatcaattttgtttattttacccttcttttcaaaattgaagatccaatcttaccctattctgttcagggtatataacggtgttaatttgagcaaaaaatgtctcttctacctttggtcatttgaccctatttaatgtctcttctacctttggtcatttgaccctattttatcagaattataaataaaatatatcaaaattttggatagcaaccaaaaaaaatataatctctttgccacggcggcggcgtcgccgacccggcggcggcgcacccacggaggaagacggaggcctccgcgcgcggggagggagggagtgagcggcgccctatgctcttcgccacggcatcgtcatcgtcattgctgaccatcggcggcgcgcgcatggaggaagatggagaacgacgcgcgcggggatggagggagcggtgccctgatctttgccacggtgtcgtcatcggtgtgcgtggaggaagacagaggctggcgcgctcggggagggagggagcggctccctgtgatcttcgccgcagcgtcgtcgtcgttgccgacccgggggcagtacgtgtgtggaggaaccgaggaagacagaggccggcacgcacggcgacagagggagcagtgccctgtgaggcgctggagctcgccggcgtgcggagggcgggcggcggcatcacgcgcacggagaaaggaggaggccggcgcaccgaggacgagcagtgacagcttggcgccgaaactcgccagctcacgggagaggggcgccgctagatctgcggcttgtacgcccagcctccgccggatccaccgccacaacttgagctccgccaccgttgctcctcctcgtcgtcatcaagctgccgccgctccttccgctcgtcgttgctgctggtccttctgctcgccgtagctgtcacctgtcctttctccgcgcgcaccgcctcctccgcgcacgggctgccacaggtctgctacctccgcgtgcgccaccacaggtccacgcccctccatcaccgctcgtctcaatcgtgtgccgccgccgccgccgatagacaagatagagacgggagtgaatggatagggttagatgtggatggggtttcttcagaatagtttggtcaatacgaataataattaaatttctttttttttcaaaaaaatgaaactttaacggtgtagtggaaacagggtcagacggagtattcatttttgaaaagcagggtcaaataagcaaactaaaaaagtaggatcagtttagtactccctccgtattttaatgtatgacgccgangctnncctatctcccaaaatctgttgaaaagcataaagcaagactaaaatccgctataaaaaatgttgctgatctaaccaagtctttaaaagtcattcctggaaccgatgctcaagatgcccaagccatcgaagaagtagaacaaattaggcaaagagctatatcggctatccagcgctatttgtctcggtaactttctgcgtaatagaccttagaaatttttgtaatcggctaagatactactgatgtttatcttgataatcctttgtgccgattaatataacttccaaatttgctcaaaaattgtcaaaatttgtaactggtgtatatatgtgcccccctaattttacaatgtcaaaagcattgatttaattatagcttacaacttacggcgaattagcaatatccgccattgtatatctgcaaaccacaaccgattacaacataaaaccaactaacgacgatataacaatatcgg

SEQ ID NO: 72198 - DNA, 3688 bp, Oryza sativa
ggcgtcatacattaaaatatggaggtagtatttatgcttccaaacggagccaaataagtaattgtgcctaaaaaaatagacttttaagatttgcactatatatttttccataagtaaaaaattttactactttcaagtatttgcactatatatttttccctgtttgcccttgccgaaattcttctactgttacaagttgaacttgttagtgtgctacggctgtatattttccaagtttgtcctttctgaattttgaaggcaaagtattatccttccggaaacctcattgatatagttttcatcccaacgtcttccgtgacttagaaaagtactgagtacagctttattgaaaaaaggcgtaatttggagaataggggatggtgacaaggtgtatatttggagagatcaatggatcccaaaggctgctgggttaaaggcaacaggcaagaaagagaaatcgagattaaagtgggtatctccactaatctttttctaggatcgaacagcaagaactaagccaaccagggagggtcaatggttgtagtatccaaaaccaaaacttttagcgaaattaaaagttaccctcgaatcgatgacacgtggtctgactagggtaaatgcgctggtctaaccgcctggacaccattggtctaaccgtagtagtcactccagctgtctgaccgctgtaatcagccgccatcgcctatagccgccgccggtctgaccgccgttaacctgccggtctaaccagtccgacgccatcggtcttgccagttggaccgctgagcctgagcaaacacaaatcgaagaactctcaaagtagatcacaactttattacttctatctgtgtttacaaagtgcaacaacagtactcctcacgaaatctcggctaaactcgaaaccctagctatcctctcaactcaatgctctcttaaacgataccaggaggccacaccctccctctctatatatacacgaggtaggcagcctaaagccacgaaccaaacttgtacaagatgttctaatcctctaggaaaccttctcgtacaagaaactaactttacaaactccaattgtaccaaatttagacaccctccaattcgaccagtcagatcgtgggctggccggtctgaccggtagcacctgcccagtttgaccggacccgacaatctagcagtatctgttcatcacctgcaaatcactttgccaataatctccaaatattaaaaccaataatcttatatgccaattgttcatcacagaataagaatcaaacacactttgattttacacttctacaatcatgatgctgattaaatcctaaaagtcaagccttcaccgagaatatctgaagattttgttacctggcattacgagaaaaatggtatcttttcaatatgcagtgcttataaattggtgctagcagaaagagaactaaaagatggaagttcttgtagcaatgctactgatgggagtagacattgctggtacatggtttggacagcaaacgtgccctagaaagttagagtgttcgcctaccgcatcgcacgagacaatctccctacttaggccaataagtttcaaaggcaattagtgacataagaaaagtgcacgatttgtggatttgaaattgagaattttcacacaatggttagatgtacaaaaagcgaaagctctgcgacatgctctgtgcaggatttgggctctcctaggggaaagctcttttaatttttttggcgtgattgctggaaaggttgtctatccttcttatccttcttagctctgtaccaactaactcttgtcatatccttgtgctgttttggggagcttatagtatttacgtaatgatattgtccatggcaaaggtgaggagatggtggcaagatctgcaatgttcttacagagttaccatgactcttttgcacaagccgtggtacaagaacctggtaaaaaggtaaggcagttttgagtgcagtataaattaattccccaaacccgaagataaatagaactttgggcgtgggttgcagctcatgggaattgccagaactggttgggccaagattaatgttgatggtgcttttttgcaggctcatgcaatgtggtatagttctggttcagtcttgttatcatatttgaagtacattcgccacggggcagcggtggaaaaattagaattgttagcttgcagagatcaaggctggcctcaccaacgagcacagatcgcggctggcgagcaagccgaggatggctttccgtccctctcccagctgccaccaccttcacctccccttccggtgacgacctcgaggctggccatcgagcttcgacggggactagatcggggcgtcagcgcgctgcggccgtcctgtccacgtcgcgagcgtcctctgccgacagcctccagatcaaggcgacggtcgtcgagctcgatcaaggcgacggttgtcgagctctccggaggatcgagagatggcgacgaggtcggtggtgggcagcgggggatggcgacgagccccgcggaaacgcagagccgagggtcgtgaccttcttggcagtgtggagaaggggatgacagcaagctcctcggtgcggcgcggagctgggaagacgggggatgatgggctcccttttcggtcatcgagacgggctccatttcctcatcacccttctccctttccctacccaggcggtttctccctttcccttcctaggcggcacaggcaatggcaagccatgccctccacaacgcctctcctgccttctctccccatgccaccaaccctcgaacaggctgaagaacgagtgaccatctttggttccgcattcttcgtgggaccgcacgaggatgatgtggcagcgaatctttgatgtggatggccaaggccgaacgccaactatatgcattatgcattatgaatggacttaatagatggcaggcagtaccgcggtagaggcggccatgcgtaggtacctagatgagctaccgcgcgcgccgactgcatcgacgacctaccgtacgatcgagttcattgccctggaagtcgcacgtactcggactctcgaagcagcatgttagctcgttccttgacacactgcaggtggctctgtatatttatctgaagagctgccgttgatatttgcactgctctagcatttgtgagttagtagctcttatatactagcacatcatgtcgcgcattcaccacactcgttctaaaatcatgttattcgttctaaaatcatgttatgtggtagagtggcaatctatatatctcttttaggtttctggttgctcgtaaaaaaacatgtatcggataagtgatattgtatatgctgaaataataaatgatttaaactttaaatatatgcaaacttttacatctgtatgagttatagtcctatagttgttttcgtcattacataattaacccccttatcctctccttattttttttgtgtgcacctttatatccgccacgcatatattttgtaagtttttaaggaatattttagttttgttttaaattagtgtggaagtcattaaacttatatttgggagaccacgacctcctcgttcgaaagaatatgtaggtccatatagcaatttttatctcaaacacattaataattgatttttagaaacataattaattatatgaatatacattttgaatatgctcttaa

SEQ ID NO: 72199 - DNA, 3243 bp, Oryza sativa
tacatctattctcttatttctatatctacactaatataaaatataccagtttcatctcgtagaaaaatgtacacagatgtttcctatccataggatctcttaatctaacattgttccatattacgagttggattcaacatctgcaattagggatccctcccctcgatgtccactacacaccgccaaaatagtggtcggttaaaaaataacacttctccactcctgactccttccagaaaacgccgctccaccgaatccagcccaccgctaccatcgtgcgcactaagccgctgtcgcctcctcccacacttgccctacccggtgcaccgctactgcactcacccctagcccaccgcctcatgcatgctctctagtctccattccactgcacacactgtcgatcacgagggcacatcttggtcgcgctatgagggagaggggggctcgagtcttgtccctggctttcactgatgcggttactcgccggtttccttccatgcctcactggcccaatcaactgcccgtctcgcgcatactaagccgttgcctcttcctgcacatgccctaggccatcggcaccgtcatcgtttccactccagcgcccaaccaacacccttctaggcgtagggtggtggttggtgcctggcgagagtgccgagatgatgcggtctcctaattggtgagagggtaggtacatgcgatgctgctgcttattgaccttaattgatgagcttgtgtctttttgttcaggacaagaatcaagttgcaatagtcacccaacatctctatctctactaatataaaacacaccagtttcatcaaaacaagcattttctaactcttagatctattcatccaatggttcataccaagagttggatccatcagagcaagtataatagagggcaataagaaggctaaatgctgaggtgtatgagagaggaaaggagagagatgagaagcgggctgtaaccttacagctggcttaggtacaggaaccaagaaaatctatgaaatagatagatgaactatatatttatactgaagagctaaccactatatgagtgagctgatagatatgccataaagatctatacagtaagtagttggctgtattattagccttgctctcatccaattagcactctcccactctgcgtgggacccaccactccgcacgtctcctcacgcctgcgcacgttgtggataccagctgcaaaccccaatccctgcaatcccgagtcggatgcccgacgcgtggatggagtcgggatccggttcaggccgctcggctccaggcgcattgtgagaaggctcagttagggtgagcggagtcatcgagcaggacggttcgcctttctctggccgtgatttcccttctccccatctcgtctccattgactagaatcacctctcctccacgccgtcggctcgctcacctacaattgccctacctcaggtctcatcaacttatgcgccgctgtcgccgtccccctccgcctaactcctggccacgtgcgccagctgatggcggcggctgggtcagcgagggcaagcatcaggcagcggaagaaggttagattattaagtcagggagttggactgatgcgctgcctgtggtggaggtgagtgtatgttaaattaagctgcatctttgtgggcatgaaaatatcataccctttataccgtggcaaaagttctgaaagaaggtttagatgattaagtaaaggggggatgagttgatcaggagatgcatgcacatgtggttaagtttctcgatttgtttggaatgcagtgaacaatagattttttcagtggtctatctgccaaattagatattagtgttgttttagaaataaattgttttctcattccgtggaactaattaaatatttatgcttttgggtttcttccttgcctatcccttctttctataaagttaaaacccaaagctacctccaattcgccacgtcattaacatcatatcagccattcgatcaatatgtacatcagatatataccattagatcttcatttacctacaagaaaacgtgcccaaattgctgggtcagcccaggtagacccacctcctaatcaaatggtaaagctgcgctccttccacccatggaaatcattcgccaatgctgaaactgtcgccatgaaagagcaggcgaatgatcgcatttaatccattttattccacccatcaccacgattgtttttgtttttattgcgccatgtaatcctctccatcttcctccactaacccagaaattatcacgatcattatcgtcgatctagctgccagcttactctcaatatatatagaccgtccgatcaatatatagttcttctgcgtcacttgaaatcttcccctgatcccatcgcatcaccaacaagaagtaccatgtacttgccctgttgctcagcctgattctctcatcatctgtaactgacattttctatgtgtatcttcctttgaatttacttaatgaatctatgctgtatcctttcgcacaagtgcacaacctgtatacacatgcataaatgtcactatatatccagatgtcagatcaattgcttgctatatgagtataattagacatttgagcaccacacaacatttgtttcattgctttgctgcaaactgaatttttcatcatctctgatgtttctggccattaattatcatcagtagtgcagcttcgagctaaccactctcaactttcaataacggtggcggtctactgccactgattctgctcgataaattgtagctttcacaaggcatcatagtttcctgatgacctctgtttttttaatctctcaaaggtataagtcaccactgcactaaaattatatttttactattgtacatctttagggtaatcgtttggatgattatagatttacatgacttattagtttcaggatgttgtcaccttggctatgatttaagtagttaggtttcccttgttggaaatatagtcatatatcggcatattttaatccaaaatattaagacaataatcatgacatgaacaatgtgaagtgatctagagataaaattaaacataaccaggagcatgcttaagatagaataagcatcatcatcatgtagagaatgcaataacattgcgactaacagaagtaacaaaaacagagatagcgatagaatgttataccctatgaaattccctttgctggattgtgaggcagaactgcctccgttggtgttgtcga

SEQ ID NO: 72200 - DNA, 1107 bp, Oryza sativa
tgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaagttggtatcagagccatctcgactgtaggataagcgaaatggtcaaaccttaaggactaattttctgaaaatatgatttgtgaaaatttctcctttcttccttatctagaattctttgcaaattgtttcattgtctactcccctctctctttcaacttcagtagttctgagacattgaaacttgaagacgccaatgaggtctacttacggaggttaagtaaagtggatcgaggaatatgaaggtgatgatcgatctgaagtgccaagtgttcaagatggaatgaagtttggatcctaccttagaacctatgccgccaaactatctttgaagaatagttagtagggtagaacgtttgttgcttgctttgtgtgtaggtatagttgcattcccatcattggagtagttcattgatgagtgtgtaactatactaggttgcttgcttaatcaacttgaacaatataatggtctacacacatcagatcagtgttaacctggttaaggtcttgtctttagtgtaacccctctccttctatcttctctaatatgcaatagatggtgaacactcgcgccagtggaagtggaaacaataacaatgaagggaacccaactcttgctcaagttctggctcaacagactcagttaatgaacatgatgatacagcagatgcagaaccagctcaaccaagggaacaacaatgctccaccgccgcagaacaagttagctgattttcttcgtgtgaggccacctaccttttctagcactaccaacccagtagaagcaggtgattggctgcacgctatcgagaagaagttggaattgctctagtgtacggatcaggagaaagttgttttcgcttcacatcagttgcaaggacctgcatcagaatggtggatcatttccggatgaacagagcagaaggacaaccaatcacttgggcggagttcacggaggca

SEQ ID NO: 72201 - DNA, 44091 bp, Oryza sativa
ggtggacttagcagtttcaacgtgaaattgaattggcatgatcagtcagagccgatgctttactctgcacgtgctgctcgtcgcgattgctgctcgtcaaatcggagtcgatcagtcgactccttgtcggcgtttgatgcgaagccaaatctcgctaaacaattgacgacgatgatgaagacggccggcggcccggatgggcctatttggtatgggattggtccaaatctaaaatttagttctagagttatgtttggataaagccgtagagcaatttaaatccaactctatctttctttctagtttattttgtgaaattattttactcagtttcgtttttattttaggtggaggtgaaactgtttagttaggctctaactctagtagaggtggagctgaaattgtgccaaatagacccttagtatatccatctctaaagttctaataccatttattataaaaatagatgcacgactaatatatgacttttatgtgaaaaactcttaccagaaaagcctacatgcatagatcggcaatgattaatatagaggagttgggtacaaacgtatagaatacattgggttgtcgcatacttcttgtgaggtttacaagagatatataaagaaaaattctaagagtcttagtagaagaagatttagagacatattagaaaattaaccctgatagtcaagttttatatattagaaaactaatccaaatatgtttcatgccaaaatttgtagtagaagtatcatatatgtaacatatttaactatacctgcggtatagcactatagaacgtgtctttgccaggacacttcgattacttggtaatttgccaaaacattccatgatcattatttcaacattttactcatttgggcagataaaattttaaaaaggtgcttttacgccctttcgcaaattgaaaattttggaatttcagcgcctcacttcctaaaaggacatctttaattagaaaaaaaaatttaaatctgaaaaaaatcaaaatatatttttaactttttaagtattttagttttccatggaccccgtaaacattttctttatttttgcaatttggatgttttttaatttaaaaaatgtttaagtttaccaaaaaattattcaaatttcaattctttgtccgatattttttagaaaaattctatcaatcacctccaaaatgtttggagattttctgcaatttagtaaaagataaaaccaggctgaacatccaacttggcatgaggtaatttaaaacgtcatctctgtaattgtatctatctagtagttgagctgaaaaatgttaaaatattaaaattatggtcattttagaaaactaccatgaaagtgtctcgtagaaaatacattattgtataaaaataacaaatacatacatatctaataatatttcgtcgagcatgttatgccttttcgtacgaaatagtatatgtgccatggaaaaacacgtgagcatttgagtacttcagactttcactcgaagagaaaatgtatcaaatgttaattaattgtatatgtacgtacatcctaatttaaaaaagtacatgtcctatattgtatattcaaggtttcattttataagaagcaaaggctctaagaatctcccacgaataaaaaagaaggcgctaagaatcaaatttggacggccatatagttaattaattagcttgcagtttgccacaaccagtatatataagaatttaggtgttgtacatacgtaccttgatgatgtagatttgcaccgaactgaaaatgacgttagtacgcatgcattttctcctagagtgtaccggctgggcggctggcatttatatatactatgtaaaactccgcgtgttgctactgagttagcataataacaagtgaaaacaatgtgtaagatagctagctagacaatacaagcttacataaattgatgcatgtgatttatgataaattaaaattaaatagtgtatagaatgatgatttaaatgataaattaaatttaaatagtgtatagaatgatgatttaaatgtaaaagtaaaggtgatatggctttatgagagaagaaaaggagagagatattttggaccatagattatctaagactaaaaataattgatgtgatatggcttaatgagagaagagagaaataacattaactaagtgagaatgaactatatatagaatattataaaaaaggatgaagagataaattgaaataatatttgaattatgtgggatgatgatttaacatgcttacattttaaaaactctaaaattcaataaatcataaaattacaaataatatagcatgcttcataatgtttaaatgtaataattattattgaatgatgatgtagcatattgttagaggatgatgatgttgcatctttttatttcaactactcccacattcctttatatatattgtaaaattaactggggcactatggtgtccaggcaccaagatttaaattgagtacatatattcaatttaaatgagtatgaatttttttaaaaaaatgtttagatatgatggttgtaaggtggttttcagtcggttcatctgtaaccgtgatcaccatctaatagggcgctgccatgtgcaaagggaaagctgggggacggtaagtctggttcggctcccaccgcctctagccatcgacttcatccagtgaatgacaggtaggcctctatggtgactgaggttggtttggccctactttagatcggtttcaactgtcatgtgagccctccaatctttttactcacgtatgattgaccggaggttcattttatggcatgacatatgtatttttattcataaatgacctgcataaatatatttatcaaaactagtgaaaatggttagcaataaactcctaccatcaagttttgatataatattttatattctttatacaggagttgacggttaaagtttacacttaatgaccgtcaacaataagcgataccgtggcagtttcgcgtagccgcgtgctaacctcggtataccggtattgcactcctaccccgcgataccgatggaatatttcttccaaacaaatttcaaccggtatatttctttcaaaaaaaatcaatatcagtattcatgcaatttttgttcaaagcactactttcgctacagtacaatctctaaggaacagcccctacatcaagtgccactgtactattgtcgtatactatttctttcttttccaccgttgacgttttagaacggagggagtatgtatatatcgtctgtacattagatttgctattttggtactttcagtgtcctttttctgagtactagctgaataattttgtgttcgctattggagggtacactaagttgaaaaaagaatttaaaatagttttgtaagatgatttaaaatataagtatttatatgattattaacaaaactaaggcagagtgaaaaaaatatcttttagtggttaaattttaaattgtttatatatccctttcaagcatcggatgaaaatgtacagaacgatttttgtgcactggactgagtgtcccataaatacttatattgtggcataaatttttgaatactcaaaatattttgaaacaaaagaagtatatggaaagtgtgtaccattaatccaatctttcatatgactgtcaacgccgtaaatatatctgtaatattactctcagtacagttaattagcatatggccctgaaatttttcggccgaacccggcaattttatatttatatatacccttgccttgagcttaggcatcatgtagcctcgccgctcaagcatcgctaactcagttatagctgtctaacaaagcaaattagctttcgctgagctttgtgttgcttttggtctcctagataggtttgtgaagcatgaagctcacggtagcaattgtctgtgccatggcgaccgcgcttctcgccgccgccccgtcgtcggcggaggccggcgacggcgagctgaaggtgggctactacgacaacaaatgcagcggcatcgaggacatcgtcaggtcgcacgtcatcaaggctatctgtcgaaactagatttcggcaataataaaagggggtggctatcaagctaggaaagtgtatgggtttggaaacaaaggatttatacaggttcaggccttcttataaaagaagtaataccctactcctgtccggggatgaatccgccgagtgtattattgattgtatgattcgggaaaaaatcagcatatgcccctagaggcgcccggaccccccttatatatgggaaggagtccggattacaaaagataatctatattcctaacggaatatgaagatacagataaaatacagtcgtaaccgactaagtctctgggtgtttccttgatacacaagttaagaaacaaacccgagatacagataagatattctatctacattaggtatcctgtacccagttcgaataccatcgccgtgtagatatgggatacccataatctccacagtagcccccgagtcctttgcagtcgaccatcatagccttctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcacacgcggcgcctaaataggcatgctagccgactgctttttagccacaataaaagaaatccgagtggtttacactctaaaaagttcacgaatgaacacacttgacaggcatccgaatataaaaactctaaagattacccatcaagtattataaagattatggtaataaataagtcaaatagcctaggccatgactatttaccatgaaaacaggcatataatacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgtaaagctgcgccggcgaactagggttcacagctccggccaaatccacctccgaaaagtgcatcaaaatccttcccgtgatccaccgcctcaatccctcacctctcccaagccatccctcgaatcaaatcagcacatttgagtgaaaccgatggcggaagagagagaaagcttcgaaggccaatgggcgccatccgacgtgacggaggaaaatcttaaggagatggtggcgcacggcgttctccctgccaaggagatcatcgggtggcggccagcgcacggtgaggttttcccgtctccggatactcatgagattgtggtcttctcgcatttcttctacggcggctttgctcttccgacctcaaaatttttccgcgggatcttgaatttctatggaatcagcttgcatcacctaaacccgaattccatagtgcatatcgccaatttcatccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggctggcatgcaaactggttctatgttcagaatcccgagcctgctcttcccgggtactcttgtcttcctccagtgtaccaagatacttggaactctcttccaatcggagatgaagcagtacaagccttggagttgttggatcgtatgttaaatcttaaagaacaaggcttacagggagagcagatcactcggcacttcatcaaatgccgactagcgccaatcaaggaaagatcccgcacagcattcgagttcgacggcaaacatgatcccaaccgtgaagaaccagattccctggatttcaaaatcatgaaggagaggatgtataaaatcttctcaaatgcaattgtagtcagctactctcatcaactgccagttgtgccatataatgcattcaatccgcctccacaggtatgcatcggaaaccctcaaaccgtgatcagaacataattttatcttcatgctgagttgactaactatggaagcatcttgttcaggaatatgcattgatgaagtcagatccaccagtcactcagcgccggtctcctcgccaacacaccgctcagggaggtggagggccaacgatcagaccagatccgcaacctcagacctccaaattgactggtcaaacaggtcctcgcaagagaaagctggtacttgatgatgatgaaggcgacgatgataaatctggggataagggctcgcctaataaacccccaaagcgcaccatgcccaggaaaaaactggctggccgtgcgatgccaaagatcagaacatcttccaggtattagatctctcggtatgatttccgcttcggcatgttttccaatgaagataatgctaaatactgaaagaacactctgcaggaaaccatctgatatagatccatctggaaaggaccccgatcctgccatgacagagcaaaatatacccaaggaccccgagccgactgctgaaaaccagccgaccgctgaaagccagccaactggcgcccatgcttcgggcgatagggccgatccgagtgacctgccgccgactagaaatcagtcggcaacaactgaaacggcaacaactcaagagcccccgactggaaaccagtcggacgcaggccctgatcaagagatccccgaagtagaagcgcagacgacgacttcgcaaggaccagaggctggtaacgactcgatagctgggtcttcaggtaaagaacaaagatcacctcacgctcagctaggtacatcttcaggttagttgtcttctcaaacaatggcgatttaaataacctcagtgtatccgtctaacgtcttggaaatacatcaggaccatcaggtgatgacggagaagaaatccctcgcataaaggcgaccgacgactctcgtcctcctatcttgatcaaatggtgggacgagaactcacaagccgccggcatagtcataaaccgtcaaaaagaagatgaagaagtgtgccagctgaagaaagcgctcggagaagccactcgtattgtaaatgtaagtcttccgagtgacggccttcggtaactttgttttctttttagcagaactgaaccatgacccatcatgcagagaatccatcttcgcaatgaggccaagactacaactttggaaaagctggttcctcatttgggaactctagaagcagttagggaccagctgcatgaggccaaggagtgcgccaaaaagacagagaaagagttaagggaccgaatcgcccagctccaggatgcaaacttcgaactaagtggttcatcaaaaggtaatcatccagatctgtttcatcggtttaaactggcataacggtatcctcaaccatctgaatttcaaacagcgcaagctgccaggatggaacagatggtgaagcaaattgaagccctggagagagacaagacagaactagctgcgcaaagggactcagccttgaaggaagtcgaaggtaacgccagctaacaatctgagcttctctccttataatgcaacagatgctcatcataaatgtgttttgcagaacgcaagatcaaatctcaagctcagtttgacgtcctggttggtaagatcaagaggcttgaaggagcaagggataacgtcgccaatgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgataccattgatggatttgcagacgggacaagtgaagaggctgcccttgatcttatcagcaatgctcagagtgcggctgacaagattgcaagtgatgttgtagaacaattccgcaacaatgatcttcagccgagcgatgataactctgatgatgaaaggactgattctgactgagtttgaatgtaatacatggaggctcaatttgtacaatactggtgtatttatgctgtgcttgatgattcttgcgaagtttttgatttcttaaaagtttttgctaagctttgttgagcctaaaacccaaagaagctattaaaaactttcagtcctcgcaaactaagtagaaaaaccaaacaaggcaatgataaaccgagtaagcaaactgaattgataaaaaatcacactccattattatgatgatagcccccgactgacaacttcaaggagaaaacttgatgtttgacagtcaaaatagggaaatacaatgataaagttaagcgtagaagcgacgaagatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaaggcacgagatcgaacattgcgattatgataacgtcgcaacccttgtaagtaccgagctgactgaatcaaagctgcttcgcggacctcttccagtcggtgcaagtcgtccactcggtcttcttcatagcgttcttcacggaaattacggaagcgcaaagattcgaactcgacttcactcggcaacattgcttctgccccgtagacaaggaaaaaaggtgactggcctgtggcccgactgggcgtagtacgcaaagaccaaagtactgatggtaactgtgacacccatttgccggcatagggtttaagccggtcaaaaactcgagctttaatcccttgaagtatcatgccattagctcgctccacctgtccattgctcattgggtgtgctactgaggcatagcaaatcttgattccaaaatcttcacaaaagtctttgaaaactccgccggtgaattgtgtgccattatcggtgatgatccgattgggtactccgaatctgtacacaatgttgatgaagaaatcgcgagcattatctgctgtaatcgtggcaacaggcttagcttcgatccacttggaaaatttgtcaatggccacaaagaggtgcgtgtaaccgccgactgcctttttaaacgggccgaccatgtcgagcccccaaaccgcaaacggccaagacagcgggatagtctgcaactcttgagctggtagatgaatttgtctggcaaaaaattggcaaccttcacatgtgcgcacaattttgtcggcgtcggacactgcagtaggccagaaaaaaccctgccggtaagctttgccaacaatggtacgcgctgcagcatggtttccgcatatcccagaatgtatgtccttcaacaattgtctcccttcctctaaagatacgcagcgttgcagaattcctgaagggcttttcttgtataactcggcttcatgcataacataaagtttgctccgccttgaaatccgctcggcttcatctttatcttgagggagctcttgggaagttaaaaatcgtatgaggggctctcgccagtcagcttcaaccatagctatgtcatgagtgtccgcaacttgagtagcatctttgtgaggtactgtcggcgaataaaggtgttcgacgaaaacatcagatggcgctgcctcgcgcttggatccaaagttggcaagtctatcggcagcttcattgttgtgtcgaagaacatggctgagctcaagcccgtcgaacttatcctccagtttgcgtacctcttgtcgatatgccatcatgttgtcgtcaatgcaggaccactctttcataacttggttgacaaccagctgtgaatcacctcggacaattagacgctttatccctagggaaattgcaatccgtagcccatgaaggagcgcctcgtactcggcgacgttgtgagacgccgaaaaatgtatccaaagcacataacttagtctttctccagttggggaaatcagaaccactccagctccagtgcctgaaagtctttttgacccgtcaaaatgcatggtccagtgctctattttctccacgggggtatcctcttggcactcggtccactcggcgacaaaatcagctaacgcttgagacttgattgaagtgcggggcttgaatgatatgtccaaagacatcaactccaaagcccacttagcaatccgcccatttgcttcgcggttgtgcagtacatcgccgagtggaaatgatgtgaccaccgttaccgagtgaccttgaaagtaatgagacagcttcctggtagtaattaaaataccatataacagcttctgaacctgagggtacctcgttttggagtcggttaggacctcgctgacgaagtagattggtcgctgaactttctggacatggccttcttcctcacgctcgacaaccaagactgtgctcacgacctgggaggtggctgatacatacagcaacaacggctcctgcgggtgtggtgaagctaagaccggtggcttggtgaggagttgtttgaaatcttcgaaagccttctgtgcttcgggtccccattggaaattatctgttttcttcagtagcttgaagaagggcatcccccgctcgccaagtcttgaaacgaatcggctgagcgccgccatgcatccagtcagcttctgaacgtctttctgggtgcttggcggtttcatgttgaggatagcagtaactttctccgggttggcttggatgcccctatgagacaccataaaaccaagcagcttccctgacggtactccgaaggtgcacttttcaggattcaatttcatcctgaaagcacggatgcttgcaaaggtttcttctagatccgagatcaaatcatccttttgcttggtcttgacgactacgtcatccacataggcttcaacgttgcggccgatctgcgttgagaagcatctttggatcatacgttgataagttgctcctgcgttttttaatccaaacggcatggtgacgtagcagtatgccccaaaaggcgtgatgaatgaagtcttcaagcagtcggattccttcagtcggatctgatgataccccgagtagcaatccagaaaactgagaagttcgcagccggcggttgagtcaactacctggtcaatgcgaggcaacccgaaaggatcttttgggaaagatttgttaaggtcagtgtaatcgacacacatgcgccattgccctgtctttttccgaaccaggactgggttagccagccagtcgggatgaaggacttctttgatgaagcctgctgctaacagcttggtcaattcctccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcggaaggatctaagggaatctttttagtctcggcttcggtttccccactttttgaaatcttggcagctggcacttctccttcgctcaccgtggttgcagccagtcggatttcctctcgggcagacgccatctcgcgggtttgggccatatcacaactctccttgtcacatgtgacagcttgcttgatgtcgctccgtagggttaggactcctcggggaccaggcatcttcatcatcatgtatgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccgggagagtgatctggccgagtggagttgcggataatcctggaattactccatgaaaaggcgcattgcttggttttaactcggagcgagggatctgcatatcatccaaagtcttggcgaagaggatattgagtgcactgccaccatcaatgagggttctgcgaagcttgacattacggaccactgggtctagtaccagggggtaccgccccgggtggaccactcggtcaggatgatccgagcggtcaaacttgattgcaatctctgaccatcgaagatactggggtgtgtcgggctgaacagcattgatctcccgttcggtcagcttttgcttccttttagactcataagccatggggccgccgaaaatatgattgagctccttacggtggtcttgaaatccagccggggtgtcgccgtcgtccttcttccttgacgtgctttgttcctcgtcggagttcttccgagtagacttggtgtactgctccgcgaactgcttgtagatgaagcattctttggccacgtggttggagtttggatgatgcgggcattgggagttcatgatcttgtcgaaggtgttgacgcgcgaacgctgtcgagaagagtgagcggcggttgcaacaagttcctcaggcttgcgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccgaatttgccgaccaattcttcgtggcgaatccctttggtgaatgcggcgatgatgacgtcgtcggtgatgtcggagatcttgttacgttgttcagaaaatcgccggatgtaatctcgaagagattctccggacttctgaatgacgttgtaaagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgttgtctcctcctgctgcgcggattgcgagaccgtagacggtaagccacgattcggggttagtggtgccgtcatacttctctattccagtcggtttgaagccggctggccaatccactcgacgcaggtcgtcggtgaaggctgcaactccgtcaaggtcgtcgtcgcggcgatccggcgagtgatgatagcctcgagctgctcggcgctgcgtgattgtgtcgcgaagatcgatggggcggcgacgaggtggtgagcgaggccgttccactcggcgctccctatgaagttcgggaggcgagtgaacagaccgctcgtcgtggcccctgctcctgcgattggatcctgctccagtaatgctgaggcttggatgacggtagtcatgagatcggaagtgggggacccggctgccagtcggcgtgtggacgctttcggagttaactgggaccgtcgccgcaatcatggtcttcgtctggttcaagatgttgacgacgtggtcggattgattgagctcgttttggttgaggagggtgtcgagaagggtgatcgcggcaaccgcattctgttgaggggtgcggaaaaccggtgtcccttcgacatcttgctggccgatgagatcacgcgctcggcgccctgcttccaaagctcgttgacgtcgatcctcagcctccttcgcggtccgctcacggtcctgctgctcacgccgtagccgttcttgttcttgcgcttgatgctcctcctccagtcggcgacgttcttcgttctccctggcttggcgttgctcctccgtctcattattggccatgaaaacgccaaagtagagaggggtgtagttgtcatctaggcttccgtcgaagtcgtcgaagtcgtcgaagtcgttgtagcgagaactaaattcgtcgtactccacgatgtcagtaggacgtgagtcgacggtgggagagctgttgtagtcatccagctgatccgtcgaaaccgtgccgagtggttggaggatgacgccgacttccctgaagctaggcgaaatcggtgttgaagccgacttccgcctaggcctacgggatgaaggcgctgtcgtggtgaagacggccgctaaatcgtcggggagcttcatcaggaccggtgggtaagccccatcatcctgatctggtatcgttggagaagatgcgatctcggccgagtggtttgaagccgactcggttgaggtggtcttgaaatagctttcagccgcgttcgggaatccaaacgggaccgaaagccggttctctcccgactggtctgattccgagtcgaggagagaaatcttgccgaagttgttggtgatgaagtcgaggctgccgaaccgaaacgtctgcccgggtgggaagacgaggtcgtcgatgccggagatggaacccattgcactgatcggcgaaaaagcttgacgctacccctacctggcgcgccaactgtcgaaactagatttcggcaataataaaagggggtggctatcaagctaggaaagtgtatgggtttggaaacaaaggatttatacaggttcaggccttcttataaaagaagtaataccctactcctgtccggggatgaatccgccgagtgtattattgattgtatgattcgggaaaaaatcagcatatgcccctagaggcgcccggaccccccttatatatgggaaggagtccggattacaaaagataatctatattcctaacggaatatgaagatacagataaaatacagtcgtaaccgactaagtctctgggtgtttccttgatacacaagttaagaaacaaacccgagatacagataagatattctatctacattaggtatcctgtacccagttcgaataccatcgccgtgtagatatgggatacccataatctccacactatcatacaggaccgcggcataggcggctccctcatccgtctcatcttccatgattgttttgtcagggtatattttgtttcttcctccgtttaataatgtaagtcattctatcatttctcacattcatattaatgttaatgaatctagatatatacatttcctatctagattcattaacatcaatatgaatatgggaaatgatagaatgacttacattgtgtaacggagtgagtacatatcggtacttcatctatttcatattataaattgtttcgggttttaaatggatttatgagtgaattcatttatattacctctatttctcattataagtcattctattttttttcctagtcaaactttcaatttatagaaaaatatagtaactttttcagcacaaagaaaatattatattatcaaaatgtattaaatgttaatcttaatgatattaatttggtgttgtaaatgttgctaaaatttttcataaacttaatcaaacttaaaaaggtttgaaaaaaaattaaaatgagttataatactctctccatcatattccaaatctaaaaaatttacttttgataggcatatttcaatccaaccacctattcttttaatgactttcttggatttcatgggggtggctaattggcgcgcgcccgcctgttggccccggcccggaagcccatcaggcttctttttttcttttttttcgcaagatttttttgcgatttttttgcctttttcttttatcttttttttcgcttttgtcttattacttttttaatctttagcacacatattttttcaaaaaatgttttgagttgaaaatttttaaatctttaacttgaaaattttaaattttgatttgaaagttatcaaatcttaagttgaaagttttcgaatctgagttgaaagtttttaatctcaagttgaaaacttttaaatctgagttgaaagttttcaaatcagagttgaaagttttcaagtcgaagttgaaagttttcaaatcagagttgaaagttttcaaatctgggttgaaaatttttcaaatttaagatgaaaagttgaaagttccaaaatttgactttaaaaaatttaaattttgagttaaaagtttttaaatctgggttgaaaattttcaaatctagattgaaagtttcaaattttgagtggaaagtttttaaatttgagatgaaagttttcaaatatggattgaaaacgtttcaaatttgaattgaaagtattcaaatatcagttaaaagtttaaaattttgagttcaaagtaataacacaaaaatagaaaataactaaaaaaacaaaacgtgaaaaaaaagggaaaaagatgtgggcctaacagaaaaaacacaaacgacgagtcctttctcaataaaaaaagtgcgcgctatttgcttaactcgcgcagcttttccggaatttaatgcgtgactctccattcttccacgcaatattggctatataggcatcgagaaatgtaaatatattaataaatcgcttgtttacgagaaataactagtagcatatttaaatggatgataagtaaaattacttatctttgatcggtgtattaagataaaatataactataaaaagtaatgaagggagtacgaaacagaggaccaaaacaacttatatagtgaaaaggagtagtagttttgaagcactaaggaggtactagtagctttgaagcacttgggactaatgagtggttgcacaatgcatgcatgcatgcatgagtattgcagggttgcgatggttccgtcctccttaacgcgtccgacgagaaccctcgtcctgagacggcagcgccggtgagcatcgggctggaaggattcgacatcctggaggagatcaaggccgatctcgagaggaggtgccccggcgtggtctcctgcgccgacatcctcatcttcgccgcccgcgacgccagcagcatcctcagcaacggccgcgtccgcttcgacgtccccgcgggccgcctcgacggcgtcgtctcctccgcctacgaggcccaggcggagctcccggatcccaccttcaccatccggcagctcatcgacaacttcgcccgcaagaacttcaccgtcgaggagctcgtcgtcctctccggcgcgcactccgtcggcgacggccactgctcctccttcaccgcccgcctcgccgcgccgcccgaccagatcaccccgtcctaccgcaacctgctcaactacaggtgctcccgcggcggcggcgccgaccctgcggtggtgaacaacgcccgcgacgaggacctcgccaccgtggcgaggttcatgccggcgttcgtcggcaagctgcggccggtcagcgccctggacaacacctactaccgcaacaacctcgacaaggtggtcaacttcaactcggactggcagctgctgacgcaggacgaggcgcgcggccacgtccgcgagtacgccgacaacgccgccctctgggaccacgacttcgccgcctcgctgctcaagctcagcaagctgcccatgccggtggggagcaagggggagatcaggaacaagtgcggcgccatcaaccacagcaagagctaattcggccacttatgcagggggttacgtacatgcatgcagacgatgtggtcgtagccatatgttttcttgttatatctcatcgttctaaaatacagaaaaccttgtactcgaaaaaaaaagactactccagtataatataaagtatttgtatttgtggttacccatatatttacctgttatgaattgttactaccttcgtccctgattttgcatctgttagtgcatagactaaatcccatacatatttagtactcgtggattgtcatgtaactgggctgaatcggtatacatattgagcccatggctagctaggctcaatccgctgcgataagccaatcattcaagccgttacaaaaggagcagatccaacagatgggaggatcgaacaaaatagatgaaacctgagttcttccttccgatgctctctcttcttcaacctctgtatctctcttctcttcaatccctggctatctcttcttctccaatctactgctaattctcagtcttgattccatttctcccatttgtatccccaaatactcgtgtatcaagtgttggaggaagaattgtgtgcttgtgctggaattcactaaatcacatagagtgggttcgtaacaatatggtattaaagccaacaatccatgggttccaagccaggagatgagatggatgacatacgtggcagccgcgacttccatagactggatctaagaatttggggtggttgcacttgaggcgtctaagaacacacatgaacatctaagaacacaagaacacaacatgaatatctaagaacacacatgaacatcaagaacacaagatgaacacacataaacaaaccagcatctatagtatagttgtcggacttttttcaaaatcggcacttataaatacttaaaggtgccaatttttccctttagcgccccccgcgggcgctccggtgggtgggaaaagcataataggtgccggttttagttattccggcacctataatactgacttttatgtgtctttttgtagtactgatttgcagttgacatgattatcatcgaacacttatgggagaaaaaaataaatttgttctagccaaatcaatagagagtgcagatgagaacttttgaaaaatggggtccaaaaacatgttgaaacacatttgtttagatccatgcatgtacatggaaattttcggggttgctagtctattggtcgctcgctttgcacctgccaattgataggcccagtagttgacgtgatctgacacacggctgggatgaacgtaggttagctgcttcccaaccagtcaacaggacctcttaaacaaaagggaagtcaaataagaaaatgtttaattaatctagcctggttcggatgctagataacagtaatggagtgattaaatattgatgagaccactataatctcgattatatttgagctagcgaacatgcctgctatagttccctcaaaatcctaaagatatgtatggcgttagcgtcctttccagtggatacgcttaacacaagcttttgacgtgaaagttaattaatttactactgtacatggaaagaaattctacaaatacatcgctcttaggtaacagcatttgaattgaaataaagatacatgttgtcaaatcgaccaaataaactgacctccttcataggggcggaactagccaccgggcggctgcttgggctcgttagcgaaaactacacaaaattttaatattaatgagtaaatagatgatgaaatttctatagcaaatatcagttatattgaaatttgtctgggctcaaaaatctttctagctccgccatgcatccttccatcaaatactgtgcttcggttgacacatgcatgatgcatctggacggccaattaatttactctatatagctccagccgaatttaaattaagttcaccgtcacaacgccaggtatggatcgatgtcaacgcctacacgttttatcagttactagctgttttgctccccatgttgttagacaacaagaactggcaaataactattctgatgattgctctccaaatattcctcaaatctcttatttaatcaatctcctcattcaaaaggagtagctcaattatcaatgatcaatttgcacatccatttgtacctataaatacatcgaatgtttgcctgtcacatcatcaaacatcaaccaatcctttgaggtagcgatcactacacatatattcattcggtttcaggcgtttctttgctgtctcctagtgaacaaccttgtcagaattcagaatgttcagcagggggatgaagctaattctcatggtagccttccaggctatgagcctcatctccatatcaactgcaagtctgcagtacaatttctacggctcgtcgtgcccaaatgccgagcagacgatcagcaatgtcgtctacggcttgatcgatgctgacccttccatggccccggcgctgctgcgtttgcatttccatgattgctttgtcatggtaatgtaattgctaaccacaagttaatttagtttttcaactatgaattgatagcagttttaatttctcacaagatatattactgcaagcaaagcttagatattgatggttaattacttcattttgtccccaaaaaaaatgtaaacgaagtttttttttttttgttttttgatcatgcagggttgtgatgcgtccatccttcttgatcccacgaaggcaaacggctcgccggagaagacagcgatcccgctccgcgggtacgacgccgtgaacaagatcaaggcggccgtcgaggccgtctgccccggcaaggtctcctgcgccgacatcctcgccttcgccgcccgcgactcggtggccaagtccggcggcttcgtctacccggtccccgccggcagccgcgacggcaacgtgtcgtccgccttctccgtcttctccagcatcccgtcgccgttcttggacgccggggagctcgtccagagcttcgccgccaaggggctcaccgtcgacgacctggtggcgctctcgggtgcgcactccatcggcaccgcgcactgctccgggttcaagaaccggctgtacccgacggtggacgcgtccctggacgcgagctacgcggcggcgctgagggcggcgtgccctgacggcagcgccgccgacgacggcgtggtgaacaacagccccgtgtcgccggcgacgctgggcaaccagtacttcaagaacgcgctcgccgggcgggtgctgttcacgtcggacgcggcgctgctgaccggccagaacgacacggcggagaaggtcagggagaacgccggcgacctgaccgcgtggatggcgcggtttgcggcgtcgatggtgaagatgggcggcatcgaggtgctcaccggggcgcggggggaggtcaggaggttctgcaacgtcaccaacagctaaaaagctatactggctggctcgagtgaagaacgcacttgtgccattggtgtgcgtgccgtttttgcttagtggcaagtttgcaccttgtgctaattaaacgtttttgttctccaatctacaccatgcacacacaccattcatgttgcaattttttattgccaccttgttctataagaggaggaaaattaaccaccttaatttgttattcactctggttatagtattttggttgtatggctcatgtaaaagatttggggcttttttttttagaattacacagtgcaatgtagatactcacaacgcacacgcactcacatctatgaatacacgcacgcaaaccctacccctataagcatcttcgaaaactgggccggcaaatccttgagattgacgaagtcaccataggcacctcgttgtcgacggatatgtcgcctaccactaaaagcacaacgccgttatatcttagaaaatccgctcccatggggagtcgaacccaagacctcaggtgctactgaggctcttgtaaccactaagcgaaaacgccgttattattattatttttggagaatttgtgatttggatctgagatttgtgtgtgatgtgaatatgtgatgcatttgtgatgaattttgtagaagttgtgatgtaattttttttaagattttatgatgtatttggagatgatcgatttgaggatttggaggcaattcggggatgattgatttgggatttttgggatgggatggagtgaaatcaatatattaaaaacaacaatgaagaaaagaaaagaataaaggagcaactgaatctaacctctttagtcccggttggtaacaccaatcgggactaaagatagccgggactaaagatagcgatctttagtcccggattcgtagtcccggttaaaaaatcaggtctacaaaaggttacgaatcaggactaaaaagcacttctctactagtgtgcaaatgtgtgagcccccattgaccaagtgtaggagcaaaccctctaaaagtgtccagcctctctggccttgatcagtcaattgatcgacatcggtttgtcgtttcgcaaatggtagaaatgatgatgggtttttgatactgaattgagtctctgagcgaattctgatgagtaggaaaagcatcttcataatgaaggtcctaaatctcgtatgtgaattcctgttgataaagaaaatgatggttcacttggaactatacttgtgcaaaagaatcctattctttttttttggtgcccttatggtgtatatgttgtgatagtaaacaaagaaaggaggtgttttgttttcggaaatggtggaaaaggaacttttgctcatctcaagttccctttctagctggccattttgcggagggggaaaaaccaactttccctgtaaaacagtgtgctttgatccttctatgttattcgttttgttcgtgaaattctttcgaggttgctgacatttttgtgttttccacatggaacaaagatctgccaccaagaatacagcaggccaacatgcatctttctgggtgttcaagcaggattgtccttgttgacatcagaattgacgatggtattttcagcctcttctcttttcgatatttaatatgagatctgagcctgagaaatttcagccataaatgctgcatgttttgcacatgctttgttctgattgtaatatctggcaatttcagatttttgggatagcacttggattcaatcttctatttgaatatgatgatctcatcactgggatatgttttgcaaccgttgttcctaatctgctaccatatgctatatcacacctggtaaagaagaagattatctcatatagaaaacttcaaacctatattgtaatctgatttggagttaatatttgtcaattactttcatatacctattctagggaaagaagatggtggggacattaaatgcttgcattgcaggctttgcgcttctttgctacgttcttggtttattggtcagccaaccacaaattcctctgacaacgaatgtaattttccccaagctcagtggtgaaagtgcttattctctgatggctcttcttggtgcaaacgtaatggcacacaacttttacatccattcatcagttgttcaggtaaattatgatgcttctttgtgcccattacatagttagaattatatttgatttgatgcatttggggtgaggggggtttgggcatttggtggacaatggtcaatggcatgccacaattatttacaccacacaatgacacatgttgctagctttgctagtgtttcgaacagttcagaaattccaaactgatagcaagggtcactatattagactagttataccagtctaatatcggatgtagtggagaatgtttttgttctaatagatccagtggtttgtgggtacgctgtatccaactgaaaaagatatggtttgtcctatttcaattgtttgcgcagagttgaagtgatgttcattgacttaatttcaaaacaccaagatacatcttctagcgaattgcagcattatgttaggcatgctcatcgttagttagtgaaagaatttgttctcacttaatccagtttggagcttaactaacaattatggccaatgaaactatagtatttaataagctattgtgccacatgcggaatactatttctgattgacaagcacaaatctagaatgttccttgagtaaatgtttgttccctaaaactgtggcctatttctatttgttttcttttttactttcgcgtgtacatattttggttcactaatggtaaatgtctagtgttcatgaggtctttgccttaggtttgctagtatatgatatatatattacctaaagtgtataaaaatggatagcattagtgagtttgacagcaaaaccagctacatttcattgccctttgtgtcttatgcttttggttgtctttttttttcagcttgtatccatgtttgctaatcaaataatctcttttcagggtcagaaaagatctgcctttgccgttggtgccttatttcatgatcacttgttttcagtattatttatttttactggaatttttctggtgaatcatgttctaatgaactctgcagcagctgattccactaacacccttcttctcaccttccaagatgttgtagaactaatgaaccaggttagtactatagttcctactacttcaccctgtgatatgctaagctggtgctgaagaaatcttgtttcagtagcaatcctaaagtgatatacactacctaacatttatcattttgcagatatttgtaaaccctatggctccaactatatttctagtggttcttctcttctctagccacatcatctcgttgacatctgctattggtagccaagtgatttcgcagcatttgtttggcattaatcttcctctctctggacatcatctgatactgaaggcttttgccatagttcctgctctgtactgtgctaaggttgcaggtgctgaaggaatataccaattactgataatctgccagattatccaggccatgctccttccatcatcagtcgtgccactcttccgtgttgcctcatcaagattgataatgggtgcccacagagtgtctttgcatctggagatattaacatttcttgcatttctcctcatgctgttttcgaatatcatctttatggcagaaatgctgtttggtgacagtggttggctgaacactctgaaagggaatactggaagccctgtggtgtttccatctacggttctcatcacggtggcttgtgtctctgttgcattttcactctacatggctgttacaccactgaaatcaggaagccatgaagctgaattgcagcaggaatggtctgtgccttctcagaaagagctcttgaatactactcaagacagagaagagacttgtgcgggcaatgttacctatgaggaagatcagagatctgatgttgtcccttctcctaggattcagcctgtggattgtctgaaatcagctctggactacattgatagttcggacacagctatagaatctgatcatgattctcaacattccactgctcatacatctaccgctcctgaatcctgtcactctccatcattcattcctgaagagtcaaaatcagttgttgctgttgactggccagagcctctggagccaatttctaatgctattgtggctgaggaaagtacagtagagagtgtggactccaagagcacaggcgaaagggatattgaagtagaaccagctcttttgatggacaatgataaggaggctccaaatattctagagtctgacaacaagtcacttggaggcaataatccttcctgtgcatcggatgatggcccaccatctcttaccttcagcagggggaaaggctcagatgcaggcaatggcagcgggagtctctcgaggttatctggtttgggccgtgcagcaaggaggcaactagcagccatacttgatgagttctgggggcatctctttgattaccatgggaaactcactcaagaagctagctctaaaaggtttgacatcttgcttgggctagacgtaagaacacctagctcaactgtaagagcagacagtcaagctaatgaaatcccgaagagtcccatggtacgagacaatttacaagggtctgccttcttgggaagttcaagggatctgatgtctactaagaatgagatgtcgaatttggatctgacatatgggcttcagatgggcaataacattgggtcatcagcctggtctcagggcatgcagttaccaagtacccaactgcagagttcaagcaacagcttactcgatcaaggtgcaagattaaattcaaattttagcacgccatcatacgcagacaacaaccaattctaccaacctgcaacgattcatgggtatcagctcgcatcatacctaaaacagatgaatgctaatcgaaatccttactctagcatgccattggacccacagcgacttccaaaatcttctgcatcggctgtgccaacctatgtcgattctgtcatgcatgctcgtaaccagaacttgcttgcttcattgggagctactccttcacagatcgcagcaacatcccggataggtactatgatggcagaaagatcctattatgtcccttccactcttgacgggaatgaaaatgctggttcatcagcttactcaaagaagtaccacagctcaccagacatatctgcactgattgctgcaagcaggagtgctctgttgaatgaatcaaagttgggtggtggtaccattggatcccagtcgtaccttagcaggcttgcatcggaaagatctcagtatacaaactcggtggccaggcctgcagctcccttggcgtttgatgagctctctccacctaagctcccaggggatatcttctcaatgcaacaaagcccaaacccaagtgcaagatccctttgggctaagcaaccttttgagcagctgtttggtgtgtcgagtgcggagctcactaaaagcgagttcaaccctgcaggcagatcgggtggcatgaccaaggatgatttctcttacaaggagtctgaggcgaagcttcttcagtctcttagattctgcatctcgaagctcctgaagctagaaggatcagggtggctgttcaagcaaaatggtggcagcgacgaagatctgattgatcaagttgctgcggtagagaagctattgcaacaaggaaccagtgacaaccaactgctgcttggtgatactcagcaaccaccatgtgataaggcagacatccagtacatgcgcgtactgcctaactgcggagacgactgcatctggcgcgcctccctcgttgtcagcttcggtgtctggtgcatccgccgggtgctagacctgtctctggtggaaagcaggccagaactttggggcaagtatacctatgttctcaaccgtcttcaggtgagctatttcagtcctgaactagtctgaatttgagtgttgtttttcagtgcccaagacttgactgcaaacctgaaactgctcattttcaacgtacaagactaactctgtcaatcatttttttcgctcaaatgtaatgcagggcatcctggatcctgcattctccaagcctcggagtgctctcagcgcgtgtgcgtgccttcacagagatatccgggtgctcaacagcctgcgccacagtagcctggtagcaacaaactccattccaaggcaaatccgaggttccttcaccaccgcatctgtggtcctggagatgatcaaggatgtggagaccgcagtctcagggcgcaagggcaggagtggcaccgcagctggggatgtcgccttccccaaggggaaggagaacctggcctccgtgctgaagcgatacaagcggaggctctcgagcaagggacaacaataataaggcatctgggcagcgtgatcctgtcgcgttttagggggactttgaccattgttcttcaaggatggcagccagccatggtggcttgccctccctgagccctggattttttcgttgcacaacgtttgcagggacctgaggaattggccaacacttctggtcccttccatcatatttcgtttttttttgtttctttcttgtttttttttttttttttgcatgtgatgtgttgtataatggtaactgttcatgtgccagaagaacaaccaccaaaatgtacaacagatgtagtcagctgatgcaccattgtaaagtttagtctctgcattttaaccttttttttgggggtcattgacaaactgaatgaatgccctgtgtaatctctcttcagagaggatgccaagactgagaaaaagcttttgccagatttccagattccttgtgttcatctaatatctgtcatgtctctcacattttctccagcttatgatctttttgtctcgttggcatttgatagcgtgtgctggagatgtctaccgtatatgtggattactgtattaagcttctgggaccggtgtatatatataatttgtatggatagagataaagaaatactaactcgatatggattagttatatcctaatgtttctctaaacaccaggcgtagtggcactgtactgcaacctcacccaagaacatgtttttggggttcagacttgagagtatccattgctgaatttgcctcaccgcaagtttagtcttgcatttcacaaaattgcaaggatagctaacaattttatcacaaaaccataaactttgtggccgtgcaattggatatgctctctttgctcagaagcttttgaggatactgatcacctgttcagaaactgtgcctttggacttgatttgtaccgggaaacttgacaacccggccgacacagtattctcgattagatgttgggaaaacaagatagccaaaacaaatacggcacaaaaggcaaaggagacctctgggaatactaatcaggagagagaaacttaggtggtgtttgaatcttcctttaagatgaagattaagtgtttcacgtaaaacgaggtgataatattatgtgattaattaagttctaatcattacaaacttgaaaaatatattaatttgatattttagaacaacttttatatagaaagtgttcacatgaaactaccgtttagcagtttagaaaagcgtgccacgagtatccaaaagcttatcaattttgttggagaaaagaatagggttagtcttccaaggttcttttattcggcagagctcccgctgtcggttctttaaagaaaaactcgtagattaggccacccatcaaatataaatgtaatactccattacacaaatttaattttacataagggttcaaaattacattatagtttatttacactacgaattacatctgggtaaatttttagaaatttggaagcaaaaccgtgaacacgtcatcaaaaactggatgtgggctccacgagttcagaggatgttccgaacccgttttgatcgcccacggcccgccgccccgccgtggagccgatccccgccaccgccggcgagcagctgttccggacggcgtcctgctgctccctgcgccgcccccatcccctcggcctccgccgagctcgttcctgcgcggtgagcatccttgccgacgcaccagaaccctcttttttttctctctctctctcgttgtacccacacacctctactcgaatttgctctatcttctcttgtagatctgaaagctaggttttcttttttacttgtcttaacctttagttacataacaggttttttcccacatcaggtccacatcgatctataatagccaagagcccaagacctgcagggcttcccgggggtggtgcatcttctcaggcggaggggcctccttggattccttgaagtttatggcgccggcgaccaaactcatcaccgtgtgtgcaccggcaaatatgacgaacaggtccccctgtacatgtgcgcggtcaccttgagttggtcacccctgtcaaaacatagtaactttgtcaaaacctaacctaaacaaacatgtttttttcacaaaattcttcattcttacctcatgtctgattttaacaaatctagcctgtggtttgccttcagatgagcaatacgccatccatgcatacttcctgccgccctctcctgtttcctaatgcgctgctcaaggcgcctcatcataaccttttgcaccagaaaagcatcaaaatgttgcttgtcagcacaaaacaataaatccttctcaagtctcaacgagggggtaaaacttccagcatcacaggtagcttctccaggtcactcctctctcatccagttaggaatcgtggatgcaaatgcagaatcgatttcatccgtccccgaaaagaaatacaagggattttggcaatgcgaatgcagagccaaactccctcatatttggatttggggacagaggtagcagataggcaaggcaattagagcagtaattttaccctggtagctcttgtggagaaatagcggggctgggcgagtgcggaggaagcccatggtggggtggaggtggcggcggactgaacaagaaacaacaagttaggcgcatttaacggaggaatagtgcagtagcaataactaggaagcttgtgcaacaaaataagcaagcacacgcgacaacaaaatgatccaatccaattacttagaatcaactcaactcaatagtgcagtagtagcaaatcagaaaacaacttcaactcggactggcagctgctgacgcaggacgaggcgcgcggccacgtccgcgagtacgccgacaacgccgccctctgggaccacgacttcgccgcctcgctgctcaagctcagcaagctgcccatgccggtggggagcaagggggagatcaggaacaagtgcggcgccatcaaccacagcaagagctaattcggccacttatgcagggggttacgtacatgcatgcagacgatgtggtcgtagccatatgttttcttgttatatctcatcgttctaaaatacagaaaaccttgtactcgaaaaaaacatcatatagtactatcaaatcagtctagatttatactactagatagctagtgtctaatcgagtactaggagtatattttaaaacaagagtagtttgttattacttggtactagcacgtcagtgaatgtacgtgcacaagaaatcctcgtcgataatgaaaactagcatggtattggagaatccatctcttaaacccatcaagtcgaaatcctgaagcaccaaaatccccctacttgatacgcaactatcgacgtttgatgtcgcaattctggtatttgcatagtatggggatcgtcggtgctaggatatacgcgagactgaggtgaaagagacggagacaaggatttttatacaggttcgggcccctgagttgtcaggtaataaccctacatcctgttggccggagccggtattgcttttattcaccataatcacaccagtacaatatgtggggtagcctatttaactgttgtcgacatgtcggtctgaaggtctgactcgtagtcgacaacagggtagccttcctcctcgaatccgtgtccggcgagatcagagatagcgctttcgtctctcctgacggtatccggagacaccgtaggggaatagccatgcctatccctgaagtcgatatccggcggcttgtcttggcatatgttggcttgtatgttgtggcttctgttgttccgtatattgtggtggttgttgattgaggtggtcgtctgtgtcgatcgtggtgactgtgttgatcctgtcatggtgggtgtcccactgtcctcctaggggggcttgtatttatacctataggtgtcccattgtccaagtagaactagggaaaccaatatggatacaatccgagtagtccttgtcgtttccatgtaaaactctggttgtctttccttatccggaactccctccataactgaagttagtttctgtataagacatggtatgtggtgggtcctgccgagatttagtcaactactattaggtatgtggtatccataaccctgacagtagcccccgacttcaatgcaaatgaacgaattcatattctcaaccgcagaccctggagtaactgttgtcgtgctcacgttaccgttctcggtgagtttagagataacgttagactttctttatcagcctcgtgcgggcaccaaaagggtttgtctaagtcaatctctgatgtcaaccaaggaagtacagagcgtacgactaagtctcccgtcttgctgtaatcgagaatttggattgaagtcaagaaattctatctcggctggtacaccatctcttcattccgtattccttgtcgagatccagcaaccgttctcgagcgatcgagaaggcgtagagtctgcgacggagccttgtcaacatttgtcgtactcgccatagtcgatcttggtgtagaaccatagagacatagagtcttcgtcaatgtcgaatagaattttcctgaaatcaatactcagaaaagaatattagatagaaatagcccccgagcgaatgcccaaagggtgataatgttataatatgtatggtaaattgaaaatgaattaaatttaccgaccaatgttttgtgtatgagcgtcttctctcttaccgacttcgatcagtcagtttgtagagtcatacactctccctagcccccagccttgtcatcggagaatcgttctcggaggataaggctcttggacccttgacctgccttggttgaacaaacactgatcctagcccccagccgtgaagttggaaagctcagtttccgattacacggcttggttaatacgcacggcgagaactcttacacgaccagatcttacatggtcttttgtctctacaggatccgacaaggccttatcggctctgggcgtccccagccgaagttcccttaggttcctcggaggccttgtcaagacggcgtaatgggacagtaggataggtttcaacgctaggtgtcgtcgtggtaagggatctctgggtaaaacacttggcgatattgtataccagctatcaactttgttgaaatagaggtagtaggagagtcgttacaccgctggtcgagaaccaggcagtagtcataactcgaccacttaaagtggaaatagtgggagaaacgctacatcgctggtcgagaaccaggcagtagtcgtatctcgaccacttaaagtggaaatagtgggagaaacgctacatcgctggtcgaggaccaggcagtagttgtaactcgaccaattaaagtggaagtagtgggagagacgctacagcgctggtcgaggaccaggcagtagtcgtaactcgaccacttaaagtggaaatagtgggagaaacgctacatcgctggtcgaggaccaggcagtagtcgtaactcgaccacttaaagtggaagtagtgggagaaacgctacatcgctggtcgaggaccaggcagtagtcgtcactcaaccacttaaagtggaagtggtgggagaaacgctacatcgctggtcgaggaccaggcagtagtcgtcactcgaccacttaaagtggaagtggtgggagaaacgctacatcgctggtcgaggaccaggcagtagtcgtaactcgaccactagaagcaaatgtacgagagattactacgatcaactggttgagaaccggtgagtaggtgtccctcgatcatttggagtcgtggtacgaggaccactacgctgccggtcgaagaccagtcgtagctgttcctcaaccatctgaagtcatggtgcgaggaccgctacgatgccgtagtcatacctcgaccatctgaagttaaggtgcgaaagattgctacgtactggtgcgagaaccagcgtgcgagcagaattatctctcgaacaccaatggaagttgcggtgtgagagattgctacgtattggtgcgagaaccagtgagcgagcagaattacctctcgaacaccaatggaagttgcggtgtgagagattgctacgtactggtgcgataaccagtgagcgagcaaaattatctctcgaacaccaatggaagctgcggtgtgagagattgctacgtactggtgcgagaaccagtgagcgagcagaattatctctcgaacaccagtggaagtgctagagttggtttattgcaagtgtatctcatgtggccagcatgactcacgtacccaacttatagcatatccggatgtccgttcgcaatcatgtcgggtgatcaagccgacgacgttcgcaaggaattatccgttaacaaccttttctcaagtagtccagccatggccggtgctatgagataggtcgtcggtctttgttggtaggttgggtgcgataactccgcatttgtcgagaatgttctcgataatggagtatattcgaccataacctactcgagtgctcaattgttcctgaaaaatattttctagaaggcaagatatatagcagataatatcgagtatgtactcaaagaactgcatggatcttctagtattatcaggatacaataagcagatgtaaatatcagggcattatgtaaaccgtaaacaagcatgatttatacataagagaacggagtgagcccccagcgttagaccgtagttggtctatcgtcggaagtactcgcacaacggatgttgtataagaaacatgctctaggtaaacataataaattgctgatatgataatgttgtatcatctgaataggtacgataaattgcatataaaatattacgtacctttgtagatacatgccggatgtatctacgaaattagtagatcaatttgaaaaaccaatctaccaattaccttattgcgtactcgttcgacatcatatgatctgacatcttttggtacggcgcggagcttgaggcttgggtgatctcgatagaccaagttgtcgatgacgatgatggttctgatcttgtcggaagacatgttccggtcgggttagatctccacagccgaagtcgtcgagtagtttgctattggagaatccatctcttaaacccatctcgtcgaaatcctgaagcaccaaaatccctctacctggcgcgccactgtcgacgtttgatgtcgcaattctggtatttgcatagtatggggatcatcggtgctagaatatacgcgagactgaggtgaaagagacggagacaaggatttttatacaggttcgggcccctgagttgtcaggtaataaccctacatcctgttggccggagccggtattgcttttattcaccataatcacaccagtacaatatgtggggtagcctatctaactgttgtcgacatgtcggtctgaaggtctgactcgtagtcgacaacagggtagccttcctcctcgaatctgtgtccggcgagatcagagatagcgctttcgtctctcctgacggtatccggagacaccgtaggggaatagccatgctatccctgaagtcgatatccggcggcttgtcttagcatgtgttggcttgtatgttgtggcttctgttgttccgtatattgtggtggttgttgattgaggtggtcgtctgtgtcgatcgtggtgactgtgttgatcctgtcatggtgggtgtccccgtgtcctcctaggggggcttgtatttatacccataggtgtcccattgtccaagtagaagtagggaaaccaatatggatacaatccgagtagtccttgtcgtttccatgtaaaacttttgttgtctttccttatccggaactctctccataactgaagtcagttttcgtataagacatggtatgtggtgggtcctgccgagatttagtcaactactattaggtatgtggtatccataaccctgacaatagtatgttttctcattatattattcaaatatattaaaatgacaacataattttaaattttgcaataactttacaaaactactaatatgtaatattcatattgtattttatatacgtgttagttattaattatttttaatatcaaattttagttatttgtaaattatatatattgactcattttttaatattttttttaatattgactctatgctcttcttccaatattatttatttttatttcagaatttttattatttctaattgtatttctatgtggactctaaactaatttttaattttgaatttcagttacttctaaattgtattcctatattgactttaaactcttcttcaaatgtttttcttaattttgaattttagttatttgtaaaatgtatttttatacggactctaaactctacttttaattttattatgtttattccaaattttagttagttttaaattcctatatggactctatactctacttctaatattccttattttttaattccaaatttctatttttttcttaattgtatttatatatagactctatactctacttctaatattccttatttttaattccaaatttctattatttactaattgtatttctatatagactatactctacttctaatatttcttatttttaattctgaatttcagttatttcctaattgtatttctatatggactctatactctacttctaatattccttatttttaattctgaattgctgctattccctaattgtatttctatatgtactctatactctagttctaatattcttatttttaattccgaatttcagttattttctaattgtatttctatatggactctagtctcctcttctaatattccttattttttaattccgaatttcaactatttttaaattgtatttctatatggactctgccttttctttttctccgattaatgtgagaatttctaggccatgaaagcgaacgtggagacttccttttctattcctttaataatataatagaagatataagtaacaaaaaaaatacaatttgacatgaattatatcaaaacaattagtatttgtgatcaaacgggcatgcatgtggggtcagcccaccctagcccatggcttgatgggtacatcctgattattatgcactgctcgacaaggatatgccgtggcggctcacgtggtaaggccagaaccaagatatggccgaagaggagccaggacgtgcacgtgtgacccatgaaatatttttttcatgaaattgcacgttagtatattagaaaaaaaatagagttttagttatacagcgtaatcgaccaaactggtcgctgtcggttacaaggaaaaagattgcggaagggaaaagagtcaaaactagaagttgttgctcgtatctagcggcactactacgaaaaccatctttcgttgcggccattttgggttttcgctggtggtttttggtaccgtcacaaagcaaaggccagtgaagatcaagatcttcgctagcggttatcggccgccagtgataattgatttttgctggcggttgtgttatactggccgccagcgataaacgattttcgctggcggttgagttataccaaccgcctgtgaaaatagtggcccaggttaaaaaaaaatgacaaagcaacactgctccgttcgcctccgtcaacaccggttcaaattattcccaaatccactcctcgattcacaaattcacataaatttacacgaacaatttataataaaaaatttccattcacagtcaaaattttccattcacaatccacagaaatccacaaaaatgcacacaaatccacacaaatctacagaaatctgagcaccaccgcccgtgacctggcggcgtcggcttcacgctccccacggcgcagcgtcgatcgtgacgaggtcaaggccgacggtcgtgctccaccgcccgaggccccgcggccgtgcgccccgcgccgccgccggggcggatctgtccttcccggcggcagcctcctcccctcggacagatctaggagagggtagaggaggggatgggagggcccggcaccaccgcgtcataggtggtcatcatcgtcacagcttccgtcgtagtcgctgttgtccccgtgcacatccgcaccgcgcccctcccgcccgtcgtcggcgccgcgcccctcccagatctcggtcgtcgacaagaggtggaagctggaggagcagggaaggaggaggggagagaggtgggggaggaggaggagagggaggtggatgggtgggtggagaggaggagatagaggagagagaggcagtgggtgggtgaaaggaaaatatctcagcacgcgcgtgattttaaatgatgccaaatttttttagcgggctctgttttttcgctagcggaagtgtttagtaaccactagcgaaaaccgacgcgaaaacgtcggttttcgctggcggacatttaagagatccaccacgaaaaatagagtatgttttatggcggacgtcttaacgtggccaccagagaaaatcggttttcgctggcagtcctataccccccacccctcatgtttttgctggcgattttagcatataaccgccagtgaaaattatagtgtgacgccatgaaaaattgtttttctagtagtgcgggagggggtggcggaggagcctcctaatctcccaaaaggctcccaaacgagacaggaccagcgagagaccagagacgaacctcctagtgaatgtattggaaaaccatcgagaccggcgaaagagaaagaatcgaaaaccctagcgttccgctctttccaaagctgtaggaaaccaagaggaccagagagtcgaaggccttacgaagatgctaaggcaggcaagccctatctaccggccaccagacctgaagagaatcgctacggaggggccgagcaagcctaggcaagccaaagggagaccggatgtagtgccaaacttaacgagcgaacacacagtcgagcatgatgtggctcgctatttcatgcttctgagcgcaaaatgggcaggtcgagcgtctgtcaatgccgtgcttatgcagatgatctgccgcctagcaacgctgttggaacacgtgacccatgacatttgaaatcgaagttgggaaaaccaaaaataggaagaataagaagaataggaacaggaaaaaaaagaaagaaaataaaagatggcaaggaaaaataaggaagaaataggaagaacatgagaaaaattaggataatcattgtgaaaaaaatagatggccaacggattaggatccgctgacatgaagtcagagggacgtggtgactgatatgtgggcccaaccgctcgcgagcccacctgtcagtgaccacgtcaagggagatttcacgtcagaggatcttcttctgtggccgaccgggcggagcttgttcttggtccttgctgtgccaggtctggccatgcacgacatggccaaatgggacgtgtggaagaaatatgtgcatgcacatgatgaaacatgaatgtgtggaataaatactatgtcgttttgactgtttgttgacttttggacgagcttttcggcacctatatgaagttatgaacaatgaaacatgcagatctatagagatactagtgcatagcgtttattggatggtaattcgttgtcctaaaaataaaatggaactataccagtccaggcgaccaaacaacagtttttttacaagtgtttctgggcagtcgttcggcagtgtgacaacaatgacgaagagttgacagtcggcaatgtggcaattaacgagcaacaatctgaggcactccctccatcctaaagaaaatcaaatcatactaaaggggccgaatggcctgggccgcctatttgccaatcaaagtacacccaaggtccctcaacttgtcatcgagttacaaaatcatcccccaatcgcaaaaccaaatatatgacatccctcaacttataaaaaccattcactttaggtcattcggtggttttgaccctggttttatcctacatgagcagagtcagtgtgggacccacatgagcccacatgtcaggatgccacgtccgcaccctctctcttccccctcctctcccttcctcctctctctctctctcttactcttctcttctcttctctgggcaaaccggccagtggctgaggaggaggccgccagggcgaggcgcaagaggaggaggcgacggcggctgcgacgcgggagaaggtgagggtggcggacggtcgcgaatggcattgacggcgctgcgtcgcctccgccccgtgcgggcaggcgccgcggcattgggcacagaggcggagacagggccgggtgccgtggaggtggactcggcggacttggagccccggcctgctcttgcgccgcatcctccctctctccgtgtgctggttgtccctccctacctcctccctattcgcgtgcgctcgccgccggccggcgggcatgggagcaagcgagccgtccgtggcgtcggcagcaatggtggtgcgatgcatgaggatggggaggaccagcgtcatcgtcacgtcacgtcctcgtcggcgcgaagatgaaggagacggggaagaggaagaggtggtgcgcgtcctcctccttctcgtcgaactcgtcgcaatcgtcgttgtcattcgccgataccccgctccgcgctggcggcttcgcacgttgccactctgcccaccgtcgccccacttcgcctgcttgctctacccgccggcttcatgcggcgccgctccgcctattctgctcccctctggtcggctgctcccatgggagagagcggacagatacagagaagagaggggatgagagaggagaggatagaggaagagaggttgaaaggggaggggaagaagaggctgacgtgtggcggtgtgggacccacgtgggtagaagaaaatcgattgggattgagacagagagggggggggacctggagagacgcgcgtggtaaaggaataggttggttgtatgtacagaaagtggttggcatgctagctgtacggtggaagcaaaccattatggcttgccattgacttctttttaatttccttgagaaatagacaaaaatttaaccagatcctcctcagcaccgtagagggaaggtctcctcgccaccttgctaatgggctcgtggatctgggccgacgatggccggatccgtcatcctgcctcgtcacatggtgtcatcagggatgatggagacggcggcggtggagcgaagcagtcgtcaatgctagctacgaagaggtccatcatagataccggctacgaggtggagataaaatcagaaaaaaaaaagatgaacggattgtggatagcgcattacctggtcgtcgtagggagagaaccaccggtagcaactgcggcggtgctggcgatcaccgattagccagtcgcgacacaaggaagaggggcttgctgtggcaagagaaaagccgatccagatatttaggagaagacgataactatgcgtgatcactgttatgtggcggttttgcaatgactacttcctgaagattcgcttctctacgttctgtaacaatttaatgcgcatagagtaaaaaaataactcaagatgctgacatcgttagagtacaacaagaaactatctcactgttagtaaaaaaaattatttggactataggagtgggggcagggggcgcaggggtgggatcgagattggtcgttagtgagtaaaattttaactgcatgctataaacttggtgggggacagggttgggagcggcagtggtggggggttgagcagtgggtggggctgggggctgtatcacgtgccatttaatacgtagcaccttaaggtgccacatagtagttctatacacacacgcacacatacacacaaatttttacgtggaaaatccttacgggaaaaaaccacggacaccgactagcaatgatcgatatagagaagttgaatacaaacgcacgacacactgggttgtcgcacccttctcgtgtagcttacaagagacatgtaaaagagaaatctataagtcctagtaggaaaagacttacaatcataataagaaactaatcaagtgttttattataaaactaatccgaacatattgcatgctatttttttttttgaaaggaaagcggcaagagtattgccgaatatattagaaggagagaaaagtatggtttacacgattaatgcggaaaaacaacttagaatcatctcagaaccatagatcctggtttgagaagggaagagatacactcatgacggttggaattcaaaactgctttcttgaatatcttggatgatctggtgtgaagtcctttgcatgtccggttcttctcctctgaagatctttgcgttcctttgtagccaaatgtaccaccaagttttgacaatctgaacatattgcatgctgaaatttggatcacatatttaacaatctccatcttaagacgaattttccttgtagcataaaaatccgaaacgctcctgtccagacgcctgattgtagggaaaacaatcggattctcatgcgtctctcctcaaaccgtgtgatgttataatggatttttttactgttccaatgggtatttaatgatgtttcactaggtcattttgaaatgttacacgggatgtttttttgatgtttaaggaggtattttgtgatgtcctcggctgatgtttcactgtatcattttttaatgttgcacgtggtgttctttgaatgtttcaggaggtattttgtgatgtttcagctaatgtttcactaggtcattttgaagtgttgcacacatggtattattttgatgtttttctaggtattttgtgatgtttcactatgtcatttggaatgttgcatgtcgtgttctttggatgtttcagaaggcattttgtgatgttttagaacgtatttcactagctcattcggaatgttgcacgtgatgttatttgaatgtgttagaaggttttttgtgatgtttcacaagatacttcactagcttattcggaatgttgtacatggtgttctttggatgtttcagcatgtattttgtgatgtttcactgggtattttactagctcatttgaaattttacacgtggtattttttggacatttcagcagatgtttcactagatcatttaggatcttgcacgtattgttctttcaatatttcaatgtatattttgtattgttttagaggtcacaaatcaatgtcccacttataataaaaatgtttcaattagtaatataattacatatgttttatttctccaaaatataatcatgtgagatctctttgtaaagatttaattgcaacaaattcaatggtgcaattgaatcacaaattggataagtatttcataagaaaaaatggtttataatttgctaattaagagtatgggagaagagacaaggggatgggagaagtttgcatgtacctcacatgtggaagagaagaaatgactgcgtgcatgcatgtggaggtttcccagaagaaaagattgcatgcatgcttagggggcccaatttttttctccaaaaatcgggcacccgttccgtagtgtcctccataaaaatcttcaatctccaaacaacatcatgtagtaccctcgatagaaaagagatgaaccatacttcaaacttaccattggtgtgaacttagcatagacacgaaacatgatgcacaaacttcaaactcgctattggaataaaatcctgaatatgctgccataaatttatgtaaccctagtagaaatgcaaaactctagtgcacaagacaaagtacttggatctcccaataacctactggtatgttgggtatgatggtagcaaaatttgtcagaaaattggatcaccttgtgatctagacaggagtgaggctccctctcgtcgactcaaatattcttcttcttttttctgtgcttttcctcttaggtaaataccccacttcaaatatttacttatcataatgagaatatgtactcaatctagacgtggtagattatcttcaaactcgtcataagaattaatcctaaatctgctcgcagtactacatgaatgctcattggtgccggttcttgaaccaacacaccttcgttttttatttttcaggtgctaaaaagtcaaaaaaaatatttggtatttttattaggcacctatacaatcacactctcgttcccaaaagtcacataatttttgaatccatattcatacaaatgtgtcaagaaaaattcaaattcaagacatctcacttcacacaaagtcaccttgccatatcacctacaaacacttcttgtcttggaaacaaatgctattgttttgagaccactatcatttgaacttataatccatatttaacaccatagataagataaaatgaaaagtg

SEQ ID NO: 72202 - DNA, 695 bp, Oryza sativa
cacatgttgacaaattgggcccgctgcgtgtcccttagggctaggagttcccttaatggagctagcattgtgcatggcagggttgcctagctagctgccacctcctctcgttgtgtggcctggagtaggtgactgggatgctggtgacgtctagtgatgctaggtggacccacttgccaaccgcaatgagcttagcgtgccgggtcatggcggtcctagctaagcgacgtgacagtcaaccatgttgcctgacagcccacgaccccgactttttaggactgatgatggcttatcccatggtcactccccacacgtagccgacagattcatatccttcacattaaatgcgagactggctgcgcgatgcggggaatgacgactcaggtgttgacgaaaaacacggtggcctgagagatctgcttaactccagtgcatgtccaaggcttgcctctagtgtgctaagggcatgccagctggtttgatcctgtaaccagcaaggaaacatcaaacagagtgagttagccaatagccgatcggccaataggccgatgacatatcgttagtgatcccagccgatatagttagaccagatcggtaatgcattgatatataaattacgtgcaaaccataaaaatgcctcatcggctgtaatatcatctaattattttgtcaagtttacgtcagatgatattata

SEQ ID NO: 72203 - DNA, 4668 bp, Oryza sativa
tcacccaaggtagatcaacaccaatatataacttgaccatatgttttagaaggagggctgtgttttgaactctcagattgatcacttctaagcctcctttctccttagggatgcacaccctatccgaggaggctagagatttccttgtagaagaagggttattccctctctacagacaattcttacaagctgtgtcaatggccttgatgactgtaactggtagctgcaatgaggacatgtagtaggttgggatagaaggcatgactgagttgatcaaagtcaatcttcctccttgaggaagaaaaatagagcttgctgtcagcctcctttctactatgtctaccaacggtgcaaagtctaccactctaggcctggtggtgcccaaaggtagccccaaataagtgaaaggaagagaaccaatcttacaccccaaaatgccagctagcaaatcagctttgtcctgagacatattaagtgggtacagatttgatttattaaagtttaccttgaggcctgtggattgagcaaacatattcaaaatagtcttgaaacagaagacttctttcttagatgcttttagcaagatcaatgtgtcattagcatgctgtatgattgggaaaccctccccactgctttcattaattggatttgacagaaggccttgatggaaagctttgttgattattctttgtaacaactctgcacccaacacaaaaagcagaggtgagagaggatctccttgtctgacctctctcttgcatttaaaagaattccctggcaccccattcaatagcaagcagtagagaaaaccatttgtacccactcaatccattttagaggaaaacccatatgttgcagaacggagagaattgcggaatgctcaatggtatcaaaggctttttcaaagtctaacttcaagaggacaatttctctttttgactgctgacactggtgaatatattcaaaagaccaggcaagacaatcctgtatggtttttcctttgatgaaaccatattgattattactcaccagtttgagaattaccccttgaagtatgtcatctagtaatttggttaagattttcagacttatacccataagggaaataggtctgaaatcattaacagtctctgggaggttttctttggaaccagggttatgaaagagctattaaggatttccaaaacaacatttccagcatgaaaatgagctgccaatctgtaatagtcctgagctataatatgccaacatttttttcatgaaatagccattgaaaccatctggtcctggtgctttgtcagctgaaataatggagatgagactatctatttcctgagtggaaaacatgtcaaccaagctgctcaaatttatatgtctgtcaaaaagagactccaggtcaaaagccatatgtggggaattagaaacacccatcttgttcttaaaactgtgatgaaacagggaaactttctgctcatgaagatgtataatctgtccatcatgatctagcacttgtgagacagtgttgattatgaacctttcagtggctaataactagaagaattttgtattctcctcccccaacatcatccatctattggtgcaccttttttccaatagatcttcctaaattccaataatttcaaaatatgtaccttaactgtttctctgaaattccactcatagactgaaagcattctgttttcttcgactaaatccagaaaatccaccactttgttacagttttttagaagtcccatcaacttagattcttactccaggcaaggagcttttacttgagcactttcaatttgaaagaaatgcacttggcatgatcatcaaaactaggatctaaagaccaaactgcctaaacaatatcaaaaaacccatccatctctacccaataaatttcaaatatgaaaataggggatttggggatttttgtgtcaatcttaactacacatggcacatgatcagagatgtttctggttagaggcagcactaatgtatttggatagtccattgtccatgaggctgatgtgaatgcccagtccaatctctcaagaagtggatatgatgcatattgctctaggtgaattttctgcctttaagagggatttccagaaggccaagagtgctaatgatatcattgaagatgaaaatgtcattcatatctgccccatctttatttctatcttgcacagatatataaaaattgaaaacacccaagaaaagccaattttgctgataagcaatttggacatttctgaatcaagaaacaaaatttgctgttttagggccactacaagggccatagacacatgccagggtccaattctgggcagagtgccttgagatgaagtcaatggtgactgaaaagaggttaacctctaccactgtgcccacaaaaactcgagacgaccaaacaatcaggatacctcctgaagctccattggaaggagcaaaagcaaaactatctagattctttggagcaaatttcctgatatcagataaatcaaagtggtcttttttagtttcctgaatacaacagacctgacaaccactatcctcaatcttctgcctcaaggagagtaacttggattcggcattcatccctcgaatattccaacagagcacattccaaaatttaaaattattcatgataaactggataaaggagactgaaataaatagaactagcacaaccagtctgtaataaaggagcatcccaagtattcaaaatttacataattgaaacatttaactgataagacacaaatgtttttgcctaagtacagaccattacatgatggataaaaatctgattaaggtctgcagaaacacacaaaaggtctaaattcatttttcctccatgtcaggcctgggcatcttcttccttctctggcctcccaggctagactcagctacctcgtcaggagctagcccgcacatgtccactcccatcttttgcaatagagaaattgagcaatcagatggtgaggaatcagaatgaatatcatcataaacatttgcattaaaatcagtttcctttatgctagtataatcaaatatttttgctatacctgccaattctttgagctttcttgcagactttccccttgacttaccaatgcccattctgggatccacctttagttcagaatcccctttgatatgctgaagtcttgcactctgcctcctgtagggattatatagaagagttctgccttcccttttcttaccaggggcttttggtagcatcaaaggagcagctgcttggcagactagactggagggtgggtgaaccacccaaggcaagacttcaagaatttccatgttttcatgggcctgtgactgaggaggactattagacttatgaaagtccaaagcccaggtagcatccagcttactcacttggggggagaaatcaaacatagtcttctttggtaggactagagctttaaaggggcttggctcataaagagtagcaggaatagagttactagccaagaactgatgcatagaacccctttctttgcacaggtggtcaatcttcttattgatctctttcatggggtagaaatagggaaccttggggtactcatttttagcaattttctccaatcttgctaaagacctctgcacttgtgcatcctggtcagatccttgcacctttttccccttgtctatagcaggaacaaaggggaccactacattatcatctccagggttagcaacagccaaatcaattattccatcagggtttacttccatgatctggcccatagggtgatcttggccccaagcatcttccacctgctcatttgctgtattctgttgctggactaaatcatcccaatcaccaggacctgcttggggatgacccatttgccagatgtggccaccatcaggatcctcatcatcatcagcagcaggattaggctgtgggccagctaggggaagatcctcatctagcgacatattgatgaaatcaccttccaaaagaaaaacagaaactgtccaggattcgtcaccaccacccattcccactggatcatgtagcacaattttcgtgggcacagagtcattgtctttaaatttagctctaatgagcaccctccccttaatctaatctctttcaagccagtaagagagctgtaacaccctaaaaattcccaataataaaaatcactaaaattttgaactttttaaaacttttgcatcatgctggttgttatgattgctattgcttgccaaaccgtaaataatcacaaagaaagtaaagaaaagatcgacatttaagcaatagatataatttacgagaatatattattgttaaccctaccaatatttatgcacaagatagtaaagtcaaatattaatttctattataaattacaaatcagatattaaatattcgaaccatgattgatagcttgatgtcacaattagctaaagaaatagtaagattaaatctaattcatttgaatccaatctcacatgaaatataagaacacatgaaatgatgatcaccactataatgatcgtgtttataactaagtaattcaccagaatatatagattgatacttagagcatttcgccgagttcctcatgacatgaaaatcactcatataaaataatggtcatataaataaattaagcttgagta

SEQ ID NO: 72204 - DNA, 17001 bp, Oryza sativa
ttgagatctcccctagcccccggccgaactggcaaaggggggcctgcgcggtctcccggtgaggagccccgagctccgtcatctggcgcgccaggtagggggctcagcgtgtgttttctgagctctcatactcttccgtgtgggccaagtttcccttgttcagcctaatggccgagcaagcaaaggcgcacgacctctctccgagtgtgagcggcgacgacggggagccaaacccgcgccatcgagctcgtactcccccacctcctccgcgccaaagtcccaagcggggggaggcgctcgagagagtcgaaaaatccgcagcatcgccagtcgcgggtggtgcaggagaacggcgagatggggagcgtcgcctcctcggcgacggcagcatgccccagggagtgcttcaggctgctggcgcgctcctacgtcacccgcccgtcgtccctgacccggagtctccagcccagcgatggctggacgacgtggccaacttggtcatgacggcacagcagcgcctgggtgctggtggacggtccgccactaccaggacctccggcgccgccaccaccggctctgtgtcatcaaggcggagggcgcggcgagcggcggctgctgcacgccattcggctaccactccctcgtcggcgcctccgactcgggaggatcagcatgaagagccggatgcccgcctcgacatcgagcgccgacgtagtgatcggcgtgctccccgcgcaacggagggtgcctcttcgtccagggtgtcacctcgacatggacgtgaggatcagccctccgtgcccccggttggtggtgttggctgtagagcctttgtggcgagtcttcggaatgtccgttggcccccaaggttccggcccaccatcaccgagaagtatgatgagagcgtcaaccccaccgagtttctccaggtctatacgaccgggatcgatgccgctgggggagacgacagggtcatggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccagacagaaggcccccgccgttgacatcgatgacggtgatgatgacctaggtttccaagaacctggggccaccattgccactgtcgacgggggagcgtgtgctcacgtttctcgccggagtttcaaggccatgaggcgagagcttctcgccgcggcccctactcatgaggcgacgcgtcggtcgcggtggtcggaggtggccctcacctttgaccagaccgaccacccaccgtgcgttgcccggggagggcagattgcgatggtggtttcccccaccatctgcaatgtgaagttggggcgtgtcctcatagatggaggagcggctctcaacatcctttcccccgcggcctttgatgctatcaaggccccggggatggtgctccagccgtctcaaccgatcattggtgtgacgccggggcacacatggccgttaggtcacatcgacctaccggtacctttggtggatcagccaacttccgcacggagcgggtgaacttcatgtggcggacctcagtctgccctacaacgcggtcctggggaggcccgcgttggtgaagtttatggcggcggtccactacgcctacctccagatgaagatgccgggccctggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatctggagtggctggcgaacccggtggtcgttcccaaggcgaacggcaagcttcggatgtgcatcgactacaccgaccttaacaaggcatgtcctaaggatccttaccccctgcctcgcatagatcagaccgtcgactccactgcggggtgcgaccttttgtgttttctagatgcatactctggttaccatcagattcgcatggctagggaggatgaggagaaaactgcgttcattacccccgtaggaacctattgttatacatcaatgcccttcgggttaaagaatgcaggtcctacttttcaacgaactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccctgctactttacttagcggcgaccccccaagtagttagtgcagcgttggttgtggagcgcgatgaaaacaatcctcatttcgtgcacccccattctgtgctaacttggcccgggagcgagcggggaggagaagcccccgagtcggacggtggcctacggcccctgacgaccggagtcggccctctgcccgcttgtcagacggtgctaggtgcccccgaccctcaggagggccccaaggccactgcgggaaggccgcacttaacgccctctgaccccgaggctaaccctgtgctgactcgacccgggaaagagcagggagaagaggcccccgagtcgaacggaggccagaggcccctgacgaccggagttggccctttgcccgcttgtccgacgatgccaggagcccccgacccccaggacggccccgaggccactgagggaaggccgcccctttcatcctccgaccccgaggtcatcggcacagaagacaagtgcgccccgaaaggccacttgaacgaagaacgccccggggatacggcccctagcagagaggatcggccccaccgaaaggtgcagtggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtacaggacgggtggtaaaatgggcaatcgagctttctgaattcgatctgcactttgaaccacgccacgctatcaagagccaggccctcgccgattttgtggcagagtggaccccggctccagagaccgtctcaatccccgaggccagcacgaacccctcgcagctgcctcacaccacctactgggtgatgcagttcgatggttctctgtccctccagggtgccggtgcgggggtcacgttgacctccccgacaggagacgtccttagatatctggtccgccttgactttcgagcgaccaataatatggcagagtatgagggactccttgccggactcagggtggcagccggactggggatccgccgtctcctggtgttaggcgattcccagctggtcgttaaccaggtctgtaaggagtaccggtgctccgacccgcaaatggacgcctatgtacgccaagtgcggcgtatggagcgccattttgacggaatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccgacccccgaggcccgtcggagtccaggcctcgggacccgaagggagcgctccaagctcccttagattgatcgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgacttctgcgaagacatgggcatcaagctctgcttcgcctcacctgcccaccccagaagcaatggccaagtggagcgcgccaatgcagaaatccttaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgtacggctggccacgggcgacggcactgagctgccgaacccgtggaacatcgaacaccttcgtcgcttctacccctgagggggggggtcgggtgtcaggtttcgggctcgggctaaccacgcacccccctcgggtgtgcagggttagccgggggctaccacacatgcacaaccttacttttcttattttagcatttcaataaaagcagtttcaatttcctaaaggttgtgtctgtgccgtttttccttctaaagaatcttaacttgaaataaggtcactcgtgctcaaccttgccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcataacaaaacaaagttaacatagaaatttttcatcatttttgattgcagattaagttgatctatacaaaaagaagaaagaaaaagaaaaaattggagattggcgggggcctgggggctcattccaatgcgcccgggtcgctggcctcgtcgccaccgtcgtcctcgccgctggcgtcgccctcctcgtcggagctgggggcgaacgcgagccgaggggccgacccctcgaagctttggacgatgtggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcgaggccttccagattggtggagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacgttgtgttcggcagctgcgaggcgggcgactaagtcgctttcgcccgtagccgccccgccgctgcgcttcctcgcatccagctccttttctcgcgtctcgaggttagcagcctgttgctccagcgcggctctctcggcgcggatgcattccagattgcggcgcgcctgctcctcctgcgctgcctcgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctggtctccacggcgccggcatgatcctccagcgccatggcacgggcttcaagggcctcttcgcgccgccgggacgccgcttcagcctccgttgctcgctgctctcgggcagcggcggcgtcgaggaccccctgggcggcgtcgagctttttctttagctccgcctcccagctcccgtgttgaaggcggagggagtcctgcgcctcaatcatcgcggtggtggcgacgagggcggcctctcgctcctcctccacctctcgggcgatctccgccagcgccgccttgcgggcttcaagctccgagatgtggcggcggtgggccttacggcccacctccaccatggcgtccaccgagcgccgcccctcctcgacgcgcgcccatgcggcctcgagctccgctcgttccgctcgcaaggcctccacctgggcgctgaatccatctagcaccgcggtgtttgcggcggccaaggcttgcagaaggggctcggcactcagcggggtggcagaagacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccctgtcgcaagccgccccggaggttgtcgcctgagcgtcacccgagggagtgggcccgagcgacgcgccggcggtcttgtcgtaaaccgcctcggaagacgccatcgcctctgcctggcgagcccgggcggtttcctcccgggtggcttcttcagcctgacaagcccgggcggcctcctcccgagcggcttcttcagcttggcgagcccgggcggcctcctcccgagcggtatcctccgcctgccgaacccgagcggcctcccgggcggcctcttcagcttcccgaaggcgatctgcggcctctcgccggtcagattctcgcctccgttcctctgcggccgccggatcttcggcctcggattggccggacttgggatggcgggagggacgcgacgggacatcgctgaagcagaagaaaaaaccagaaggcaaacaagatgggtaaggtaaaacttgcttttgggatagaagaaaagacggtcgcaaagagagcgggacgaacctgcgagggggtcggttaaatgaccaccttggaggggaaattaggtttccctgggatggttctgtctcccccatcttgcgcagccgtttcttcttgcgctccccctcgggctgcgatgttggcgcggccccctccgggcgcctgctgctggcacgcgccgccccgccccctcggggaggagatgggggaggtattcctcccagtttcctcttcccccgggcgtcggtagggcggttgctccccgagcccccgacgcggggcccagaagcacgaccccctccgggggtagattgatccccccggcggctcccacctgcgccgccatggcccttaggagcctgctcctctgaggccccgaccgccgtcataatggtcaagatggagacgcgatctgggtcgctgcagagggggaggataccgtgagggatgagggacgcctccacggagttgagatttagcacccgttggatcagtatcttgaagtcctcgggggcccaatcccatctgaccccctggtgggtccgcatatagtcttcgggcccgatgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcaccgggggctggctcggaagtcggagatgcgcttcgtcggcgaggggggtgtagaaccagtcgctcttccagtcatcccactttttgcggaggacgcaggggatgtagcggttcaacaccggcccccgcggcaggaaatagcagccgccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggagaaagaagacggaccgccccgggtagtctggcgccgggcgtccctcacccagcattactatctcacggccggtggcggattctggcatgaagcggcgcggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcagcaaagagagagttaggggcgcaaacggcgaaggaaaggggaatagtggcgaaaaggaagggagcaagtcctttcctcgatagctttatacccttgccatcgctgagcccggctcctcgtttctcgtgcccactatctcgctccctcgttactcgctatctcgctccctcgtttctcgcgcccacgcttccactaaattccattcgcccgcttgcggcgcataaggtagatatgcggttgtggcagtcgagatagatcgtatcgtgtgtgcgttaattacgctcgctgaccgaagcgacgttaccatatctccagacgaaacgaatctacacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctgtcaccaggctttatgagtggcgtcatgcccgaccgcttcccttgagaaggatgattgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccgaccccgagggccgaggtgccccgaccccctgtggggtttgcactatgtacataggttgggtgaacacggtagggctcacctaaccgcatttattgcggtctggtcaagcgtgtcacgttgcatgcagcgcaatgcagcgcgctcttttatccggtctgtgaccagtcacagaccggtcggatcaacggttaggtggcgactggtggtctgaggcacgcctcgccccgtcccgtcaagacgagagcctttaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggttgtcccatcgaaatgtcattcggacggcaaccataccaatctccgtccataaagagaagaaaagtccagtttggaaaggaaagggtacatgtggtatccccttaagatataaaaggaggaccatgcccacaaagagagggggctggattttcccgagagaggagagggctggttgattttttgtaacttgctcttacacagatccaccaaaaacacaggagtagggtattacgcttcccagcggcccgaacctgtatacatcgtccgtgtctcgcgtttcttcctggcacgcgatctttccacacacagcgagggcttgagatctcaccctaagcccccggccgaactggcaaaggggggcctgcgcggtctcccggtgaggagccccgagctccgtcaaatgccatttcacaattattcgaattaattcaaagttgaatctttaaactagcatagcttggatttgaatgaaacttaaacctaaatttatctaagatcaagatctatctgatggtatcacttttatcatttattttgtattatatgaatttatggtgattttatttgaattctattcgaattcaaataaaatctttcgtgtctaaatctagatccctaggaagttgatgagttgagtgaagaccagggtcagcaaggctgtgagcaaggcaagtcatctctaatctttgagcatgttaaacctattgtgaagttatgttgatttaagtaaaatttgcatgctatatatatatacacacacaccatactttgatgttgattccctgcaattatttgtatccgcaatattgtgtctcgtaaatctaataactgcttagtcaatgccacttagattcatgcacatccatgtttatcaaatgctatggtggtgtttggatccagggacttatcggatgtttagacattaatttggagtattaaacatagactacttacaaaactaattacaaaaatgagatctaattcacatgacaaattttttaagtctaattaatccataattagcacaagtttactgtcatggattaattaggctcaatagattcgtttcacgaattagtctagggttatggaataggttttgtcaataatctacatttaatacttctaattagtatccaagcatccgatatgataggaactaaatttttagtcccatccaaacagcccctaaatgcttgggcatctactttggggaagctagttgatatacggcatgtggagacatgagcgccactttgatataacatgaacaaaatggtttgtgaaaggaaatctaaactaaacaaatgtttttagactagtggctggatgacttgggtggtgtccggtaaaggctagtgccgtccttggtctgttaaggaccgtgccttgaagctaagcatgaaatgaccctagtacaaccatacttctcgtatgggtatagacctagcggagtaaatagccgagcagaggtggtacccaagtgcactggttttcatctaggtgtgtgaataggcggggagcctacggtgggtaaccatctgtgggcaaccaaattaaaacctaacttaactataacttaacgcatgtgtgagtttttccctcctcgggaacgccagaactcctctcactactagaaaccatgtatgcctagagtgcatgagggctcaagttcatggagcgggtactgccaaagtgaggttattgaaaggctttgccatgacgcatctcattcgttcggactttggctcatgtgttgggcaagtcacggcgtacaggtggagtgtatatccactacagtgtgagtaaaccaacatattcgaatagctgtgcgcgtggatattgagcaccgggacatgtgttacacttgcctagaatctaaattcttaaaatgatgggtgggatatgcatgatgattttgtactggtggatgaacttctcgaaaagcgagaaagggtagaccctagaaaaccatgatggtccagtggccggaagctatccttgggatcacaacggatggtggacagaagcgttactgtttaatgaataatggtattaaaacctgatcagtctatgctaggtcttaggcttatgaaaagaattacaaaatgagctttacacaaaaagaacctttaaccattccttgaatatcctctatgatatgcatcgttgagtgtaattaataatggataatttaatacaaattaaatccagccatgctttatatttaggaaattttattttcccacatttaacttcatttgtaaattaataaacatttaatataaattctaaaaataatttataaattctgaaacgaaaatcaggatgtaagagtgggttagcccaattcaggtagtgtctaagaaaggtggaatgacaatcgttaaaaactcaaaaaaacgagttgatcccacaacgtaccgtcacgggctggaggatgtctatcgacaatagaaaactcaaaaaggctacaaagtcagtccccgttgctctttgttgacagttattaaataccaaatttaaaccgtcaatacatgcataaatctaaaaatataaaacatccaacatagtggtagggtttaattccagcaggaaaagcagaactcgaactacacacaagctccaagtcacttccagatcttcatggctttgcatggtgtgtcactcgcattgtgttcactctaatatccttcctgggtgccaaccataacttgtttacaagatttcatttgtgacttggtttagcagcacatccacccattgcagcttgatgacttgcctcctatgatttatgtagaactaaatgacaccccgcgcgttgttgcgggcataacttgatttacatagtagatttttttaaaaaaatctactgatcctcatcatcaagcatcgaagttgagtactcctaccttgctcagaaagcgtaaaaacatttgacatcaatgatgcaagaaatcactatgagagcgaagaaaattaaatataaagaccttttgatcattacgattttcaaatgaatgaaatcacagcacatgttagtttgactccatatgcatttgcatgagcttgaggtagcacattggggaatgcacatggccacaacccacaactatgtatcaattgtatacaacaaaatgagaaaaaaaaacagcttgtaaaaatagataaaatagaagaaatgagtaaagatctgcacaagctgcaattaaatctttggataattacatatccaatattattagtttttacttcatgtgctaaaaaaagtgaactgaatgatttatcatgatcagaatatgaattttcgtcgcagattttcactgcagtgggatcaagttccatagtgaaaaattaaagcattcaaataggttcctctagcagcgaatggcttaaattcaagaattgagtaagggatgttagaataaatgggctaggcccgatttttctattaaaatctcaagggccaataataaatgttaaggataataataccagcttaggaattaaaagtggagtatctcaacttaaatagggagttattggaggctccctgttgaccggtcgaggtggggatcggaaagccacgcgcgcgccgagccgagccggccgggccgaggccatgggcgaggcgtggcgtgcgttgcattgggttgggttgcgttgcgtctctctctcgatccttttgcaatggaccggaatccaaccccgcgagattgcctctgtaacgggcaggcgattcaatacgcattgatcgcgtcgttactatggcaacgggcggattcctctcttgcgctattaggaaacagagacccccgatcagatctccatgctttctctcccatttctgtttccccggttctgatcccgattagatctccacgctttccttcccatttctgtttccccggttctgatcgcttgcgcgcacgagagatcggaacgagcaaggcttttggggagtgcttccgcacgactgctcctcttcttctgttcgttgtccgttcgtctgcatcacctgactgctcctcttcttctgttcatcgtccattcgtctgcatcaccatgtcttctggagatggcgcacccggaggcaaagctggcgcacctggagctggagctggcgcaccgatcgacaacaccaacagagacagttctacctcacaatccagcgaagggactttcacagggtataacattttgtcgctatctctgtttttgttacttctgttagttgcaatgttattgcgttctctacatgatgatgatgcttattctatcttaagcatgctcctggttatgtttaattttatcactagatcacctcacattgttcatgtcatgattattgtcttaatattttggattaaaatatgccgatatatgactatatttccaacaatccaaaaacctgatatatcattttcggtagttgtctttgttgctgcactaaaaccacatacttttgatggttctaattataaaagatggaaagcacgtgcactactgtggttgacagcgatgcaatgtttctatgtttcatggggtaaccgaagtgaaccacctctctctcctgaggaggaggttaagttcgaggcttcggattgcctgttccgtggagcattgatcaatgtactcgctgacaacatagtggacatgtatatgcacaatggcttcagggaacgacatgtgggatgcacttgaggccaagttcggagtttctgacgccagcagcgagctatatgtcatggagaagttctatgactacaagatggtcgatgaccgttctgtagtggaatgtcacatcctgatttttgtttcaggatttataaattatttaataaattattattagaatttatattaaatgttcattaatttacaagtgaagttaaatgtgggaaataaaatttcctaaatataaagcatggatggatttaattttttattaaattctccatggttaattatactctctggaatattctcggatttttcggagctcaattcctaatttttaatcatacaaagagcatttcagtaattacccacatattaaattaatcattaaatggtctggttttaatattgttaaatactttgggtgtccaagtatgttcaagatttttcttggaattatttgagcattggaagtatttttaacaattcaaagatcatttcattgattaatttaattggaaaagtaataataatcctcttcctagtcttgggccctttccggcccatctccctcttttgtgtgcacggccgtgcagccctagtcggcccagccgagcttcccccttctctttctttcttttctttgttttcagccagcccaagacgaaaagtctaatttgcgtccccttctctcttccttcctctcagcccgcatagaagtctgtttttcgtccctgtcgctacagtgctccttcttctacctctagcagccgaactgagaccgatttggctcggtttttctcctccaa

SEQ ID NO: 72205 - DNA, 505 bp, Oryza sativa
acaagttgggatctactcacgacttgatcaagtttttgaagctcctcctgctgtgaaagatgttttaattagtcaggctaatttggaccgttcggtataactgtttatgtcgacttcattaatctataccaagctgaactgaccagaatcctcaatcgtgtttcctcttctgtttccccctctattatgcctatatagtatataggtacagatgaaacacacaatagagcagatgatgtaccaaagctaggcatttctgacttttggaccccagataaccactatcggtggtccaggtcaagatatggcggtcatttgtcagcatttgtagatgccgtcaatccttcccgtctttttatgtgcagtatgtgttacaatctcaacattaatgcctgtcagctacttgggttgtgcattctgatctggtggtgcctgatgcttgtcagattttttatgcagatttagatgttattgactctgaaagacttcgatctcagaaggataa

SEQ ID NO: 72206 - DNA, 1851 bp, Oryza sativa
ttctttcaaatcgggacagtatctcagaaatctgtagaaagaggaggaaaaagcggatatgaacaacatccatcatacagtattcccgtaggaaattattagcaggcatatggagacaataaacagtagagtacaatttagtgtttggttgcatgattgaaattggttacatgtcggcctgccactagccaggatgttagtagtagtactggggaccattgatttgacaaacctgagagaagaggagatgagaggagaggaccccaagtgtgcagtgcagagttgaggagcccaattggagaaaagaaatgaaaagagagcagaatgacagatctgccatcacatctcaaagtttgtctcatgtgaatgtgattactactcagtattattagtcatatgtagaactgagatgagatggtactatgcattatatagttgttactagtggtatatcgaagtatatgtactccagtatgttagtaatagagatgtactagtaatcggaggaagtacatggtaccaacatgagcatgtaatgggattccgtaattttatatcgtagtatgatgtatgcactagtaatttgctggtgttaatgctacggtgatacttaatagaacccatgttagtattattaaattaaaaaaaatcatgttggtgatgcaatacaagtagtagttaccaggcccctttggacgccgtcaggcttgatgacagggacctgtaagttgacatgtactgcaccatcaacatactacatgcttgtagtcgtagatgtacccaaaaaaaaacaaaaaaacaagagagaggcatagcactacttgcaaatgcatccatatatactcacttttaattacttgccagccacactccacacacacactttgttattgcctcgcgcactgcttcctctcttctgcaatcttcccctcccctccccattgagagaggctacacttttctctactcaaattccctaggagtactttttttttctcgtcactctccttgccttaatttggagggaaaagaatatctacttactgctgtcgactcatgtagacaaaacaaaacaaagcacagtcattaatctgaccttaatatcttttggccttctctactttttttcccatagtaaaaataaattatgttttcactcctgaaacaaaaagtaaaatctactgaccagaaaatagaatgcttgttagtaacatgtttgcaattaagaacgttacatttcagtacttcattcattttaaaatgaattaactaagtggactgaaataacctctttgtcatctgtcgatcctacagggaaacatggcacaaccatcctttctatcagagtatgaccttggaggggaaggggacctgttcaaagctcctgaacccatcattgaagaaccagtgcttagccttgatccagttgcagcagccatttcgatgatgtctggcagtgagaacgtaatggatgaaactatagaggttgcagatatcagcgacattcagaatgactctcttttaagcgaagtattatatgagtgcgagaaggaactcatggagaagtccgcaattgaagagagtatttctgaactggtggatgtcaagattcttatgctgcaagtggaagagttccttagggaaacccaagtacaactaccggccatggagaaggagaaaccatcagttcatgaatgttgttcactccagaaaagtgtcagttctgggtgcctcaactcagctgattggatcaatggaccagccaggccaaacttcctggacttccaaggattggactttgagacagcgtttgggttgaggagggcatacagcgaaggagacagtcaggtt

SEQ ID NO: 72207 - DNA, 1214 bp, Oryza sativa
gcttattaatatgcattttacccatgagacttgttgcataactgttgtacacatggcacgatacttgttcgaagtttcggagagcatatgcatgcgacgtccaaatttaggaagtagaaccagagaatgtgcctacttttttgcaaataatcaagggggctgacttaatttgtaccacccatttttgggcggtggctaggtccatgtatgccaatatataaatcgatcagagaagaggatcgacgaggagacaagctagatagcttattggagagaaaaaagggtcgaagcgcaagcaaatcgatcagcaacacaagatgaagaagatgcggatggcaatggtgagcctggccctggtgctggtggggcttctcctcgtcgccaccactgctaacgccaagaacgcccatgccggtggcttgaagaagggcggctctgaagctgaaggccgcgtcgtctacgccgacatgagattggtcgttccctccgactccgactccgcccccgcccccgcccctgcctccgcctctgatgggccagcacctgcgccatcccccaacaattaattcaacatcgacctagcatatatatatacgtatatatttgttattttcatgtgttgttttcgcattttatataaccatgcgcgctctagttgtacatgcagccgattgatgtgcatttgatttatgcctgctcatttttatttctttctttttatttacgttaaatgaaacactttctccatgcatacatggttgttcttattttatttattataaggatatatatatatatatatatgcgcattcagtaagaccaacaagttcatgttatgtctcatctatatacctctctattattaggccacctctcatctcccatgatctctacatgtcggtctatttatccatagattttgaacaaattaattactgaatacaaattgcgatcaaaggctatagcaattgaaatagcaagcccatgtttctgtacatcttgtgaattacagccgtgtaaattcatgagcatgcatgcatttgatgataacaattaatatagctaatactagccccgtttgagatatagctgaaactgatggattgatggatagtttttttatatatagttattttgagggtatacatttacttctttatgtatgtataaacttaaaaacttgctttacaaaattattcgttaaaatgtaatat

SEQ ID NO: 72208 - DNA, 1163 bp, Oryza sativa
gtcaccaccgttaggtgcgcgggagggtggagaagcccggccgcctgaccaccgaagccgctgatcaccggagccccgtcgccgccgtcgaccgaagccgcgccgccgctagacctcgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggccattgatgaggtcatcatgacgtcatcatcgtttttctttttcctgtttttctaatagattaaatcttcagaaattcataactaaatcatcgtaactcggttttgagtggttcaagttgctaaattcatctaaaatcatgatctacatgtttgtttactttttatgtattgtttatttggtttttattagtctttttcttcgttttgcgtgttagcttgtcgtttccgtcgttgcgaaggttcgtgagtgccgccggaagtattcaagaagattaattgaaaaccgattattgcaaggcaagtcacacagatcctaaacacgatcctttgagcatgttgatcctatatttaaattctctatttatttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaatgttatatatatatatatataattgcttagcaatgcttagaaacattagctcactaatgggatgaatcttatatactacattattaatgatggttatattaaatggtagctcacgatggttaatcgtgtgatgttaattaattgataattaaaacctggttaaggtgggttgtgagcatatggttttgatggttgtgctcatgacaattaaggaccggttcgcgagctactgttgtgaaacctttaccgtgccaaccacaagccagcatgggcaacggctttatcttttgtatagcgtgattcattatagtgcgccagactgagaagtggcgagaagtccacgggggtcgctggggagtccatgccttgtttataaaggggtgattatgatcca

SEQ ID NO: 72209 - DNA, 7575 bp, Oryza sativa
tcttgttggttgcaggatcaaaccaactggcatgccccgaacccaaaagcaagattttaggacatgcactagactaaagcaaatctctcaggccagtgtgtgtttttcacattaacagtagcttaactggttacgagctacgtctcttgtggtagaaccagcacaaccaggttcaaattctatatttggcacggatgctcatatttacgattaattattgttttagtggtaggtgctcgtcaacagcgaggcgcccatggttacttcatcaatatcaaaatatgttggctcaatctttcggatgtgctcataggagtaggatgtatgtggtaaggtgcaacagtgaaagtaaagaaaagacatgtgttacgtgagctcgaaaatgcatgcatcaccgcttagttgttagtactacttgtttacctaccaatgcacatcgtcatgcaaccgcagatgcaccttgcctcaagtcaagaagtaaatatggaattcctatttgaaatattgttaacaaaagtttttctttcagtttgtatggaaggtgttcacaccttacccctaagaagttatggttttgctatttcacacgcgtcagatttttgggcttctatctttattttttcgtccgcaagatcttgcattaagatttctgttcttgtatatccaacttgcagttacactcgattacatagcacttacactcagttatagtgcacttgcacttaattacatagcacttatactcagttctagtgcatcaaaattatattttagatcagttttttctagatttttgattgtttatatgcttgtcttttttgtttattatttcatttaaaatgggctatagccattggttgaaatttctgcaagattcgaagttataaatctatcgcaatatcaaaaggtagtcctattaagctatttcttcggtgtctaggaccctaaatacctttctttcttctcccgcacttcatgaacgctctccatcttttccatttttttctccctctgtgctagggaaggcaccgcggagcacctggccgtgagatttcaatggcggcaccatgaatacaatgagataatagaggaaagatctctcatatggtctattaatgtgaccaaacatgggacatatataatcattccattcacttagcacggatggcacacctcttctcatcgatcccaggaatgctaattcacgcatacgcgctagctggcaaacttccgcacgtggccccaactctatctcacgacaagcgccaggttggagttagggtttctagagtgggtaggggaaggttaacactggagagggaaagttaggggattggccttagagcgtttgtcttgaacaaacaaaggctggtttccatcaagaaatcgggttaatgaaggaaggggggaagaaaagcgtgtcaaagtggaggcgaggactttggaggtgattactatcaaagtggggtctcatgatatgccaataccttctaaagatggagccaaggcgattccaagcgacgaaccgaagccgggaccatctctgccggtctaaccaccggccacacgctagtctgaccgggccgactggccagtctgaccggtggtttacaaccggtcctgactggtctccagcgccgatttgacagtagatttgctagaggtggttcgggtgcttcatcgtcttcaagcaaaatcaatagggggcataatattcctcatggaacatagccgaaatcaaggcggatgcctaggaatttaacggctactcaaaagaggaggttgcaacatcttcggactcaagagttaaaagagagagaagccgaagagtggagggatagaagatttaatgagttgtgactgccgccaatgaaggagtggaggcctaaatccatagagattagagattgatgagccggttgttgagcaagtaggaaaagatgaccaactggttgttaaagatgaattgccgccaaaggaagacatggacataaacatggtgtgtatgtttcctatggagttttgtgctatggatgaggttgaagtttttcaactttcactaggtccaagagatgcggtttttgggaagcccgatgagtctaaccgtcatatgaagcatcttaatcttaagggtcatattgatgggaatctctaggatgttggtggatggaggtgccgccatgaacttgattccatactcatttgtcggagatatgggcccgggggtatgtgaagtaaagggaagttaccttcccgtccagccaagtggccctgcaagctggccccactcacacacctcgtgagtcgcgagagcggcggggggggcctcggggcgtgacgtcgccccctcgggctctcccgctgctcccctcgaggccctcgcccggctgtcacgtggcagggggagagagtgagagggggacccaggctggacagccataaaaatgcggcaccccaactatccctcactgcatttaacgcgataagggcaggcatgcggtgcgcctagctgacccctgtcaatcggaggtgaccaatctgtgaccggcctgttgccggtcacgtccgattgaacgggcggccgtgcccccacgtcgcctctgtctctggcggagtgggggtaggtatgacctgtcacattggagcgtcactcgaaggagggctgtcacgcccagaaatttaacccaaatttccagactattttgcgtattaaatccctgtcccgagattctgggatggctagaaagaaagctggagctggcgggcggtctgactgatttgcacactgcactgttcctttctaattcaactgaccgattcctcaatggtccaaacctacacgactgaactgaccggcattgaccattctgttcttttgctccaaacaactgaactgactggcctcattggattcgaccttggagttctggcgccccacaagactgaactcagtacgagtgatctggctggtttcagctctgcggtcctgttgctcccaaaactgaacagattggttctgcttgaactgacccagactaggactgcgaatgctcgtgaaactttcttatcttgggatgaactgttgatgctagcaacttgataacctgacagttcaccaagttggctagagaaggatggagttgttcctgaatcttgcatctggcatttgtaactcattgatcctacgtccgcttgaactggtcctggctcgaatgacaattccaggaaacctgcttgacatgtcttttgtctgaactgcaaccgtctgcttgacctgtctaagctaagcggttgaactggcctcatgggtgtaccttagaattcaatcggttgcccggggattggcttaattcttctgataccttgcaacatgtttcttcaagtgctaccctgattgcggcactggttgaaccttcaactaaaacagcgacgaagtgaggcaaaactcttctccgagacctaccccccttacagggagtagtcttactttcgcgtggctgggatcggttgaactgttgtccttcaaatataaccaacacttctctgttttgcgaagagccctgactttgaaaactaaaaacttcgccgatcgatcaaaatagagtaacaacgatgcactttcatcccattaagatttggaacttaaccctcagttgctgataggaaattccacataaggaaattctcatttagcatatgatctttctaactcttgactacttccccatcagttctacggctggcataactagcatgcttctggactgacgtcggtgtcgtatgcttggacatattgcatagtcgacattctttgaagcacacattgaccacttaacggatcaaaatcaagagtccttctcacgacataaccccacacgtcgatttttttttactcttcctggattgatgaactgtaaaccctgcaactgctttcgcaaaaatactgtagtctgcacgactgccggaaattgactttgatgctgccgagagttcctgttctttgatcataacaacttcgctttcatatgttcggtaaagatgatttgttgaaaagagattctatgccatataccttgttggctacacatttctatttctggaccaaactctcgtatcttcctgactcatgtatggaacaatttctttttttttcaacttctgagaaacattgagatgattcctggaacttatactggttgccttgaactaagcaaacaccttctgaattcatggtcaccacactagggcgtaatcgccgattaccatcctgtaacagcttccaaggttagagagtttccaagagtttctatatgatgtcactttcaaatattccatccctcttttcatttgagtaccactgatgttgcctttagagagatctcatcatgtcgagtgttgagggtctaaccattttcactccgttggttaaccattcctctattggcttgcaaacaggttttggagctcaatagaattgcgatgagttagaagagaaacccttggtttcttgagacactgacagatacccattttgatttgcttttgcatgctgaagatgaatcataaaaggagaggaactggctgactcatattttattcaatatttccttttcattacatggctaccataaacatatatgtacaatgagaagtactacaaaatcaaacaattgtagactgctgctgattagaactgcccttttcacgactgaacttgaaaagtagaagtcttgtctagaactgctattgcttccattattcaaacctgactgacttgtttctttagttcctactaccagaagtctcaccgggaacgttgctctgcttgttgatcttcgatggtggaggggcaactgtcttgtcagctgtaacgggtaggatcttcttgcccgtggggttaccgaacggtgatttgtcgatgggcctccagattggagcaatacgaggtgcattgctagaactgacaacagttgggcgacctggtgctgacaacacttgccgcgggtgctgacgaaggggcgtaccgcctctttgtagctgtagcgagctgttgttctcctggcattgcttacgctgctggcgttggtgctgtaggcttgaaacgattgctggtggaacaatgtgacctttgacggtgcccttgacgataatccgttggggcggaggttgcacattcaggtgtcgattggtgtcatgggcagtgctggtaacttgtgaatcacgacgaactgcctttgctgctcttggaagaggacaatcactgaaacgatgtcctggcttacgacagttgtgacagaatcgacttgcttggtctcggggtgcaggcttctgattatgcactttggcagctgaaacgggaacaagcagagacttatgaacatccttggtgacgttgcttcttccatggttggcttccactggaactagagttggaggaagagcagaaggattgtgaccgctgttgtcgattgtcattggttgacgaatgggttgcacggttgtcccttgttctttcttggtcttagctatgaccgcgtttaactgacagtccttaggcacatgatctgttccttcacacaagaaacatgtgaccttccttaaagggaatgcatctgagtaatgggtatattcaccacagcagcatgtggggaggcataaactagcagtgtgtccgactatcccacatctagtacatgctttgaactccaatcctctttccatgaaactgttaagggtcgtatcatcatcgtcatcagtatcatcatcatcgtcatcagcagaaaactgctctcctgattcatcatcttcgggtctgggcgaaccgtactttatgagatgtcgggttagctggcgtgctccacggaaggtatttcttcctctctgacgcttgggtatccttgctgcgtcttcaggagtaaattctgaacttgtgatgatcatggtcctgccattatccatcttccatgtcaccttcctgttcgctccagagttgggctgcaaagtaccatccttcttgtcggtagactgacttggagcttggttactccctgggcactgcttctcgtctttttcaggtgacctggcgaacaccttccatggacagttccttacataatgaccttgctcaccacagtcataacaggtagcacttactttcctttggtctgacgatgacttggctgtcgttatcttcggggatctggacagcattttgacaggggtcttcggtgccgatattgggaactcctgactctgactctgattcgggttccgggctggcatctgatctggcacctgcggtgggtgacattgacgtgactcctgacattgtcgttgcatctgttgcatctggtatatttggtaccgacgtcgcatctgttgtaacaactcttccactgtctgagtttgattagccatgacttggggttcaggctgatcttcaagaggctgacgtggaatactattagaattgcactgagttgccccatgaaactgacggggtcttgatccgatgaaattgtccctcatgcagaccatctgctgcaggcaccagagagagggggaaatgggaggggttactagagaggaggtactaaaccacttgcctattgatctgttgtgaatggattttatgattcaagttgtttaagcaaacaacctagtatggtcgcatccccaccagtgatgcaaaccatacccctacacacaagcaaacaacacacgatctagaagctaacgaaactaccctcccgggaaggattgggtttaggtcatctccgagaaaacttcacttgatcttcgcggaacgacgactttgaactgatcttctcgctccttgcatgaagcttgaggcttgacttgacttgacttccgaacagacatgaagttgacggtttctcctccatgtttgacaactaaaagagttggagggacagggaggagaattttcaaaatcgtttcacaaagaaatgccaaagggcgagaggagacattttgcaaatagggttttcagaaaacttgtccttagggtttgaccatttggctcaacctacagtcaagttggctctgataccactttgtcacgcccagaaatttaacccaaattttcagactattttgcgtattaaatccctatccaggaccagccagggtacacaaaacgacaagtaatatacagttccaaacgtaaataaagcgtaaaatacttacggaagaggcacttagtcctcacaccgaaacagaacgatagcagcggaaaaaggcgatcctagcggggctcgggaaggcgggatcgaggccggacgtggcggaatcggccggcgaagtggggcgccgacgtggggtggtgaagggattaaccggcgccgattttcgctgggagagtggggagaaaggtggaggatgtggaggggatcgatttcacgcgctcgtgggacggggtggagcgcgggagccgcggcgtcgtggggcgaaaccggcggccatggcggcagttggggcgacgggaggttggggaagaagatgacaggtggggcctcgggtcccacctgtcggggagagagagaggggaaaacg

SEQ ID NO: 72210 - DNA, 1598 bp, Oryza sativa
ttaaattggtttaacttttatttaatttttagaaaatgcattattaaatgatttttaatcccgaacgaaaatcggggcgttacaagggttgccacaagtcttcactcatttatgagggaatgacagggctgtcctccgtgtcaggcgggggatggcattgggacccactcaaggaccggttgctgcttagcttccgggggaaggcacggatcaatgcccggtcaaagtggagtgggtccccccccatggagggttaggtagaggcagtgcatgtggtatccccttgagctataaagggaggaccttgcccaccgagacaggggggacgactctcagaaaacctgaactctaggagaaggaaagtgagaacgctctctggagtaaaggaacctttgtaaaactcatccataatcccaaacacaggagtagggtgttacgctccatagcggcccgaacctgtataatccgactgtgtgcaagctagccgagagtcttaggggcgaatacgtgatttccaagaggcgagcctctgcccccggccgaactcacgaaaggggggtctcacgactccccgctatcgaggatcttccctcgacatcattattcaagaagttgggacgtggagatgatgagttgaagaagaccaacatgactctcaacggcttcaatggtgaaccaacggaggcgaaaggtatcttttcggtggagcttaccgtggttaaaaagacgttgccaaccgctttcttcatcgtcgatgtgcaaggtaactgtagtgttattttggggcgttgttggattcatgccaattgttgtgtgccttctaccttgcatcaatgtttaactcaatgggacggcgatgatattgagattgtttaagcagatacatgcaatggccgatgcttcaattgagtgcgaacatgggaatcctacaacatttctaagaatggtttttgtaacattctgaaaattcgaccaacaaaatcaaagactccaaaaaaattctgatcttcaaaaaaaaaactttttaaataaattgcatcatgccaattttattcgaagattttattggattttgatttcggatttcatcgatcacaaatgggaggaaattaactaggaataaaccctaaaaatcaagtgggctaaataaataattaaaatataaattaaaataaagattaggtgggtttggaaataaataaaatgttatcgcaaccatattaacaacaattaaattttaatacgatggaatgagaattaactttaattaaaaattcaaatgaattatataaacaaaatatgagtgatattaaattaggtgaatctttagttagaataatataaatatggggtaaaacttcatttatgcaaaaattaagaatttcggaatcaaattcatatgagaaacactctaaaatcggtttattggaaaagtgcactgttcattgcccgccacgtgttcgacctggtccccagcctttcccctcccctgccacgcgcgccgctccgcctcccctctgccgcgtcgctcgccgtcgcatcaccgtcgtcgtcgcgtcgagccccgtgccgagccgcgcccgtcccgctgccgcgcc

SEQ ID NO: 72211 - DNA, 637 bp, Oryza sativa
taaactcattggaaaaatactcgccactcctatcagaactcaaccgtttgattttcctttcaacttggttttctacctcagctttataggtcttaaagtaatgcaatgcttcatcctttgttttcaatagatacacataacaaaatctagtgcaatcatctatcagtgtcataaaatatttctttccccctttagtcaacacgccgttcatttcacgcagatcggaatgaacaagttctagaggtgccaaatccctcgcctcagatgccttgtgaggcttgcgaggttgtttcgattgaacacaagtatggcacttggaacctatgaccaaagtgaattttggaattaaactcatgttagccaagcgcgtcatacaacggaaattcacatgacaaagtcgcgaatgccacacattggactcatcattctcgctaatatggttaacaacattattattattacacatgtcatccaaagaaaagcggaacaagcctctgttgtcataacattttccaataaaagttccatatttagatacgacacatttattggattcaaacacaagtctaaaaccttctctacacagtagagagccgctaactagaatcttctttattgaagggacatgttgcacgtt

SEQ ID NO: 72212 - DNA, 754 bp, Oryza sativa
gagtagagtgtccactagttgggggtttgtttaatctagggtggaccagggaattattaccattaccattattagggtcttaccaagggtaataggccttggttaattaaaccatgattaccccggaatttaaattaagcgataatgcaataatttaaatcaacataattttataaactgggattcaatatgttcaaagatgatgtgacttgccttgctcgctttcccaaacgtcggcttcaacctccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaaggttatatgctctttaaatgaatatttgcaaatttcttcatttaaattttaatttaaaatttggatttattgcgtcagccgaggggaggggcgcgcggaccgggtccatgggagtggggcccacgcggcagcctcacggtctacggtggaccgggtgcacccggctcacaccggccggcgccgtgggtcccacgcgtcagccgcacccgagggcgcgggcggctgacggccgggccccacatggcagccgcggggcgcgcccgaaggcggccacgccggcacagccgacgggaggcggcgcacccgcgccccgatgg

SEQ ID NO: 72213 - DNA, 4525 bp, Oryza sativa
tttactgcaaccctaaccctttatattataactcccttgtactcccttgcatttattatgcacttgtgggtgtgtcttgttgagtacggtggttgtactcagtcttgctcaatttttcccaacctagaagaggagcccctggatgatgaaggctttggtgtctagctcgtgcctgccgtcaagtgcctgtggtcgtcgccctagtcttccgctgtttctcgtttgtctttgtgtgtgctgggccttcgtcgcccatgtaataaattatctatttacgcttccgcttgttaaactctgaattgtatcaactcttggtgtaccttgcctcctgggacaaggaataatacacgcacgaaaggaacgcccgttgggttaattccggtcatgacaggaactctcctagatggttatagatgtcgcaacgaatgaaccggcacaagtccgcgcacaagttgataagcgttttctgatcgaatcggcttgcattataatggatgctcgggagctatggaaagtaaaagacaaatgatttgtgttacaatcgacttaaatgaaatatttgcaacatctaaggagcaagatgacttacatttgtaaactcagttctgtatctcccgcagaccattatttgcaatatcgaagggtcattcacatagaaaacctgagcaacacactcaacaagaaaccacggatcatccttgtgtcctagcttgctacgatccacaatcatcaggccgtagttatcgatggatacgcctgttgtgtctctgacccattagcatcgtagcactgggatcggtatgtttaggccatagtcaagctcccaaatgtcttgtatgatcacatagcaagacttcttcttacctgatgcgtcaaacgcctccacccgaactccgctattctaagctgtgcttttcttgtccttgaacatcgtgtaaaacctatatccgccgatgtcgtatccttgccatgaggtcacaaggctagttgggccatttgctagcctgcgcaaagtttttcctccagcgattcacccaacggcagatctttctccttcaaccattcaggaaatttccgtttctattcttaacatatccaaatggccattcttctagggttgcaggctcttatcttgttcatgtgttcctgaatgtacggctcgacgatggcgaactattgcaaaacgctgctatgtgcttccgctacatctttgaagtcctcatcataaaaccttttctttcctatgatccccgtcccgactaaccggcccttgtgtaaaggggggttacaccgatcgattcggcgtccttcatgtaatcaatgcagcattctaccacctcctcagttgtgtacccctctatcattgatacctccggatgagctcggttacggacataccctttcaggacggacatgtacctctcgtacgctcacatctggtgtaggtacaggggaccaatctcgaaaatttgaggtacgatgtggataatcagatgctccatcatgttaaagtaagctggagggaaaaacatctcaagctggcacgctgtctcgattgcaaatttttggaggggtcctaactcttcaggatcaaaaaccttctgtgatactcgattgaaaaagtagcacaacttggttatcactaaccgagtgtgaactggcttgaccgctcttatagcaatcggcaggaagactgttaacatcttgtgacaatcatgagcattatacccagagatggtcaaatctttcaaagatacaagttttctgacgttcgctgagaaaccagtcgggactttcacactatgcaagcatctacataatttttttttctcttctggtgttagtgagtagcaagccggaggaatatcgatcttcccatttggcagctcttttgggtgaagctcatgccttatgtccaaattgacgaggtcggtccaggacatcaacccatctttcgtcttactcaggatgtccagtaaagtgccaatggtgctatcaaacacattcttctcaaggtgcattacgtcgatggcatgacgaacctccaggtctttccagtaattcagatacctgaaaaatattgagtgcttcttaaaaggtaagttactttcctctacaggtgcatcagtattttcctgatccgtccgtttcttcctcttgatgggcttcttctttggcttgccgaacacaaccttaatatcttttgtcagctcgaagacagagccaccagttcgtgtgtccggagctagatcgttctctactgtattgtcgaataatctggccttcacatggcacctatgcctctgaggtaagaaccgacgatgacgcatgtacacacccttggttgacgaggtgaggtacttgtacgacatcttgtcgatacatatgagacatctgaacttttccttaaactggcccgagagcgaaaagtttgccggtaagtcgttgatcgtaacgaatatgatggcatgcagagtaaaatgttccctacggtacttgtcccacattcataacccttcctcccacagttcttgcatgtcctccatcaatggttccagaaacacatctatgttaatcccaggctgtcttggaccttgtataaggatagacaaaagaatatactttcgcttctggcaaatccatgtaggcaagttgtacacggttagcagcactggccaggtgctgtgtgtgctgcttaagtcaccgaacgggttcattccgtccgtgctcaatgcaaaccttacatttctcgggtcctttgcaaattccaggtgtagtgcttcaaagtttttccacagtcgagcatcggcagggtgtcgaatcttaccgtcatttttcttaccctcctagtgccatcccatcaacttggcatcatcacggttggaatatagccgctttaggcgatctttcactggtaggtaccacaccaccatcctaggaatcttttttttctcatccaccggtgcatcatctttgtcgaccacctctccatcggaggctccgttacccgtcttgtaccgactcgtcccacatgttgggcaagagtctaaatccgcgaatttcttgctgtacagtatgcaataattttcacatgaatggatcttctgaacacctaaagaaaatggacatatcaatttctacacttgatatgtgttcgttggtagcaggttcggcttaagaagcataactctcaaaagatccatcaaatcattgaagctagtgtccgacaattcatttctggccttcaatctgagaagttcaagcaccgagcgcagcatcgaatagtccttgtcgcatcctttcgcttcgtcatacagaaggtccttcgctgctttctccaacgcttcccaattgtccaaccctcatcttctaccagttaggacctctggttcaacgtgccacaacatatcttccagatcaaattcaatgccttcattctctatatgtcacgaccggaaataacccaacgggcgttccttatgtgcatgtattattccttgtcccaggaggcaaggaacaccaaaagttgatacatttcagagtttatcaagcggaagcgtaaatagttactttattacatgggcggcgaaggcccagcacacacaaagacaaacgggaaacagcggaagactagggcgacgaccacaggcgcttgacggcaggcacgagctagacgccaaagcctacatcttccaggaactcctcttctgggtttgggaaaaattgagcaagactgaatacaaccaccgtagtcaacaagacacacgcataagtgcagaataaatgcaagggagtacaagggggtcataatataaagggttagggtttgcagtaaacagcattaaaagtcacttagttgctcaaagctactttgtaaacacggtcctagagctatacaagattattaatcaaggccgtgaacccacatgaacctgccttaacccaaggcctacgatgattcagaccgaactggcaacccgaccctgggtcccagctcgtcccaagccaacccaggccaaccattccacattttagttgttaagcaggttttaagaattaaaaacactaacttgggtacattgctcggcttgcccataaccgagggcgcagctattcgaatagattataccctgatcagaggtgtacatctttacccacaagacacatcttcctcacgtgtaaccacgtgccacataccaccacggtatacggacggaagacatgacatagtttccaacccatcctagccataaacaagagtaccgacccaaccccacctacggccggaacccccgggacaggtaggcaggactgagcccctagcagcagacaccggccctgtgccatgacatctcgactaccgggccgcagctcgtgtagcccttatttgccctagagatgttcatcgacccccgacttcgtacatctccataccggtacttttggttataaccaaactgagccacaaactaagccttacccactaaacatgtcgaagtacggtagtgctttgcaacataagccc

SEQ ID NO: 72214 - DNA, 14470 bp, Oryza sativa
ggagtctgatatggaacttgttataaaagttagccgatatagcggaacgacgactaaccttcctgatcgcttcaatcattgatcacccaagacacgccagatgacgacacaggaacacacgatatttgttaatgaggttcagctgaagcctacatccccggggctctgattatgggcgctcctccccaaccaatatagctcctagccgctacgagtccatggccacactgccatcatatccctgcatgtctacactacattgtagtcgccatggttacattgtggtgcccccctctctatttaagagagttgccgggttacagagtccgactctaactccaccccctaacacctattacaactccaagcccaactgtaaccaaataggactagtatattcgacacctattctaacaaactccaccttggcgaatatacgccacctagaaatagtagaatcaccatgccgatccacctgtcctccagacttgggttgtcttcttttgcagcttcaccgcaagccgcaagacgagtctgcgccagacccgccgccaccaaaaacaattgctatcccagcaaccgcttcctcctggactccacctacaacagtgcaccctcgcagcttgtaaagatgcgactccaccttctctccagtcatcacagtcatcttgcccttcatgatctccatggtcttcctattccgattaccgcggaatattaacccttcttcatgcaaggtttcaagcgaaatcagattcctcttttgccctggtacatgcctgactccctgaagaacatgttcacctccatcttctagcttgattttgacttcacctactcccacggccggataacttgtgtcatcgcctaagtagacaaaaccaaactcaccagacttgtatgaagagaaccactccttccttggcgtcacatgaaacgagctagctgaatctaatatccacgcttctgcatccttagactgtgcacttgacatcgtgagaagatcacaaccatcgctatctgagtcatttgaagaagtcactgtattagcctttgcttttcccttcagtgttggacactccctgcttatatgcccccactcatcacatctgaagcactgcaccatcttcttctttttgttcttctttaccttatgcccagcatgatcttctttgactagcaaaccctccgcttgagatgtttcaccctctttgttctttctcatctgatcacgagccagcaacgcagaagtgatatctttagttttgatggtctccttgccgtacgtcaaagtagtcaccacatgctcatacgattcaggtaaagaacacaaaaaaactatggccttgtcttcatcgtcaacttccacatccatcttcacaagatctgtgactagttgattgaaaacgttcacatgtactgtcagatccgccccttcctgcatctttagcccatacaacttctacttcagatacagtttattggttagaatcttggacataaactgagcttccaacttttcccaaattatctttggtgaggtctccaccatcacatggtacatgacctgatctgagagacatagccttattgtcgcagccgcctgcaactgcatctcctcccaatcgtcatcctccatcttggccggtttgacacccttcaaagcctttgaacctccttgttgagctaacaaatctttgaccctagtctaccacaagccaaaatttccggagccgtcaaacttcaccaaatcaaatttcatacctgtcggcgccatcttgccaacccacgacctgactggtctgtcgccaccagaatactcgccctgctcagaaccgtctgtattcgtcttcacaatcccgtcttgtgatccgatctcagacattcaatagcaaaccgtgttcgctataatccgatgtgaccaatcttccaccctcgatgtgcctctactccgcatgatctcgtcggcctggcttggtcgacccatacgcgcgcactttgtcacgagcctctgcacagcaagcctattgagccccttgtaccatgtttgaccaatgtcctgccgagccgcccaaaaatcgctgccgctttgttgctttggttcggctctctcttcggctgcctatttaaagggcaagcaatacgagtctgatgcgatcacgagtccatatccatacataactctgaatccgactccatagcaactgcggtcgagtcggccttgtccgactccgacaagtcattttatcatccaactcctctactcgatttcttttttggctcatcaatctgtcagactcccacggtacaaaagtttccatatgtatgaagcattagtactcaagggcgtgcctacgttatactacccggtgtcataggacaccgggtagattattcaaatcctatataaattacactatattaattaatatattagtcaataattagataattagtatgtattggacccccggtaatttttgttctgggttcgccactgttggtactgctgccccttgatcccttgtgcacgcacgatatgcatgccctgcatgctcatgttcacgtgaatatgctcaagccatgcacgagttccaaagctgcagcttccctgcccttgtttgcatgcaattgctcgatttggttttgcttcttgcctttgctcgttagtctttgcacgccatacgtataagacagcacctgtgctatctgtccgtgcctatgcacgcaccgcagtcgcagccctcgtgttcaccgtccatgaccccgtcgtcccggccctccacgtccgccgcgccgcgccacgctcgccggtttcgccctttcatcactggcctcctgccgccgcggatccgcgatcaccacgtgcgtcgggcgcgccgtccatggcgctacccctcagatctctccagtcgccttcggccacgcccggccccgtcttccggtcattttccgccatcgccggtctgatcgcgagcgaggtcaccgcctccgcaacatcctcgttgtcgccatcgatctcatcgccacggctgacgatctcatgtcgatgcgtgatccccacctcgtgtttcctcctccacatgtcttcttgatctaatgctgaaaccttctgctctgataccacttgttataaaagttagccgatatagcggaacgacgactaaccttcccgatcgcttcaatcattgatcacccaagacacgccagatgacgacacaggaacacacgatatttgttaacaaggttcagctgaagcctacatccccggggctctgattatgggtgctcctcctcaaccaatatagctcctagccactacgagtccatggccacgctgtcatcatctccctgcgtgtctacgctacattgtagtcgccatggttatattgtggtgcccccctctctatttaagagagttgccgggttacagagtccgactctaactccaccccctaacaccttgtcggtgacatggggccgagggtatcgtgactagaggcttgggtagccgcggtcacccacgtgccctgacccccacgggggggggtcgggcccgagggtgacgtggccacccctccctctgtctccccgaggggtcgggccgctcccgcttcggccccgagggctggggcgccccgaccccctgtggttttggcaccacgtgtgtgggttaggtgagcacagcggcgctcacctaaccgcacttatagcggattgacgagcgcgtcacgccgcatttaatgcggcgcagtgcgcgcttatccggtccgtgaccagtcgcagtgtgtgaccggtcacagaccggtcagatcgcgggttaggtggcaacaggcggcctgtcacacgcctcgccccgtcacgtcgaaatgatgatagcctctaggcactcgtccctagccggagccggcgtgctagctcctggagtgggtatgtcagtcccggccagattcataccaggcttcatcgcaaccattacaaggaagtcattgtatgaagaagggcagacgtgtggcatgctaaactgacacgtggtagacaagaatgactggtttgtgactggtctgacgccggtcacgtcatcggcagacaaccgtgctcccacattgcatctgcttccggcggagtggaggtaggtatgacccatcccatcggagggtcattcggacagcggccattgcaaatctccacccattaatgaaggaatgacagggctatcccctgtgtcaggcgagtgacggcgcaaggcctcactcaaggacaagctgtgatttagcttccaggcgaaggcgcgagccaagttttggtcaagatagggtgggttcccatccaaaagaagagtaggtaaaaatggtgcatgtggtatccccttgagatataaaaggaggaccttgcccaccgaagcaaggggacgagaaaaaaaagggagagactctcagacgactctgagaatacctgagctcgtagaggagagaaagaagaagagtggttctagagcctgaactctcttgctctccggctctctgtaactctttcacacacagatccaccagaacacaggagtagggtattacgcttctcagcggcccgaacctatctacatcgcccgtgtcttgtgcatttgctctctcacgaacattccacagatcgagggtgaagaacctcacttagcgcccccggccgaaccggcaaaggggggcatgcgcggtctcccggtgaggagccccacgctccgtcatctggcgcgccaggtagggggcgcgtgtgtctttctaagccctcgtcctctttcgtgtgcgccaagcttccctcgctcagcccaatggccgaacaggcagtggcgcacaacctctctccgagcgctagcggtgacgacggggagcagaacccgcgccgtcgagctcgtactccaccgtccccctctcgccgaagtcttgggcgggaggaggcgttcgaggaggtcgaaagatccgcgacttcaccgcccacgggcgatggagaaggacggcgagacggggagcgtcgcctcctcgtctacggcgatggcagcacgccccagggcgcgctccaggctgcgggcgcgctcctgcgtcccccgcccgtcgtccccgatccagagactccagcccgacgttggctggatgacgtggccaacttggtcatgacggcgcagcagcgcctaggcgccggcgggcggtcctccgccaccaaggcctctggcgctgctaccgccggctccgtgtcgtcgaggcggagggcgcggcgagcggcggccgttacccgccgttcgtccgccattccttcgtcaacgcctccgacccaagaagatgtgcgtggggggccagatgcccacctcaatatcgagcgccggcgcaatggtcgtcgtgctgcccacgcaacggagggcgcttcctcatctggagcgccacttcggtccgggcacgggggccaggcccccgtgtccccggttggcggtgccggctgtcgagcctttgtggcgagccttcgaaacgtccgttggcccctaaggttccggcctaccatcaccgaaaaatacgacggaagcgttaaccccgccgagtttctccagatctacacgactgggatcgaagccgccgggggtgacgacagggtcatggcgaatttcttccccatggccctgaaaggtcaggcgcggggttggctaatgaacttgccacccgcatcggtccactcttgggaggatttgtgccagcagttcaccatgaactccagggcacatatccgcgcccaggtgaagaagcggacttgcatgcgggacagcgaagggacgatgagtctcttcgctcgtacattcaacggttctgtcaagtccgcaacaccataccatgcatccccgcacacgcggtgatatacgcgttcaggggggcgtgcggcacaaccgcatgctcgagaagatcgcctccatggagccccagaccaccgcggagcttttttagctcgcggaccgtgtggctcgcaaggaggaggcctggacctggaactcctccggttccggtgtggcagcttcggccgcccctgggtccgccgctcggtcagggcggcgggacaggaggaggaagaagaggtcggcccattccgacgacgagggtcacgtcctcgccgtcgagggcgcttcgcgggccacccgaaaggggaggcctgcgagcgacaaaaagaaggaggccggcgctcccagcagggagcgcccgactggcaagtggtgcactgtgcacaacacctccctccacgacctcgcggactgccgcgcagtcaaaagtttggctgagcggatgaggaagtgggaggaggagaggaggcaggagcgccgtgagggcaaggccccggcggctcccgccggcaaccggcgaggtgaggccaagcagaaggccaccgccggggacgtcgacgatggcgacgatgacctggggttccaggagcctgaggccaccgtcgccaccgtcgatgggggagcgtgcgctcacgcttctcgccggagcctcaaggccaagaagcgagagcttctggccgcggcccctacccatgaggcgacgcggcgggcgtggtggtcggaggttgccctcaccttcgaccagaccgaccacccgccgtgcgttgcccggggagtacagatcgcgatggtggttttccccactgtttgcaacgtgaagttggggcgtgtcctcatacacgggggtgcagccctcaacatcctttcccccgcagcctttgacgccatcaaggccctggggatggtgctccggccgtcccagccgatcatcgatgtgacgccggggcacacttggccgctaggtcatatcgacctcccggtcaccttcggtggttccgccaacttccgcacggagcgggtgaacttcgatgtggcggacctcagtctgccctacaacgcggtcctggggaggcccgcgttggtgaagttcatggcggcggtccactacgcctatctccagatgaagatgccgggtcccggtggccccatctccgtccatggcgaccacaaagtcgcgctcgcttgtatggagcagcgcgcggaccacctcgccgcggcgtccaagcccgagggtggcgacgagaggctcagcacctccgtccctgccgccccgaggcagcggatgatcacgtgtgacgaggtcccggtcaaggaggttgccctgggcgacggcccgtccaagaccacacgaatcggtggtcttctagacgacaaataggaagacgcgctcgtctccttcctgcgggcaaacgccgatgtcttcgcctggagaccggcggacatgcccggggtccccagggaggtgattgagcaccgtctcgccgtgcggccgggcgcaaggccggtccggcagaaagtgcggcggcaggccccgaaacgtcaagccttcatccgtgaggaggtggcgcgacttctggaggccggattcatccgtgaggtcatccatccgaagtggctggcgaacccggtcgtcgttcccaaggcgaacggcaagcttcggatgtgcatcgactacaccgaccttaacaaggcatgtcctaaggacccttaccccctgcctcgcatagatcagattgtcgactccaccgcggggtgtgaccttttgtgttttctagatgcatactctggttatcatcagattcgcatggctagggaggatgaggaaaacactgcattcattacccccataggaacttattgttatatgacaatgcctttcgggttaaagaatgcaggtcctacttttcaacgtactactcgaatttctttgggtaaccaaatagaacgtaatgttgaggcgtatgttgatgacttggttgtgaagacacgcaaccaagagaccttactctcggatctagcggaaactttcgaaagtctccgctccgcccgcataaagctgaaccgcgataagtgtgtgttcggcgtgcctgcgagcaagcttctcgggttcttggtctctgcccgaggcatcgaggccaaccccgagaagatacgagctatagagcggatgcggcccccagcaagcttagggacgtgcaatgcgtcaccggctgcatgactgccctaagtcggttcatatcgaggctgggagagaaggcgctacccctatttaagctcctcaaacactccgggccgtttacctagacggaggaggctgagcgggccttcactcagttgaaggcgtacctcagttctcccccagtcctggtcgccccggagccagatgagctgttgctactctacttggcggcaaccccgcaggtggtcagcgcggcgttggtagtggagtgcgacgaggacaaccctcactccgcgcatccccaccctgtgtcgactcgacccgggagagagcagggaggagaggcccccgagccgaacagcggcccgaggcccccgacggccggagcaggccctccgcccgcttgtccgacggtgccaggcgcccccgacccccaggatggcctcggggccactgcgggaaggccgcgcctgtcgccctctgaccccgaggtcgtcggcccaaaagtcgagtgcgcccctggtggcctctcggacgaagagcgccccggagatgtggcccctggcgaagaggatcggccccgccgaaaggtgcagcggcccgtctacttcattagtgaggccctccgggacgccaagacccgataccctcaggcccagaagatgctttatgctattctgatggcctcaaggaaattgcgccattatttccaggcgcatcgggtcacggtggttacatcttaccccctcggccaaatcttgcataaccgagagggtactggacgggtggtgaaatgggcaatcgaactctctgagttcgatttgcactttgaaccacaccacgcgatcaagagccaggccctcgctgactttgtggcagagtggaccccagctcctgagcccgtctccgtccccgaggccagctcggacccctcgcagctgcctcacaccgcctactgggtgatgcagtccgacggctccctgtctcttcagggcgccggtgcgggggtcacgttgacctcgccgagcggagacgtcctcagatacatggttcgcctcgactttcgggcaaccaataatatggcggagtacgagggactccttgcgggacttagggtggcagctggactggggatccgccgcctcctggtgttaggcgactcccagctggtcgttaaccaggtctgtaaggagtaccggtgctctgacccgcagatggacgcttacgtgcgccaggtgcggcgtatgaagcgccatttcgacgggatagagcttcggcacgtgcccagacgggataacgcggtcgccgatgaactctcaaggctcgcttcctcgcgagcccagaccccaccgggcgcctttgaagaaaggcttgcccagccgtcggcgcgacccgaccccctaggggagacggatgcgcctgaacggcccccgtggcccgtcggagtccaggcctcgggacccgaggggagcgctcccagctcccttagattgattgcttggatcgctgagatccaggcgtacctcgcagataagactctacccgaggaccgcgaagggagtgaacgcgtccagcgcatctccaagcgctacgtgctggtggaagggaccctttatcggcgcgcggctaacggagtcctcctgaagtgcattcctcgggaacaaggcgtcgagcttcttgccgatgtccatgaaggcgagtgcggagcccactccgcctcacgcaccttggttggcaaggcctttcgctagggtttctattggccgacggctctcaacgatgcggtcgacctggtccggcggtgcagggcgtgccagttccacgccaggcaaacccatcagccggcccaggccctgcagaccatacctctttcgtggccgtttgttgtctgggggctcgatatcctgggtccgtttaggcgggccccgggcgggttcgagtatctgtatgtcgctgtcgacaagttcactaagtggcccgaggcttatccggtcgtcaagatcgataagcactccgcgctaaaattcatcaggggcatcactgctcggtttggggtgcctaaccatatcattacggataacggcacccagttcactagtgagctcttcggtgactactgcgaagacatgggcatcaagctctgcttcgcctcccccgcccaccccagaagcaatggccaagtgtagcgcgccaacgcggaaatcctcaaaggcctcaaaaccaagaccttcaacatcctcaagaagcacggcgactcgtggatcgaggagctgccagcagtgctctaggcaaaccgaaccacgccaagccgagcaaccggggaaacgcctttcttcctcgtctacggcgcggaggcggtcctcccatctgagctcaccctgaggtcccctcgggccaccatgtactgcgaggctgatcaagatcagcttcgcagagacgacctcgactacttggaagagcgaaggcggcgcgcggccctccgagccgcgcgctaccagcagagcctgcggcgctaccatcagcgccacgtccgagcccgatcactctgcgtcgacgacctcgtcctacgccgcgtccaaacgcgtgctggactgagcaagctctcaccaatgcgggagggtccgtatcgagtgatcggcgtcccccggccgggctccgttcggctggccacgggcgacggcacagagctgcctaacccatggaacatcgaacaccttcgtcgcttctacccctagtgggggtcgggtgtcaggtctcgggctcaggccaaccccgcacccccccgggcgtgcagggttggccgggggctaccacatgcatatacttatcttttttctcttccgtatttcaataaaagctttttcgatttcctaaggactgtgtctgtgccattgtttccttttgaagaatcttggcttgaattagcacgctcgtgctcgatcctgccctcggtgtcccgggccggctaaaatcgccaaaaggggcccagaaccgagccgtgccccggggcgtggtgaactccgggggggaattggcaaaggcccacaatcgggtcatccataaccctcggtcaccacgctcccggcttggacagtctcgacacgtggatctccccaggcactagccccgacccgcgccgtttgaggctgggacctgggcacgagcccttgttcaagccaagacacagaaggaccgcggcacagaccatcctcgtctcatacacacaacaaacagaattgacacagaaatttcctctttatttgattgcagattaaattagtctatacaagaagggggcccgaaggcctcggaagaggaaagaaaaaactattaagatagacgggggcctgggggctcactccgacgcgcccgggtcgccggcctcgtcgtcgctgtcgtccacaccgtcgtcaccgccctcctcgtcagagtcgagggcgaacgcgagccgaggggccgtaccctcgaagctgtggacgatgtggtcggcggcgtcccggacccgcgcgcgcgtgccgtcctcggttccgggagggaactcttccagcgttgcccacggggagaagtcagggtccctggcctggtaacttgccagtacgagctccaccgccccccgggcgagatccctcgaggatgacttgatcgtctcctcgagctcctcggggagccgcttgaggaccccggccatctctgagaggcgctgggcgaggcccccctggttggcggcgtacttcgcggttcggccgccccagagacccgcttgccgcccggcgtggtatagacgggagacggcgtcccgaagcatgccgggccccacctcgctcgccaagcggagggcctcgacctcccctgcggacgagtccagcgcgccctgcagcttggcgatggtgtgttcggcggctgcgaggagggcggctgggtcgccatggcccgcggccgccccgccgctgtgcgctctcgcgtccaactccttcgctcgctcctcgagctcagcggcacgctgatccagtgcggccctctcggcgcgggcgctttccagatcgcggcgcgcttactcctcccgcgctgccacgcggagggactgtccgccagccgctgcgccgcggcctcggcctcctcgagagctcgctcccgctcggtgagcgcgtcctcgcggaggcggagtgcggactcctcttcggcgcaggcggcctcgtgcgccgccagtgttgcctcccgggtggcgacggcggcctcgcggtccgccaggtccctctccttcgcgcgggcgcgctcctccagcaccgtggcgcgagcctcaagggcctcttcgcgctgccgggacgccgcctcgatctccgctgcccgccgttcccgggcagcgacggcgtcaaggactccccgggtggcgtcgagcttcttctctagctccgccgcccgactcccgtattggaggcggaggtcgtcccgcacctcgtcgagcacggcggtggcgatgagggcagtctcccactcctcctccacctccctggcgatctccgccaggtccctgcgacgggcctcgagctcggaagcgtgccggcggtgtgccttgcggcccgcctccaccatggcctccaccgagcgccgcccctcctcgacgcgcgcccacgccgcgtcgagctccgcccgctccgcctgcaggacctccatctgggcacttaacccgtctaacaccgtagtattcgcggcggccaaggcctgcagaaggggctctgcgctcggtggggcagcggaaggcagaggggagagccgtctcggtgagggtgccgcacggctcggcccgccgatcgacgtgccggacgcggtgtactcccaggtgccccgggcgcgccgttggagcggcgcgatccggcgacgaaggtagtcgccgaacaccatggcccccgtaagcccctgggatcgcagacccgccaggcggtcaagaatggcgtcgtagccgtctcccagatctaccgtcgcccgccagctggaggcctgcgccgggggctggctcggaagtcggaggcgcgcttcgtcggcgaggagggtgtagaaccaatcgctcttccagtcgtcccactttttgcggaggacgcagggaatgtagcggttcagcacctgcccccgcggctggaagtagcagccaccgactaccgacggcggcgacaccggctgtacggtgaagaaccaccggaacagccggagagatgggcgcaccccgatgaacatctcgcacaggtgcgcgaagatggccaacgtcattaccgcgttgggggtgaggtgcgccatctggagatcataaaactccagaatatccatgaaaaaagaagagaatggcgggaccagccctgccattgcgaaagagaggaagaagacggaccgccccgggtagtgtggcgccgggcgtccctcacccagcgcgaccacctcccggccggtgacagattccggcatgaatcggcgcggcagcccggcctgcctctcgctcacgatgcgggaaggcggcagcacgctaccgtcgagcggtgcggagccccgtgccatgatgccggcggaggaggagcttgagagcgagtgagtgcggcaagggtagggcacaggaaacgaagagttagtgctcaagtggcgaaggcaaggggaagaatggcgagaggaaggaagcaaatctcttcctcggcgtctttatacccttgccaacgctattcccggctcctcgtttcccgcgcccactacctcgccccctggtttctcgcgcccacgcctccactaacccaactcgcccgtttgcggcacacgagacggatgtgcggccgtagcagttgagatgggacagatcaagcgcgcattaaccatgctcgccagacgcgaaaagcgccatcatcacgtctccaggcgaaacgaaccggctcgtcccgattcgcgcactgctcgagtaatgtagcggtcttaaagaggccgctcattattgtcggtcggttttcccttgccgatgcgcgcaacttgcgaccgctgggttcctgcccgcctgtagggacctgccccacctgtcaccgggcctaaggagtggcgtcacgtccgagcgcttccctcgaagggggcaatcgccctggcgtaacgccgggggctactgtcggtgacatggggccgagggtatcgtgactagaggcttgggtagccgcggtcacccacgtggcctgaccccctcgggggggtcaggcccgagggtgacgtggccacacctccctctgtctccccgaggggtcgggccgctcccgcttcggccccgagggctggggcgccccgaccccctgtggttttggcaccacgtgtgtgggttaggtgagcacagcggcgctcacctaaccgcacttatagcggattgacgagcgcgtcacgccgcatttaatgcggcgcagtgcgcg

SEQ ID NO: 72215 - DNA, 2262 bp, Oryza sativa
  unsure (1)..(2262): unsure at all n locations
acaaaatttcactaagcaatacaattgttctttacttttaatcactgttgagagaaccactcctttcggcgtgacgcagttgtccattcgataatagagatagttggtaacttcgttaacaccacaaatctttaggcgagtctcgtgttagttggaaaagggggccaacacgaggtttgcattttgttagggattgttttttttcactgtgttgagaaatgacatgtttattttttgagaagtttcatggcaatagtaaaacttgtcttatttttttgaattttttatagacatgtgctttgcattgctttgaaaaatgaattgttttgtgaaaggttgcatatttttttagggaaaatactgtaggagtgcataaatatatttaatagaaacaatatttaccctgtacaataaagatatgttacaaactttgcagccattgttgcatttggggtattgaacaatcttttactctatagataaccttgctagattcctttttgaaaagatccaagcaaacttggaagtaaggagagttgtttctgaaaatcttattgtttcttgtgttccaaacgctcctagccataattttgactgtgagaaccataattgcgaaaaaatcatggagccgccaatgactctgagagcagtaacgttgaccaagaccaaagcaaacaaccaatgttaaggctgtgttcggaatcggacgttcccgcgtacatagtaagaacggaaaacggaacggtccattagcgcgtgattaattaagtattagctaatttttttttaaaaagagatagatcaatatgatttttttaagcaactttcgtatagaaactttttacaaaaaacacaccgtttagtagtttaaaaagcgtgcgtgcggaatacgatggacaaggattgggaaccttgagttccaaacacaaccttagacgtgtagtagctgtatcataatttaccaattttagtatcaaagccatgcttcctagaataacctggatagaaaaatctacaaccccctagcaaaaatatcttaagtattgaaaggttaagaaaaaaacttgatcgaggcatatattggctaaaggtacaaataaaaaaaagggagaaatatcaaaccaaaaacagagaatgttagctcttgtaccgattggcagatctanattattatttatttttgtaggtccaacccacagggaggcgacagggacttaactgcaataggacgaacagatcattgcacatgcagaaacgaaaacaaaataatacaggtcaacaatacatgatcactgtgttgtgcacgtcagtctgacgcctcaatccttcccgtgcacacaaaatttcttatcctcccctctccatctctccctgcctccctcctgctcagctactactactagtagctatgctgccatggaatcgagctgctccgtacagctaattcttcaccatcaacctactccatcctctctgctcactctgaattctcaaggtatagttctcatcaggtagatggccatggaagcagcagatgaggagagggcgcctctgcttcaacctcaacctcaaccttcacgggtatctaacctacctaccattgcttcttgacttctgcatgcatatcattggaacaaagtcgaacaatccaccaagattctttgcttcaagtttcagcttctgcagctcatagtttggatgatttttctgcagggggatgcagattcagagtatacaggtgatggatcggtggacgtcaacaaccagcctgctctcaagcgcagcacggggaattggagagcatgcttcatgatcctaggtaccaagaataattagcaacagcaattcaattcaaatcgctgatcttccatatatctgtttctcacaaccttttgaactaaaattgcaaactaaagttaatcactcaacctaaccaggtgtcgaattcagtgagaatttggcttactatgggatctccaagaacctggtgacctacctcaccaagattctccacgagagcaaagtgaacgccgcgaggaattcctctgcttggtcgggcgcctgctacctcacgccactctttggagctttcttggctgacacatattgggggaaataccggactgttcttacttttctcccgatttacatcctggtaaggattgaatactctgttgcagaggctggactgaactccattatccttcccaaagacaactctgcactgtttgcactgtattgagatttgaactgttttgtttt

SEQ ID NO: 72216 - DNA, 5933 bp, Oryza sativa
  unsure (1)..(5933): unsure at all n locations
cgagccccgcgcgccgccccgagccccgcgcagccatcccgtcaccgcagccgcgtcgccgcccctccccctcctctctttcccctcttattcttcccctcttcccctcttccctcttccctcctcctccttcccccttatctctctcccttcccctataaaagcctcactattcccccccttctccccgtctccaccacccactcctccacgccgtcgcgccgccatcgtagtgccgccgcaccgccgccgtcgtgctgccgcgccgaccgtttccgtgcccgcaccgccgttctcgcgccaccgtgcgccgccgtcgctgccgccgtcatcgccgctgccgccgccggtgagtcgccctccgtttccctcgagtccgccgccgccaccgctcgggtgggaaagagagagagccgagagaaagagagggagagccgagaaagagaaggagaggaagggaggaggaagccaggagagaaaagaaaagaaagggagagaaagaaaaagaaaagaaaagagaggagaggaaaaagggaaagaaaaagagaaagaaaaatttagggggaaatttaaaatatttgcaaatattagaatttaattgtaggattaatgaaaatatagttagataaactcttactaattaaatacctaaaatactagcatttaaatataggattaatgaaaatataatgggataaattcctatagattatagataacttttagtactctccataagaaatcaattcgcggtattaatttagatgtaattaataattaaacaaatgtatgaattctcgtaaattattgtggattatttctgggtaatctctataaataatcgatcaacggtagcgattcggatttaattactagagtgttaaccgtgtattatatttaatcatagactaaattaagtcgtataatattataagataattttaggattccgctcgacatttagctcgcgataagaaatttctaacctaatatacggatataatgctagggtagattaaattaaaaacatacgacaacaaaatattgtaaccgcaaaataatttaaaccaaaattggggtttgccatagttcgcggatagtaaaattaataaaaaggaattgactttcgcgttcgacttccatttggatttacttggatttttatttgaattctaaccgaattcaaatcaattttcgcacgtaactatagagaccgagggagccgcggatccaggtgaaggccaagacccgcaagacctcgagcaaggcaagtcatcactattccttgaacatgttgatcccaattgcgaaattgttttgtttataaataaaattgcatgcaattatgaacctcctacttgtgattatgccatgccttgattattgttcacctttaaatctttgtaaccatagatacgtacgagtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacataatttgtgaaaggaaaataaagtaaaacaactgttttcgactggggcggctggaggacttgggtggtgtccggaaaaggctagtgccgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtggggcagccattggtaggaccgcgaggagggtgtctacagtggtgtcgccatcggtaggaatgccatgtgagaatctaaaacataattataacttaatgcatgtgtgagtcttcccttcccgggtgccagaactcctctcactgctagaaaccgtgtacgcctagagtgcatgaggatgaaaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaacctattcgaatagccgtgctcgcggttattgagcaccgggacatgtattacacttggctagactctaaattcttaacttgtgtgggatgggatattgcatgatgaattttatgctgttggagccacttcctgagaggcgagaaggtggacgtcctcagaaaaccatgacgaatcaatggcgggaagctatccttgggatcacaatggatggtggacagaaccgtcgttgtttaaatacaaactctggtactaaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttattagaagtgggagatgaagcctcggaggatccctatgcctattatcaggagggagatgaagacgatggcgtccagtaggtcttagcacggtcgttgcctgtggcaatggcatgccgctgcctgaattccgctgccttatctatttctgcttttggatgtattccggacctctcggtccgatgatttaaggctatgcctgcgggcctatgatgtaataattcgtattaaacactcgtgtatgtgcacttgatattccagctatgaattcgtgtgtaccaaactacttgatccagggaaatggtactgtttacacgattgattcctgttataaaaacgggggtccacagtttctgtaaagtcggctagtttaacagggttagatcgttctagctatgatttcattagtgtttctaagaatggttttgtacctatctctataaagccggctagtttagcacggctaggcaatattactttgtatcatgagtaaagatgctaatctagagtggttgcaagggtacaatatcaatctacgaagataacatgttctatgcttttagattcacgatattcatcaaaaagacaggggcatgtgtttacgcccaaatttggcacataggatcgaaatagggaaaattaccaagatttgggacatctgcttttgatagtcatatttcatccgtccctctaagtcctactccctccatctacttttgatagtcatatttcatcttggcacacagaccaaggataagtaattttacttatcatctatttaaacatgctactccctccatctacttttgatagtcatattttatcttgacacacagaccaaggataagtgattctacttatcgtctatttaaacatgctactccctccggttctatattaattgacgttttgaacaaggttgagattaaacttttataactttgaccatcaataactttaaaaatatttagtttaaagaaactagaacaacatatataaatttgtctttcaaattactataataaaagtaaacatgcatttatttattgtatatattataataaaaaatgagatcaaagatatatcttgtagaccgtgtcactgtccaaaacgtcaattaaaataaaactggagggagtactagtcattcctcgtaaacaagcgattcattaatatttacatttcacgatgcccatgtagccaatcttgtgtggaagaatggaaagtcacgcattaaatctaagaaattcattaagatgataagttgttggattgaaatatgcctatcaaaaataaatttttcaaatttggaaatatgactatcaaaagtagatggagggagtactagttattcatcataaacgagcgattcattaatatttacatttctcaatacccatataaccaatcctgtatggaagaatggagagttacgcattagggtttaggaaggaaagccattaagattataggttgttggattgaaatatgcctatcaaaaataaattttttaaatttggaaatataccttttgatagaagacagtatcacagagagaggaaaaaaactgaacagttacgaggtactccccatctgtacattaatttgcatgtccaggaaaagatggacaagtttaattacacacccatatacctcttcacgaaacaaaccactgacggatatgtgtgcacaattatcgtcacataaggacaaaaggaatctacattatctacctctccggctctccctctcatacaattttgcataggactaactaatgatacaaatgggatttccttcaattctggcctgcgtgagcgcgcatgcgtcatcctagctgcatgtacgtagacatccaacaatcgattgatcatttgcagatatcgcattcgacaacatcgtcctgcatatgtaagttgttttgtattattaacaattgaagagccacgtgttcactctggagatttaaaatattactaagtgagtaggagaaaaggagaaattaatgtatatttactgtgtttaatcatgcatggtgggtttagattaaaatacaattgtatttataaaaagaataaatggaatgatatggttgtatacatggatatataagacatatatgtatacagttatataaacgtaaacaacatttaaatttagctccacgtacttaaaaatgagtggaaaaatatgataatagttgcatatcctatcttactataaaagttgatgctaaataacttttaaaacttaacatgcaagtgtgtcacatcatcacctttactagcaattattatctagagtattttaaatcacatacaagtttgacacatcatcatttactagcaattattatctagagtattttaaattacatgcaattgcgccacatcatcacccactagcaattattatctagaatattttaaatatcatgcaaacataatatatcagttacagttgtatttttagagctcaatatgcgagtgatatcaaattgttatcttcacattattctcatatacacacactatttctataacgtataaaatgtattaattcatataacctgcagtaaaacactgtgtatcaaccagtacaagaggcgtgtctgttttacctcgtctttatcgtgtccctccagacggcgcttggtcttgcatggacatgaatagggcgccaacctagaaacgtggagcatatgccgcagccttgcctgcacatggttgtagatgctgcgcgcgcaggcaggagtgccccgcgcatagtgtattcagtaaattattatactaagagcatgtaactattagccaggtaccaacatattttaataagataaaagataagagagaatagcagcgggctacagatctatagccagctacagcaaagactccaagatgcaatatgtgtatgacaggtaggaccatatactaatagtatagtaagcaattattatatgaattagctattagattggctattagatgaattggagctagtagtgggctatactattaaacttgctctaataactagtagttgtacagtacacgagagcaatttgtggaccctaattaattagggaatgtctatagatcatttgacagaaaaccccctcacaaatcttgtaaatttttgaccacccgattgctttaagattcgtgcaggcaacaaaaccttaaaaatcctctctcctctcccgattccttcaaacacgcccgnccnccgggnncccttgctcagcgcttcccacccgcctccgccactgtcgccgctgccccagcgcaccaccgcccgacctcgccggccggccaaaaggtgtcaacggcgccggctaggcccccccgaccggccccct

SEQ ID NO: 72217 - DNA, 957 bp, Oryza sativa
atatatctaatatattattaagacaactcgaaaagaaggcaccacgttctgtgaaggctagaaattcctacattaatcaaagagaaagaaaagaagagtccaaatagaaatacgatctaaaaaataattgaaattcgaaattaaaaataagtaatattgaaagtccatataagaacccaatacgtgtttaattaaaatttagaataaaaaataaataaattgctgaaattagaaaaagaaaaaagagtgttcgaataggaatacaaatttgaaattactaaaattaaaaataaaaaaatattgaaattagaaaaataaatatgattgttaatgtaggaatacaagttataaataacataaatttagagaaaataaagagagttaaagtagaaatacgatttaaatatagttgaaattcaaaattaaaaataaataatattcgaagtagattctacatagaacctaatatgagattaattaaaacccaaataaaaattaaaataaaatatgaaattagaaaaaataaaaaagagagttcaagtaggattaggtttttgaaatttctagaattcaaaataaaattgattattaaaggaagcaatacacatatagtatacaatatgatgtaaatttagaataaaaaataaaaataaaatttaagtaggaatacaatttataaataaaaaccatcagtataaaagttaagtaagaatgaaaaatgttgaatgttgaaagaaccgtcaatataaaacatagtggtagtaaatgaaaataaagtgaggaggagcaacgagctcataaatgagtagggtggctgtggttgatgaggtatctataaataaaacctcaaaaatgattatatatgatttttagagtccctatgacgattaagatgaggatagcaggcatgccgttaagcacggtggttggcaggacttttagaagtaaaaaatgaaa

SEQ ID NO: 72218 - DNA, 4315 bp, Oryza sativa
  unsure (1)..(4315): unsure at all n locations
agagcacgaatcgtgaagcacatccagtgatccaaaatttgcaagatttgaggtatgattttctatcgacatagctttagcaattccgaattaattaagcttgtagtagggttacctgagcctatgcctgttgcaagatgcaaagaagagcagtataccattcagtatgctcctgattgcccggaagatctattaattatacatataaatgggtgtatattatacacagagggatattgtatgaatcgatatagtactagttagctaggagtatagtgtatatgtatatatagtagtgtacctgggagaagagatcgttccagagagacttgagcaaggagacgtcgaaggcgctgtgctgcgcctcggccatgtggttgagctcgaacatgctgctcaccgtctcccagatgtccttgccgaagttgtaggtgttggagagcagcgagcccgcgcaggaagcaagagaggccgcgaaacgcagcggaaggagcagcgcctggaccagcgggttgaggcagtccaggacggcgtccaagggcgcccacagcgcctccgccaggtcgcccagcagctcgcatacctcgccgcaggcggccaggaggggccccgcgatggccgacagcggagccgacagcggacggagcaccgccctggccatgcgcagcagggccaccatcccctgcaggcacttgcgcaggtggttccggaggaagaggatggtgcccaggtactggatccgggtgaccatgtcccacgtctcgatccagccgaagagcggcccacacacgcgcgccgccgcggccttgagcagcggcacgttcttgtacaggtcgtagaagccgatgatgacggtggccagggagaccagcaggtagagcgtccgcgccaggggcctcatccacggcctgtatagcaggcacagcagcgggtacgactgcaggaagatgacccacgacggcaggccagactccagcagcgtcagcagccggatgtccgacatgatatctccctcagctttccaatttcccgggggggcccaaaagggccgggnccgntcctttggttcccctgnngnaccgnngnagnncagganntncaggcgtgtcggtgtaggaagaagacgaagaaggcgcctgatcatcctcatcatcggcgtcctccttcttcttgtccgactccgacgacgacgaacgtcggatctgttgatgaatcagccgccgcatattactagtactagtattaatattattgttgtccttgtcgtcgttatcaacgacgttgtcttgggacagggagtagagggtggtgaggtagccgcgcagcgcctcagcctcgggggcgcggccaaggaaccagagcttggtgcagccggccgcctgctccgcgctgtagaactcccatttcttcatgtacctcgcctccagcgccaacgacgtgtccgtcagcagctcgttcaggtagttgatgccgtgcacgtctctccacgacacctcgaacactaggaacccatgcagcgccagcctcaggtccaccacctcgaaccaccgccgcgccgccatgctgcactcgccgtcggctgctgctgcggcggcggcggtggcgctcgaggtgttccggccggagcaagggagcgccctcgagtttgcgaatggagacatcctgtactgcaattagagagagaagctagctcgtgaccataagctaggcaggaattaattgaaggtagtactagctagtataccttggtcaccatgaactgccagagtcttgccgatcgagattgcttgctcgaccgccatggctggttatccaccagaatgaacaccttcttgctgagaggtgcaaaatacaggaacgcccgtgacacgtaagattgcatgtccctgcagacaacataattataatcgatgtaaatcatcatcatcatggcattcatgtcgatcgattaatatatctacttaattagttacccgatttgcaaccctgtcaatggatagatatctggcaaggcctccatgtgtgcaagatgtatgtatgccgtctgcctactactaaggttgatcgatctgcaaataaataaagagagattgatcgaccaactctgaagaacttttgggtaactttagctagctagctagttcatgaatgaccggaaataaatactctatataatgaaggaacggaattaacagtacatagcgccatgcatgagccgatatatcgacgatgacttattagcttagaatttaaatccggggattgaaagatgatcaaatcaaagccggaggagtaacaaatataccgagacgagacgtacgcgacgtcgtgcggaagcaaattgataaagagatgatggaggccggacgattgcaaggtggtagttcttgctcttatcaatcgctgcttcgttttcctttcagccggacggccggtggcaagagcaagagcaggagcaggacaggaggccgattgcatgttgatgttggcaggtcgatcgatcgagaggtgagcgaatggccgttctttcctttgtttccaaattaaacctccattattggcaactaccattaatagctgttactgatctcggccactaattcatttttatatccaactgagggcgcactccatcgcaattcgactggccattcccaacccaataacggggatggtgtccatagcattaaataaaaacgatgaaaattgatgtaacaagtaaataaatgaggaaagagaaggaaactaggtcttacatgagacatgctttctacacaacattcaagatatcgtgtgagataagtagcattaaatttaagtatggaaaagtggtgtttgtattgaaagagtagtgtctagtactaagttcttgatggtgtagagttttatattatgtcttatattatggttgtgtcttatattatggaatggagggaatagtacataatcgatttttgcggacaaggccccaataggttgcaggtgggctgtaacctatccctcgtgcaaaaatcgccaaagtgttggattgttcattcaccaataagtaatgtgagctgggtttcatttttgtactttgtagaggtctcataaaccaccatgaccttgctgcttcacggattgttagtcgcctttcctctcaatctttattgggattctaaatatcaaacctaaatgtcatcgtaagagaggtttattcatagtttttattgtttcatcaaccgctatcacactacttgctagctcgttaccctatccctcttttagcatttaccatcattgcgttctatattacattatttcccttgaactctcattttttatataattttgaaatttatcttacttttatttcaaattttaatcaatgtcatgttgtgttctgcgtgcatgtttttttaacataattgtcattgcaaacgccaacgctccctcctttcccgcgtgcgccgccgccccctgcctccgtgcgccgctgccgctccctgcctccgcgtgtcgtcgtcgcccagctgcagctcagtaggcgacgaggtgaggatggggatagggttgatttgtaataggggtattttggtcacttcgtgctagcaattttttttctttttcctaaatgaagtgctaacggtgaagtgaaaaaacgaggtcaaatgagtaaggttagggttaaattagtagctaggcttgggcaaatttgtaattgcaattaaccccacgtcagcgatccgcctctaaaccatcacccccgatccggtcgatcgatcccccatccccactgaaaaagaaaagaaaaaaaaagaggaaaagcagcgagcgagagaccgggggacggaaatggtcgtcgccgtcgcctcaccttcgtcggcgccggggccgggcgccgccggccgcccccacccgacctacaaggaggcaagattctctctcagatactcccccccatcccaaaattatactagtatttttgtcggttgaatcgagcatatgcatctggatgcttcttacttctcacttgctccagatctccttgatttggtgcagatgatcctgcgggcgctcaaggagcttccagatccgatcatctccagccgccgtgccatcgccaagtacatctccgacaacttctccggcctcccttctcacacgacgcgctcctcaccgttcacctccgccgcctcaggtcacagggccttctcctcatgtctggacactcgtaccttctctccacctccgccaccgccgctcgaggacggggacgaggacgaccgcccaagaaagcttcctcctccgcgccgcctcaaaagcgcggacccgg

SEQ ID NO: 72219 - DNA, 6623 bp, Oryza sativa
ctagctagcaaatatcaatttgtgattacaattatttttgaaaataggaacgttaacataataagtgtcaacttgcacctggatggtgtcgttggcggcggcgagggtgggcaccaagccgccgttgcttgtgttgcaagcgatctcgaagcccgcgctgcggaagcagccgccgccgatgccgaacgggtatggaatgtcgacgtcgccgcacctcgcctggcagccggcaggccggccggcgatgcccacggcggcggaggacatcagaatgagcagcactccggccaatagccgcaacgatgccatccgatcgagatatcacgtacgtgtgctaattatcgatctcggttgattcctaattgcttcgttcaatatatatatatgtacttgctctcacccgcgcttgttcattgcctgcagctttattatactccgatcgacgacccagtcaggaatggcagaaaattaacgacatgctagctaattactttcttaagttttctttttagtcttgtcttaaatcaaacgtttatactcgctctgtttcggaaaaaaaacttgtcgttcagagcaggtacaatagcaggctacaagttagctgtaagcacatatggaagagaaaagataggatacaaaaggaaagcgggttacatatttataactaactgcagcatagactccaaaatattgtgtgtatgagaggtgagaccatatattaatgttgtagtatatatttatattgtatgaaagagctattagatttgctatagatgacttggagctggtagctggctatactattaaacttgctcttacacaaaccgcaaaaatgtaaaagattgtggggataatctcattaaatatatcctaattatttttttcaaagcatatgagccaataggagttgtgactgtatttatatatgatgacgagggtagacaggaaatatcatttttaaaaatgctttgcaatgtgacaacgacaaccaatgataagtaatataaaatggaaggagtagcctatagataatcaatttttgaaattaatacaatttatgttgtaaattatatattataaaaccattttctagaatctaagaaccgaagtttgaaatgtcagatttaaactaaattaaaaaaaactattgtaatttgaaacggagaaagtagataggatctaggattgaaaaactaaatgtgaaaaggactgcacaaaacaaaagaacaagacaaggtcgagaccacaatgtgccacatggtgcaacatgcgaagaattgtctaagcttgcaagcctggcatctatatgttgaaaacacgcccttttttttaagaattcagaacttaaaaggagaggatttcaaagctgtcttagtcggacagtcagaatgagagcataagtgagaaatattttgacaaactatttgattcagattttgtctagatttatccctggtttttttggcaagaaagtcagccatcttattaacctgtcttaaaatccatttgatgttgagagcctgtgttctggaaataagttctgaaagtaaaggatttaagctctaatgatgatactgagaataatagacttgaacctgcaaaaggctaactaattccctattgtctgataaaagagtaacatcaataatatttaactttcgacaaatcaaaagttaaagcaaaagggatctacttgtccagaatattatctcaagaatactgctttgacttgtacgtaggtatatagagtggcagcagacagattcctacctaaaaatttgtttaaacgtcctagaacttactccaaaggtgtgtttagttcgcgtcaaaattagaagtttggttgaaattgaaacgatataatgaaaaagttggaagtttatgtgtgtagaaaaattttaatgtgatagaaaagttaaaagtttgaagagaaattttgtaactaaactcggcctaatttaggtatgcatgtgaactgtaccgagttcacaaaatcaattgactgctgcgcccacaatcacgtggtaatcacttgggacaccaatggcatctttcatgagacccgatttggtagacagggtaatttgtaacgatttgtgatagagaaacggattgctctagctgctgatgtggacagtatatccggcaactaaatatcttttttatcgttactgttctctaaaaatagatgctacgctgtaacgtataaatggtgggaagttgggatccgccccaggggatatgttgaacatcgatatgttgaaaacttttgttccacacaaaagttttacaccctatcatatcgaacgtttgacaatgtggtgctacagtaaatatttgctaatgacggttaattaggcttaataaactcgtctcgcaatttacaggtggattatgtaatttattttattattagattacgtttaatactttaaatgtgtgtctatatccaatgtgacacagcaaaaaaaatttaccccggatctaaacacatcctaagcttgtacaccatttttatatccaaaaaatctcggtagagaaagacttcagagctaaacagtgtttcaaaccttgcttgggctaggtaaaatagtcaaagtagcttgcttggttctctagctagcaaatatcaatttgtgattacaattatttttgaaaataggaacgttaacataataagtgtcaacttatcttgcagtatttcaagtcctagctagctgagcccttctatatatatatatataaaaagcaaatccagacatgaatatagtactgacactataaatcaaaattgtgtttttttttgtgtgatgtgtagattgaatttagtacttattgtttgtaaacaatgtaattttatgtatgtttgagataatcgaatgttacattaattaatgaaaacaatctgtgcaagtagtaccaaatcgagaaaaagtctaaatactagatgtgacaaaaacatctatgcaagtagtaccaaatcgagacaaagtctaaatactagatgtgacaaaaataacagggtcaatgtcagctagtgagatggcgggaaataagttttatcgtcgagagaaaagcaacccagtttgcccgctgttgacggaaaacacggcggtctgtgatctgcttaactccagtgtagatccaaggctagtctcgagtgtgttaaggatgtgtgttaacagtgaaatttggtaagctccgaagtcatcatcggtctagtgccaatatcggtttcagagtcctggaatcggccgacgggaattatcaagtcgccaatagtcggattattgctatattcggttaaagaaattaatctactaaaggaagtttatccagaagagaccgagttcaaagatgatgcgccatgacaatttatctattagttatgaatagtctgttagtttccttttatctttaggaaagtgtgtttagtgtccaataaggacttctatctttaggagtctttttttccaacaagaactagttatctacccatgggtataaatatgtacactcaggatcattgtaaactatattcacatatcaataaacttcgtcgcatcgctactctttttacttttctacattttcggcgagttcatgctccgacaaggagtaagacttgttatggttgtttttgcatcggcggggctagggcttcgacactccgatcttgtcaatataagcacttactatcatatatcttagttaatctagcttggtagttcgatttacttgtatcggctgagattcgctttaggtttttttgtcaggatcagctaaatcgctttaccagattagattagctaatatatctaccaccctgaaaatcagtcaaggacttgattgtctagatattatgtttcttttcatacttagtgctgcatcagttaagtttgatctactaagtcgagcttagaatcataatcactagtctgcttgttgattgccaataagggtttcattggggttttagccgatgagatatctggatattgcatcggcttataaggattgcatacaagttggatttagccgataagaataaaggttttactatttatctaatcatttagaaaaaaaaaagtgtgtatacgaacaacaggccagtacgtcaatggcataacacctatcagtctggaagaattatactaagtacatctaaggactgaagctagttcttattcctgaaacaatctattgacttattaaaggtataaaaaaaaaccctccacgttcgctctcacggtctagaaattctcatattaatcggagaaaaagaaaaataaagtccatatagaaatataatttagaaataattgaagttcggaattaaaaaaaggaatattagaataggagactagagtccatatagaaatacaatttcgaaataactaaaattcgaaattaaaaaataaagaatattagaagaagagtataaagtctatatagaaatacaattaagaaataataaaaatttagaattaaaaataaggaatattagaagtagagtatagagtccatatagaaatttaaaactaactaaaattcataataaaaataataaaattaaaagtggagtttagagtccgtataaaaatacaatttacaaagaactaaaattcattaaaaaatgggaataagagtttaaagtcaatataagaatacaatttagaagtaattgaaattcgaaattaaaaattaaaaaatattgaaagatgagtttagagtccgcgtagaaatacagttagaaataataaaatttagaactaaaaataaataatatttgaagaatatagaaatacaatttacatataatgaaaattcggaatttaaaaataaaaaatattgaaagacgagtctagagtccgtataggaatataatttaaaaataactaaaatttgatattaaaataattaataactaacacgtatataaaatacaatataaatattacacattagtagtttcataaagttagtacaaaatttaaaattatgttatcattttaatatattttaataataaattgagaaaacatatatgctattatataagagaaaatataatgatgctagcagcgtaatctgcgggggctagaatgctagtttaatataaacgacgaccttcactagaaatggtagtagtggcctcttgcacggaatttttttttgaaaataatacaattttaatggaaaattacaaaaatatatgtcggttagacgaaattataagtttaacaccctgtcaaacaaccgtggtttgacagggtacctatcgaacaaccgtggttcgacagttgataaaataattaaaaaacagaataaacactgtagcccctatcgaacgctgcccattcgatatgtcctccgatcgttctttgctggttcgatatatccctaccgagtactcatgtacttttttttatttttttcctggaccacctactccacagttcgacaggtacatgtcgagttgatctatattttaacaattttctattaaaatcatattatttttttaaaaaaatctcttgcacgaggaggaggatggcggcgacagctatccggtggtggtgtttgtaactgtggtggcagcttcctcagcggttcgacgaacgggctccggacgagagaggcggcagcgggatcatgggatggctcgtgctcgctccctcctcccctctcgtgcgtagcaccgccgatctgccaatctgccatgtttatttgtttgcttggccttttggttcgttgattgtagctgtgtttagatccaaacttcagttcttttccatcacatcaatctatcatacacacacgacttttcagtcacatcatctctaatttcaactaaaatacaaattttgaatccaactaaacacagcctgagaaaattaaccaggctcctagatctcgtaaatctcggattgtcggttgggtggatggattcgatatcccatattccaaactgatgtgcacaaaaaattgccagttgcttgatttttattgaattacaaaattcatttctgcaactagtataatctcttatgttatttttgggacttgggtgctatctttgaagtgaagactagtcaaaaatgtactatttggctcacgagcgaaacgaggtagctcgaggtgccatgcgagctgacctcccgtcatcacccgcacggttgcctgtgctgaccccgaccttctactgttgccagcatcgtccttggcagccgctagccaccacctgcctgccccgatccgagcgagaatatatgccagatctagctagccaagggagcaccgagatctgacaaggaaggaaggaagggatgtcggatctagccacaggagcaccggacacaagctttgcgaccccgtacccgtagcgtgaattcacgacgactagctctcggcgacaccgcggcggcgactcatgggtcgctgcctcctcccttcctcctcggcggcgagcttctgggtgcaagctgttcggcggtatgcctaagcggggtgcccaaccaaactgcaactgacgctcaggtcaccaccgcccaactcacaactgatttcttcttcttctttcttcttcttcttcttcttcttcttcttcttcttctttcttc

SEQ ID NO: 72220 - DNA, 2369 bp, Oryza sativa
ttttttcctgtgctatagatcgaattttctctataagttataccatataaccagtcggataactatgccgtgtgggtatagggtacccataatctccacacatagtttcaaatacacccttagaaaaagagctaatatactagctacgaacgaacaaataaacaattaacccagatttcagattgtctaccacgggacagtagtaccgcctccctgcatgtcgttcctcccccttctcacggacacgggcaaggacggtttgtaataaaaacacccgtgtcgtcccagctaattccctttcctcctcgagagcgaaccggtaaacggaagcgtctccgctgggacgacgagacgacacacgcgaattctccatgccgtctcgaggccatgttgtttcgccttttccctaataaacccaaaacggtttattagagaataaaaattaaatttacaggtaaaacttttaaatacgtgctttttttacttaaaaaccaacgaaaaaagctaggttgaaaatatctcaaaatgaatcttataattaagtttgtaatttttaattttagttttttatttggctgccattcgacgggggcttcgtacgcgccggtgttttgtcacctaaacaatgatatgtacccatcgtcgatatggctaggggacctattttcttaagctacgcccaatacagattaccgtgaaccgagtgccttgcgcattatgctacgtagaaccgcgttagtttttctggtacccaccaacttcccttagccgaagattccatccattttttttatcttcccccagaaaacaaaaaacaaaacgaaaaaaaaaagggaaaaagaaacccgtgtgacctttttgagcgtccccctgaggctgagacagacaggcacagccaaaattaaggagaagaaattccgatcgaccatggcaaaatgcatcttggaacgcaacgtacgtactttcagtttcagggcgcgtcgtcgctgttacgtttaatttcgccttgggtctctctggcgatagatcggcgccacatttctcggttaagctattagagcacgtacaatagcaggctataagtcagctataaatatattagatttgtagccagctgcagcacgaacttcaagacgtaacgtgtgtatgacaggtgggaccagatattaatagtatagcaagcaactatggtatgaattgactattacattggttatagatgatttggagctagtagtggagctatactattaaacttgctcttactacaacgtacgtgtacacggataacgcggtggcatgacatggtaagcttgtgctgttttatcgctactagctcttggtggctttcgcaggcgagcggcaaattgttgttgcggtcatgtggtggtgtcactcttgggctattgtggcctgcagctgcagctgcagggagcaaaaggcaggcatctcgtgagctgtggagtctgaagatggtcgcgcatgcatacggacgaagaagtggtacacggggaaaaagatggacgggagaggcgtcagtggcaaattggcagctgctgcatgctaaagttgctaatcctgttctagtgtggttctggttaggccagagccggcgtacggcttattattgggagacgtgatcagtccagctaatcgcacagtgacattgccgcacagggcataaccaaaccgtgtatgttgtggtcttgtggacctgtaatgtgtgcgtgggtaggagggatcgatcaaggctcttccaaatggaaactcttgcaactatttcttcagggattttgttgtatttcaggtgcttgaaaggtttgtagattttcattcaccaaaaactacacaatgtcaagcctaaaacccatggtgttaatttgtaatttaagtttatttaactacagttctaatggtatatttggtttggttttattttacccaagtttgaatattttcacatgtattttttttggaaaaaaatatgaactgtaaagtttattccatgtttgggttagaataacttatttttctaacaaaaattaactttctttaaataggtaacatgggagcaatgaggaccatgagcaattctacggtccttcaggaggtaccataaggtacaaaaaaaaattcagtgtaaaatttggtacctaatagtacatagatatcaagaggtaccaaatttacaatagaaaaaagtggtacctcatggtaccttcttaaggaccgtaaaattgctctattttgaaagagcctatttcggagaaataacaatgccgtacctaacttatttagtggaaatgtatgaaaccatatatatatatatataaatagaccccaaaactggcgcctatctcacgaaaatg

SEQ ID NO: 72221 - DNA, 5271 bp, Oryza sativa
cccgttgagactgggagtgaagcggggacctgggaggccgcgcaagaatgctgctgctaccccgttgagactgggagcgaagcggggacctgggagaccgcgcaagaatgccactgctacgccgttgagcctgggagttaagcggggacctgggaggccgcgcaagaatgctgctgctgctgcctctcccgttgctccgccgcctgcatctccactgaagcggggtgttggacgcccaaggaagaacgccactcctctagtcaagcctggacctgggaggccgtctggattcaaacgtggaccaggccgccctcgcaagaatgccactcctcctgtgctgtcagtgccacccactgctgctgctgtgttgggagtgaagcgtggccgtgggcgccctagaaaggataaaccattgcaatcttggtctgtgctctctggcggtgctgcaatgactaagagagggcctgggaggccaagaaagaagaggccactggaagctggaggtgttgtggcagcacaggtagacactgcagatggaggtgaggctggagccgttcaaaatggaggtgaagttaggtgtctgctctctgatggtgcttcttcaatggggaacagagggcctgggagtcctaggaaggaggtgctattggaaaatgaacctacagtttctacattggtgggaaagagaggccgtggccgtccaaaaaaggagaaaccatcagcagcaaggcctgctgaaactggagatgctaaatcaatggggatcaagagaggtcgcggaagaccaagaaaggacagttcctttcaagctgtgtttgcagaagctgcaggtcaggtgtcaagagatgtcacagcagctcagcccgaaggagatgcagatttactggcaaggaaggaaccagagactgcagctgtagtttcggtggagaacaaagaaactaggcctgcagatgctgggggtgttgtggtttctgaagagaagacatcgattgatccggtggaggctggaagtgtaatgccatgtgttaatgcagaagttgatcgcatgaactctgacctgcgcactgctaatccatagtgtggctggcgtcagcactcagcacagaagggaggacctggatggctggcactacctgcaggtgtgaatgtgtattcactgatttagctggagacatactgtgaaaactgttaaatgttgcaaccaaaattattactgtcatgctgttaagtagtttctcaagatcaacattggagtatgcttttaatgatatccacttctcggataaatttttataatagtccttaggtagcacatatagttcctttaggaatgactggatatatcatatatgttgcttttagtgcacccagtggtgatgagatgcatcaatgtttacttccaatttgaacatccattagtgtttcattcaatcaatatctctgttttttccatgcctatatcttaagtaattttggtgaatttcctttcttattaattattaatagtaaggttaatctagcaagtatttttctattcattgttgtattgtgcaaattcagcctagaatgtgctcttatgatatgaagttttactgccacagcttgtttgtttatggttattagtatttgtggggtttaaataattccagatatcttttgtgacatagtataggttgtggggggagaattgttggtccatgaccatgaggtctggtgctcttgtcattttactgtgaggattaccctagataccctaatcatgctcaatctgcatgtttctctcaatttgcatagaaaatggttggccctattgtgttgctgagttaatttataccgcttgtaggccgagcaacttagcaaggaatttaatcaaaatctttgtttctctcatatcttcccatatcctatatgaggtcctgcatgaatatttgttctgttcatatgagttttggctgacaagtcatactatactactgcacactagctgttctcacgtggcctgctttggttctgcataatacaattatgtgtttatgaaccgccttcaatcaagctcagttggtgggaggtgtagatgcatgggtttgagtcctcttgaacacaagtgccccttcttcctaataatgatactgtaatgaatagggtttatggagttgaatttgcagcaaaattcagtttatagagaaggttttgttttgttttgaacagtttatagagaagttccattcatcatttgttcagtgcatttaatggttccttttttgtgtactttttttgtacattcttgattccttgttattgtgcaatattttttttgttgttaagaaattgttacagtgtaaggatatgtaagggccttatcttttcaattatgcttatgcttatcagccaaaatttgaattttcaaccttaaatttggagttgattttgaggttttttcatcaaaatttatttttcagcctttgcttttagatcgataagaacacgcatataaaagttttattcacaaattcctcttcgtttgtaaatatgccgtttcgcttattctattccgtgaataagtgaaacgatggttcgcttattctattccgcaaataaggcgaataagcgaaacgatggttcagtaagattggtttgcttggctctctgattgctatggtgagaagttggtatgaaaaccataactttgagtaccaaacaaatcccttttttttgtcttggtccattatcactggcattaccatttgtgcacagtacaatctccaaccaaatattatcactgaaatgaatgttttttagatgaatgttctgggttgtgatattgatatagatgagttatctcactttacacacaagggcgggcagagcacaaagtaaaatgatgattacagaggttggttagcagacaatctttcatttcatttgttatggatggcttgattttccctgaagaatgataacagcctcaggaggtggaaggaacagctaggtttgagtgtgggaaaaaaacattgaatgcgattagtagtacctgctaaaggttttctactttcaggcagatgaagtaagggtttagggtttagggttaaatcagctgagaattattttttttaacaaacaagatacaattgtgttctctgttctagtttagggtatatatataaactgaatgatggcaacctcgcaagaattatttccagataattagactgatgcattgttccctgcgtgccttgagaggtcagcatgttgaactagttgtactatactactacctgctgcttgtgacaacattcttgtttagggggtaagttttggcttgtcacactgggtattgtataggatgtcgcatggaatgtttgggcactaataaaaaaactaattatagaatctgttagtaaaccgcaatgaatttattaagcctaattaatccgttattagcacatgtttattggagcaccatattgtcaaatcatggagcaagtgcttcattgttgaatcatggagcaattaggtctaaaagattcagtcttgtaaattagtcgcaatcgtgcaattagttgttttttagcctatatttaatacttcatgcagatgttcaaacgttcgatatgacaaggtgtaaaattctaggagggatctaaacaggccttaggctgtgtttggaaccatgggttcccaacacgcacagtgcgcataaaaaacggagtggtccattagcacatgattaattaagtattagctatattttttttcaaaaatgtatcgatatgattttttaaagcaactttcgtatagaaactttttttaaaaaaaacgcaccgtttatcagtttgaaaagcgtgtgtgtagaaaaagaggcggaggaacacgaaattagcttttttattcgtgtccgaaaacccattccgacgtccagtgaaacatccgatagtaacttagcttcaatgcttcttctttcctttcctgtactagaatagttcttgtgttgactggaaagttggcttgtgtttgcttctcatgtatgaacaagtacgtgtattctaattgtcgtgtagtagtatatgagccaaaaatttgataggatttcttatatagttaccaaaatttggtagcaaactaaatgtagccactttttttatatctttattaaaatttggtaaggttgaaaatggtatcaaagtgaacatgcccgaaaagaaaagagtaaatgaaagaaaagagtgaatggacggcccagcagcatagtcagcccaagcccaatgcgtaccaaccaacggctgtgatgacgtgaagcgccgagcgcggcatcggacggccagggctcgcccggtgcccttttaaaacccgtatcacttctctcgcattcccaatcccctcacagccttaaaccctagctccgcctcccacctcccttttcttttctagggttcttccgccgccgccgccgccgccgccgattccgatggagttctggggtaatctcctcctctacctctctctcttcccctccctctctccatccatctatattgcgcagtttcggtttttgtttgatttgatttggacgcgattcgtttgatacggtgtttggttcgtgcgcttctcttcgttacggattagacgcgattcgtttcaccatcgagtgttttgggttcgcgcggaatcgcggccatggctcttccctgtcttcgttagggattaattagggattttagttttcatgggccgcgactatttccatcatacatgcgtaaccgcattggttgccgcctttatgtttgcgagaatcatcattttgttcattctgtttctgtttcagttaacacattctgattatcttcagtctcatagttgttatcatatattactacagtacttaccttgcttcggccccatcgtttggcatatttacgaacgaaaaataatttgtgaataaaacttagcgatctaaaagaaaaggctgaaaaataaacttctgaaaacctccaaaatcaactccaaatttaagattgaaaattcaaattttggctgataagcataagcggaaagataaggtcgcttgtttctatgggccatcctcgttaatttactatgctagttgcttttcaactttactagctaaaggcaaatatgaactgtagtatactgtttcattcatgccttcttggaagggaaggactactctatacatgtgtctttccctgattagtcaaagttgtgcaggtcttgaagtcaagcctggacagactgtcaaatagagctgaaggg

SEQ ID NO: 72222 - DNA, 1030 bp, Oryza sativa
acctatgtgaaaacgacaagagagcccaaatcaaacctgaatcgagtacagcatgctaccaattatgtttgtgcagaccgtgctgacctgatagcaccatatatgaatgcctataactatggcaacattgaatacagtggaccttggttgatcagggggagcattcgttaagtaggcccaaacacgtcttgtcttcgtcttcgtctccggggaaggaggctcgccagtcaccactaacaacagccgggatgatcgagtcaaacgatagaaaatttattaggcaatggatataatttctgttttgtttgtgcccatttgtttgcatcttgtccaaaccatacgacgatcatcgatccctgtgggccttacaacatacagaatgtagatcgatggtcactaatcactcgacatgctaaaagcaaggaaaagctacatcacaactaaccgaaaataactcctcgtgctactgggagccctcatgcttgaaaatgtagttgcgtttcttttcagccacagtgaatatcagttcactgaaaagtttttgtaactaatcctagaaactactgtttgaccaggtttaattctgacaaagaattcgagaacacaaaaccatatgcttcgcatttggtttactgttgttaaaaaaacatgttgtattcgaaagaaactcctctgatgtaatgccctctgacatgtgggtccacgagttatgggctccatatgtcagtcccttaaagtcggaggacagtaagttagaaggtttttttccgttgtattcttgtttctgatggaggattttttttttctgaaatttcaggccagggcatacgcgagagcgatgaaggcgaccctcttgttctccagctcgacgcacaacatcaacgtgaacaagatcttcaagttcatcacggccaagctcttcaacctgccgtggacggtggagcgcaacctcaccgtcggcgagcccatcatagacttctgaagactctacacccttacactgacaaaatgctaggcaaaaaaacgtaca

SEQ ID NO: 72223 - DNA, 16442 bp, Oryza sativa
  unsure (1)..(16442): unsure at all n locations
catatagaaatncatttaggaaataatagaaattcggaattaaaaataaagaatattagaagtagagtatagagtccatatagaaatccaattaggaaataatagaaattctgaattaaaaataaggaatattagaagtagagtatagagtccatatagaaatacaattaagaaaaaaaatagaaattcagaattaaaaaataagaaatattagaagtagagtatagagtccatataggaatttcaaactaactaaaattcggaaaaaaaaaggagccttcacgttcgctctcatgatctagaaattctcacattaatcggagaaaaagaaaaagcagaatctatatagaaatacaatttagaaatagctgaaattcggaattaaaaaaaagaaatattaaaagaggagactagagtccatatagaaatacaatttagaaatagttgaaattcggaattaaaaaataaggaatattagaagtggagactagagtccatatagaaatacaattaggaaataactgaaattcgaaattaaaaataaggaatattagaagtagagtatagagtacatatagaaatacaattaggaaataactgaaattcggaattaaaaataagaaatattagaagtagagtatagagtccatatagaaatacaattaagaaaaaaaatagaaatttggaattaaaaaataaggaatattagaagtagaatatagagttcatattggaatttaaaaccaactaaaattcggaataaaaaggagctttcaggttcgctctcatggcatagaaattctcacattaatcagagaaaaagaaaaaacagagtccatatagaaatacaatttagaaatagctgaaattcagaattaaaaaataagaaatattagaagaggagactagagtagttattacacattagtagttttgaaaagttattgcaaaatttaaaattatgttgtcattgtaatatattataataatataatgagaaaacatatatgctattatatgagagaaaatataatgatgctagccgcgcaatatgcgcaggccaccatgctagttattataaaccgaataaatagcttagaacgagccaggcaatgctgatgtagaaaatttctagtttgagaacagtggtatgcatatcccgaagttcataagctgaaaagattgcaccctaaatctaatgtattgtaattttcctgtactgaaaatgctgagggggggactacaaggagccaagccgaggcccgtcaccgccctcacggacgacacgtcgccagacagcaccgctagcgactgccctccggggccaaggagcacgaccgctccttcgccgggaacagcacaccgtcgccgggacacacgccgccgcaccgcctccaccacgccccatcgcgccaccgcgcacggcattgttgctctcctccggccaggtccaaaagcagggtgccagatccagccacgggggcgccagatccgaagcttcgcgccgcgctgatgtcagcccccacctatcacgcgccgcgtcatcatcctcgcgctgagccgtcgcgtcgccgaggaatggcctcgccgccgccctcacagttggcagcgcggaactccggtggtgcgctccgacggcggcgagggaacaatagtaaggaagggggcggcgggggctagggttcaccccctgtgccgctcgcgcgagagggcgacgcggggttgtgccggcttcgtactcttccaattgaggataagatgaactgatgtgataagtagtatgagattgtacttattttaaaacaaaatttgaatataaaatcatacttattttaggaggatgtagtatttgggacttggcagtaattttactgttcttggtattagaaggtaccatttattttatataaaacttggtatttctcgaggtataaaaaacatacggttaggaccgtaacgaactgtgttagctgtaggtttgcatctgttcccaaggtgatttaatttgagcaattgcaaatagctttttcttctttcactcggcagctgaatcttgcttggtggagtactcgggccgtgcacgttcatccacgggtttgatttgacattggtcatgagcgcgttttagtggacaaagtggtggttagcatagtgaaattgtcaacgcgagaagcagaaaccaattgctgttgctgtcgccggtaccaatactgtatggtgttcctgttccatcagaattcagtcgagtgcatggcagctcattcttgtggcccatcacacaattaatctccgacgatgtactgtacgtagtggagcatttagattagtaattctcgaatacattttcgtaagggttaagtgggcatatgtaacgtgttcactccttgttactatctctgttttcagatgagtgacatcatcagcatagtccgcaatacacattttatcatcataacaattttacactataaaaaacgatttttcgtgatgttaccctataatttacgctggcgtccatatgcaaaaaccgccaaaaaaacataacaataggtggggggctacggaccaccagcaaaaaccaatttttgctggtaaccacgctaagagaaacgcctaaaaaaactactctatttttcgaggcgggcctcttaagtgtccgccagtttttctaggcggacctcttaggcgtccgccagcgaaaaatctcattttcactggcagtaggtaaggaggaccactgcgaaaaaagttttgggcgaatatataaatctactgtcccccacccccaccgctcccttctcccttcccccactgcgcggcccctccgccgcctctcttccttctctctcggtttcaccttcttcctcccttctccaccgccgccggctgccgtcgcctctaccgcctctccgcggtggtggggcgtggcctcctcctctccaccgctagccgccataagctcggggccggattcggccgctgcgacgatggtggaggccggatctgccgccgcgacgacgggggaggctagatccgtcgccgcgatcgccgcagggccactagtctctaaagactaaactatatatttaaaaaaacattaccaatataactttatgaaagagagtttctcataaaaaaaaatataccaatataacttttcatattttaaatatttttacgtctattaaatttttaaggtttcaagatttgactgcacttacaggagatactactatacaagaatcaacgagaaacgaatttttaagttgcgataaactggtagtagtaagattttgtgaacaaggataatgcatatctgtgtaaaaaaaatatatagtgcaaatcacatatacattgaaaatctagaaactattgtcacgagtaaaatttttaccaaccaaacggccacaatgtcgcgcagggcttatccggggcactactgcccatgggctgaaagtgcggccacaagcccacaatatcttgcggggcttagccggggcaccacggcccatgggctctatctccctcaccagtaaagccctagcctccaagaccgcacccgtataaagctgcagacctctctctccttctcctcccccgccaccgccgctcgcctccgaaaccctagccgccccctccccgcggccgcgaaaatggtacgcttctccctcctcctcctcctcctcctctcccctccgccgcacgacgggaagatcgcacgcgtgcttgtcctcgtgccagtccacggctccgcgcgccgtctttctcatggtgtttcacaatttgtaggatgcgttctttattcatgttgatctgccgtagatggggggatcttgagccggaggagaggagtagctagtttctttgattatgcgttttggggtctagcggattttaacatgagatggtttctctttagcgacatttttttttgttcatgttgatgtccacggtgattgttctagttatgtcatttttatcttcaagacttcaatgctttgaatcgtgggtatagaccagattattgtcgtgaagatcgacgtattttccgagctgaccctctgcatgctgaaaattttgtagtgggttatatctagattatatgtgtattgttgtcatttaattagcacttaaacttctgtagtatgaacattttcatcattttcctgtgaggacatgggatgagttcctttttttttctcttgttctaaaattgttcggtaatcttgtctggctttgactaatgggctccgatgatggcatgaaatctttgagacctgacattcttgtgatgacaaacataagcatatttcctgagacccaattgaggttttaaccattggtttgctgaatgtgtcttcactgttgaaaaatttgtacacacatttgcttcaaattatgcacatttgattattgtttataggcctgcgatgtccattccacattcagtatttgttaagctgagtgcttttgtttcaaatttgttttgtataggtgaacgttcccaagaccaagaagacctactgcaagaacaaggagtgcaggaagcacacccttcacaaggtcactcagtacaagaagggtaaggacagcctgtctgcccagggaaagcgccgttatgaccgaaagcagtcaggatatggtggtcagaccaagcctgttttccacaagaaggtactgtgacagtttatatatgattatgcagtgttgtgtgtgactctctgttcattagaaacgtacggtgtcatgattgatgtatcagtgatatgtgtctgtacaatgcatgtggcaataaccatcacgtagttttaattgcatgtggctttcagctgtgcatttttcatgttatgatacatggttcctgttttcaggcaaaaaccaccaagaagatcgtgctgaagctgcaatgccaaagctgcaagcattactcccagcaccccatcaaggtattatttcattgtcaagactccagagctgaaaattatcatgaatcattattttgctggatgtgttggatgctcacttgcataattgttctctgcagaggtgcaagcatttcgagattggtggagacaagaagggcaagggaacatctcttttctaaattgcttgctacctactggatactaaagttgttggtctactgtgcttcaatatttcaatgttattaggagcttatttaagcataccatatcaatgtattcaagtatcatcgtctgacatttactctagcaaggattggctttctgctgaatcaagttttgttgcttaatgctcgttgaatccaatgtgatgcatgtgtttatattttgctgcaattttatcttacgacagttctatttaccttagtcctcagtatcccttttctttttttgttatcttacctgctgtcttttgattagtagttagcaaacatagagcgacccactttaattacttcccgtgacatgaatatgacctcgagagattagtctagtgaacttccttttcagactgaatgttgtattgttaactgtactggcgtttggtcagtatctttcgaaagagatggaatgtagggacgtaattttattgcaagataattcatttgttcttgtggttcagtatcttggaaggtcttgtgatattagtgaattcttttcgtagcattgcagtacttgctctgtccttaatgcatgattcgataggctacgcaatcccgtttgtagtaatgaattaaaaattatatattattatgaaccgaataaatagcttcgaacaagctaagcaatgctgatgtagaaaaaaattagtttgagaaccgtggtatattccaaagtttgtaactgtcataagctgccccccaacccacccaaaaaaaccggatggcagcaatcacaacttagcattgctgctcatggcaatgttcatatactatgagtgcgggttagttcagactacagacacgtgtggtaattgtttttttttagttttttattttgtttgttaggtggtgtttggatccagggattaaactttagtctttgttttagatactaatttagagtattaaatattgactacttacaaaactaattacataaatgagagctaattcgtgagacaaattttttagggttaattggatagatgccattataaaatctttagttttgaaatataccgttactattaaactatttagaaacatgccattacaactttttcaggtattgaaatatgtcactgtacaacctttggatgtgtttaacaaaaattttagaccaaatcgctctcgtcttctcctttgtctccaccctctcctgttcatcttctttcttccatttctttcccttttggatctggtatcttagtattcttcctccacatctcctttctcggccagcaacggcggtgttgtgctgcaccatctagtttcccttcttcccttcgctggccgcatcaccaccttctcagtttccagcctccccgaggtctactgcaacaaccaagacgcggagcatgtcgttcttgaatgtccagcacccggacgcccaaggacgtgcccctgtcggtgcagctggagtcattcgcctacagcggcttcaccatggcgtggtccacgtccaccgattacgtgctcgtcgacgagcgcgccttgtgcacagggccggtcctgagttttcaagctctaggacaaaaacttacgtggaggcccctatatatatacataaactaatatatatatttatagtcttataaacatgtaatatttaatatttgatatgataaaattatctatatataatattttaaaactttcaaagagaaataatataatcataaacacttacttggcactttcaaaagtttcttctaaaatttcaatgaaatcatccgaacattttttccgttttcttttttcgctaccggatacatattttcttgacaatatgattaatgttgtgctaaaaaataatcattaattattaagtagtacaagctaataatttttgatctataaagaggaaaaagaaagatagagaaaattaccttagacgacgactgcgaggcgcgagcagccgatcggccgatgagggcgcgccgccgggcggttggcctccaatcgacgtagtcagccagtcatgcagagccgctgcgatttgctgccgattgccgtgtttgcgttgcggtttgccgccgtttaccgtttgcaacgcgacgcgaggcgtgatcgaggcgacgggaacggagtcagatcgcttcacttttccttcgctcctcttcgtcttctgtcttcgataccatacatgattcaggactgagagcgatgctgaccctgggggcgtcgtgggccatggcccatccgccatggggccccctaaattttgggggactcgggcgtgcgcacgggctgaccccccctagggccggccctgcttgtgcatgatcctgacaaagtgactattactgtgtactcctaatctcacagcagcaagaaacgggaggaagaagatgaacaacagaacaggagagatgggggaggcaaaggaagaagacgggggcaatttggtccaaaatttttgttagacatatccaaggggtatgtaatggtatatttccaatacctgaaaaattataatggcatacctccaaatagttgagtagtaatggtatatttcaaaactgaagaatttacaatggcatgtatccaattaacccaattttttaagcctaattaattcataattatagaatgtttattgtatcatcacataggctaatcatggatttattaggctcaatagattcgtctcgcgaataagtccaagattatggataggttttgttaatagtctatatttaatacttctaattagtgtccaaacatccaatttggaagggactaaaaaattttagtccattccaaacacctccttattatttttatcaaatagccacgtaagcgtcatgtcaatagcacgtgggacgaagacccctagtcaaaggcgtcatgtcagctaaaaccggagacattgctaccgagagagctcgtttgcacagtttgaagaaggcgtcatgtcagccaaaaccagaaatattattaccgagggacctcgtttgcacactttgaaggatggattgtatatggttttcggataaggatgaaaaacagactaagcgacaaagtaagagacctaaagtgaacttatttgagggataaagtccacttggacttccttaactataagggaataagttcacctgacgtcccttaactttaagtcgagttcgtctgaggttcctaatccacaataaaatctctacctctcaactaatcataaaccgtgcgaaaaagatcacaaaacagacggagcgatgaagtaagggacctaaagtgaactcattttgagggataaagtcacttcataactataagggaatataagttcacctgacggccctcaactttatgttgagtttgtctgaggtccctaatccgcgatagcaaaaatctctacccctcaactatcataaaccgtgcaaaaaagatcccaagacaatattgatccattttctccggttttgctgacgtggcatacggtgggacccacatgtcagcgtcctgtcttctcctcttttcttttttctttttttttcttcttggcttttctttcttctctcttctcctcttcccttcttctcctagcctgagaggccggcgggcgggcgagcaggcgacggcaggcggtggcggcggtgtgcggagcaagcaaggggtaacgggtggcgggcgagcgacggcgcctcaaagagggtgtggtgtgggcgtcgctgtgctgtggcgggcggagcggggtggcggcggtggggtgcanaggacgacgacatatggaagtgatggcggacgctgtaggggacgatggcgaggaggacgaagtagcccgggagaggatgactccgacgcgcttggggtttcaccaggagacctcgccttcaccgtcttcgtgccctcaccagagtcgttccaccgcgtcctcaggctgcggcgtcccaataacaacgttgccgatgggtgggtctcacattttccttctatttcacttacatgtgggactcacatattattttattcctattttgctaactaggatgccacgttagtgaaaccaagacatctatactgccataggacataaattgaacggttttgtatatttggggtgaagatttctggtattgaggataagggatggcaaacaaactcggtgtaaagttgagggacatcagatgaacttattccaactataaggcaacgcatcacggtgcatggcccatgggctgcgcattctggcccacaaagcagcacacgcaccagtaaaccctagcctccaggagctcacccgtataaagtcgcagaccttctccttcccctccccgccgccactcgccgcagcgtgtcgaccagacaaggcagcgcctccgaaaccctagctccccgccttcccctccgcggccgccaaaatggtacgcttcttcctcctccccgtccgcctctctccgccgcacgacggcaagatcatgcgctcgtgtgtcctcgtgccagtccacggcaccctgctctggtcgatttgtagggggattgcgttctttattcatgttgatctgctgtagatgggggcgatcttgagccggaggagtagctagtttcttattgatgcggtttcggggtttttagagatttaacacggtttcgcggtttctctttagcgatttcttttttcatgttgatataatgatatccacggtggttgttctagttatgtcatttttatcttgagtgctttgtgtgattgtttttcaattgtgggtagagaccagattattgtcgttaagatgcatgctctgaaacgcggaatttttttgtaatgggttatatctagattatgtgtattgctgtcattcaatagtcttttcttaatacaaggcgcaaccgtcttttcttcaagtaccagtatacaaggcggcaactgctcaactccgtacttggtgcatgcaagcattgaatggatggttgcatgagctcatgatattcggttcattagtttaaaggcaaaggatccaccactcggatgcttgcatgcacgcgcaaaaactgcaggacacgggtgcatgctgctttggcactagatgcgatgaactgatcaaagcgtcacgcattggaacgcgctggaataaatcggtacgatgggtagttataggttttcttgttctccgagtccaaacaagttatgccttgtattaaggaatggagggagtagcaattaacttctggagtaaacatttttcatcatcttccttgaggacgtgggatgaattcttttttttatcttgtgcgaaaattgtttggtaatcatgtctggttttgactgatgggctccgatgatggcatgaaatctttgagacctgacattcttgtgatgacaaacataagcatatttcctgaggacccaattgaggttttaaccattggtctgctgaatttgtctttgctgtcgaaaaatatcgattcacatgtgcttctgattatgcacatttgattgtgttgtttataggcctgctatgtgctttccaataaccagtatttgttaaatttgtttcatatttcttatgtataggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggtattgtgacagtttatatgtgattacgcagtgctgtgtgtgattgtctctcttcattagaaacatatggtgtcatgatttgtgtctgttcaatgcaaacatgtggcaataaccatcatgtagttttaatgtatctgactttcagctgtgcatttttcatgttatgatacatggttcctgttttcaggcaaaaaccaccaagaagattgtgctgaagctgcaatgccaaagctgcaagcattactcccagcaccccatcaaggtattatttcattgtcaagactcaagctgaaaattgtcatgaatcaatcagtatctttttagatgtgttgggtgctatcttacattattattctttacagaggtgcaagcatttcgagattggtggagacaagaagggcaagggaacatctcttttctaaactacctactggatactgaagttgtgggtctattgtgcttcatacttcaatgttattaggaacttaatttaagcagaccatatcatgtattcaagtatcatcgtctgacatttactctagcaaggattggctttctgctgaatcaagttttcttgcttaatgctcgtcgaatccaatgtgatgcatgtctttagatggcactgcaattgtgacttttgtcttatggcagttttatctccctaagtcctcagtgtctgtttttcgttatcttacccgagtttgcaatcctagagcgacccacgtaaacgaattcctgtgacatgaatccctgagaggctagtctgatgaacttccgtttttcagatcgaatttcgtatatggttaactatactatgttttgttcaatatcttcgtaacgagatggaaggtatggaatactatggatggaggtgaattgaaagataggccttggtcttgtgattgttatcttagaaggtcgatactaatgtttggtcttgtggcgttagtgaaactgttttcgtagcaatgtttggtcttgtgatgttattgaactgttttcgtagcattgtattacttgttccattcttcatgcatgatttggataggttattgacaattgtttatagtaatgaattaaatattacactcctaaattattataaaccgaataaatagcttaaagcgagccaggcaatgctgatgtagaaaatttctagtttgagaaccgtggtatgcatatcccgaagttcataagctgaaaagattgcaccctaaatctaatgtattgtagttttcctgtactgaaaatgctgttggatcggacagccgtggtgattggttgcgttcattttcaagttgtagccaagttaaataaagtatagaaggatatgcaagtagcaacatcggaggagtgccatcgcagtgatcctcccaaaaagcacgaaagaaacatcttcattggaacctaagcagctctggccttttgagcccagaaaagctatccttgattcaagcacaaaccgtcatttggttatatgctttctccaaatactagcatgagtaaattgcattggcggtacacgaacttgctaggtggaagcaatctagtacataaacttataaaacgctcattttgatacacgaacttgttaggtgcatgtgaatcaaggccaaaagaaaaaacaaagctaatcttattttagtgttaattaggatactacataaacacatgtgtgagaaaaatgctaagtacatatacatttgttcaataaaaaggggttaataaggcctaaagattgtatggagaaagacacaaaaatactgagaaatagtgcaaggggtagaacaaagaataataaagcacaaatgcatgtctcatgtccacctccatatgcacatctcgtcctaatcagtgtataacttagtaaaattgattatgatgtgtcattttgaccttgtttcacatgcatcgaacaaattcatgtaccgaaacaagtcttttacaagttcgtgtagtaaagtgcatccatctggcaatttactctactagcatttgaagctaaaaggctttggccttttggagcccagaaaagctgttcttgattccagaacagatcgtcatttttggggtatatgcctcctccagaatcctaaaattctcatttcatgtaaggaaaatcgcaagtgtccaacgctgaatccatcccagagatctcagtgagcaaattgcacagcgccagttgggactattcaaggattttcagggccatgccctgtacccatcatccatcacccagcaacaaaacaagccggaccgtagtgtgtcaagcatgcactgcttctgctctccgatctaaccggtagcccccaactcattctgaaccacaccttgtgttttggaccacatcacaaaattcagaagcagcagcagcagcagcaaagggtcaagcaaaaaatctaacagctttatttaggcagatccacctctctacatcatcatagtcatagtacaagaactcgacgaattcagaagaaacattggcagctacacctagagaaagaaaaatgaaaagaaaagaagatctaatatattacaagggatccttggatatatgctcatagcattgttacatcccgagcaccgagtcgcgacttgtggcgaaaacgggtgccatttccatgcttatgccattactgcttcgcctgaaaaaatgagatgttttttttttggttagagattcagacttatgttcatgaattggctcttttgtgaaaaatgtgatttggtaaaacatgtgcggaaaatctacctgagagtagatgaaagttccgagaatcgcaatggcggctccgagggcgttgatgggctggaccggcgtgtggaagatgatgatggaggcgacaatgacggagatccgcttcatggtgttgccgatgctgaatgtcagtggtgagatctcgtccaatgacatgtaggacacttggttgtacaagtggtagaacacactctgcgccgccacccacctacaaaaccacagagaaatccatggccacatgaatcagctggattatcacacaaaaatatcatcaaatcttttgatacttcttatttctctttcagaatgaactgaagaagatattgccgcttaggaggaaatgatagtgataggacgatcctatatctatattaattgataatggttctttttgtatagaatacttgagtgatgttactgaaagtacaaagtgttgcatgctgaaactgtttgaaagcttaggtcaagcacttatcactagaaattttttgcccaattgatacccaaaaatctcaactgacgtgatggttgtgacagtgaaacggtgagaagtggtacaaagaaaagcatgtgaggctcaccagacgaagtttggaccgatctcggcgacggctttttgccagccggcagcccacaccttgggcccctccatggcgaaggcgaaagggaggaggatgaccagcgagagcatggagaggcaggcgtagtagttcatcccgctcaccgacttgcccttcatccccttcttggagaatatgttccggaacacgaatgccaggttcgagatcatcgcccccatgaatcctgcatcgaattttcagcaatacacgatgaacagattgatgtgatgtgtcaggtttatgaacaaattgtgcactttttcgtggctggtgtatatttctttatctgacataagaaaacatatctttggttaatggacagttcttgttctgaagaattcttggagataatatctatttttttaatcaaaaagtgaggatatttctggtgtatctgctgcaagtatctccaggatttcaggtggagagacagagagatgcagagtgtttgctcactcaccaatcatgttgaaattgagctcggtgatggcggcgagggcgcatccgccgatgattgggaggagggagaagtagaccggcgccgggaagtgctcgccgaggaagaacctggagacgagcacgctgaacgccggctcgccgctcttgatgatgtgggtgaacgacaccgccaccttcgccatgctcaccgtcgccgccacgtgcccgatggtgtgcgcgatcgccacctgctcgtcccacaacgagcaaaaacgaatccccaaatccaacgaacgcgtcagagattcagaatagaacagaatcaagaaggaggagacgatggtgtccatggtcaatgcgatctcaccggagacagggccttccagaaatcgaggtcggtggcgggcgcctcggcgatcctggtggcccaggaggcgagcatgatggcggagccggcggcgagggagagcgtggacgtgagccacgggtaagggaacgcgttgagcaccttcttgttgtagatgttgaagatcacgttcagcgcccaccacgtcgcgaagtagaccccgatcttggcccgcctcgcggcttcctccggcgccgcgcccggcggtgcagcctccaccggccgggcgccgtcggcggtggcggacgtcggcggcggcgccggtgacgcgacgcgcgacgccaggaataacgggtcctgctgccggtacagggggcgcgccgagagggagagggtacgtggcccggcggcggcggcggcggcggcgaagaggggagggaggtggaggggcttgaataatgccatcttgggcgccgtggcggtcccggccgtggagagcttgacggaggcggcggcggcgagcatattggcggcgggaatggtggcgccggcttcttcagttacagttactgtgttgtgttgtagccggccgtccgtacgtctatggcggcgatgggttgcggccatagagaccgctcgcatcgagtcttcttcaatccgactataacaaattgctagctagttccacgccctccaacgcccttttagggaaggaagcctcaaaggagggagggccgccgaacaatgtggttgaggacaatccaaggaaaagggtggagacgaagagggagctggacaaaagataagtggtagaggggggaatcctacagctagaagaacatcaaccgcgtcaacagggaaggctgcaagaatagtagccattcaagccaaagaaaaccgtaggcactaacataaaagacctgacctaatccatcaatcaaggagcatgctaaaaggagatctagagagagggagaggcactagcgaatcctaattgatggatcagagccaagcatgttatggcaaggagctcgttggctagctcaagggcgcctcaaagaggagggaggaggagggatggggatggaagaaggtgttgggcaaggtcaccagtcccgcgggggagggggggtccgaggccagagcctgccaccggtgccacggattcgaccagatccagacgctaggagcgcagatctgcacgccaccagtcgggggcgccgggcctagccttcatcgccggctgaggggggggggactataaggagccaagccgaggcccatcaccgccctcacggacgacacgtcgccagacagcaccgctggcgactgccctccgcggccaaggagcacgaccgctccttcgccgggaacagcacaccgtcgccgggacacacgccgcggcaccgcctccacacgccccatcgcgccaccgcgcacgg

SEQ ID NO: 72224 - DNA, 2261 bp, Oryza sativa
aggacgaaggagtagaggacggtgtcgtccatggtggtgatgttgagatggagcacctcgagatggaggctctcgagaagggcgatgatcctgacgggaggggcgcgcctagagagcgtgcgaagaagcacgttggcgccggagatcctagcctccacgtcggccatgggggagttgcagcaggcggcgagctctgctaccagctgcagctgctgcttattttcgtccttgggggagatggaggatgagctgccggcgctgctgccggcggcggcagtgggagagcaggaggtgatgagggagcgcgggctgggcgtggggctggggctgccgccgccggaggccgatatcgatgccggcgagattaggtgcgcctgcggctgctgcctgcgcttcttctgggcctccagcgattgcagtagcgtctgtagctccttgatgaagtcgatggcgccgccgatgatcgacgcctggtcgccctgcatgcatgcaccatattattatatatttgtttatcatttccatttccatttccattagaaatattaacaacgtggagtacgtacgtacgtacccgtttgatgtagaatgcgggcgtgagcgagcggagcaccttgaggtggtcgttcatctgccgccgccggttgcgctccacggcgatgtgcgacataacttaattaatttacttacgaccttgtcgatgcgctagctccacggaccacggcttgcttggcttggcttgtcttggcttggctaggttagcacatatcgaatatgtatatatatgccaatctgccatgcatatggcattaattgtcacaacacaaagtagtagtagtagtagtagtagtagtagtagtagtaagttacggcaggtctatctgcgtggatgcatgtatggagtgtgtgagtgtagaagctcacgtacgtacgtacgtgcgtgtgggcccacgtacgcacaaataaacttgtacacggtcgcatacatgtatgcacgtactatatatgtgacgagatttaatggcagcgcgctgggccggcagctagctcgatcatcatgtccccgtgaccgtgaccaagcgcaagcgcccgcgcccatgcacactcaatgcctccataccggcaactctttggaacctcagcaagtaatctcacgttactcaactcgtgcgcatgctcgccttttcttttttcctccgccacattaattctgctagctagctgattctttttttttattttttttatttttttgaagaagaagatgctagctgattctttttaattatttttatttttttattttttgaagaagaagatgctagctgattcgttgcgacagaggtaaatcaaggaggaggcaacgaacagcagctcgatccattggagtaatgcaaccctgctgattttttactcatgtcattgtctcctcttctcttccgctccactccggcttgaacacctgccacaactgggccgatcatcgtttctccccttcgttttgttcgcaactgggccgagccactaagcttccgggccgatccaaggaaaacggcgctccagctttggaaaaagtacaccgaaggtccctcaacttgtcatcgaattataaaatcatcctccaaccgcaaaaccagatataggacatccctcaacttacaaaactgttcactttaggtccttcggtggttttgatcccggtttcgtccgatgtggcggctgagtcagcgtgggacccacgtgggtcccacatgtcagggtgtacagtcagcacctctcccttcccccttctcccccttcctcttctctctctatttctctctctctctcttttcccctctgcaggatgctcggcaggtggggagctcgtcgaggcgaggtgggagaggacatccggctggctggcgatgcggcggcggcggcggcgtcgtcgacgatgcgggagatgggagagcgtcacaggctcaccgcgcatgcgacctcgaggtcgggccatcagagaggcccgggcggtggcggcgaggacgccaaggcgcgagactccgggtggcggcggcggcatacgacgcgctgcgggcgccggtttgggaccaattagaggagcagagaagattagggccaggccgtcatctcccgacgacggcggcgaggcagagaaagggcggcgcggtgaggagggctcgatgaagaagatgaggagcgtggtgctacgggaggccatggcggggctcccggagcacggcgacagctgtgtgaggtac

SEQ ID NO: 72225 - DNA, 2820 bp, Oryza sativa
aattccgtaccatatgacagcttatttaattaaagcctaatgcattcgatcacagcctaactaggttttcaaagatggatatcagtactagttaagacaccatgattaattagctctcaaaaaatctttgcttgctgatcagtacttgatcgggccacggtcgacaacgtgcagaccaaaacgtgttgtgtgtatgggtaggagtgatagatttatgtccactgttttgatcttttgacacaaacttgagcctttttaatttcctatggattaagaagaagatcaatatagtttagtaacctcgctttgaaagtgtagttaattgatggtatcaaagccacttcattataataacaagtggcatgcattttgcttggtctaactagattacaagcaccggtttcagattttcagcgaactgataattaatttcaggtcatgggagcataacacagtggcccaatccccatcaacaacgtatcagctacggcattttgggtgatgaccacatgacacagggtgctataagtatgtagcctaattacctatacaagattaatcgtagagacaggatggctgacatgctgatgagcagtagagtagtactaaccacacctctaatggatgattgattggtgcccatgtgttgtggttgacaaaaacttcttctttgcatggcagcatggcaccacatctcctggttttctgcatgccctctggcaaacagacattcctctggaagaaaaggaaaagtgagaaatagaaaacaaaacctgtcccttgaatgagtactgagaaggcaaatgtacaacatttagaatctgttctggagtatggactatggaggtacaaattgcacctaaaaagagagaacatttcaatagtaaacttgaaagagatgcatgcaaacaaataagacatgaaagggatctgtcatggttgctaaaacgacttcacatagacataatttgcttattttatcggtactatatttgcaacgtttacatcgaattttaagtggcctagactgattaatattctgacttgtgactgaaacaaaagatagagcagcactgtaaagcatttagtttcttctgtagggaatagcgagttttcatctaaccgatcgagtgataaacaagtaatttgtttcttctctaaagaaacattgttggctcgttttcatctgcctgttcattgtctgaatgaaaattgatgttcagattatgtgcctcacaacttctgcacatggcttgtgttttcataatagctagaatgattatggtgttgaaagttatacctgaattcgtttttgacggcgtaaatcaaattagcacttctggggttccttttgacatttcagagccaaatcattgagtttttccctactagtatgtttgaagggctaatagaatatggcccccatataagaatccatggcacgggagcattgacttattgggacaaacatattagtgccaccgtacctgccatgacttgcttacaagacctgaaataaagatgaaaatgttcagaggtacatgaatcaagaaaacagaaatattgtatgtgcaagaacaaatgtaagggtaattagggaacaaaaatcctttgagaagactaacaggctgtacagaaaatggacgaatgtgaattgtaatgtgttatatagtactagtacttatcattatcctagtaaatagtgggaaatgtggatctcagctggtgctactaatcctcgcttccttggagattctaaggatttgattaatgatgttgtccatgttttaagctcagtggtggcaggcaaagcgcaggaaaaactccagctacagcttcatgctagcctgtctttgggacaaaaatcattggaaatgcaactattactccaactagtcaacagcaagaaaaggctccaaatattcagtgcagataattcaatataagaaagaatatgctgttcaatacaagacagaaacttagcagcatttctatgctgggaatattaatactatgggggttgacacatactaagtatgatcttagaataaaaccagagagatgtatgaagttaatggcaagccagttcataggatagcacggaataataatactatcaagtatgtcctaaattgcaaaatcattaaaaaaaatgcagcggaaaatagctttttgtacctatcagcaaaatgcagggtccagcagtaactggaatattttatgccacagctcatagatattaggtgctatctgggaacaatctaggtggaccattagagagtttagtctttaggtactacaaactagatatatagaaggtagctaatcaatgtgattgctgaggttagctgttgcagccaatttagaaacatggataattttgtatgtattatagatatactccaagttaaaagatagagatgcctgagaacaattgacatcaattgcatgtctccagaactcggaagcttcagaactaatgtacctgtcagattatcaattggcaaaaaacggagctgataatcaacttaaccatatgggcatacagggagcaaactaaagaagttaatatgcaaatactaaattccaccaaagaaacagcattgtacaatcaggtcacatggataggaaatctctagacatatagatatatccaaatttcactgcactaacagcaaacctagtataaatagtatgtcgcagtttgttgcaggaaggaacataaaggagaagcataggtccaaagtaagcaatctgggtaccattagttaacaaagattatttgcagcaacagcggtgagaagatggaatctacataac

SEQ ID NO: 72226 - DNA, 11205 bp, Oryza sativa
  unsure (1)..(11205): unsure at all n locations
caagggtataaagacgccgaggaagagatttgcttctgtcctgtcgccattcttccccttgccttcgccacttgagcactaactcttcgtttcctgtgccctacccttgccgcactcactcgctctcaagctcctcctccgccggcatcatggcacggggctccgcaccgctcgacggtagcgtgctgccgccttcccgcatcgtgagcgagaggcaggccgggctgccgcgccgattcatgccggaatctgtcaccggccgggaggtggtcgcgctgggtgagggacgcccggcgccacactacccggggcggtccgtcttcttcctctctttcgcaatggcagggctggtcccgccattctcttcttttttcatggatattctggagttttatgatctccagatggcgcacctcacccccaacgcggtaatgacgttggccatcttcgcgcacctgtgcgagatgttcatcggggtgcgcccatctctccggctgttccggtggttcttcaccgtacagccggtgtcgccgccgtcggtagtcggtggctgctacttccagccgcgggggcaggtgctgaaccgctacattccctgcgtcctccgcaaaaagtgggacgactggaagagcgattggttctacaccctcctcgccgacgaagcgcgcctccgacttccgagccagcccccggcgcaggcctccagctggcgggcgacggtagatctgggagacggctacgacgccattcttgaccgcctggcgggtctgcgatcccaggggcttacgggggccatggtgttcggcgactaccttcgtcgccggatcgcgccgctccaacggcgcgcccggggcacctgggagtacaccgcgtccggcacgtcgatcggcgggccgagccgtgcggcaccctcaccgagacggctctcccctctgccttccgctgccccaccgagcgcagagccccttctgcaggccttggccgccgcgaatactacggtgttagacgggttaagtgcccagatggaggtcctgcaggcggagcgggcggagctcgacgcggcgtgggcgcgcgtcgaggaggggcggcgctcggtggaggccatggtggaggcgggccgcaaggcacaccgccggcacgcttccgagctcgaggcccgtcgcagggacctggcggagatcgccagggaggtggaggaggagtgggagactgccctcatcgccaccgccgtgctcgacgaggtgcgggacgacctccgcctccaatacgggagtcgggcggcggagctagagaagaagctcgacgccacccggggagtccttgacgccgtcgctgcccgggaacggcgggcagcggagatcgaggcggcgtcccggcagcgcgaagaggcccttgaggctcgcgccacggtgctggaggagcgcgcccgcgcgaaggagagggacctggcggaccgcgaggccgccgtcgccacccgggaggcaacactggcggcgcacgaggccgcctgcgccgaagaggagtccgcactccgcctccgcgaggacgcgctcaccgagcgggagcgagctctcgaggaggccgaggccgcggcgcagcggctggcggacagtccctccgcgtggcagcgcgggaggagtaagcgcgccgcgatctggaaagcgcccgcgccgagagggccgcactggatcagcgtgccgctgagctcgaggagcgagcgaaggagttggacgcgagagcgcacagcggcggggcggccgcgggccatggcgacccagccgccctcctcgcagccgccgaacacaccatcgccaagctgcagggcgcgctggactcgtccgcaggggaggtcgaggccctccgcttggcgagcgaggtggggcccggcatgcttcgggacgccgtctcccgtctataccacgccgggcggcaagcgggtctctggggcggccgaaccgcgaagtacgccgccaaccaggggggcctcgcccagcgcctctcagagatggccggggtcctcaagcggctccccgaggagctcgaggagacgatcaagtcatcctcgagggatctcgcccggggggcggtggagctcgtactggcaagttaccaggccagggaccctgacttctccccgtgggcaacgctggaagagttccctcccggaaccgaggacggcacgcgcgcgcgggtccgggacgccgccgaccacatcgtccacagcttcgagggtacggcccctcggctcgcgttcgccctcgactctgacgaggagggcggtgacgacggtgtggacgacagcgacgacgaggccggcgacccgggcgcgtcggagtgagcccccaggcccccgtctatcttaatagttttttctttcctcttccgaggccttcgggcccccttcttgtatagactaatttaatctgcaatcaaataaagaggaaatttctgtgtcaattctgtttgttgtgtgtatgagacgaggatggtctgtgccgcggtccttctgtgtcttggcttgaacaagggctcgtgcccaggtcccagcctcaaacggcgcgggtcggggctagtgcctggggagatccacgtgtcgagactgtccaagccgggagcgtggtgaccgagggttatggatgacccgattgtgggcctttgccaattcccccccggagttcaccacgccccggggcacggctcggttctgggccccttttggcgattttagccggcccgggacaccgagggcaggatcgagcacgagcgtgctaattcaagccaagattcttcaaaaggaaacaatggcacagacacagtccttaggaaatcgaaaaagcttttattgaaatacggaagagaaaaaagataagtatatgcatgtggtagcccccggccaaccctgcacgcccgggggggtgcggggttggcctgagcccgagacctgacacccgacccccactaggggtagaagcgacgaaggtgttcgatgttccatgggttaggcagctctgtgccgtcgcccgtggccagccgaacggagcccggccgggggacgccgatcactcgatacggaccctcccgcattggtgagagcttgctcagtccagcacgcgtttggacgcggcgtaggacgaggtcgtcgacgcagagtgatcgggctcggacgtggcgctgatggtagcgccgcaggctctgctggtagcgcgcggctcggagggccgcgcgccgccttcgctcttccaagtagtcgaggtcgtctctgcgaagctgatcttgatcagcctcgcagtacatggtggcccgaggggacctcagggtgagctcagatgggaggaccgcctccgcgccgtagacgaggaagaaaggcgtttccccggttgctcggcttggcgtggttcggtttgcctagagcactgctggcagctcctcgatccacgagtcgccgtgcttcttgaggatgttgaaggtcttggttttgaggcctttgaggatttccgcgttggcgcgctacacttggccattgcttctggggtgggcgggggaggcgaagcagagcttgatgcccatgtcttcgcagtagtcaccgaagagctcactagtgaactgggtgccgttatccgtaatgatatggttaggcaccccaaaccgagcagtgatgcccctgatgaattttagcgcggagtgcttatcgatcttgacgaccggataagcctcgggccacttagtgaacttgtcgacagcgacatacagatactcgaacccgcccggggcccgcctaaacggacccaggatatcgagcccccagacaacaaacggccacgaaagaggtatggtctgcagggcctgggccggctgatgggtttgcctggcgtggaactggcacgccctgcaccgccggaccaggtcgaccgcatcgttgagagccgtcggccaatagaaaccctagcgaaaggccttgccaaccaaggtgcgtgaggcggagtgggctccgcactcgccttcatggacatcggcaagaagctcgacgccttgttcccgaggaatgcacttcaggaggactccgttagccgcgcgccgataaagggtcccttccaccagcacgtagcgcttggagatgcgctggacgcgttcactcccttcgcggtcctcgggtagagtcttatctgcgaggtacgcctggatctcagcgatccaagcaatcaatctaagggagctgggagcgctcccctcgggtcccgaggcctggactccgacgggccacgggggccgttcaggcgcatccgtctcccctagggggtcgggtcgcgccgacggctgggcaagcctttcttcaaaggcgcccggtggggtctgggctcgcgaggaagcgagccttgagagttcatcggcgaccgcgttatcccgtctgggcacgtgccgaagctctatcccgtcgaaatggcgcttcatacgccgcacctggcgcacgtaagcgtccatctgcgggtcagagcaccggtactccttacagacctggttaacgaccagctgggagtcgcctaacaccaggaggcggcggatccccagtccagctgccaccctaagtcccgcaaggagtccctcgtactccgccatattattggttgcccgaaagtcgaggcgaaccatgtatctgaggacgtctccgctcggcgaggtcaacgtgacccccgcaccggcgccctgaagagacagggagccgtcggactgcatcacccagtaggcggtgtgaggcagctgcgaggggtccgagctggcctcggggacggagacgggctcaggagctggggtccactctgccacaaagtcagcgagggcctggctcttgatcgcgtggtgtggttcaaagtgcaaatcgaactcagagagttcgattgcccatttcaccacccgtccagtaccctctcggttatgcaagatttggccgagggggtaagatgtaaccaccgtgacccgatgcgcctggaaataatggcgcaatttccttgaggccatcagaatagcataaagcatcttctgggcctgagggtatcgggtcttggcgtcccggagggcctcactaatgaagtagacgggccgctgcacctttcggcggggccgatcctcttcgccaggggccacatctccggggcgctcttcgtccgagaggccaccaggggcgcactcgacttttgggccgacgacctcggggtcagagggcgacaggcgcggccttcccgcagtggccccgaggccatcctgggggtcgggggcgcctggcaccgtcggacaagcgggcggagggcctgctccggccgtcgggggcctcgggccgctgttcggctcgggggcctctcctccctgctctctcccgggtcgagtcgacacagggtggggatgcgcggagtgagggttgtcctcgtcgcactccactaccaacgccgcgctgaccacctgcggggttgccgccaagtagagtagcaacagctcatctggctccggggcgaccaggactgggggagaactgaggtacgccttcaactgagtgaaggcccgctcagcctcctccgtctaggtaaacggcccggagtgtttgaggagcttaaataggggtagcgccttctctcccagcctcgatatgaaccgacttagggcagtcatgcagccggtgacgcattgcacgtccctaagcttgctgggggccgcatccgctctatagctcgtatcttctcggggttggcctcgatgcctcgggcagagaccaagaacccgagaagcttgctcgcaggcacgccgaacacacacttatcgcggttcagctttatgcgggcggagcggagactttcgaaagtttccgctagatccgagagtaaggtctcttggttgcgtgtcttcacaaccaagtcatcaacatacgcctcaacattacgttctatttggttacccaaagaaattcgagtagtacgttgaaaagtaggacctgcattctttaacccgaaaggcattgtcatataacaataagttcctatgggggtaatgaatgcagtgttttcctcatcctccctagccatgcgaatctgatgataaccagagtatgcatctagaaaacacaaaaggtcacaccccgcggtggagtcgacaatctgatctatgcgaggcagggggtaagggtccttaggacatgccttgttaaggtcggtgtagtcgatgcacatccgaagcttgccgttcgccttgggaacgacgaccgggttcgccagccacttcggatggatgacctcacggatgaatccggcctccagaagtcgcgccacctcctcacggatgaaggcttgacgtttcggggcctgccgccgcactttctgccggaccggccttgcgcccggccgcacggcgagacggtgctcaatcacctccctggggaccccgggcatgtccgccggtctccaggcgaagacatcggcgtttgcccgcaggaaggagacgagcgcgtcttcctatttgtcgtctagaagaccaccgattcgtgtggtcttggacgggccgtcgcccagggcaacctccttgaccgggacctcgtcacacgtgatcatccgctgcctcggggcggcagggacggaggtgctgagcctctcgtcgccaccctcgggcttggacgccgcggcgaggtggtccgcgcgctgctccatacaagcgagcgcgactttgtggtcgccatggacggagatggggccaccgggacccggcatcttcatctggagataggcgtagtggaccgccgccatgaacttcaccaacgcgggcctccccaggaccgcgttgtagggcagactgaggtccgccacatcgaagttcacccgctccgtgcggaagttggcggaaccaccgaaggtgaccgggaggtcgatatgacctagcggccaagtgtgccccggcgtcacatcgatgatcggctgggacggccggagcaccatccccagggccttgatggcgtcaaaggctgcgggggaaaggatgttgagggctgcacccccgtgtatgaggacacgccccaacttcacgttgcaaacagtggggaaaaccaccatcgcgatctgtactccccgggcaacgcacggcgggtggtcggtctggtcgaaggtgagggcaacctccgaccaccacgcccgccgcgtcgcctcatgggtaggggccgcggccagaagctctcgcttcttggccttgaggctccggcgagaagcgtgagcgcacgctcccccatcgacggtggcgacggtggcctcaggctcctggaaccccaggtcatcgtcgccatcgtcgacgtccccggcggtggccttctgcttggcctcacctcgccggttgccggcgggagccgccggggccttgccctcacggcgctcctgcctcctctcctcctcccacttcctcatccgctcagccaaacttttgactgcgcggcagtccgcgaggtcgtggagggaggtgttgtgcacagtgcaccacttgccagtcgggcgctccctgctgggagcgccggcctccttctttttgtcgctcgcaggcctcccctttcgggtggcccgcgaagcgccctcgacggcgaggacgtgaccctcgtcgtcggaatgggccgacctcttcttcctcctcctgtcccgccgccctgaccgagcggcggacccaggggcggccgaagctgccacaccggaaccggaggagttccaggtccaggcctcctccttgcgagccacacggtccgcgagctaaaaaagctccgcggtggtctggggctccatggaggcgatcttctcgagcatgcggttgtgccgcacgcccccctgaacgcgtatatcaccgcgtgtgcggggatgcatggtatggtgttgcggacttgacagaaccgttgaatgtacgagcgaagagactcatcgtcccttcgctgtcccgcatgcaagtccgcttcttcacctgggcgcggatatgtgccctggagttcatggtgaactgctggcacaaatcctcccaagagtggaccgatgcgggtggcaagttcattagccaaccccgcgcctgacctttcagggccatggggaagaaattcgccatgaccctgtcgtcacccccggcggcttcgatcccagtcgtgtagatctggagaaactcggcggggttaacgcttccgtcgtatttttcggtgatggtaggccggaaccttaggggccaacggacgtttcgaaggctcgccacaaaggctcgacagccggcaccgccaaccggggacacgggggcctggcccccgtgcccggaccgaagtggcgctccagatgaggaagcgccctccgttgcgtgggcagcacgacgaccattgcgccggcgctcgatattgaggtgggcatctggccccccacgcacatcttcttgggtcggaggcgttgacgaaggaatggcggacgaacggcgggtaacggccgccgctcgccgcgccctccgcctcgacgacacggagccggcggtagcagcgccagaggccttggtggcggaggaccgcccgccggcgcctaggcgctgctgcgccgtcatgaccaagttggccacgtcatccagccaacgtcgggctggagtctctggatcggggacgacgggcgggggacgcaggagcgcgcccgcagcctggagcgcgccctggggcgtgctgccatcgccgtagacgaggaggcgacgctccccgtctcgccgtccttctccatcgcccgtgggcggtgaagtcgcggatctttcgacctcctcgaacgcctcctcccgcccaagacttcggcgagagggggacggtggagtacgagctcgacggcgcgggttctgctccccgtcgtcaccgctagcgctcggagagaggttgtgcgccactgcctgttcggccattgggctgagcgagggaagcttggcgcacacgaaagaggacgagggcttagaaagacacacgcgccccctacctggcgcgccagatgacggagcgtggggctcctcaccgggagaccgcgcatgcccccctttgccggttcggccgggggcgctaagtgaggttcttcaccctcgatctgtggaatgttcgtgagagagcaaatgcacaagacacgggcgatgtagataggttcgggccgctgagaagcgtaataccctactcctgtgttctggtggatctgtgtgtgaaagagttacagagagccggagagcaagagagttcaggctctagaaccactcttcttctttctctcctctacgagctcaggtattctcagagtcgtctgagagtctctcccttttttttctcgtccccttgcttcggtgggcaaggtcctccttttatatctcaaggggataccacatgcaccatttttacctactcttcttttggatggggacccaccctatcttgaccaaaacttggctcgcgccttcgcctggaagctaaatcacagcttgtccttgagtgaggccttgcgccgtcactcgcctgacacaggggatagccctgtcattccttcattaatgggtggagatttgcaatggccgctgtccgaatgaccctccgatgggatgggtcatacctacctccactccgccggaagcagatgcaatgtgggagcacggttgtctgccgatgacgtgaccggcgtcagaccagtcacaaaccggtcattcttgtctaccacgtgtcagtttagcatgccacacgtctgcccttcttcatacaattacttccttgtaatggttgcgatgaagcctggtatgaatctggccgggactgacatacccactccaggagctagcacgccagctccggctagagacgagtgcctggaggctctcatcatttcgacgggacggggcgaggcgtgtgacaggccgcctgttgccacctaacccgcgatctgaccggtctgtgaccggttacacactgcaactggtcacggaccggataagcgcgcactgcgccgcattaaatgcggcgtgacgcgctcgtcaatccgctataagtgcggttaggtgagcgccgctgtgctcacctaacccacacacgtggtgccaaaaccacagggggtcggggcgccccagccctcggggccgaagcgggagcggcccgacccctcggggagacagagggaggtgtggccacgtcaccctcgggcctgacccccccgagggggtcaggccacgtgggtgaccgcggctacccaagcctctagtcacgataccctcggccccatgtcaccgacagtagcccccggcgttacgccagggcgattgcccccttcgagggaagcgctcggacgtgacgccactccttaggcccggtgacaggtggggcaggtccctacaggcgggcaggaacccagcggtcgcaagttgcgcgcatcggcaagggaaaaccgaccgacaataatgagcggcctctttaagaccgctacattactcgagcagtgcgcgaatcgggacgagccggttcgtttcgcctggagacgtgatgatggcgcttttcgcgtctggcgagcatggttaatgcgcgcttgatctgtcccatctcaactgctacggccgcacatccgtctcgtgtgccgcaaacgggcgagttgggttagtggaggcgtgggcgcgagaaaccagggggcgaggtagtgggcgcgggaaacgaggagccgggaatagcgttggcaagggtataaagacgccgaggaagagatttgcttccttcctctcgccattcttccccttgccttcgccacttgagcactaactcttcgtttcctgtgccctacccttgccgcactcactcgctctcaagctcctcctccgccggcatcatggcacggggctccgcaccgctcgacggtagcgtgctgccgccttcccgcatcgtgagcgagaggcaggccgggctgccgcgccgattcatgccggaatctgtcaccggccgggaggtggtcgcgctgggtgagggacgcccggcgccacactacccggggcggtccgtcnttcttccttttcttttcncgcaatgggnccagnggggncccttttggggggggnttttccccccccccccgggccccattctcttcttttttctggatattctggagttttatgatctccagatggcgcacctcacccccaacgcggtaatgacgttggccatcttcgcgcacc

SEQ ID NO: 72227 - DNA, 6634 bp, Oryza sativa
tgcccctgctttcttcatgaactttatgaataaggtgtttatggaatacctagacaagttcgtggtggtctttattgatgacattcttatctactcccgaaccaaagaagagcatgaagaacatcttcgccttacactagagaagctacgagaacatcaactgtatgctaagtttagcaagtgtgaattttggttgtctgaagtgaagttccttgggcacgtcatctcagcaggaggagttgccgtcgatcctagtaatgtggaatccgtaaccaactggaaataaccaaagacagtttcagagattcgctgtttcctaggcctcgcaggatattaccggaggtttatagagaatttttccaagattgctaagcccatgacacgactgcttcagaaagatgtgaagtacaagtggtcggaagaatgtgagcagagttttcaagagttgaagaatcgcttgatatcagctcctattttgattttacctgatccaaagaagggtttccaagtgtattgcgatgcatccaaacttgggttaggttgtgttctgatgcaagatgggaaggtggttgcctatgcatctcgtcagttacatccgcatgagaagaactaccctactcatgatattgagttagctgcagtggttcatgcattgaagatttggcgtcattatctttttggtactcgtacagaggtgtacactgatcacaagagtttaaagtatatctttactcagccagatctgaacatgagacaaaggagatggttggaattaattaaggattatgacatgggaattcattatcacccgggaaaggctaatgttgtagcagacgctcttagcaggaaaggctattgcaatgctacagaaggacgacagttgccattggaattatgcaaggaatttgaaagattaaatttgggaattgtcagtagaggttttgttgcagccttaaaaacgaagcccactctaattgatcaagttagagaagctcaaattaatgatcctgatattcaagagatcaagaagaatatgagaagaggaaaagctatcggtttcttggaagatgagcaaggaactgtatggttaggtgagagaatttgcgtccccgacaacaaagatttaaaagatgcaattctgaaagaagctcatgatactttatactccattcaccctggtagtaccaaaatgtaccaggatctcaaggaacgattttggtgggcaagtatgaagcgtgaaatcgcagaatacgtagcagtatgtgatgtttgtcagcgcgtcaaggcagaacatcagaaacccaccggtttattgcagcctttgaagattcctgaatggaaatgggaagaaataggtatggattttatcactggtttacccagaacgtcatcaggccatgactctatttgggtgatagtcgacagacttaccaaagtggctcatttcattccggtaaagacaacttattctggaagtcggttggcggaattgtatatggccaggattgtgtgtttgcatggcgtccctaagaagatagtgtctgatcgaggcagtcagtttacttcaaatttttggaagaagcttcaggaagagatgggttctaagctgaactttagtactgcttatcatccgcagacagacggacaaaccgaaagggtgaatcagattttggaagatatgttgagagcttgtgctttagatttcggtggaagttgggataagaatctaccttatgcagaattttcgtacaacaacagttatcaagctagtcttcagatggctccttacgaagcactgtatggtcggaagtgccgcactccgcttttgtgggatcaaacgggagaacgtcaggttttcgggactgatatcctgagggaagcagaagaaaaggtaaaggtcattcaagaaagattgcgagtggcccagtcccgacataagagttatgccgacaatcaccgcagagatttgagttttgaagaaggagattatgtgtatcttcgtgtcacgcctcttcgaggggttcatcgttttcacaccaaaggaaaattggcaccgcgttttgtgggaccttataagatcgtcagtagaagaggagaggttgcttatcagttggagttacctcaatctttggcaggagtccataatgtgttccatgtgtcgcaattgaaaaagtgtttaagggtacctaccgaagaagctaatcttgaacagatagaagtccaagaggatctgacctatgttgagaaaccaatccgtatcttggaaacagatgagagaagaaccaggaatcgagttatccatttttgtaaagttcaatggagtaatcactcggaagaagaatcaacttgggaacgagaagatgaattgaagttagctcatccgcatctgttcgccagttcttccgaatctcgaggacgagattctgtttaaggggggtaggtttgtcacaccctgaaaatcataaatatataaattgttgtttaaatggaattttttttgaaataattttaaaagccttgaagagaagatctaattttaattaataaattccaatataaaatggggccagataaaattttattaaatactttgcttaattctataattcctagatttttctgggattcatttgagctaaggaagtatttttaataaatggaattgcatttaagaaataatttaaattgaaaaaggttttaaaaagtcttcttttggctttgggccgaaagtcggcccaaaacctctcttctctctctcctcggcccagtccggcccagtccgccgccgcgcgcgcgcgccctcgctcgctgacaggtggggttcgtcttccccgagccgccgtcgcccggccgaaaccctagcgcgccgccgccgccgttcacttccaaatccggccgttcctttccttctccggccgaatcaaaagaggggaaatgatctccgggatctcctctaccttttctccgttggaatcatcggctaaaacgttttggaagttcgtggaatcgagttcgattcggatcggcctctttccttcaagccacgaagtttccttctcgtcaccggccgccgtgggccttcgccgccgcctcctagcccctttaaaaggctccccggtgtctcctctacccgccgccaccctcgccttcgcctctcgtcgcccgtagagctctagcgccgtgtgccctagcgccgccgtcgccgccgtcgctccagcagtgcgccgccgccgttccagacgtcgccgtcactcgggaaggtcgtcgtcgtggtcgccaagtcgtcgccgtccttgtccgccgcttcgtcaccgtcggaaaccgccggagcatcgtcgccgtcgtcaagccgcagtccgccgccgttccttcgtcgtcgccgtcgccgtctgttggtcttccgccgctcccttggtcgccggtgagttcgccgtgccgtccgctacctgttggtgccctccgttcgtgccgtagtgccgccgttcgccggcgagcttgcgccgtccgagctgtcgagccgccgagccgccgccgccggtggtgacgtcatcgctgacgtcatcgtccccgtttcccgtgagccgccgtggacccgatcgatctcggccgtccgttttggatcaagtcgatctcggccgtccgttcccgtgaaccgccgccgtgcgcccggtccaccgcgaaaccctagcccgctgacgcaataaatcccttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatatacatattaaaaatatccacatgtactgttcatgcttgttttgtgctgttttggtgattttgctcttttttgcttagattccgtcgtttccgaagagtccgttttcgccggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcctttttgttcttgattactttattccttgataccttgggttattataatttgactagttgagctttgtttatattggttcaactagacgtattagatataattgcttagccctgcttagaaacattagcacactattgggataacttatgactcactattatttaaagatggcttaatgatagttcacgatggtcaatcgtgattggttaattaattaatgtgccaactaaaacctgataatggtgggttgtgagcacatggttttgagagtcgtgctcatgacaattaaggaccggttcacgagtttcggttgtgaaacattaactgtgccaaccacaagccagcgtgggtaacggctttatcttttgtatagcatggttcattgcggggcaccagactgagaagtggcggagataagcccacgggggtcgctggggagtccatgccttgtttataagggggtgattatgatccaggaaaggtgcgctgtaatggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacttttcaccatagtaaatgatgctataattggtaataatttgattagctcctggtttggaatggtatattcctggtttggagatagaactgtgcagccggggtggttgttcagaatggttgggcctatacaacagggtacgttgtatagtgttggattaatattgtttaattattacttaacagttttattaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttttacagtgaagctgatggtgtggaggattaggtgtagccctggtcaagctgcttgtggagtggagccgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggctcacacacatgtaagcgtttggaattttggatagaaattccgggcgtgacagtagacgacgacgccggccggaacggacggcggacaacagcggcgagcggcggagcgaaccacggcgatacaggcaaaagcgagcacaccgggtggttgcacgagaagaggggagacgagccaatggctccgattcgccggagggagcttgacggcggcgaatcgcggcggcggcaaccggcggcgggagaagggggaaacgacgacgaggtcacgaggggccgattcccggcggcaagagcatctacacggctacgggaatccgatgctagcgtcggattgggcggagctacgccgagcgaggccggcgacgagcgggtgctacggagcacgggcggtgagcacatggcgagcggcggcaacggtcggggcggtgccggctagctacggggaggctactcgtgctactaccgaaaactaagggggagagatggagcgaggaggaagaacggagggaggcactaccgtgcggacggggcgcagtgacgagaggccgacggcgcgggagtaatctctctggcctcgggcctgggaagaggaaggagacgagcgcccggagtccccttccgcgtcctcgctcgtgccggctcctccgacgcgcgcaacgacgaacggcgacggcgaaacagagggacggcaacaatatagtggaggcgatgggacaacgagaggagaagagagggagggcgcccggggctttaaagggtggcaatgtcggtttggaaaccgactttggtcggtcaaggcgcgagctggcgctcggcgctcgcgtccaaatcggcgacagggcggagggaggatgacgccggcgggaggaaaaaggggaaaaggagggagagaaagggggcttgcctccttgccgctttggggaaaaggaggagggggagagagagcgacgcggcagagggaggagggctctgcctccgtcccttggcggcttgcgcgcggagtggcggggccgaggcgatgacgacggcgatgacggcggggcagtttggagcggaggggcgacacgggcgacaggcgcgggcaggcgcggacgacggcggcgaccaggcggtcggccaccacggctcgcgcgcgcgggatgcaacgggaggcgcggcggtttgagtggcgcggcgcgggcacgcgcgctggcagcggggccgagcggctgcgcggctgcaggcggcagggcaccgggaccgggtg

SEQ ID NO: 72228 - DNA, 1150 bp, Oryza sativa
tttatttcaatatttcctaagatgattcaggagcaaatttgttgtttgtcaccctctggccatacgggcaatatttcataagctcaaaacatggtgattgttcctcagatgtcaagtcttacgtacagtttttttttttttttttttttggggtgggggggggggataattgaagtacctgaattgattggtgggctgaattttatgacttgcttcagttgttgaagatgaattggatggctcatataaaagtgacttattttctggcaattgcagatggcacttcctaacagctgcaacaatcacctgacagaggctcttgagggggctaaatcccaggttcctaaacctgtaaactcttgagccggcaatgaatacagggaaactgatgatcatgaacacagtcgggattgcgcaacccaccccccatccaacattgtcttgcaaccaaacaagcactgtgcttgacagcaaggtgctgacagtagtcatgtagaaggaccaactgaagaaggaggccttcttcggtaactcctccagatcagtgctatcaaactggtcggccccaaaggatgaagtgcatggtttcattgcaccactcccaagggcagcaagatagagccctagatacactacggaacgatgaacattgccatgttcagaagatgtcaagaacattggaagtgatgctgaaactgtcacgatgagcattccctgacaaaatggaaatattcagagtctgcagaaggtactagctgatagtgcagaccatatctgtgagctgcatttgcgcttacagtgatgtacaccgggaggaaaacaacaattgtccagtatctgccccaataagtgtctgccagaaaggcaccaacaaccggtgtgaggaagcaagctccaacccaggcagagacatttctggcagcatcgaccttgctttcgtggagcacagtggtgaggaatgtgactagattcctcgagattacaaagtaggtcatgttttcacaaaattcaacacctggtatgcataaaaacattcacaaatcacaacagaagaagacaaacagtttgaaaatgatgtttatttgttgcatcagttgctctatagtacctaaaatcaagaagcacgccctccagttccctgtgctgtgct

SEQ ID NO: 72229 - DNA, 2838 bp, Oryza sativa
gggcgctccacccgctcgacttgttccgcaagagcttgcttagcggccagcaccatagaccacgcggcgacaagggcagaggcggcggtggcgccgccaggagagacgaccgccgccacgacgacgacgaggaggaggccaacggcggcatcatccggtcagcggcggagctctacgaggcgggcatccggttcaggcgtcctcatcatccggtcggcggtggagctctacgaggcgagagaagagagaggagagggaggaagatgggaataggagtatgacacgtgggaccatatatttttaataaataaggtgctgactggattgccacgcgtaggccacgtaagacaaaaccacgctggattgggtcgaggggggtaattcgttcggtattgaaagttcagggtgagtaatatctggttttcgagtttaggggggtaattcgaccgaccgtgatagttcaggggcgtaattcgtactttttcctttacataattataagtgcgataagaagatggtgtttgaaaatgaagatgaagataaaagattaagtattttacgcaaaacgaggaggtaataacgtgcgattaattgagttttaattattacaaacttgaaaaatggattaatcttatattttagaacaactttcatatagaaagttttcacacgaaacgcaccgtttagtagtttgaaaagcctgtcacttttgtccaaaagttaccattccaaaaggttgcatttttgttagggaattttatgtcttaacagtatggtctcgacatctctctctgttgggttacgcacaggctatgatagtataaatcaaaattttctagcgcataaactaggaaccatgcaagtattagatcataaatcgttaccactcgacgcgctgcgcagcggaagaaagcgctaagaaggcaaaggaaccctcgcaaagtagcgcacgtcgatgtagaggaagtagtcgatcgtaccggctcgatcttctcctcctcgtgcgttctcctcgctgtaatcccacgccgatcagcaccgcaaagcagcggcacctctaccagtatccacacgtacagggacagaatactacgcgcagatatgctagtacccgcgtgcggctaggattttgctcagggaagggagtggcagctagggtttctcacgtgatgcattacctctgccggtcacacccctcacgaatatataggatccatgacttaggcccgtagaacttccattcggatctctatccaaattaagctcatattggatctccatccaatccccttattctggcccattaagcgtgcgaccctgtaggttcatacacactcggctataacccgaaaactctttttcggtccacgtgtcaccagcggtccctagtagaacatattgatccactgggcatacataaagatcatatcggctaaacctctagtgtatacttgtatgaacccctttgcctcacgatatcgatgaagctcaaggctagatatgtgccatcctctaatagcttaatcattcactcgagcctgtgatatattatataacttgtgatagactcctcaatcacctttggtatggccatgcacttccataatctataacatcgaggggaccagagatacctctccataggaggggcaaatcctattttgattattcatatcccactacatgtttcatagcatacccgaaaactacttttataactacccaattacggagtagcatttagcggtccctaggaatcatgataatcttaggtctaaggatccaacatcaagactaaatgggatcattgatgacacaacacatatggctcttacaatatctcatattgggtctattcaacaatatgttccccaacatgtgtccccattattaatttgttatctctataccataattcatgagacatgatcatcaattaatacatgtgctgatcatttaaatatatttgttatacatatgatatttgatcagggatcctttagaaatagtaacaaccaacataaatagtctcatactcattaatcaataatgagctatctatttcaagtaataaagtcagataaatatgtaaatatagtatgtgatacaatcatctctatgattgcctctagagcatatcacaaacactcccgacgagcatatgacgtcctccagcgatatgatggccaccaccttcaacctgtaatggtctatctcgggctgtacgcctgtacctcgtcgcataagagcaggtacaataacgtgattaagctggctccaaattttctatcaccttcctaatcctagattaagctagcaaaattgaagagagagaaatgagcaggcgcttaacctggcgccgggcgctagcgcttcatccgaagccgtatcgctcgcatgcagcccacgaaggtgattaaaaacacgttatgtagttcccacaagaaaaatccctgatcccctcctccaccgcatctcaaccaccgaaaatcccatcgctccgccgcccctcccttcgcgttcctcttcgctccttggacgcgcatcttctccgctccctgcgcgtgaaatcttctccgcccccttgcgcgcgaaatcgccggcgacgcctcgcgttcctctccctcttctgcccgtgcgtgcaaaattccctccgcctgtgcgcgcgaaatcgccggcgcctcgtgttcctcttccatagccccgccgcacgccagccctccgccattgcctctctctgatcccgctaaatcttgcccccgatgcgcgcgaaaatgcctctctcccgccaaatcgaagccaaattgatgcccaacaatctccccagccggctccgtg

SEQ ID NO: 72230 - DNA, 707 bp, Oryza sativa
agctgaataatagtttgaaggagtaaaatggacgaatttccttaatccgtttgttctttggttaattaacgatgagtgtatttgtagttgagtgtaggcatcataggtgatggaaatattatttagtgcacgctcgctacttctgattctaaagcaccacttcttttaattcaggtgactcttaacatatcacacgactcgcacagaggactcccaatgtgcgaatgagcattcaatgagtacttctttaagtaatttgatttttgaagtgattttgaaaagatttaacatttggatagaaattttttagttgcacaaggtccagttgaaaaactatactcaaaatttgaaatctttgacttcaattaacacttcaaaactcaaaatttaacactttcaactataaattttaaaacttcctcccaaattcggaactctcaactcaaaattaaaacttttaccaaaatattttaaacctacccaatccaactcaaaatttcaaatattcacagaaaatttttaaaacactatccaaattttgaactttcaacacaaacttttaacctttcaactcaaattttgaatttttttaacttagtaatttatttataattattatacaatttcatcaaggggaagaaaaaaaagtgtgttagcgcattgtcccctcactactcgcgactcgtgtgtgactctgattcaattcg

SEQ ID NO: 72231 - DNA, 8431 bp, Oryza sativa
accttcggtgcactttttcctccagctttctacgtcccagtccctctaacgtagaatccactaacgttggatgatctggttccaaaagcagataggataaatctgaagctacttacattaaacaatagtcacattgcatacaatcacggattaaggctctgttcgttctgggaagatatgggagattgattctcgttttccgcgcgcatgcttttcaaactactaaacggtgcgttttttgtaaaaaatttctataggaaagttgctttaaaaaatcatattaatccatttttaaaatttaaaatagttaatactcaattaatcataagctaatgactcacctcgttttgcgtatctccccaatctcctcaatccccttctcctcaaacacaccctaagagttcatcctagaaaaagaaattaagagtctaaaaaaaatccaatttgtccataagtttgagaaaagaagcatgttttactgcaagggaattaataacttcattacatgcgaatgggaaaaaaatgcattaccttcagatgcatttctatcactctaacagcaaacaggtcaatcaggggtggatcaaaatcaggtgctaaaaaatattttcctcattagataattggtgtttgtgtcctcgtaaaaaaaaggtgtttgtgcttgcagtttgcttcttctagttttgcatacatataatcagtttgcttggttgttttgttgtcgtgcgtggcaaactgtttgccatgactagtgtaatctaccctatatttcagttcaaaacttcaaatggatcggaaaagctgcgcttgctgaggcggctcaaaaatctttgcgttcatctatgtttttcacagtatgtgtcatttcgtcaaatactccactgtttatcaaattgcaatgtatgtgctcatgcatgtggtttttctaatattaccagctcgcagttattcagagaatgtatggcaatacggaaagtactacttagttactcttttgtacttggattgtttctataggttccgtccattcagtccatggggtagaagctgaagatttttggcacctggtataggtaacaggtctgaatatggcgtaaaatagatatccatcttcttttaaagaaaaatgatcagctctatctttaaagcgcatggtagatagaaccttcaagtttttattaagtcagtagtacaaaagtataaaaagaaacattggcagcatcaacacttacaaatccaatgcaaaggagacggccattgtagcaagtgtgacaaatcaatgaatcatgaggtgtagatgttatcaggttctcccatcaggcatttttgagggaaattcaacaggcttagatcgctttctcagataagcagcgtctatcgtcatctttacagttgcatgtcatgtgttgtcagatggttgctagatgcttatccttctgatccaatttgatgatcttgcagactcataaacccttggtaacaaccaactttagaatctcaacaccctcttctatggctgaatcaatctaggttaaaacaaaacatgcaagcattagactctgcccgtcacaacacaccttcagggtctttacatctagaataataatgaaatttgtaacactgaaataattaagtcaaatacggtgtttccggaaatatggtatcactagagtgattcaatgacaaaaattcgccaagagtgtcacagataatgccataataagtcctccaagtaacttcactccagcagttcgatttctagggcatcgtggcatttatctaaaacaattaagattaaagagatctcaacggctgtgagcttcacggaattggattagtacaccatatggaagttgaccacaaggttaagccaatcttctaatcatacacatgttgcaagcctataactcatctctcatttgcgtatagcaccgcagaaattactaagattttaaatgaagtagaataaatctaggtgcggcttacatgcaggatataaccagggttttagactgttggtcatatgaatctatcccagcaaatgagcatgttcatcgagtgagaattatggaagtaataatacaatgattacttcaaaaaacctcaactcagaaaaaaaaaggaatgacacgaaactacaagtatgcctactcccttccatccccaagaaaaaaaggcaacctagtactagaatgtgacacatcctaatacaacgaatctggacatagagtatgtacagattcgttgtactaggatgtgtcacgtcgtagtacgaggttgagttttttttggaatagagggagtagatatttacccgttctagactggtcttattaaacttctggagcacaaaagctttggggtccatttggccaggtggacatccaattcctgaataaaagtatgaatatcacattaaggaaaaaaaactgaatgccacagatgtcaaacctaccaatccttaatattgactaaattctcggttcttatgaaaatggtatatcattctcttcgccctgataagctagaaaggtaaatattttgtgtcaatttaaaaattaaaacacttagttgcagacgtaaaatagtttcacatagctaatggtaaactaaacatgtataaaacaagggagcatgctaccccacactcagataagagtgtgcttatgtctggtaaacttttcaacagaacgttgcctcaggctatctaaagggagcaaaaaagaacatgtggggaaaatggaaaggtgcatgaagaaattaccactacaaataaaaaaatgtaattaagtaaacaaattggaaaggaagaatatgctgtctcttcttaatgaagtcagcatcttgcttatcaggtcaccttttgaatgacaaattacttcattaaaacacatggttacaaaatcaacagacccattatggcgcccgaatcctcctttaggttgtaaacgaagaattccacagggcaggtccgtgccatcaaatgcctgaaattcacaccagaaaagtcagattgctatgtaacttagcactcataaagattagatattacaatacttaccacaaggacacgattaagtggtagtttataataggcagcaagtggcccaacctgcaataggccaaaaaagacttatcaccaagagtcatcagatcagggtcagtatggtataaccatttttttatgtccagttaaaggaatttctacaagctgaattacacacgacctatcaaagaaataagacatagaagtaaccaaaacaaaacagacatattgagatatcaagttcaagtcatagcaactaaaattctgattgttgataggcttttggttgccccaaccaaagtaaagctgcggacataattgaatttagggggaaatggctcttagcaaatcgttctgattcagttagtaacatcaaaaacattgatgtactccattctttgacattccatagcatccaaatatggtatatattctaaattatctcaaaatcaagataataagaagtgccaggattgccctgcagttatatcgacttaaattagctcaattggactgaacctttttggtcacccataacctacccattgcagccacatattcattctccaggcttgtggccaggaaactctgatgagtaatagcaccacttccactagtaaataagcctaatcctcaaaaagtttaatgtatcatcctaaattggtggtactcaagagacccaccaccaatgacgacaacatcagtgtttctgctgaggcaatcacagtttgacctcaaaccattctggcagttgcagaggatcatagagaccaacctgggtctttgcctcccccagctttgcaagatttaaaataaatgtaggcatgaagcacatatttacccatagcaagtgattaaattacaaaatgcccccctctttcttatgtaactctggtaagtgttgttcccctctagaatttagcctaagctccgccactgcattccccggagtgaatgaggggatttaggtgaagaatgtcgaatacatgtaggacgtgaatgaggtgaaccagtgaactggtggcagcagagtttgttagtcttttgttgagtttgatggaagagtaaattacactcacaatacacaaacttaggtggtggatgcaaataagtatagcaacttgcaaatcgctcgtttggtactacttgcttagtagtaccttagtataacttgtatgggccatttagtcttagttcacacggactaagcaagttgtagtatcagagcgagcaatttataagttctatgtactgtaggcgcaatttactcttgatggaacatatttcagtgccaatactagcttctcatgaaactggcaaactcaatcccgaggctgacagaaaaaaaaaaggcacaacagaatatgacaagatatgctcatgatggaaagcatgaaccatcggtcaatgaccaggacaggggcatgcaactgttcgaagattagtagtggcaataaaccacgagccagagtgatttagttttagaattcagggacaaaagttaaaccatgccaagagttaagggacacgaaatagatttattccaagatagtagggcagagtagaaatcagatattaaaacatggaaagagttctaaaagtgatgcttgcagattcaccactgagattcatatacgtttgaggcttagcgagcaaaacaggcacaccttcgaccattcctgcatcaatggaaagacaacggttccaattcagcccttcgaaccaggaaaacagagtttacataactcaaaagatcaaaatacattctctctgggatcacatatatggagccaaaccttccgcaaatagtgccttgaagtgatgcctggtcggagatataccctgagactgtgcaaacatgtctatcatatcaaacccagcctgcagcgaaatggggtgtcacaggatctgaaaataaatcattgaaacaattaaatgaccaagacaagaatgagatgcaaagcttacattgtgtctggtgcaatgatacttctcaccagggttaccaagaccaacaaagagccatggctgtatcgcggatcatgatgagcaggatgaagataatgaggtctgagaggttgaaatatgacgcttggatatgaaaggggcaagtcttgtccacggctttcctcgcatggctaattacaaacatccacagatccaaaaacagatgcagcagtctgcagcagaaaaccagattattcttccagatacacaacaaaaacaatagtacatatagtaataaaaaatatgataagactcgctcatttattgattttaagggcaatgatgtttcagcaataaatttctttgagtctccaatttgtaggcattgacagcttgattgttagatgatatgtacaaaggaatatctaaatgtgcacaacacctttctaccctaacaacatatagagaacagttgatttattatgcactagtataaattccaaacagggcatggaagtcttcactcaagcctgcttcctcttttgaagatgaggtgagtttctaaaaaatgaaatagctcagaaaaattaagttgtttaattaatcaatgacatacctaacaaaagtagcttgatctcacatcaggatcaccgtagcacgtactccgtagtaactataatattgttgaccgaaagtgaaaataaaagttaaggatgtgttgggtatgactttagaacttggatgcaaattgtgtgaagtgaaacttatgcactagtggagggagcacgattatttgaggagaaatgaagaaacggcagcactagctgaatgagcaaaaatccactccatgagaggagaagataataaaaaggggagagtagagttggagggagaagaaatcacgtgtggctggaatgaagggcggaggcggagtgggatccccgggcagggcagcgtaacgaaggaagcaggagaagaggcggctggacctcacctagctatatataggacgacggcagatccacacaggtgcccgctggtggtggaggcgccggcgccggggaaggcgaacgaggtgggatgcgggaggctgcgagcgatggagaatagtagtgggcttccccttcgaggccggcctttttaattaggcctgaatgggtttcaggcccattaacctactgcccggcctaatatgaatcggaaggggattttattttattttgttgccctcagccgcggaggaaaggggtttagcagtagcagtagaagaagaagaaccttgattgaaatccctaaccccaaccaacctactggaggaggagtactggagtagagagcgagcatggcgagctcccgcgccgccaagcgccccaaggtggatccctcttcctcctcctccgcgccgccgccgccgcccccgcccccgcagcgtggggacgacgactacgtgccgggcaacatcgtggagatcgagctctgcaacttcatgacctacgaccacctcacctgccgccccggtccccgcctcaacctcgtcgtcggccccaacggctccggcaagagctccctcgtctgcgccatcgccctcgccctcgccgccgaccccgccgtactctctcttctcctctcctctcctctcctctcctgtacgattgattccatgctactctaatactacataccaatgcactgcagattctcgggagggcatccagcgtcgctgccttcgtcaagaggggagaggactccggccatgtcaagatttccctccgcggcaatacacccgaccacaagctctgcatcactaggaaggtcgataccaacaacaagtctgagtggcagctcgatggtacatgctctccttactcctcattacacaaaccgatgcttatttctttcactatcctttttattcagcaaatggattggatttgaggcgatgattcctgcatcactaacatttgtttcctgcaggcaccactgtccccaaaaaggaagtcattgatctcatcaagaaattcaatattcaagtcaacaacttgacccaggtgcacctccagtccattttagattcagctcttttacatgatccattccttatcattttcctttgcatgccatgatattgtaatccagaggagccactcacttacccttttatcgtgaatctattcctgatttctgttgcttttgtgctcaactctgttcagtttcttcctcaagaccgagtatgtgaatttgcgaagttgacacctatccaattactggaagagactgaaaaggctgttggagatcctaatctacctatccagcaccgtcagcttatagacaggagtaaggaattgaagattcttcaagtggtaaagctgaatcattcactattcactctttccttatgcttgcttggaccagtgaaagctattcccatttccttgcatatcttgtttagatgtcaaccctatggtatcgattcacgataaatttatctcgtttgttaggctgtaaagcaaaaggagcagactttgaataatctaaaggccctcaatgctgaactagaaaaagatgttgaacgtgtccggcagagagacagacttctgaaaaaggtttgcagtttcatttttttggtttggtaaattcccccttttgggttatgacatgaagggcataaaaagtattttagtgataattataacatcttgttggttttgtcttaggctgaattaatgaagaagaagctcccatggctaaaatatgacatgaagaagaaagaatacaaagaagcacaggagaaggagaaaactgagaagaaaaaaatggaggaagtggcaaaaatctgggaagattctaaaggccctgtcgagtatgtttcatgctcaactggcttcaatttttcattcatttataaactcatctctagaggtatctttgaactacgtgggctaggcatttgttctgatgttcttcgttatgaagatttcctttcaaagcccttcaatctgaatggatacattcacgtacagccaagaggacagttctattaacttccaaccttgattcagtagtacttctatgttttgattgacacacacttccctttaatttttcatatcaatttcctttttgtacttgagtaacactaattaaaacaagctagaacttgatttatacagaatatgttatcactatcacggttaatatgtaagcattttgtgaatccgatcacttcatataaaatgacaggattccttggtcatgcttgcaaccacatgctagtataagtttaactttatgttcctcatctccccttaacttttttcatattcaagtaacttgtgtaatcatattgtttggattcaacacaaatcgaatcccctctatttaatcattgtacattatcacattgtcaccttaaatgtaaaagggaaaaaagaagaagga

SEQ ID NO: 72232 - DNA, 1794 bp, Oryza sativa
gtcgcgggcatcatagggaacctcgtgaccacgagaccgcatcccgcacgagcagcaatggcaccatcacctcgcacttaccaatgctgtgagttagcacgcgcgcgcgaaggcgagagagagagagagagagggcagtggcatcatccatccgatatcgccgccgcctcgttttctcgcgcgcgaacggcggcgcgggaggagaagggcggggacgcggggagccttggattggaggagagcggaagcagccaaccaacggcggacgggccgagaaactgagaaagagacgtggtgggctaagcccaggacgaagcgacttgatgggctggaaatgcgagaggttttgggctccgaacgccaatttatgggcctgttcgggactccatacaccaggccagattcggaaagctaacgcgcgcgtacgcgccgctagcgcgcgactccatttaactcgattagcgattccagaggacgtaactaactcaattagtttaggttaatgacggtaattaataaaatatttccttttctccggaattttttttactaaaaaaatctggaaatgctctttgccggtcgcccggtgcggagggagccggatcgggcactccccccgcgccccctcccccacgtgcctacttaggcccacctatttatgctcctcttttttccacaaaagatgtttcacataatgtatttacaatgtttcactatttatagatctaatgttgtagtaaattaaaatactcttttgcaaaaaaaaaaacccacatattttagaaactctctattaagggaattttgtttattttttgttccacccaaaatgtttcacctagtgtactcataatatttcactatgtatagatctaatgttacactgaacgaaacattccattgcaacaaaaaacccacatattttggaaacccctattaagagaatttggtttattttttgttccaccgaaaaatgtttcaccgagtgtactcaaaaatgtttcactatgtatagatctaatgttgcagtgaactgaaacattctttcgctatttgctgaaacattgtttttatataaggtgaaacaacacccaatttaaacgagtgaaacattttcgatctacttagtgaaacaattctgatatatctggtggaacatcttgcaacatttaaaaataattcaataataagataaaagaaaatttcgtcgaaatatatccatgcgtggtcttgttttgaagatttaattgcaatgaatttaatagtgcaatcggatcatcatttggataagtagtttaagagataaatcagtttaaagtaattttgcatgtaaatcggacgctgacgtcagcgcccgatttaccctctcctgatcggacgccgaccaggagtcatccaaaaaaatctatacgtgaaaaaaaattctcatttaaaaaaaaaaaaatttaactcaaaatttgaaaatctaaattcaattttttaatattttaaattagaaatttaaacttttaacttagatttgaaacctttcgacttaagatttgaactttgaagtcaaaatttaaaaaatttcaacttaaactttgaaaattttaaactcgaaatttaaatttgtaagacaaattttaaaaacttcaagtcagatttgaaaactttcaactcgagattgaaaactttcaagtccatatttaaaaactttcaactcaaatttaaaaactttcaaattttaaaaaaaagaatgaaaaaaatatatggaaaatacgctgaggggagggaggcaaaagggaaaaaatc

SEQ ID NO: 72233 - DNA, 3253 bp, Oryza sativa
tgaactatctagattattaatttctactgccagtaataaaacaaattatgatcaggttcttgaacaaggctgcgatagtggtgacaccatcgtcgttaagcggggagaagggtaacgtgccagcggcggcggcgccggtgagccgatggcggcagtgcacagtgacacaggtggaggaggtgaagatgctggtgcggatgtgccccatctgggcatgcctggtgctcttcttctcggtgagcagccagatgtcgtcgacgctggtggagcaaggcacggccatggacaaccgcgtgggccccttcaccatccctccggcctcgctcgccaccttccactccatcggcgtcctcctctggatccccgtctacgacgtcgcgctggtgcccctggcgcgccgcgccaccggcaagcccaaggggatcacgcagctgcagcgcatcggcgtcggcctcgccgtggccgcgctcatcatggcctactcggcgctggtcgaggagcggcggctggcggcggcgcgcgccggcgccgccaggacgagcatcctgtggcaggtgccggcgcagctgatgcacggcatggcggtggtgttcaccagcatcggcaagtcggagttcttctacgaccaggcgccgcgctccatgaggagcatgtgcaccgcgctcggccagctcgccatcgccgccgggaactacctcagcgcgttcctcctcgccgtcgtcgcctccgccaccacgcgcggcggcgaccccggatggatccccgacgacctcaacaagggacacctcgactacttcttctggctcatggctgctctcttgctcctcgacctgctcttatttgtcttctgcgccatgcgatacaaagggagcactgctgcttcttgatcgacccacccaaaaatgtcactctatgtatggcatttgtaggactgtacaaaaattgaattcgaaaatattttatgattcactaatattacatagatgaacccctttaactgcacgccaagtgtgtaaatgcaacctcagacacaaagcatatttaatttacaacctcttgtaactactaactattgatacaaaatagagctcttttttcatccttgagaaggtaccatgaggtacaatgaggtactagtattatgaggtaccaaatcaaatctagccattgatttgggaggggcacgatcggaaaaaaagaggctcgctcattgggccactcggtcgacaccgccaaagcaggtgcaacaatcccttcaagtccagcacgagtcgtcgtccgccgcagcagttccgccgccgtagccccttctcatctgccggtgtcgccatttagttccgccgccggcgtcaatgctggctgggagcttttagttctgccgctgctcgacgacagcctgccaccgccgtcggccggcgcccgaccatagccgcccaccgcccgaccacagccggctgagcacaggtgcccaccgccgttgcccgccgcctgagcacttttctgtccgtcgccgccagccatcccggacagagcaacgccgccagccatcattcttatggattaggggttgattttgtccagcttcttattatttgcagacttgttccaaacctgtattgcacaagaagtactgcattttatatttgcaaactttcttatggattaagggtgtattttgcccagcttgttgttaaactgcatcggtattgaatgcaaagctcacatgttgtgtgcctggatttgtacttgtgtttaaatctggctgtttcagttaaattgcatctattaatcagtgaatgcaaagctcacatgttgtgttcctggatttgtacttgtgtttaaatcccaaatatccatgctagcaagtgtattagtgccaaatatgttatacggcagaagcagaaacaccagctttcatcagtgaaataaacaccagctttcatcagtgaaacaaacatcagatttcattagcttccacatgggcaactagtagacactagtcagttcagaaacagcagcagcaaaaaatcataggcagaaccgaaacagccagattttcaatactgaagcatccatttaggattaaacatatgtagatggttcatccattaacttaattacatcatagaaaggcatcacagtacataatagaaggaacattaagactaagcacatcttcatttagtcttaacgattactagggcacgactgaatgaagatgcacgcggccaatctacccgctgttgcgtagttctaaacaccagccccaccctacatgcggcaagatcacctccattgctcgaagggggccacgagcggatggacctatctagggatctgccatcccccatcatctgcgctgctccaactgccttcgcccacatgtaaatcgaagagaaatacgagatcaagaaagagagctgagagaatcaaagagaggtcttccctctgcgtgcgcccatgaaatcggacagaaaaacaagagaaggaaatacctctatgtgtgccaaggccggattcgagatgtgcggaggaagaagaaggccagcttcgtttctttgagagacgaaagaacgaaagagggacgagagaaggaaagagccgagcagaatcatcggcctctctctcgctattgcggcataaggcgaaattactttcctaccccccacctgcggtaccgcgtatatcagcccgtgcggtactaggcggtacgctgcaatctcatccgtccgatgaggccggatcgacggttcagatttggtaccgcatggtacctcaaaacctcaaggagtaaaaattctctacaagatatatacagtttctcttagcttgtacatctatgttagatgtatagccaaaggccaagtttagtttaaggctgagacaaaatgagtttggatgttgattctcccttgtttgtcatgatcacgcttcccaaactgctaaaacgtgcaattttatttttttaaaaaaaaaatcaaataaacatatttttcaagtttataataattaatactcaattaatcatgtattaatgattcgcgttgtttcgtgtgccactaaaaattaaggaaaacttcatttttgaaactcagcctaaatccattaccaaaaatatacaatatgcacccttttatagaagctaaaaatcgatgtagtcaatatgtaacgtacgtgaaatgatgtagtacacaaagccggctatagtcaaagtggcgtatataacaaaagctatatttagccaaagaccttc

SEQ ID NO: 72234 - DNA, 2107 bp, Oryza sativa
atgtcaaactttgactaagtttataaaaaaaacgtagcaacatctacaacagcaaattggtttcattaaatccaccaccgaatatacttttgtaatatatttgttttgtgtcagaaacgtagatacatttttctatgaacttggtcaaactttgacaaacttaaaacatattacaatatggaaccgagggagcatttaacatctactcaagattagaatggcgttaccgattattttatcattaaaggtgctatttggatggtcctgtaacccgtcttttgttgcctgtttctagccatgttcatcccgcagtgtttaattccatagttcagcctgcttctactgtagcctgtagtttaagggtttccacaaggtttctgttggccttattttgtggtttttaatcaaattgtggcattattttcctcaggcaaacaggtcagttgcaggtgttgagcgctcatcaccaatctggaggggtatgaaaaaaactattagatgcattctagaaaaatatgccttatacttactattattttttgctcctttataggagcgatcagtttcaaccatcctgtaccttgtatcacttcaagatcttaccaactgcccctttcgggtcgttgatgagataaatcaaggcaagccaaccctcacaagtttttgttccctatgcactcaatgctgttataaaatgattactagtttgttgaagcattacaaaggtaactgtttccccgaaattgcaggaatggatcccataaacgagaggaagatgttccagcagcttgtgagagcagccagtcagccaaacactccacagtttgtgacagtactcttagcatttcaggaggcattttcagatagcatctaccaactcccatgtttcttaatctggctataggtgcttcctcctgacgcccaagttgctgcctgatttggaatatagtgatgcatgcagcatcctaaatatcatgaatggcccatggattgagaagccagctaaaggtaatatgtgttctgtacttaggccctgtttagatcccacactaaaatttttcaccctgtcacatcgaacgtttgaacacctgcatgaagtattaaatataggctaaaaatatgactaattgcacagattgcgactaatttgcgagacaaatcttttaagcctaattgatccatgatttaacaatgtggtgctacagtaaacatttaccaatgacggattaattaggcttaataaattcgtcttgcggtttactgacggattttgtaattagttttttgtttgtgcccaaacacctcatgcgatatcttatataatacctgatatgacacgtcaaaactttacactcctggatctaaacatccccttagacattttagcatattctcggtctcaatccatatttgatgcatgctttgcagcctggagcaccggtgattgctggagaacagtaatgagcgtgagtgggcactgatggtcaaatacggatttgagtactgcacttcgcaagcgattcttcaaaagtcaatcgttttacgcggaagcttcagggtattcaatgtgatctttgcttgtaccccatgtagataaattaagtccaaaaaccagaagctccaatgtgctggactgctagccagctgccttttgtgctttgtttattgcagtggtggtttaaacagctactggctgacccttcggcatgtcgttaactcagggacttcataggacaaagtggcgctaaaatcgtgacatgttcccaaccaggttttatcgtttgatgaaggccggttccaatcgcaaaatatatctacttgaattgtcgagggggataacaccgactgacattttcattgccctaattcaaccctacatcatgtccatgttagttgtgaacgccttgttctgcactctgaatctcctggtgaacgatcagttgtacaactgagccgatgcgaatgaggcaggtcttctacaaatgacatctcggacactagcgagtatatgtggtcttctacaaatgacaactcgaacactagcgagtatgtacaaacttgagacgggtctggatggttattatgcgattgagattattcgtacact

SEQ ID NO: 72235 - DNA, 1099 bp, Oryza sativa
attatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcttttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaatcgactctcagaggatccccggattatggatgccgatataggcttttattctttttttcttgcctatgccgaaccggggagggggaggttttttaagtggatcaacaaatactttttgaataaaaagtcaatgtatctaaccaatattttacaggagtatcttattcgcgaagccgatttcataatcaaaaaaagtaaaatcaaaatcatttaacttattctctcaatttcaatcgaccgctgttagtatatctaatatgaattggccatcataacacatatggatagaacttctaaaaggttctcgaaaaacacgtaatttttttgggcctgccttctttttctacgtatcactaagattcttaaccgtttgggccttccacttatctttgtaaaaatattatatctttacttccatatcaacaaaatctttttttttcacagggggggtcggaatgtctttctaacggaatccc

SEQ ID NO: 72236 - DNA, 1827 bp, Oryza sativa
ctggaccattttctttgacaacatatctcccatacatgggtcccttagcaacaatactatcaacccgtatcacggtgttttcatttactctgagtcctaccttacccaaggcagttcttctctcacttccttaaaaaaacaaacccttttccttcgcacaaaaccaactaccctttcccataaaaaaaataactatctttccttcacttcgagaaaccctacctccccgagaaggtagtctccctcaataaaacactagaaattttgctaccaaaaaaagaatggtatattgttgccttgtatgcgaaggaagccttgactttggtaccgagttgcccccggtccaacaatgagattggggggttactgtcgaagaagtaggaaccgagattcccacccctgactgctcaggacatcaaaggtctgcagaataggccccgtggcgccacatcccgccaagcacaagcaagaccaagacctcagtctcttagttcagcaggccatgccctaagcatgaggggtaaacccaaagcaagcctcgagctcggccttttgctggctgctcggggcccctggcacaccataactacgattcaacctgatgttaacaacggaattttgcatcaaattcggagaagaagaaacaagatcgaagcggatttggtgtggaatcgagttaattaccaattcggactacgcatcggctgagtatcgtatcggctagaaacaagacagaggcttgacttggccgacatagcaagtagccaatacgatacaacttggggcctggtttgggtttgttttcgaataaccatcattgccaattagagatagagctcgaataaggcaattgtatatattaattaggatatttaagttgatttgagagatttggcaagagactgccatgaggtcttatttgtatcttatctttaggaaagtttgagtcatgtccctaatggactaagtttttattcagggtataaatatgaaccccagaccattgtaatcggggagacaatctaatacaacttcagcgcatcgccaccctttttgttcttcttttcgatgagttatctcgacaagaggtaatccgtcttgatggcttgtgctatcggtgctattatgtcggtttagatgttctagtccttttaccataaccatatgctattatatgtcttaattaatctagtcttagtatctcaatttagccctatcggctggttctcgtttcagggttcctgtcggtataagcttaattgccttactatattagattaactaaggcatccaccatcttgaaaagtgattaatttcttgattgtttagactttagatttctttacttactcagagatgcatcatccctagtcttgtctagaaccctagaaactaatatggaattaagcataattagagatagtatcggagtttcagccgatcttacttaatatacatgctattttgctagttttatgtatatttcccccttatatagagagatcaccttatataaatatattaagtctaggtcaatatcagctgagttgccaaatttggtagatgatcgttatttgatatgtttctatagattggtttgtctatataagtttttactagagtactagctagtatattatctttatttatctatcttgctctaaatattgttccatcggctacttctataatatcatctgacgtaaacttgacaaaataattagatgatattacagccgatgaggcatttttatggtttgcacgtaatttatatatcaatgcattaccgatctggtctaactatatcggctgggatcactaacgata

SEQ ID NO: 72237 - DNA, 2540 bp, Oryza sativa
cttacataaggataaatatgggctatttaatttcatgaattctgtgataatcatcagttccactaaatattttggcaaatccttagcatttcacagatgtaggggatataattttacctaatctaaacgtatttgaacctcaattactgaaatacataatgcaattatcatatttatctgttgtgcacactaaaaaaattcagtacatttttcaaatacatccaagaataattcctattatttctttgtctaagtgaggagggagtgtggttgtaaaatcataaaatttacagaaagatgatattttgaaaatgacactttacccctttgccatgttgcagcaaggagttctatatttcgacgagtaatttctgaaaattcgggtcttgttccccctctccctctagatcgatcacgctaggatatcattccccagaaaaaaaaattaagtatttttaattcagccaatatttttttctttttttgaaattccagaaatttttattgcatcggtctaccaaattaaatttggcatgagttttgttttttagaaaagaaataaattcagtgaaaatatattcaaatttgaaattttccataatttttgtttcacctttcagagatttccattctatcccctgccttgaaatacttttgatatctgcaattttggatgaaaatataaccggctgcgcgtgcaacttggcatagggataaatgcatcatttctaaagtttcctctctcttcaattaagcgaaaaaagataaaacaataatcttttggcaaattaagacaaaaccagagtgtcatatggtatagacatgattttggagtgttcggtagcaaatgacacaaaacatcaacgtcataaggataatttaagctagatacacctgtgctagtccttctctaaataggtactccttatcctagaaatctcagtcctaatagaaatccttatcctacatgatacaaagagctaagtgaggaatttctcgctctcatttccattaggattagagtcacaaattacaacattgagggtcagctcccgcgagctagattcgctcgtgtagtagttgaacccaaaaacttaccctgttttcaccctaaaattggacttccaataatacccacgctagaaaatttacagttctctagcaaaaatctgtgacctatcaagtatcaaccatacctgaagattgcaactctagcccagctcaagccatattaacaaaaaaaaaagcaatataaataaaataaaataaatatagcaaatggggaatgtttgctcttttagattccaaggtcgatcgtgcttttctattcaagtacagatatgtccatgcaacaaggagacgacgacattgattgaccaacactgcaaggaactgatcatggccaagaaaacaaaggaaaaatacaaatacaagtcatgaataatcgatgccctcatgatctgcacgttactgtgacgcctcaatcctctgcatacaaacaagttatttttatctccactggaccctcccatctttctagctccttgcaataacccaataatgtaatgctgatagctcaactatttcttttgcaaataatgtagtaatagtagtctattttcatcagcaacaacattaattctccatgtctcctgatcaggccacttatatacatattttcatctcaggtaggttaccatggaaacagctgatgatcaggagagagcacccctgctttatcctcaacctcatgcacaggtaaatatcattatattagaacaaattaacatccaagaatcactttgtagtttcaggtttttgcagccaacagttttgctgattttttatgcaggagggtgcaggttcagaaggtgatggatcagtggacatacacaaccagcctgctctcgagcgcaacacagcgaattggagagcatgcttcatgatcctaggtagcaattcatatgtagctgatactagtgtgttttctttcttggttgctttgattcaaatcactgaaattaatttgtccgtaattactaattaggtgatgtgctcagtgagtgcttggctttctatgggatctccaagaatctagtgacctgctacctggtatgagagcaggagatatggcagctacctcacaccactcttctcatcttcctcggctgacacttcttagggtagatactggacagcgcttactttcctcccgctttacataaggaaaaagtacgaattaccccctccccggaactattgcggtagtacgatttaccccctaaactataataccggacatttgacacccccaaacacttaaaaccggctaaattaccaccctaactcgattcgaagcggttttcagcctacgtggcacacatgtggcgatacagtcagcaaaaaaaaaatataaacaggtggggcccagctgtcagcaccttttttcctctccttctctcccctctctctgtcggtgaacaactgaacactgcaggcggcgggcgggcgaggagccaacgccgacgggctgccagcgg

SEQ ID NO: 72238 - DNA, 5712 bp, Oryza sativa
  unsure (1)..(5712): unsure at all n locations
cattacaatgaccccgggtgtacatatttatacccatggggagttactagttcttgtagaacaagaaagaaactttcctaaagataaatggaaaacataaagtccttataggacactaaacacacatccctaaagataaaaggaaactaacaaactattcctaattaatatataactcgtcatgccgcatcctccttgaacttggtcacttctggataagttttctttagtagattaatttccttaaccgaatatagtaagaatccgacaactagagacttgataactctcatcggccgatcccaggactctgaagccgacactgactttagaccgatggtgacttcgggcttaccaaattttaacaggtccctcactattatagctcgagcttcgacatttgcttacaataccggcatggacaatcccccacgcctcccccctaaccccctcttgctgaaaagtcaagtgtcgtgatttcaaaacgagcacttatggcctttccgaattggcgttgatgacgtttttctgtgcaatggtagatattagatttttcttacataaaaagtaaaacttttggcctttttgtcgattaagaatacacataattacatgtatgaacttcaggatttaaatcctgatgggaaaattatgcacccatggattaatccaccacataaacgttctttatcatacacagatattactactgacctataagctacttaatttcatcgatgccaatatattcatgggtgcaagttgatcgatgcaagtataattaaaaagaacacttttgagttttgactaataccctagctaagtagctagcatatgaatggccaagtcagaatcgtcatcgaatctgctagtatttgacatcactaagacactaaccactccgatatgaaagatagtactagtatactagtactagatacatgtacaatcgagttggcaaggccccagtggataaagaattaatgcatgccgcgcagcattttttcttgatgaatggacatatttataattaattagttaaactagatcatgcgcatgttcggttgtggctgctgcctgcttgataaaataagcaaataaatatactagtgctatgaatctacatatatttctatctaaatttatagtagtatatgtctaatccagccatttgattgttatattttaaaacggaagaagtaatggttggtcaatgatccccctctctctctctaattaattcattgggaataaactccgctggggaataaactccccatcaaatatatatatatagagagagagatatactatatgtagtattgtttctttccatctgctggagaaggcttctctcagccagccgagcggtggtagcacgtgtactagctctgtgtgtgcgttctttgtggataacaaagagggagaataatggaaagggttttattttttgaaacgaataataatagaaaggataagatagaaggagaaatgaaggagtgatccagtattgatggcggataccgttgtccgtcactcgccgaacggctggtatcccggtaattaattagcacttcgccacttccatatataaataaaatcctagaccttcggttttggtgacttgtctctgtctagagtttgcggtgaaaaacacattatacttctttttagataatggaggcaatcaaatcaaattatatagacatggtttcaatttttatgggcagagttgagagtccacgacacaggggtgatctcataaagtagtcctcggagcagttgcgatagctagctaatcgatcactacgtactagcaactactcatcaagccagtttaattagttcactttgttcttcagtttaatactccctccgtattttaatgtatgacgctgttggcttttgataaacgtttgacctttcgtcttattcaaaaaatttatgtaattataatttattttattgtgacttaatttatcatcaaattttctttaagcatgacataaatatttttacatttgcacaaaaattttaaataaaacgagtggtcaaacgttagtcaaaaattcaacggcgtcatacattatacggagggagtaataactatcattcatgtttattctctctcatgtactctccgatcgcgctctgctgacctagctagataaaacagaaatatatgcattgcatacatatatatactcctataagcaagaggttgatattatgcatacatatatgtattatatatagtttgcatgcatatgcttatttgccgttatgaatcccgtaggtagtcgtagtagcagaaaaaggaggatattcgtcatgaaagatgtgtctgccgtcccagaagttgagtttgacctgatcatcaccagcctgcggtcagaaaatctaacggccacatacgtatacgtatatagattcatcaacaaaatatgcaaaccggcccgatcatcttgagcaagttgacagttgctaatgtgatggctcatatacatatagtttaatttatctagaagaactgacaccgaatttaaactaaacaagagaaaatagaattgataattatttcctgcggtacgttttgacctacttaaagtttgagcaaatttcagaatacccccacatttatgatctaagtcgtagaaaaccaaaggtttaagacgtgtggcacataaccacatgtttttaccccacctttattcaaatcttgattaatttcagcatatattaaacaattttttagtagtgaagatttaaactaagtcaagaacttaataattatttctcaaaaaaagaacttaatatttaaaaatttcattaacattttaagtaaatccgcgttcaacatgcataagtgtgaggttttgtaaaactttagaacatatatatgaaaagtataggacaaataatacaacgcaaaaataacaccattaatttttactgatgatccgcttgtattatttccgtgcactacattagcagacaaagtacgtcatgcatacgaagcaactaccaataattgtgagaaaagaaaacagagacaatgggtatctaatattttttttagaggtaaaccatgatctgagtagtattatatttccatgttgggtggttaattcaatggttgcagctagcattcgctgcatttggcctgcctctgagtgacatcgcaacgcctttaaactaactgcagataagggagaagggagacatgtcatacacctactacatatatatcgtaataatgttatttttcacaaatatatcagagtaaaataaaaagggtcaaaatcacgttaacaaagacagctagcatatactaataagcgatcgaggaaacataggctgtggatactatatgatcaccagcaagtcactacaattaatgttaggaaatcagattgggaggtgttaaaatgttagcactgatcatcttgataaaaagaaaagggtattaggaattaatgtgtttttggaacacgtatgattttttcattcctaaaatattgtacaaaaattatgcagaattaattcatgtgttggagaccaccttacctatgtttgttcttaaaaataatctcggtagcaaataattaatggacaaaaggagtagcaggtttggtcagtacctctcctaagctatgctatgtactacggtacctgactccaccccaccaggccagcatgataatagtattggacagacagggaataatggtacaacaaaacaaaacaaaacaaaacaaagacactgaccaatgggacccacagcgcgggttttgactttttgtttgatttgaagttagaatagatgagatagacgactagacaagggaattggaatgggacgccggcggcgagtcaaccaccggggcagcctcgtcgtggcggctctcgcggccggcgaaccagcgcgctgtacgacgagcgatggggacccagcggtcctcgtgcgccaggcgctccctcatcgccgcccgcagcctcggcaggctcaccatctccgacatggaccgcactgatcccgacgacgacgacgatgatatcatcctcgccctcgccgccgcgtcgactgatgacctgccgccgcttgccgccagcagtgtcttccgctgatgatcatgatctgtctcctcctcctccgtctccttgtacagctccatctccatctccacctccatcgtctccatggaccgaagcagctccgtgtcgagcgcgatgaggtcggaggagttgatctcgctccatcggctcttgaacaccgcgtccgacaccacgatgcggtgcttgtagcggtccagatcagggcagtgtgccgctgccgctggctccatccgcgacgacggaacgcgctcgacgaagatgcccaggaggtcttggtcgccgtcaaagcgctcggactcggacgcccccccggccgggacgaagcgtgcgctggaggcgtacttgaggccgagcgcggcatcttcggcgtcgacgcgcgcgcggcagagagggcagctggccttggactcgagccagcggtcgacgcagtcgaggtggaaggcgtggcggcagcgcgggaggaggcggagcaggtccgcgtcgtcgaagcgcgccaggcacaccgcgcactccagcccctgcctggccccgcggagagccgcgaatcggaagaaaggcagagactcgatcaccggcttggcgacgccgtcgtccgccgccgccgccgggacgaccgtgggggcgggggcggcgacgggggaggatggatggcagaatttggcgtacatgaggagaaggaaggtgagcgagaagatcatggtgaagannnnnnnnnnnnnnnnnnnnctggggcggaacgacaccttgatgcctacgccgggcgtctccggggcggcctcggcggtggccggctgcgctgctgcgacgcaagcagcggcggagaggagggcggcgacgagggggaggcgtgtcgttgtcgacatggacaccgcacccatcgcccggattcctctcttcagtttcttcttcttctcttttctttttcagttcagacgctgctgcctgtagtgtactcagtctgtctgtctgtacatgtagtgtgtgactgacctcctctaccttctcttaatttgtttagagtattctttattataactactcctactaatccagtgtcaactaatgtagtgtcctgtgcagtgggccccagcagatgacgtccttctctacttaatcccccatctctatctatctcgatactattctttctttctttctttcggtgtttctttctgttgtgctatatacgcctgcgtctgcgcttgcaaaaaagttttgtttctgtcctgctaacctcttcctcctcgcctcattctcttcttgttattaaattctccagcgcaacatcattttcatctgcccacttccggtggcaacaaaactacgtccatttgcttcgtcgatggatgggattgtactataactgtcatttccttcacagataagggcgttctaagtttgggccaggactaagcccatcccgctgcatattgggtccaaaggaatacttgtaaggtaaaaataggtataagtccacctaagatcctaatcttgatgtcgagtttaaatcgctcccttaaaacgcaatattcaaatataagacgttagacgtccctcaccttgcattaccaaactacgtaagatccttgtctggtt

SEQ ID NO: 72239 - DNA, 1908 bp, Oryza sativa
tgatatattatatgtataaataagatatatctacaaccggactccctatatactctctccgtctcataatataagggattttgagtttttgcttgtactatttgaccactcgtcttattcaaaaagttttggaattattatttatttttttggtgacttactatattatccaaatccaaagtactttaagcacaactttttattttttatatttacataatttttttaataaaataatacaaacaaaaactcaaatctcttatattatgagacgggacgggaggagtagatggtaacctcgcacgaatccgcaaaaagatggattaaattctgttgccaaaatatttctccactacacagaacggttgcacccaagccgactgctctcaattgcatccaaacaggccggcccctgcatgcagttcgacacaacctgaccacatcctgcacacgttgcagaaatttgtcttccacgttgctgctctcactcaaaaaacctgacaatacaactcacacgttattagtttaacagccctgctacacagcttttttttttaataatgtattaagaaacccgacctctacatccatgataaaatgtacacagccaacacagcttgaatttgcctggttatagtagaccttgtggttatgtttgtttggcctcttcactcagcagggcttctcttcatcctgcctctttgttgactgataaacctgtagtgtagtgcatactccatactagatgtgaggcttcaatctggtcggtcagaccgaactatcgtaactttggtggtaataacaacttgggtttcctaatcctgtttctgaagagagaccgaagttttttttggaggatttttatgctacactatactacaaaagtatatacttatagtataaattaaggtgtagattcatccaatcttcctttcgattagttttgcagtataaatcgaaaagaatatatttgtcttttcatctttttgcgtgagggtatttttgtattttcgcgtttcagaacctgctcgagagagtggctcagatgaaatcagcttgagagaaatccgttccctttccttcgtcccatgcgctaacgccgctgtggacagccaccgcaccgcgtccctggctcgccgccgatatccaccgcgagcaagcgccggcccgccccgcaccaaacgaacagacaagaaattccagcacatgtactactcgtctatccgtccatgatatatgcatgccagagtcctaatctcttgcccgtctcgtcgtcgataggtcggcatgttcgctagctacatactcggtccgtaaaaaaaacgctagcacaaatggacgacgagatacagaacaattactcctgaatcctgatgaaaataaatctcaacttcaaatgatttagcagccctttacatgttttaaaagaaatacctactagtataatgtcgagtcgcctataaatcagacgctcgattttttttttcaaaaatcggttgctgttacaccaggtagattgagcatgtttcaccaggtagatcgaaaatgtttcagtcttttaaaaagctaaaacacaatcaaatcaactcatgaaacattttgctacaacgtatgaaacaaacggttatccaaaaaattagatgttgtttcatgttggtatttcttaacgacattactagaaatattcattcctagcaatggtgccagaaatagtcctggtatatttatggttacaaaattaatccgcaagcgtacagatgtaccattgtagcatttcacccgaaagtattctaaggtatcgtatttttaatcccaaagaaagataataagagcgaactttactaatgcacttgatacatatattacttataattgtcaaagcctaaacaggggttagactataacata

SEQ ID NO: 72240 - DNA, 1780 bp, Oryza sativa
attctcagtgagtgagacattttaattttaggattaggatgccgctattagcgacatagtacataaattttagaacaaacacaaacatcctttttaattctaacatatttaaccttacaaactagcttagtcacactctttattagaaatccttttaaatttaaatttatgaatattacacatatttaagtgggctttcaatagaaatctcaataggaatctagtgagataagggatgcaccgcttgtttgcttctctttagcttgtgttagggccaggcgcatttgtgggtatatgagtgtagtgttgtgcatatgcacatttgctgtgtaataaaaaaaatctttttaaccgctaaaaaaaagaaaaaaatctttttaaatttgattttgatttcatgccgtttcctttgatccaaagatgctatagctagcatttggggtatatattttccgcatattccagtgaactgtcaccgattacctgaagaaaccattagttttaggatttactcagtctcttacaatggacataaaaaaggttgcttcttctgttgcctcgtagcgacggtgggatcatcactgtaatctgttcgatgctatctgccagacaaggtgagtatagttagcacgatgattacaccctcagatcagaaaactaatcaggctagcaattaagacgcatccttcctgatagagccgatcgatcgatctgtttggccagttaaactatgctctatgcagaagccaaactgtacaactgtcatgtccagacaaaccggaccagaagagagagagagagagaaatgaaaaaaatttgtgccggcaggtgaatcttgtactgggttccggttgtcgatgcaaatgtgctgtggatctgatctgatctgctctgataagtactacctgtcccaaaataagtgcagtttaacactattcacgtttaacgtttgaccgtccgttttatttgaaaaatttgtgaaaaaattaaaaacatttagtcacacataaagtattattcatgttttatcatctaatagcgataaaaatactaatcataaaaatttttcaaataagacggacggtcaaacgttgaacatgaatagtgcaaaactgcacttattttgggacggaggaagtatgtaaaagttgatttaaaacatcatataaatctattttcaagtttgaaacaattagtataacttaattaatcatcactaatgattttctcattttgcgttcctgtactcaatcttcaccagttgatatgtcgaaaggggccttagaggaaaaagaaggtgattttaaggtgtattaaggattttaaaattaacattagatttaattctaagtttttttaaggttttttttaccttagtttatttttgtaatatttgtttttaaattgctaataatgtatatgtaaaagctttttttaattgtttttaagttcttggtaaaccgttatggtttgtgatcggcgtaagcggaaggacgaatgtggaaactggaaatgttgatctctcgaacttttctccacttgttcagcgatctgggatcctaaaaatgggcacatgtcctcaaatggtttctgcacaaaattgctaggagaatttctcatgattgcatcctagttttatttcgagtccacgttttctttaagtacctacatttggtaatcacatatttcgtttggtcgttggggagattttggcattcgtttttggtagggatagccgaaagcacgttagcagctttaccaaatatgtttggattttggc

SEQ ID NO: 72241 - DNA, 10807 bp, Oryza sativa
tagagccataccgaaaactattccgaagactccgaggacttccgaacactattctatactactccacttagcactatactactaatactaatgtatgaaaagaaattgagcttgcttgagtgtgttgagaagtgaagtgagctcctccttttatagggccggtatgacggttacttcatgcgaaatgttcattttaccctcgtaaccgtcatcagcaatgcatcctagacatccatgtgtaaggggggagggggcgagccgacttgcccctggttcggctgaaccagggtcggctccaaccgacctccccttcagtacaatggctgacaggtgggtcccatttgacagttaaggtggtttccggacgtctacatctgacatgtgggcccccttatccaattgcttgcttaggagtgaggttttctccactttctctttattttatttgataaattcctgtaacatgttattctccaagtacaagtggaagtatattatttgcaaataagcatgcattgtaagcatggctagttcttcattttttttagttatattgacggtcgaaatttgtctgtaacgactgtcaatatttcaatctatataaaaacaatgtttcagcaaatagcaaaataatgtttcaattcactgctatatttgatctatacatagtgaaacatcatgagtacactagctgaaacattgttggtggaacaaaaaatgaaatagattccttaatagagcgtttccggaatatgtgagtgatttgttgcaacggccacagatggtggggtgcttggtgggggaggcacgcgagcgtgcgaggcacggcgggagcacaggaggcgcgggcgtccgattttctcttccgcgatcaggcgcccggcacgtgggattttccgtataatgtaccttaaaaattctcttttttagaccggaccgaaccacctttctggcctcctactccactaggggtgcgtttggttcccggttaaggttggatgagatatggcgatccatattttgctagatatggcgatacagttttttgtttggtggagtgaatatgacgatccagttttttgtttggttgtagggatgaaagtggatatggcgatccattttttttgtttggttgggggagtgggatggataagtggttgcaatcaccctttcattagagatggtaagtttacccctccaaattctccagacccaaaataatatcagtctactaaaaaaatataaatagaaataaaaacggaaatgctacttatcggtattccgtcccaaagggacaaccaaatcaaaaaaattgtaaccatgccattataattttggttttagctgtgaaccgcttctcatctatctcatttaagacaccggtgttgttgggattttttttacttcagacaaaactaaggcaggcttgggaaagaaacacaaggctggcatggggggaggaatcggcgaatcttgcggcggcgaagacaacgctagcgacggcgtcggtggtcattttttcttcccacaatactgcattccaggttcttctcgttctcattcctcgtttcgtcccctttattccctcgaatctagatcccaaatgctccccatctgttctagggttcgtgcgcatggtggctatttattcaggggctgttattccgatcagtgataaccgatagcaactgggattgtctttgattttctagggtttagagttagtggagaagaaaaatagttaactccttggtaatgagatatgttggggcttttttttccggaggctgattttggcaggattagggagagagaggggggcacttttaatatcatctgataccttgcaagtatcacctaacatgtggtaggaatcgcctgatacctaacaggtttcaccttatactacttcgcaagtatcaccggatatgtggtaggaatcgcctgatacctgacaggtttcacttgatacttcacaagtatcacctgatacgtggtaggaatcgcctgatacctgacagatttcacgtgatacttcgcaagtatcaccagatacatggtaggaatcgcctgatagctgacaggttttaccggatatttcgcaagtatcacctaatatatggtaggaatcgcctgataccagacatgattcacctgatacatggtaggaatcgcctgatacctataaggtatcacctgatacctcgcaagtatcacatgatacatggtaggaatcgcctgataccttataggtatcacctgatacctcgcaaatatcgcctgataccggttaggtatcaggttgtcatgccctgaagtttcccccttttccttgctttaaaaatttgttaagtaaatcgtccgaacaaattgttctaattaacctagagttgaatccctaattaataaatgcaattaataattggaaatggcattgtgggatttttcttggtttccgcatgtcacaatacattaacagaggatttttagtggaattttcagagccttggaaagaattttaaccaattaaaaatcaccaaagtgcaatatttaatcccaggaaaatccttttcctctttttcttttcttttccttcctttttctctagatgggccgtcggcccatctctctccccgcgctcagtgccccttcctgggccagcccgctcctcctttcccctccccgaagtcctccctccctccctttctctttcgggcgccgataggtggggcccacctgtcggggtcgtcccctacctctagccgcccacgccccggcgccaaccaccgccgaaaccgccgctccccacgccgcccaccttccccgcctcctgcgcctcaatcgcgccctgcgcccacgtcgctgcccctcccccacctcttcccgctctcgcgcccgcccaaaaatggacgggattcgcattcgaatccacctctctctctctctccctccactccccacatcgtcagccaaataggggccatccccggccgtttccgcccctccctcgcccataaaaacgctcccccaaacctcctctcccatttccctcattcaccgcgctctcccgtgcctcctatcgcgctcgcgccgctcgctgctagcgccgccgctagccgccgcctttggttgcgcgccgccgctgatagagttgccgccgcgccaacccgccaccgccgttagcttcgccgccacaagagctttcccggccaccgcctcacgttgccggaatcccaccggagcgcctctcccctcgcgagccggtgagtttttccctcccctccatctccggccggcaattcaagccgctgtggtcgtcgtctcctctcctaacgcctctccatcttctcctagggtgtcgccgccgcccgtccgtgcctccgcatcaccggtcatcgccgccgtcttcatccttcgcgccggctgccgtgctcacggtgaggagctcctctccttcctccttccctctgtccggcactgggtattattgcgcaataaattgattaaggacttttctttattagtaaaaacacagtttatcttctaaaattcataagtaattcatccaagctccgtttaagtccattcaagtctcagtaaattcataaaaattcaaggaatccattaaaaatggttttgtttcctgtttcagtagtcctatagcatgttttgcttgtgtgctttgtttgtcgcgtagatttcggccgtttcgtcgatccgcggtttctcgaaaacgttgctgtggtctcatcagtgcgagagcaaggcaggtcatgcattacaattgatcatattgtacccaatttacaaatgtcccgcatttctattaaatgtcgcattcttttacaatgtcacgtgggatgggtcctattactcagccatttattgtttaccctatgccattgataacctgggtattaaaatgattagatgttggtttaggaaatgcttagccatgcttagctcaactagcacacaaatggggatcacattattacatagactttgactatgagcatagctttggattggtgccaccgcaatggtgttagctaattaaaatacactggacggtgggctgtgggtacatggttttgctggtcgcacccatggcagttaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagtggggaccgcccactgccttttgaggggtgggggtgaaaccttagcgtggtgtggatggttaggggagggttatgtggagggtcttgtcacgatttccccctttgcagtatcatggtgatatttcggggcatggtgacatgtgtggaatcgtgtcttgtgggtacagttgtacacctctgatcagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgctttcaactactgtttttaaatgcctgctttgtgcaaaagaacctttagcctccttcggttatatcctgcatcatacctcctcttccgatatgacttgctgagtacagtgggtagtactcagtcttgctctcttttccccataccagagctgaagatcttcctagtgggagctgtcttgtcgaagttggtttcgtcgctgccgtcaaggattgcctgtggagtggagtcgccccgctgcagaagtcaagtttccaagtctagctcgttttattttttccgctgcatttgtaatcttttctatttttgtaaaacatggatctgtatgtcaacaattgtcgtttgtgtaccctggctggtcctggacagggatttcatgcacattcagcttagaaattctggttcgtgaatttctgggcgtgacaagttggtatcagagccaggttgaccgtaggacaagccaactggaaaacctaagagctctctgaacccctttttcatctgcatatgcatttttgcacccggatttgtttcgggaaaatttggggttttgcctcgttggtttgtgggaaaaatcttggtcgttcattcggatcggatctttaaaattagctcagtctagggttttagtaaaattttatttggagtttattcgactgtcagtcgggaatctatcaggtgatatgcattaggtcgtatctatgttcgatggggcaattttatgcgcattattttctatgcatctattttatgcattaatttattggttagcctgttgcattagtatttttgtctaggttcatgaaaaatgttctatgcataaaaatcagccatgcttagttatttatttgagtcttttgttgctttgttcaatttggaatttagcatgaattggttcttatcccttgtctactttagatgtcagtcctatccctcgattgcaagcgccgctccgagcttcagagtcgccgcccttagctttatcgtcttcttagtttgttgtttgctagtttccgtgtttaggtctgctgcttgtgggttagtcggcggtcgatatcatgtgtcagtggtatggctgcctttattaggagttgcgtgcctcttttcagtgttttaatcaagattaagataattgcacttaaatttataagaaagattagtttctaagccctctatttttctctcttttctcatatttctacctatcccccttcagatggtgaagacaagaaatggttcccgtgactccaacaacgctagtggcagcgaagagcatatcagtggagcacgtgccagcgatgcatctgacaacagttcatctccaccgcccgagaacccaacgatcgctcaggtgttggacaatcagactcagatgatgtcaatgatgatgcaacagatgcaacaacagtaccatcaggtgttgcagcaggtgcagcagcaagtacaacagcagcagcagaacctgcagtttggtcttctacctcctcaatccaaactgttagaatttctccgtgtcaagccgcccactttctcaagcaccaccaacccaatcgaggccaacgactagctccatgctattgagaagaagctgaaccttttgcaatgcaatgaccaagagaagattgcttttgctacataccagctgcaaggtcccgcttctgtttggtgggacaactacgtggtgacccgtccagctgggacagaggttacctgggtagagttttgtcagagtttcaataaagcacaagttcccgagggaattgtggcacaaaagaagagagagttccgttccctgcaacaaggaaccagaacagttatagagtatttgcatgagttcaaccgcctcgcgcgctacgcccctgaggacgtgcgtaccgatgacgagaggcaggagaagtttatgtctggtcttgatgatgaattgactaactagttgatctctagagattatgaggactttgagaagccggtggataaggctatccgtcaggaggagcactgtaacaaaataaaccgtaagaggaaggcagctcagttcaggactccccaggggaagagtcagaagcctcgtttcacgatgggacgtcacggtggaccttccaccatgattatccggcagcaccgtccctaccacccgggtagcttcaacaagaaccaccatagtagcagtcacaacaacagtgagcagcacagcctcaaccctactccgagttcactaaagattccagcttaatcagttcagccagctctgccagaatagcccaagaggttgggagaaaaacccgaactctgcttcaattgttacaaacccggacacacggttggaaagtgcccgaagccaagacgtgctggacccaagttcgttcaggcccgtgtcaatcatgcatttgcagaggaggcgcagtcagcaccagaggttatattgggcacattccccgtcaactcgacaccggcagtaatattgtttgattttggtgcaacccattccttcatttccaagcgttttgctggtgcacatgggttctctttagtgaaacttaagataccaatgcgagttcatactcctagaggtggcatgaccacaactcactactgcccatctgtgacagttgaaattcaagggttgatttttccagccaacctcattcttctcgaatccaaggacctagatgtcatacttggaatggattggttgacaaggcacaaaggagtgattgattgcgccagccgcaccatcaagttgaccaatgcgaaaggagaagtggtaaccttccagtctccagtgccgcagaagccagggatcagtttaaaccaggctgctggtgaagaacaagaggtagcagtggagaaaaccactaagaagttggaggatattcccatagtcagagagtatccagaggtttttccggacgatctgacaacaatgccaccaaaaagggatatcgagttccggattgacttggtacctggaactacaccgattcacaagaggccttacagaatgggagccaacgagttggtggaagtcaagaagcaagttgatgaacagctacagaagagatacatccgcccgagcacgtcgccttggggtgctccggtcatttttgtggagaagaaggacaagaccaagaggatgtgtgtcgactaccgcgcactcaatgaggtcattgttaagaacaagtaccctttgccaaggattgatgatctgttcgatcagctgaaaggagctactgtgttctctaagatagacctacgatcaggctatcaccagttgaggatccgcgaagaggatattccaaagacagcattcatcactcggtacgggttgttcgaatgcacagttatgtctttcggactcactaatgcatctgccttcttcatgaatttgatgaacaaggtgtttatggaatttctagacaagtttgtcgtggttttcatcgatgacatacttatctactccaagttcgaggaagaacatgagcagcatcttcggttggtacttgaaaagttaaaagagcaccagctatatgccaagttcagcaagtgcgacttctggcttaaggaagttcagtttctcggtcacatcgtgaatgctcaaggagtagctgaggatccagcaaatgtggagtcgattaccaagtggaccccaccaagtttggagtttcttaggacttgcgggctattaccgccggttcattgagaacttctctaaaattgctaagccaatgacacagctattgaagaaggaagaaaagtttatctggtctgctgaatgcaataggagttttgaagaactcaaacaacggttggtatctgcaccagttttaattttgccagatcagacgaaagactttcaggtgtattgtgatgcatctcgtcaggggctaggatgtgtgttgatgcaagatggcaaagtggtttcttatgcttcacgacagttgcgtcctcatgaaggcaactacccgacccacgatctggaattggccgcagttgttcatgctttaaagatctggcggcactatctcatcggtaaccgttgtgaggtatatatagatcacaaaagtctaaagtacatcttcacccaacctgatctgaatctccgacagcgaagatggttggagctaattaaagattatgatatgagaatacactatcatcccggcaaggctaatgtggtagcagatgccttgagcaggaagagttactgcaacgtcgcataggtagaggaactatgttgtgaggttcaacgtgatttggaacatctgaaccttcgtatagttgagcacggattcgtggctgccctagaggcacaacccacactggtggagcaggttcgcatagctcaagcaagtgatcctgaaatagcagagctcaaaaagaacatgagagttggaaaagcccgaggttttgttgaggatgaacaaggaacaatctggatgggagaaagattgtgtgtacctaaaaacaaggagttaaaggacttgatactgactgaagctcatcaaactcagtattccattcatcctggcagtaccaaaatgtaccaagacctgaaagaaaaattctggtgggtaagcaagagaagggaaatagctgaattcgtcgcactttgtgatgtttgccagcgagtaaaggcagagcaccaaaggccagcaggattgctacagccacttcagattccagaatggaagtgggaagaaatcggaatggactttatcaccggtttgcccaggacgtcatcggggcatgattctatttgggtagtcgttgatcgactcactaaagtggctcacttcattccggtgcatactacctactcagggaaaaagttagcagagctttatttggcaagaatcatgagtctacatggtgtacctatgaagattgtgtctgatcgaggaagccaattcacctcaaagttctggcagaaattgcaagatgaattgggaacccatctgaacttcagcacagcctaccatccacaaactgatggccagaccgagcgagttaataaaatattagaggatatgttaagagcttgtgcgcttgactttggtggagcatgggacaaaagcttgccgtatgctaagttctcctacaacaacagttaccaggctagtctgcagatggcaccatttgaagcactgtatggacagaggtgtcgtactccgctcttctgggatcagacaggggaatgccagttgtttggtacagaagttttaaatgaggcagaagagaaagtcagagctgtcagggaaagattgagaatcgcgcaatctcgacagaaaagctatgcagacaaccgccgaagggagctcgttttccaagcaggggattatgtgtatctccgtgtcactccgctcaggggagtacaccgcttccaaaccaaaggaaagttggcaccacgctttgtgggaccatatcggattttggaacgcaggggtgaagttgcttaccagcttgagcttccctccaacatgcttggcatccataatgtgttccacgtctcccagttgaagaaatgtttgagagttcctgaggaacaagcaagtccggatcaaatcgaaatccaagaagacttgacgtatgtggagaagccgactcgtatcctcgaaaccagcgagagaaggaccagaaacaaagtaatcagattctgcaaggttcagtggagccacctctcaaaggaagaggccacttgggaaagagaagatgagttgaaggccgctcatccgcacctcttcgccagctcttcccaatctcggggtcgagattccgtttaaggggggtaggtttttcacgccctaaagtttcccccttttccttgctttaaaaatttgttaagtaaatcgtccggagaaattgttctaattaacctagagttgaatccctaattaataactgcaattattaattggaaatggcattgtgggatttttcttggtttccgcatgtcacaatacattaacaggatttttagtggaattttcagagccttggaaataattttaaccaattaaaaatcaccaaagtgcaatatttaatcccaggaaaatccttttcctctttttgttttcttttccttcctttttctctagatgggccgttggcccatctctctccccgcgctcggcgccccttcctgggccggcccg

SEQ ID NO: 72242 - DNA, 6194 bp, Oryza sativa
  unsure (1)..(6194): unsure at all n locations
taaggggggagggggtaatttgtactttttcatatatttaattggtaatttgtccacgtcttccatatggacttttcgtaactgaccagttgataggtagatatttgggcgattgagttgctctgtttataaatggagagccttaggtgctgcccatgcatggcatctaggcctgtttggcacagctccagctccagctccacccctcctggagctggagcttagccaaacagtttcagctccaccaaaactaggagtggagttggatggagctctctcacaaaatgtactagagttgtggagctgggttttggcagctccacaactccactccagactcaactcctggagttatatttaggagttggagctgtaccaaacaggctataaggctacgttctaaactctcgtttcccaacttctacctcatttatttccgcacgtttgcttttctgaactgccaaatggtatattttttataaaatattacatagaatagttgtttcaaaatatcatattaatctatttcaaaatttattttaactaatacttgactaatcatgcgctaaccgtttcttcattttacgtgctgggagtgaagtttcactactagacatgcgattttcatggacgccggcccctttaggttccaggcgggccgtaagtggctctgccttgaaccaggtgatcccggcgccgagctgtgggccgcacaggataatcgattatcccgtgcggtccacttaagacaaccgcacgggataatccttttatcctgtgtggtcgttaggcgaccgcctacgatggtgagggagctatacaagtcccagcccgaccgttgcaatggcatgccggtgatttctctctcctaaaactccacaaattatgggagaatgttttcgatctcaaatctttgattgggttccatataaaaggtgtagagcttgttctcctccttcatttgcagccatttttgtcagttttcatcggtgcaatacgaagaaacttgcacttttataaatggtatattgtagttacttttttatttttttcttattttttagcaaatacataatgattccattacatgtttataaaagtatttagtacctaaattgaaaagttgggtttgcctctattaaatttattttcattcggataaaaggacgatttttttcatttgtaagaaatggacaatattttattaatgcttaaaattgttgtgtggctgtttaaatagtccgtaaaactttaatttactatgtgattagttccctccaatttaaatacattcttttttaccatcgggcatggatgtattaatgacaagctttattgtaggtcatggatgtacagcaagaaaagagctcatccaacgttcttgaaggaagcagccaaatttgttgaggtcgcaaaggcacatgctgtgagggagaatttgaggagcgttttttgcccatgcaaagtgtgtaagaacgaaatttgctgcaagatccgaatgaagtattgtcgcacatcgtagagcaaggatttaaggagggccacaaaatatggacttttcatggggaagtcggtggtcgtaacgaagtgatggatgatttctgctttgatgatgcagaaaattttataatcaaagacatgtcacagggaaacatcccggaatgtggtggctctggtatagtgtcacgtcccaaaacgactctaaaatacatcctctaaattatgcctagaataattaaaatccgtgtgaaagcctccaacaattaaaatgtgcaaagttaaaagtcaaataaggcttagaggatttttgtatatttcctaaaagcctaaaatgtgtaaataaattttagtggaattttctgagcacaaatagtaattattaagaaataaacaaagttgaaaaggttttataaaaagaaaaaccctaaaaatcccccttccctctcttgggccgaatccggcccatctccctccccctctctcctctccccctcgcggcccatccggcctctccccgcgcgcgcgccgctgacgggcgggcctgcccgccaccctcgctgacgggtggggcccacccgtcatccccttcctcccgccgctcccgccgctccgcccgcgccaagcgccgccgccgccgccgaatccgccgcatcccgtcctccccacgtgcaatcaatagggggaattattctccgtgattccctctccctttccccccaaatttccctccctttctcccttggattcgtttggaaaccctcccctaatcccgccggcgccattgatggagcccgagagcgccgcgccggtttccttcccctccggccgccctctcccccttccaaccctatataaaccctccccgcgcctccctcgcccgtttccgcccttgccgcaccgtctccccaccggaatcgagttcgtgccgtcgccctctctctcctccgtcgtcgacgacctccggctggccttctccgctcgccgggaccgtctcctgccccggcgtcgcctcctccggcttcgccgcaccgccgtcgaccccgtccaccccctcgccgagcccgcggaccgccggaatgccgtcgaccccgttgacccgagccgcgccgccgccttcctccgctccggccgcctttttcgtcgtcgctgtcgacctagggtgagccgaggaccgccgcctcttttcccccttcccttcccctctctcggccgccgctccgccgtgcctatggccgccgccggcgaccataggggcgcgggcgccgtctcccgccggccgcgccgagtggccgccgcgtggggcccggccgtcagccgcccacgtcctcgggtgcggctgacgcgtggggcccacgacgccggccggtgcgagcccgggtgcgcccggtccaccgtggaccgtgaggctgtctcgtgggccccactcccgtggacccagtccgcgcgccccctcccctcggctgacgcaataaagcttttttttaaattaaaatttaaatgaagaaattcgtaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagcccttttattttccgttggtcgtgtagacgttgcagcttcggaagatccgctcttcgtggaggttgaagccgacgtttgggaaagtgagcaaggcaagtcacatcatccttgaacatattgaatcctagtttataaaattattttgatttaaattattgtattatcgctttatttaaattcccgcgttatcactgttttatctagccatgcctatgtacccttgttatgaccttattattgttattgttattattaccttgttcaccctagaataaacaaaacacaaactagtggacactctactcatggtaccactagtatgattttaggtagatgcttcgctggttaattaggcaacattaggtggttttacaactctagactttgggaatattcatatcacctggatactatggaatggttggattattggggaattagattcacaccgccccctctattcaaaatccccaaaagggttttaggctgtgcttggggtgcatggtttgaatagtagcacctcggccatataaggaccggtcttcgggcctgtgttgcaaagcactaccgtacttccacatgtctaatgggtaagggttagtttgtggctcaatctggttataaacaaaagtacacggatggagatggacaagttcgggggtcgatggacatctccagggcaaatgaaggctacacgagctgcggcccggtagtcgaagatgtcatggcacagggccggtgttctgctgctaggggctcaatcatgcatacctgtcctggaggttccggctgtaggtgggattgggtcggtactcttgtttatggataggatgggttgggaactatgtcacgtcttctgtccgtatacagtggtggtatgtggcacgtggttacacgtgaggaagatgtgtcttgtgggtaaagatgtacacctctgatcagggtataatctattcgaatagccgcgccctcggttatgggcaagccgagcaatgtacccaagttagtgttttaattcttaaaatttgctcaacaacgaaaatgtggaatggttggcctgggttggcttgggacgagctgggacccagggtcgggttgccagttcggtctgaatcatcgtaggccttgggttaaggcaggttcatgtgggttcacggccttgattaataatcttgtatagctctaggaccgtgtttacaaagtagctttgagcaactaagtgacttttaatgctgtttactgcaaaccctaaccctttatattatgacccccttgtactcccttgcatttattctgcacttatgcgtgtgtcttgttgactacggtggttgtattcagtcttgctcaatttttcccaaacccagaagaggagttcctggaagatgtaggctttggcgtctagctcgtgcctgccgtcaagcgcctgtggtcgtcgccctagtcttccgctgtttcccgtttgtctttgtgtgtgctgggccttcgccgcccatgtaataaagtaactatttacgcttccgcttgataaactctgaaatgtatcaacttttggtgttccttgcctcctgggacaaggaataatacatgcacataaggaacgcccgttgggttatttccggtcgtgacatatagagaatgaaggcattgaatttgatctggaagatatgttgtggcacgttgaaccagaggtcctaactggtagaagatgagggttggacaattgggaagcgttggagaaagcagcgaaggaccttctgtatgacgaagcgaaaggatgcgacaaggactattcgatgctgcgctcggtgcttgaacttctcagattgaaggccagaaatgaattntgggcacnaanttcaannatttnatgcatnttttgagggnnagccgtgnnaaacnnaacctnntaccaangaacacatatcaagtgtagaaattgatatgtccattttctttaggtgttcagaagtccattcatgtgaaaatttttaaaatttgtttggggggccccaaatttaaaanccttggtnaaccaaggcaaagaaaatttcgcgggatttaggactcttgcccaacatgtgggacgagtcggtacaagacgggtaacggagcctccgatggagaggtggtcgacaaagatgatgcaccggtggatgagaaaaaaaagattcctaggatggtggtgtggtacctaccagtgaaagatcgcctaaagcggctatattccaaccgtgatgatgccaagttgatgggatggcactaggagggtaagaaaaatgacggtaagattcgacaccctgccgatgctcgactgtggaaaaactttgaagcactacacctggaatttgcaaaggacccgaaaaatgtaaggtttgcattgagcacggacggaatgaacccgttcggtgacttaagccgcacacacagcacttggcaagtgctgctaaaccgtgtacaacttgcctacctggatttgccagaagccaaagtatatttttttggctatcgttatacaaggtccaagacagcctgggattaacatagatgtgtttctggaaccattgatggaggacatgcaagaactgtgggaggaagggttatgaatgtgggacaagtaccgtagggaacattttactctgcatgccatcatattcgttacgatcaacgacttaccggctaacttttcgctctcgggccagtttaagggaaagttcagatgtctcatatgtatcgacaagatgtcgtacaagtacctcacctcgtcaaccaagggtgtgtacatgcgtcatcgtcggttcttacctcagaggcataggtgccatgtgaaggccagattattcgacaatacagtagagaacgatctagctccggaaacacgaactggtggctctgtcttcgagctgacaaaggatattaaggttgtgttcggcaagccaaagaagaagcccatcaagaggaagaaacggacggatcaggaaaatactgatgcacctgtagaggaaagtaacttacttttaagaagc

SEQ ID NO: 72243 - DNA, 6237 bp, Oryza sativa
cctgcagcccgttgaatctgtgttaattggttgataactccaaactcccggacatgtagataaaatctcaaacttggttctggaaaattttggagtagattgtggcggcgatggagaagccaaaattgccggagaaataattggagttgatgaagtagaaagcttgctcggaagtgaagacgaagatattgactcattggcttgttaattgattgcttcatgttgacataacatctgtcgaattttgagtcttgtatttgtgtagccccgactctagaactgaagcttcttgttgtcgagtggtcattgcttaattgaagatacgtgttgaagatgtctgagtagaattcttaaaaattgtagaagcaccacttgttgtagtaaaataacacggcatcatatttcgtgatgcatgccgagatgtcgaggctcttgtagacgtcgtggttggtgaagtagcaaatcttgcgaagtaaaggcaatagagtttgccggtgcaaaaaacaatgaaaatgtagtcgctccaccatggtggtaaagttgcatagccgtgatgacgtgaagatgagtcggcggcaacaaaagcaaaccggtgcgaagacgcataatagtgaagacaaaaaatcagttgacggcgaacgagatgactggtggagaagatgacaacgctaattaacggtgaagatggcacgtagccttggatgcgaggaaactagtcggcgtaggacaaggcggtcaacattgaagacgaagacgcccaacagtgacaacagagttgtgcagccatggcggtgggataatcattcggcaattgacgaggcgaccgtagtggtgatgaaaccagtcagcgatggaagaagtagaatgatgatgaaaacgaaaacttccttgaagccagtcgtgaaagtgaagacaccttggacgacggcgaaggaaagctggtggtgaatacaatgatgaccatcgacgactgtgtgaccatcaagccatgtaggggaaaacaccagtcagcggcgacaaaggcaagccggcggtgaagacgaagacgtttggtggagaagatgataactccaataaatgatgatgaagacgcgcaaccatggaggcgaagaaactagtcggcatcaaaagataggtattagtgaagataaaggtgtccagcagtgacgacggagttgtgcagccatggtggcgagataatcagtcggcggtagacaatataccagaagtgaagacgatgacgcccaataatggtggtatgaccaaccaaccatgtaggcaaagacaccagtttgcagcgacggaggcaagccgatagtgatgttgaagatgcccatcaatggtggtgtgacgaaccaaccgtataggtggaaacaccagtcggcggcgacggaggcaagccggcagtgatgatgaagatggccatcaacggtagtatgaccaaccaaccatataggaagaaacacacgtcggcggcggcgaaggcagccgatcggtgaagatgtagacgcccaacaacggtggtgtgaccatccaaccgtataggcgaaaacactagttggcggtgacggaggcaagctggtggtgatgatgaagatgcccatcaacggtagtgtgaccaaccaaccgtataggcggaaacaccagtcggcggcggcgaaggcagccggtcggtgaagatgtagatgcccaacaacggtggtgtgaccatccaaccatataggcgaaaacaccagtcggcggcgacggaggcaagccggcggtgatgatgaagatgcccatcaacggtggtgtggccatctaattgtataggcggaaacaccggtcggcggcggcgaaggcagccggtcggtgaagatgtagacgcccaacaacggtggtgtgaccatccaaccgtataggcggaaacaccattcggtggtaccaaatgcagctggtcggtaaagatgtattcgcccacaacggtggtgtgaccattccaccgtctaggccaaaacactaatccgcggcgaccgaggccaacccgcggttatgttatgactgatccattcctaaagcgtaggggataagcttaaagccatgaatccctattatgcatatgtatatctagatcctgcagaataaacaaacatataggatgggtagtatctgatgtaaatacagtacttgatgaaagttcaagtattttaagatgtttataaatatgtatatctcctcttgtcaattttgatttccctgagaagatgactctttacgtttaaacactctgcccgactagtcatagtccccaagcaccggcagtcggccaatgcacttcccaaacatgcatatgagtgacatgagttcgtcattaatggaactgagtttcatggatcagaatttactacccgggtacttttgcaattgttaagagcagaaaataaattatcttatctctatgcttttgatttcttccaagtaatacttagcaccttgcgttactcggtctatccaacgagtccccgggtgctaggaatcggcccaaaggcaactatccatagacaaaccaaacggaaagcataggaagatagaactccataactcgatagttactttatttttacttggatcatttcgcaagcaatcaagataaatattatgaaaaattgttgaaaaatatgatataacatccgtagccctcgactcactaatcaatggagaaccaattggtgtagtgaggcagcggaaaaaaatatcaaataaagaagaaaaataaatggtgacttagctttttagtgttcccccggtaatagcagatgtagccgatgtgtggagaaagtcgtccatcaatcccaataaaaacaccagtcggcggcgatggcagccgccggaagtgaagacatggtcgccatcaacaacggcagcggattacaccaaccgtggaggcgaagaaaccggtcggcagtgatgacggcggccagcgatgaaggtgtagatgcccaacaacggtggtgtgaccaaccaaccgtgtaggcgaggacactagttgacagtggacgaggcggccggtcagtgaagacgatgatgtccatcagcagcggcgcaatatgccagccgtgaaggcgaagaggcttgtcgacggaagatgaggcagctggcagtgtagaatatgtcattatcagccatggcgataaagacaacatgtttggataaatccaatacacggtatggtaggcggagcctgcagcttgattaatgtcatcggctgtcaccacagcatttgataaacaaaggtgctggtgatctccgttcccgtgcgtgccatcggctggcacggcatggcttgacctcaatccgtccgatatatgcaaacacaaaaaataccaggatggtcaatttattagtaataaaaaagatatatgccttacagtctgattagagaaatcatgcatgttaattgatctctatattgatctcatagaggcttggacgtcagatcagatgcatccatgttgtccctgtaatgcacgaagcgttgttgaaggactcggcatcccaggaggcagctagcttgatctcaattgccgtcgatatatgcgtgtcaaacaaaaatatgacgaagatcaatatgtgtgattaaagatcaatctaacaaatatgtattgaaacaacaaacccggttattctcacgatgtcaaaatccagctgaagcgaaggaccatgccggagatgaacatgatactggtagcactagatattaattccatcacactttgttgatgggaaactgtcacggcagcaacatctgtagcagggagttcaaagcagaagccagtgacccagcctatgaatcggcctagacgggagaagcagcccaactcccatttccctgcaagtgtgtggaccaaatagtaattggctgggccactgtcagtgagtgagagaggctgtgtagtgcgatgctatataagccggcaggattgagaggaaggggatcaaatcatgtaatcgaacaaactcaaattcaattccatctctctcctgttcaattctgttctgttcttctccttcttcttcttcctcaagccatctctctcaatctctttccttctctactcgaccgaatctctcctatgaattcgagaccgtgacaatttggtatccagagcaatttcgatcctggagaagccacgatatacttcccgtttgcaacttcaagtcgaagcgatggaggagcagaacattgatttcggcaaggtgttgatggagatccaggagtccttggtgacgctgaatcgtgctcaaggcgaaactcaagcagcgctcgtcaagctagatcacggagtaagcagttggagacctcaagtagaagcagcagttcaggagctacatgaggaagtcggcgatcttcgtcagcaactggatctcgtcggcaaaatgaagcaggcttctccggtgatgtcttcccctcgagttccgttgatggacgaggaaaggaaggcgccgccgctgcctacgccgccaacttcatctcaagctgccacggcggaaggtggaagcaaagtggccggtggctgactgcatgctcatgaacaccggggaagggtactggggatgaacacaaccctaggcccgactgcggtcaagggtgcgtatgaatctccttccacatctctgaaaaattttgatcaatttgagtttgggggtggggaatatgatggggatcagtttgggcgtcagtataatcacagggttcctaagttagatttccctaagtttgatggaacagacccagaggattggaaaatgagatgtgaacatcattttgatgtgaataatacttttccagggttgtggattagaatagccacaatttatttttcgggtagggcagcttcctggttacgatcttctaaggctcatgttagatttcctgtgtgggagaatttttgtattgctgtgtcacacaaatttgatagggaccaacatgaaactctcattaggcagatggatagtattaagcagacaggaatagtttgggagtattatgagagatttgatgaattaatgaatcaattgctgacatatgatcctcttctgaatatgcgatatctaacacatcgttttactgagggactgtgtcgagaaatcaggaatacagtgctgctgcaacgtcctaaagatttggagaatgctttggcagtagcaatgttgcaggaagaagtgatttccgaggcaacgacagggtcagttccaaatctgaagaaaagtgatggtggaaatttgcagattcggccaaatgttgcattcaagggagcattaccattaccctcgcctccaaatcgtggaagtggctctggtgttttgaatcgatcagaggatcgtaagtttcttcacaataccgagactggtaacagtaatgataaaatttctacactgaaggctcagcgtagagctcaggtgttatgttacatatgtgcagtgaagtggtctccaacacataagtgtgcaaacactatacaactgcatgcagttaaagaattgctcacagttttgcaatctgatttgctctctgatccggatattttgcaaaggaaatgacggtctggacattcctggattgatgtcaatttcagttcaagctatacaaaggctttgaaacagtgggctgtatgagaatgttgggctatgttcagggtaaagaagtgctcatattggttgattcaggtagtgcaactagctttattacctctaagattgctcaaaccttgcaaggcgttgtaactcttgaaccacctgtacaagtgaaagtagcaaatggttccatacttacttgtctttcttcagtactaaggtgtgaatggatgactcaaggatgggtgttttatactgacttaaaggtgttaaatctgggaagctatgacataattttaggcatggattggttgatggctcatagtcctatgcaggttgattgggttaacaagctcttgacagcttcctggagaaaggcatccgatacgttacagggtattttgtcagaaactgaacagtgtttccacttttttttcccaccgtttttggagttgaaggaaagacaggccatttttcacctgaatcagttgggccacatcagattttcagacaaggagcaaattccagtggaaattcaacaagcgctagcagagtttgcacaggtgtttgaaaaaccttttggattaccaccggtcagggtttttgatcatacaattccactca

SEQ ID NO: 72244 - DNA, 10601 bp, Oryza sativa
ccgtgctcccacattgcatctgcttccggcggagtggaggtaggtatgacccatcccatcggagggtcattcggacagcggccattgcaaatctccacccattaatgaaggaatgacagggctatcccctgtgtcaggcgagtgacggcgcaaggcctcactcaaggacaagctgtgatttagcttccaggcgaaggcgcgagccaagttttggtcaagatagggtgggttcccatccaaaagaagagtaggtaaaaatggtgcatgtggtatccccttgagatataaaaggaggaccttgcccaccgaagcaaggggacgagaaaaaaaagggagagactctcagacgactctgagaatacctgagctcgtagaggagagaaagaggaagaggggttctaaagcctgaactctcttgctctccggctctctgtaactctttcacacacagatccaccagaacacaggagtagggtattacgcttctcagcggcccgaacctatctacatcgcccgtgtcttgtgcatttgctctctcgcgaacattccacagatcgagggtgaagaacctcacttagcgcccccggccgaaccggcaaaggggggcctgcgcggtctcccggtgaggagccccacgctccgtcacacctattacagctccaagtccaactgtaaccaaataggactagtgtattcgacacctattctaacagaactagagatggagtatatggatgtacaaatcacgaagcttgacgagcaggatgcaaataatttaaatttcaccccaattttccctcgtggaatatgacattaaggaaatccattcattttattatggaaacctcccgattaatattacaagatgacctccttagagaaacgcacaacatccatcacacacttgatcaatgaacttattacaatactgaaatactgcatggaactaataaatgaagaaataaacatttcctttctgagaactaaacccaaaagctatggaatctcagcaatgatcatctagcactgtggcaagtccgatggtggtggcggtaacgatgtctcctgcgttggaccgttctgaacctcaaacaccatgccaagcccgaactctagatgagcatcgaagtggcagtgcatgaaccaaacccctgcatcaaacacacaaatgtcaaatttgatttcacaatagtcaagtcaacgaaatgatcagaagaaaagaaattctgggttgtagctagttacgggtcatcttccctatgataactaaaaacgtgcaattttagatgtcgacagtctttggaattcaccgttgactattatcaaaaacacaaactctgataaaaatcgtatattgtgacatattttcaagcaaaaattactgcaatcatctgcatatgcgtataatttaaactgtttgaatatttacattgaaagttttaacgagacattaatttggcattaccacgcgtgtgatacacttataattataattaatagtactccctctattccataatataaagttttaaaaactaatatttcactaataattataaccatatgaaagtaaattcaaattttaatctataatattattttcagcaaataaaatttagttcatattatattgattgttgatcgtgctttaaaagttgaatcttgaaccacatgtgtgtcttatatgatgggatggagagagtatatgattttgtgcaaatatatacctgggttgtctgcaacgaagcggatgacggcccagccgccggtggggacggcgacggtgttgcgctcctgcggatcgacgaggttgaacttggccgggtccgtcgtctcgttgtagttgccgaagccctgtgcgaggacgaagaagttgaagccatggaggtgcatcgggtggctctccttggacaccagcctcgtgttctgcagcaccatctgcaccgtcgagttgtacttgagcgtcttcaccttggtcgacttgaacgtgtgcttcagcgtcgcgttatcgtccgatgcgtcagcggtgtagtcgaagacgatcggcggcgtgtcggggaagtcgcgggtgtagacgccgtcgatggagcccttgtacatggcctcgagcatggaggttgtgttcgggaggatgaaggaggcgttgttcatgctcgacgcgaagatggtccctttgtcgtctggcatgcacatcgtctgctccggtccgcagaaggtgtctcccatggagacggtgacgaacatgtgggtgtcgacggcgagcggcacacggttcggcaccagcgccgtcatattggagagaaaccggtgcgcggtggccgtgtcgttgtactccggcatgtccggcaccatgggtggcgaggtcgccgggccgccgccgtactcgacgatggccgtgctgttggtcaggctgtacagaaaacttgggtcggcagcattaacggcgctgttgtacgggatgaccgccatgtagtagcgccctccgacggccgcggcgacgccggcgtccggtaccaggagcgcgtccaccgtctgccccggcgagatgaccaccacgtcggtcttgtacggcttggtgtagcacgcgtcggcggccaccacgttgaagctgtggttggccaccttgaagaagagcggcgtgttgagcgcagcgttgatgatccggagcatgtacgtcttgttctgcttcagctcgaacttgtgcgtttctgccagcaaaaaaaaacacatcaaaattcatccaagacacatctcgattgccatgaatattgcatgtgatcgatcagcaacttacggttgggggcagagcagttgtagaaatcgccgggcttgccgttgatggtgtacgcgtcggcgtggggcgccggattgccagtaacgagggagcgctgctgcaggtcgtacacgttcgtcttccaccactcaccgaggatgaccaccacctcctcatcgggcacggggaacgggtaggccttggcgccgccgcgaggtttgatgatgagcgcgccatagacggtggcgcggaggaaggaaaaatgggagtgccaccacagcgtgccctcctgcccggtgacgttgaaccggtaagtgtagttgcctccgggacggaccggacactgcgtgaccatagccggtccatccgcccatggcgtaccgcgctggaagataccatgcctgcatccaagacacaattgatgataatccttcgttcaccgtggatgaacgtagatattaattttaccgttcttgagaagataaaatattaccagtggatggtcatgttgtagggtgactcgttgaccatatgaacaaccaccgtgtcgccctcagtggcaacgatcgtcgggccggggagctgaccattcactgcagttatgatcatttcctgctggcatagctgactaatggagaggttacctacctgctcagttcaaaaatgtaagattaagacatggtttagttcgatcacctttgacaagtaacccctccttgaacacaaatgaagttctactccctccggtcaaaagaatatatttttttttcttgtgcaattttgcacccattttttttatcgtaacaactaacgagtacataaaatctaatatgttaatgtgaagaatcttgtcacaccagttttgcagtttcaaactaaaattcttaaacatattaataatagtccatatttggaaactgcaggaaatagtattaaaatttatgtatttgattccaggagagttttttttatgccatgtctacgtcttgagccaaaagccctatctcatgaattaaagataacagtgttcatgcatgttgcgatatatatgcgataaaatagaagaaaaaaaactgcatgcataaatggaagtatatgaaaactagatagaatattacattgaaagtgtactccacaacagcagcttgagcaacggaagcaaccaaagcaagcgcaaatggaagaagaagaagcgaccatgatctcgccatattatccttaactatttgtgtaccaaatggatgttcgagatggacaggtgacttcatttgattttggatgaagtaaattatggttcaagatgaactatttatagagatgttggggctgactggttcaatcatcaaggaagacaattaaacagacttgaaatttcatgcttaactacagagaaagaagacgtgcttagattcttttctgctgcttcagaagttttatttctctgcaagtaattatggaggcagttaaaaattcctatatattccttcccaagcttagctttacttgctagctagttacgcacatgcttatgttgcttttctttggaaaaggttgactaatcaatgcttctagtttagtactcatgtatgacgatagcaatatagtagaaaaaaaattgacagtttcatggttagtttggtgtggtgcagattccatatatatggtgctgatgtgatgacataattatagaaaagtatgtgcaaaacttttggccgtcgagcacatctgatatccctgacagttcttggacatctcaaacaacttcgacacaggcgatttttacgcaggagctaacccatacagtttctcatttagatgtatactccctccaaatttataattcttactgtaacacttttaatatggacatggtctccaaaacatatattaacaacgattttttaataatatataataaaagaaaaattttattttattaaagtacactgtctctacttccttcggttccgtaattacagatattttagttaaggatgagaggtgaaacaattagaattttaccaatcaataactttaaaattatttactccaggtatgtatttaacgtgaaaattgtgtggcaccgtgtatggatttacattaaaatatgatatatttttttgggtttttttagcccgaaaaatcaactcatggacgcgcggctggaatcaacgtgtgtgatgatccacatcatagaggctttttatccgtgtaagtgataacccacataacagacgtagatacagagacgttgtctctcgtgtttgtgttacgtgcccgtaatattgggggcatgttgaatgattaaaatgtagttgttgcttagggccggtatcgttatgctttttgtagccttgccaattttcggcaatggtagaattgactattgcagatgtttagattgttactccctccgtttcagtttataagactttctagtattgctcacatttacatatatattaatgaatttagacatatatatgtgtcaagatttattaatatatatatgaatgttggtaatgttagaaattcttataacctaaaacggaggtagtaccatttttttttaagtaagagttgctagctaggctagctagtgtttagtttcctactaaagagtatttcgtcgtggactaactaaaatcaaccaaaccaaaaaataggcagtcaaaaatttggctacaaacaaaataaggcataaaattttcagcaacaccattattttcgtatggttaagtttgtgaggcaaagaaccaaacaactagatcttaatgtgatataatttgggtaaaacaagaaatacgacagggaacatatcctatgcacataacatttccatgcgcgccaactagcaaatgtcatgaaaagttctaacatatactcttaatagtattacacatatatacatatatatatatatatagcaaagtctcatattcaaatttattatattttagcctaaaaattgagaaatttaacaattttaagagtagaaatctatcagaattttatcttccttttgtcacggctaaaatataataaatttgaagatcagatttcacacatgggccggtgtaatactattgaaagtacgtgtctatttttttctaaaattttctgtgacatttgttacttggtgtgcacaggaatattatgtgcataggatatattcacacctatataacgttggatatatagatgaaaacgatacgaaaactttatggagttcggactttttcggaaacggaaattgttgctcggatttttttggagtcttttagaaacggaaatgaatttgaatttttatatcggaaacggaaatgaatgtgataagaacagttttcgtcgaaactcggaattggttgagaactttctatacaatttctcgaaatttctagagttacaaaggcccgtactatagtccataaccataataatagcctagcccaatccaagttagcatcctattgattgtattgattgtgttttctgatataccgttgactactgagactagagatagtaattggacatgataaagttttaacctcagtttgagggggtcttgtattcagataaatttacgtaaccgtatccatgtcagttcttattcgctacattttttttcaacaatattcgattccatttttattctgggtttccgattttgattaaaaaaatagaaacggaaactatagaaatgatttccgatccgttttcatccatagtgggagtgcatccatatattggtagtcattctcacattattgtaaggcaaaatttactacagggcatcgaaaaaacgtgtaattagcttgtggacatcgcaagaatgagaatttgctgttggtcatcacaaaaaaaaacgtgtaattagctcctggacactctgagccttattttattatttaatgtgaatttggagagagaaacacgatgagagtacgattttgcccctgccctcacactggccagagcaccgccgccaccacctccgcatggcggccggagcccacgcaggccaccaacgcacgccatcgcatgcacttctgcaccgccgccgccagccaacgcacgtgcatgccgccaccgccggcggcagccgacgcacgcgcgcgctgctgccttttcccccatctgcgccgccacgccggaagacgaggaagacgacagcgacaaggacaacaggaaggaggaggccgtggggcttgagatgctgcgcatcgaccgcgcgtggaagtccgtgaagccgacaagctctgccagcggcagccgcgggctgatgccggtggagctgctccggcctgtggtcgccgccgtcgcatcgctggctcgctgcgtgcgtgcatgtgctgaggaatcgaatcgaatcgagggaggaagtggctggtgcgtggcggcgatggacggggacgccagggtgaggagtggctatggcgcgagggcgggtcctggtgctactactagtgctacgacgtcgtcgtcgccgtcgtacatgagcattgacggcgacgacaatggtggtgccggcggggcgaaggtgtgggtgctcgtgctgctcttcttgctgatcgtgctcatgttcttgccgtcggtggtgcggcgaggcaggccatggggaggagggggaggagagcaccatcgaggagggggcgggcttagcctcaagagcggccgggatgttgtcaacctctgcctcgtggcgttcgccatcctgtgcgggctgcttggccgcgccagacgacttgctgcctcgccgccgagccggctggaaagaactagctcggcgccatacacgaaagggaattcactgtatgtgcatgtgctctcgccctcccgatcaaaatttcccctcattttttttgtgatctctccatctctatattcaaattgttgtttgatccccatttctctcccttgcaattgcgaagtagctgccattgacacggcgggagaacgggatgctggcgtcgaggctggcgaggagcagctccgcgatgttgttgttggcgtcggtgtcgtcgatcaacacgtccgttagctccacgccaagggggtcggcggcggcgacgagcacacgtatgccggccaaagcgcggagcatcccggcgatggccgcgctccaccgctcggacccatcacaaggacagaacacaagtgctgcacgtgttcagctccgtcgccgcctccggccaacccaatgtgttgtctcactgtccaggtcgagacccaagggcaaacttgtctttatttagtgtttctctctccaaatttacaggaaataataaaataaggtcccgagtgtccaggagctaattacacgtttttttatgcccgacagcaaattctcgattttgcggtgtccacgagctaattacacattttttcgatgccctgtagcaaattttgcgttattgtaaaagaagggccatcatgatgtatgcaaagtggtcacctttgtcacatgctgttcaagtggaactagaagtaaagaaagacaagtattgtataacttattccgggcttctgagaaaaggttgaactacgaatgtcataactttctcatatgaactgcacctacgatcgcaagttatccagatgtgatagattggagcctaatcatgaaaactatcttccggacaatcattgagttcattgagtacgtaaaagtgattactacctccgtcccaaaataattacagttgtaggtatctgtatacaacgtttaaccgtccgtattatttaaaaaaattatgaaaaaattgaaaaaaaaatagtcacacgtaaagtactattcatgttttatcatctaataacaataaaaatattaatcataaaaatttcaaataagataaacggtcaaacattagacatgaacagtgtaaaactgtacttattttaggacggagcgagtacttatgtggtcttcaaagaataacatctagatctcctaaaacatgtggtgccaaacatcgaactcttaaaccattaattaattattaaaaattaggacttccatatgtgaaaataatattagtgaaaacgcaatttttttttctttggaacccaacatttgaatgtgtgaaagagagaaagcacatcttccttgggcagtcagccatcaaccttttcttcggtgtgctcagctgtcattatgtttatcggatgttacaactgcaaagtcatgcatacttagcaaaggtcattttattctatagtagcatatatcattctcaatttgaagaaaacataaaagtaaagttcatgtctaaatcaagattaacgtgtgagttaagtccttagaatttaatcacacgcttagctgaaattttaccggaagcatattaacatatatatgcgcacctccaattaccaaataatgttgtatatgtgtgagtactgtttgacctatgtatacttttcaagagtttgacagagaaaaaaaattaatggatcgatttgggcaaatatcctacagctattttccttagagagtctgcaatacagctcatatggctgtcatcacgtctctggtaaacctaatccttatcctttacggaactgtccacacccttctctttcatccttgtattggataatgggatagcatatcgtcacaccttgccaacaaaccgccctttcactaccaaagctacctatgatctaagcttttccaagttatcggatgatctatttgttggacccactttgggcaaccatgctcaaaccaaatgcaagatcttcctttggacaacgcacaagtgacgtgcaaaatcaaaggtgtttttgattattattctgtgatgaacaattggcataggagattatttgtttttttatttagaatttatttacgaagtggttttggagatgattggattttacaggtgaatctacaggatactgctgttattttttgtagacctgtcagaccgggcatgtgctgctggtcagaccggcgtgtattgcgcggtcagagccttgttttcttctttggatttttatcgatctagagtttttgccatggctactcctgttaggttttcaactaagcctcatgttttcgatggaacggatttttcttattggtgtagtaggatgcaatcttacattatggctgaagattatgatatttggagaaaagtttctcattcttatgtgatttctgaagtaattaatactgctgctgcaaaaactgagtttgaacaaaattgcaaagctcgcaatattcttttgagtgggattaatcgttcggattatgattgtgttgcgcattttcaaaccactcatgagatttggattgctttgagtaactttcatcaaggaataaataacattaaagaacttcgtcgtgatattttcaaaaatgagtacattaaatttgagatgaaacctggagaagctttgtatgactatctttttaggtttaataaaattttgagtgatcttagatctgttgattcttcttatgatgctaattatctataatatgagatttctcgtcactttttgaatagtcttgacatgtctatttgggagatgaaagttacatctattcaggagtttgttaacatgtctactttgactttggattcgctttacacaaaattgaaaacacatgagatgaacattctttctcgtaaagttgattctaagtcgagtgctttggtttcttcttcttcttctttggatgttgatgcttctacatctaagccttcttttcttgctatttttaatgccacatccgatgatcaactcgaacagatcgaggaggaggatttgatttggctttggttgctaacagaattgctcgagctatgaataa

SEQ ID NO: 72245 - DNA, 5260 bp, Oryza sativa
  unsure (1)..(5260): unsure at all n locations
cagatatgaataagtgcgctcattatgcaaagttataacagaactctcaactctgaatattaaccaagctaaggcaggtaaaataatcacaacaaaggccttcaaaattttactcatgtaatcatatggagttctccaaaaaaataaaaagatcaacacatggtggttcccatcttggatcctgtgatctggtgagttgatcaatgaaaggattaattccaagcctgcaattgcatctgctcactctgaaccattggcatatatacacaaactggggcacacctagctagatatatgtagtaagtacatatatacacacggcctatgtgtgtgtgcatgatgcagaggcggcattatttgctggatagccttgtgtgcatctcgatcgatcatgtagcaagtgtgacaatgcacacactgcatatatatgcatatacatatatgcagcagcagcagcagcagttatactatatactagtatagtagttagctgtaggcttgatgaagtgaagaaggccatagcagaaagatgcaggaacacatactatgtgtaattacattgcatgcagtagatgctgcacaagagagggggtcagagctacatgtttgtgtaaggtgttaatgtccttaattggtatttctctttcgtacgtacgcatgcatacgtggctgcctgcctgcctgcacaactgcatatgcatgcatacttggcagttggcaacttggcatgcagagaacagttgaaattctggaggctgagaggaagctaattagctaaatcaagctaataactaagggttcatttcgaaaacataagaatagagggcacaggatcagtggcggagtgtcaagtccggatgactaatagtgttttctagtgatcgattaatttttataggtgtcgatggccatcgatagtagagacagcaacagcgaatcctgggcagttacccgacctgcccgagaggtggctctgccactacatagaattacaatgtcttatattaagaattcctatgggaattagaaatgtaggaatactctaatatagtcatttagacgatatgcagaaaaaacagagaaattatagacacaataagagagaactgtgatgtacaacctcatgttttgttttcttccaaaatttctatgaactagctcattccatgggttttccagaggaattttcggacatatatatcctttgttttgaatgagttcatcataggaagtttatcctaagaatttaaatcctctaaaaatccttcacattttccctttgttccaaagaaagcccaagtgttttttttccccttttcagggtaggttgggtgggcaattttaaatatttttacctttttcggttttatgtacacgagattcagaggtcatctctataaatgaatgctgatggatgatcatgttaactataggaatggattaaatattatatgaaaatttgaaaaacacccacaatagccgagttaatttgcatgtataggttgtgtttagttccctcaaacttccgaaaaccaattgcacagtttgcatgtaaatcgcgagactaatcttttgagcctaattacgccatgatttgacaatattgtgctacagtaaatatttgctaatggtggattaattaagcttaatagatttatctcacagtttaccaacggaatatgtaatttattttgttattagtctacgtttaatattttaaatgtgtgtccgtatacgtaaaaaaaattaaaaaggaactaaacacagccatagtattttagtttacccatatttatatctcacctccatcttcacgaattaataggaataatctcaaaggtgcatatgtcaatcagctagctcatgtgggatgcatgcatgtgtacaattgagcaaaccctactccagggacatctggtctaccgagaccaccacctaccaccgatgtcattacggatctgggattgggcttctcagccgtaaggncncagcgacacactctacactctgcggccaagtgcagagaacgagctcacgagatagaaatcaaaccacaaaaacatccatccatgttagtatcatctgctacactcctcattgccttcattatctttctctcttcatctcttgatcagctcttgacgatggtttagacgacaggccgtacggtgcacggctggtcatggccatcactcatcagtcatcaccaacggcgccacacattccgtcttgtactacaagattaattaattgaaaataaaattgtactacacgagatggccccggtgggcccacctggcagccgctcacagagttacggccgcagaggatcccgagccccccccctaaaattaaccaaccaaaccaaatcgcgtttaatttttcgcgcgcctcctctaaacccgcctagcttaaaccccctcgtccaccgatacactgacatgtgggcccacacccactgacatgtgatcgcccaagccgacccgggcccacatgtcatcgactcatcaagcagccagccaaccgtggtagagagattttttgaaaaaaactggaagccacgggcccctacgcctacacgtacccccctacccaccgggtccactcactgacgaggtgggccccactttgtcagccttcctcctcctcctcctctttctctctcctgccaccaccaccatggcaccagctcagctcagctcagacacccacacagtgagcccctctctctctcttctctctcctctttctctctcttggttgctgctgcgtgctgcggtgcagtgcagtgcagcggctgcctcccgaaagcaacaacagtcacgtcgctatcggcaccacccccacaaaacaccattgctcccccccatcgatcgatcagagctcagagaaagagagagagagccatggtggtcgtggtggtggtggtaactcggccagggtcgatgcactagtgacacaacgagtgcgagtgccctgaaaggggggaggaggagcggcttgagagggaataagctaggtggtggtggttcttggatcaatggcggcggcgagggcgccgtggctgtggtggtgggtggtggtggttgttggtgtggcggtggcggaggcggcctccggaggaggaggagggggagatggggaggggaaggcgctgatgggcgtgaaggccggtttcgggaacgcggccaacgcgctcgtcgactgggacggcggcgccgaccactgcgcgtggcgcggcgtcacctgcgacaacgcctccttcgccgtcctcgccctgtacgtcctcctccctgcgaagctcggtgttctttcctgggcagacatggcgcgcggcggcgcgggtggttgcgttcttgttcttgcaatcttctcttgtggtggctgttggttttttcttttcttttctttttccagcgtgcactctgtgcttcatgtgatttttctctcttgccgtgctcgctctggcattctgatcaggaggagcaaatagttcaactgttctgttctattcttgcctcccttttttttctgaataaaaaccttttcttggttggtctatttgtgcctagattgctgtgaatgtttcttcttgataatcttgttgttatcgtatatatctaatggaaaagaaacgggtttttcttgttatcttgcgtaggtctttggatattagtgaggctatcttgtttgttatgctaaaaaggatttttgtgatgagagtgtttccctgtgtgaaaaacaggaacttgtcaaatctaaacctaggaggtgagatctcgccggccatcggagagctcaagaatctacagttcgtgtgagtacggatatgagtagagagtactatttccccttgctttgcatctacctgagtttttgtgcatttgactagcctgtattttctttttataatcctgcacacttcacctgatttgacccctcatgccatgatgtgacacagttctttactattttactttaagcctgtggatttgctcgctgattagtttatttgtgctctaatgatttgcctctctgcagtgatctcaaggggaacaagctcactggccaaatcccagatgagattggggactgcatctccttaaaatatttgtacttcacctaatctaagtcttcttttattctgttactttttgtaacagggtgttctagctaattttttaattgggctcttttgattcttgccatgcagggatttgtctggcaacttgctgtatggagacatccccttctccatctccaagctcaagcagcttgaggagctgtaagctctactttttttaaatcttttcctaccttttctttagcaagagctatggcctatagctgttgagatatgggcacttcctctcccttctttggaaagttcaggctaatactgagacatcagagactaattgatttacattaagttttggaacatcttgttctagaatccagattatgatactgaacatcttgttggagtagtagtagtttttttcatggttttgcgatgcttgggttgtagtggtaacattttttctctctcatttattgatgcaggattttgaagaacaaccagctcacgggacccatcccttccacattgtcccaaattccaaatctcaagacattgtgagcctcttagtaccttactctatccgtgactatttacttctttggggttcttggacaaactgggtgatctgacttctacttgtttaactgtttttgtgttataatgtgcgtgccacgggaaacatggcttgctgtgtcattttttgcatcttaagtactactagttcttacttactgataaaatccttccttaattatcttggaatagggacctggcacagaaccagcttacaggcgatatcccaaggctcatatactggaatgaagttctgcaatacctgtaagaatcctataaaagaaaattgtctaactgttttagctggtagtataagaaggtatttttcaggcattaacactttgcttctcttaatcttcagaggtttgaggggtaactcactgactggaactttgtcacctgacatgtgccaactgactggcctgtggtacttgtaagtcatctcctctccctttggagatgttgctgcatattgtgcaacttggccttgttgacagtggttactgttcttaatctacagtgatgtaaggggaaacaatctcacagggaccattccagagagcatagggaactgcaccagctttgagattctgtatgttcttg

SEQ ID NO: 72246 - DNA, 19422 bp, Oryza sativa
  unsure (1)..(19422): unsure at all n locations
ttgctatctacccattcggctacacaattgcttttatttcccctgttcaatgatttagagttatccactatagaagcatcaaccttattaatattttccaattttagttttgtgcctctagctctagattgatcacaagcaaaccatgtagacataaactttggcaatgatgatatagaaaatttaaatactttattattgtcaacaagaacattaatctccccaatcgatcctttagaattattcatgatgaccgtactgatgtataaattatttttagatgaatgatcaaactgggaaataagtacattacctgtgaatgctaccttatctgacgtgttggagaagcatggagatttatttacttgaatgatatcttggttcgtccccttatgaccctccaacatctcctccgtgttctcaaggtttcgtgccctatcgtcttgctgctcatcaacttccttggcacaaaattcatctggcaaaataaaaactcctatgtctccagagaaatcaagcatagctacctcgtcttcattagccgataattctggatttatcggcttttgttcttgtgaaaaaattggttttgaccctttacttaaaatataagaattgattttttcctccacatctgtcacagcttgatttttcgtttcaggatttataaattatttaataaattatattaaatgttcattaatttacaagtgaagttaaatgtgggaaataaaatatcctaaatataaagcatggttggatttaatttttattaaattctccatgattaattatactctctgaaattttctcggatttttcagagctcaattcttaattttaataatacaaagaatatttcagtaattattcacatattaaattaatcattaaatgagctggtttcaattttgttaaatacttagagtgtccaagtatgttaaatatttttcttggaattatttgagcattagaagtatttttaacaattgaaagatcattttggtgattaatttaattagaaagtaattaaaatcaacttttccttttcgggccgaattaggaaaagtcctcactctcggcccaatctcctctcggcctgcagccctctccctctctttcccgaagtccagtttctatccctccttcaatcgggctgtgtaatagaagcccagccaaaagtctgttttgcctccctatcgctacagtaccttcttctactcctggacagagccgagccagccgtgccatgtcctactgccgccgatccccttccaaaatccggcctcctcgttgctcctttttccaaattagttacgggaatagaatcatctcaatctcctctacaatttccctaggaaatccccaaaagtttctatggaaatcttttccaatttcgcggttcaatcttttctttctccggcgaagatccaaaactttcccgagtttttcccgtcgatgtgggcttgatcccgagctcccatgcctatataaaggaccccctagtcgtcctctacctatctcctcaagtcccgtcttccgtcatcgccggaatcgctctccccgcgagctccttctctctccacctctggccgccactccagccgccgtgcgccgtcgcttcggtagtcgccgtcggtcgccgtccccttcatcagcatcacgaggtcgtcgccgtccccgtccaccgcttcgccgccgccgtagcacgccggagcgccgccgacaccgtcgacctgaagctctccaccgtcgccgtcggtccagccgcgccgtgtcgtcgttgcagccgccgctttcggtcgtcgttgccaccgtcgggttcgcaagaaggagctgcaccccatctgccccttcgtcgccaccaaaatccaccggtgctccatcgtcgccgtcaacccgaagctcgccgtcgcgttttgatctccggtgaagccctgctgctcctcccatcatcgccaagcttcgccgctgcctccattggattcgcagctgcgaagtgaagcccggccacccctccgttgtcgccgcacatcgccggaaagtcgtcgccgccgtggacagtacctcgccgcccttcgaagctcgtcgccggccatcttccgtcgccgttcatcgctgcgtaagtgctggtgagcatcgtcgttgcctcctcttcctcccggtgccctccgtttgcattattgtgccgtggttcgccggcaaccaccgctcctatgctgttcacctgtcaggttttccttaatccaatctaatctaatccgtggttcgtctagcgttgtcgtctccgtgtgttgctgaacattgtcatcatccctccctctccgaacgtttttgatcggtgagacatctgtctgtgtctccaagttgccctagtgccaccgtgtcgcagctgtgtgccgctttaacctacccgccgctttagccgttgctcggtagccaagttgtctagccgtaggtgcatcccttaattcctaccggcctatcgtttgccgtaccggaactttcctgtgaatcatttctaccccaccggtttagccgcagccgttgttgagtcgttcactcattcgttcgaacgaggtgttccccgtgcttcgttcgttcatctgtgtggagtcgtcctttagtttagagctgttcagagccgccggttccgttcaccggtttcggttgatcatttgggtgatcccgtgtcacgtagaattgactcgttgcgtcgatatctcgtgaggcccgcttgctagatcaatccaagccatccaatcttggtcgactcggtcaagattaatctcagccgtccaaaattgatataaatccgttctctcttttcagtgacattatttctttttaatatatgtcatctaccaaatatgatctaatcttttccggaggttgttttaatcttttgtctcagttataaatcatttgtaaatgatttaattaatttggaataatcttttctttaataggctttaattctaattaatcttgtaaaattcataattaattcatatgaaatcgaatgaggccgttcaagtctcataattcatctaaaattatgatctacatgtttgtttaatttatatgtattgtttatttggtttttattagtctttttcctcgttttgcgttttagcttgtcgtttccatcgtttcgaaggtttgcgagtgcgccgtaagtattcaagaagattaattggagcccattattgcaaggcaagtcacacagatcccaaacacaattcctttgagcatgttgatcctatatttaaattctctatttatttcaactgtgcatttattttggaatgtcaccgggtggtgtgaacctattcttttgttatgaccactttgcattgcttactctattctttgatacattgggtgataatttgactagttggacttatatattggttcagctagatattagatatattgcttagccatgcttagaaacattagcacacgattgggataactaatgtttcactactacttaatgatggacatgataatggtagctcatgatggctaatcgtgattggttaattaattaatgtgcctactaaaacttgataatggtgggttgtgagcacatggttttgatggtcgtgctcatgacaattaaggaccggttcacgagtttcggttgtgaaacattaatcgtgccaaccacaagccatcatgggcaacagctttaccttttgtatagcatggttcattgcgggacaccagactgagaagtggcggagataagcccacgggggtcgctggggagtccatgccttatttgtaagggggtgattatgatccaggaatggtgcactgctttgagttgtgttgtgcgaggggtactgtcacagctcctttccgaggtaccgtgatggtattgaggcgcatggtgacatgttctagggctgtgtcttgtgggtacagtggtacatctctggccagagtaaaactattcgaatagccgtgcccgcggttatgggtgggtcgaacaatgtctttcatgattagtcccacactactcattaacaataatgtggtaattgatggtaattaatttacaattctcgaatgtttgctaaatgctacttttgcaaatgagctctatattatgccattctttggtatccttgtgcacttgcatatttgctgtgtggcttgcggagtattccatgtactcaccttgcaataatcaatcaaaccttagtggaagaaaaatgatccagaaggagaagacgtttggcttatacccctgttgagctgcctgtgggagtggagccggagcttcgctagaccgttattccactgctgtttttcttttcttttgtaagtatgtaacgttattattatgatggatttgtatattaaattgtcagtttgtgtacctcggctgattcctggacgaggattttatgcacaaattatttcggaaattaccttgtcttcattagccgataattctggatttatcggcttttgttcttgtgaaaaaattggttttgaccctttacttaaaatataagaattgaatttttcctccacatctctacagattttttctgtaagactatctatctttacattgaattcctctacaaattgccccccaatgctcttagtatctgaattctgctcggccatgatcccagtatatgcacaatcaatttgctgtggactaaaagcattgaagtgtgatgtatcataagaatatgatatagagggctcttcatacgacatatgcaatggggggacatcaacacgttctttcggcaatgaactatgagaattgccgaaagtctggagagattcacgtgatgcactatatgccacaaaatcagacagaggcgtatgtatactcgttgaattttcattaattcggccataatcataaatagcacatgaggccgaattataagcgttggacattatacaagatgaaccatgagcacgagaagaaatctccgattgagaaatatttggtatggcatgtaatggattaatagaatcaactggataactaatattaccatgtccatacatttctttcatcggcaaaatttgttgtgtagtaataggttgcaaaataatcaccggtgaatcaaaaggtgcacgtacattgctagcattattaaaatttatagtatatgaattactttgcatagactgtgacatgctgtgttcataatttaaagagctcaaataattattttaactatcattagccgatgcagtatatattcattaaaagtagatctagcaacatttatatgagaatttataggacttgcaaaattatttgaaggaatagacaaagtatttacctcgcagttgacgtagtgaggtagcggtgtagcactccagtacccatccatgtattttcagcaagccttggccttttcctggtgcaattgatacgtacacctagcaaaatccaaaagagattaatttgcacttacagatcaagtgttactcctatatgcctgggtttggttgctgtgtagccgtgaaagctctcctgaatttcctgatcaagcactgtttaatatttgttagccctgcatgctacctccccaccgaattaaacaattcggcagaacagaccgccggcgacggccaaaatcgatctacagagaagattaaaaaaattaaatagagaaactatgccgcggtagatcggctgatttcggccaaaaagtttacggccaaaacttgtccccagcggagtcgccaaaatatattgacgcttttttagtcaacacaagatcacctaatgatttgaggtgcaatcaatagagtcgccaaaatcgatagatcaaaaccggctagcagagccgatttcaagattaattcactttcacggaatcaagtgactaatttataagcaaattagcaaggaagataaatatcgtacttacgtgacgacgaacgactagtttccgagcaaactagtaaaggataaccttctcgctttcgtggagaagcacgaccgtttttcagcgcaaaacggtaaagattaacaaaatagaaaagatcagaaagtaaagaataggaaacggtagattgataaatagtagattgaaattgttcggacctctcgccaacgtcggagctgtaaatttatactggcaccacacccggcaccataggtctcccttcatgttcggtggatccatccttccttcctatccgagtcgataccgtaggcatgtaatcaggctaatgatgatcttctataatcttcaccacgtaccagtccacccgattcacctctgtggctatccaaaactcctaatcatccggctgcacctgcatggtctgtatacatatatgcatatctccaaaataggtaaaattctacagccacccaacaaactgcacacacatttgaccaactctcaagcaagccattcaatgaatcgtgaagctaaactacacaatctggcatgcctaaatgaactaattactagccaaattatggcataaacagatgttcgtccccgatccagcatattacagcctatcagagttacaacgacctttgtccagacaccgcgggtagtgtggagattatgggtaccccatacccacacggcgtggttatccgactagttataggagataacttatatctatggaatatgtaacagatcatgacttgggtattacgtttcctttatattacgaaacggcctaaagtcctagtttgataatattgtaaagtagatttaggaaaccgataccgtattggttaaggtttctatcttataatcctgccccccatcctatataaggtgggcaggaggccctctagggggcatgagacaacctgatcgtcagatctatactatacccggcggattcaaatccccaaacaggagtagggtattacctctcattgagagggcctgaacctgtctaaatcatttgtctctgcatctatctacttttaggtctcatgtgctacccccttttattattgccgaatttatgtttcgacaggtagccgctccttctcgcctatgctaggtcgctatgcgggtacaataggtgtgcatctctatttaggaaagagcctaggataaagtccaactcttgctccattgctctatagctagttgaacacaagtcctaaattgtaatcgataacatacacatatttaacaaaaactgtaacaaaccccaccttaacgaatatgacacaccaacctaaatttatcccgtacactcgatcttcggtgtacaatcggacttgagttggtccttttgctgctcacgttaagccgtcccaacaagcgttcaataggctcatcgtaacaagagactccgcctatcaatatatgcaaccttttcctcttgactccacctttaatagtatctcaacttcccacctatcaccacagtcatcttgtcaatagaaatttaattaatcctttcaaggtgtcacattataaacttcctgaagactattttcaccttcatctttcggactattttcacctccatctttcgtcttaaatttttcttaatctaatccatagctagataacatatgtcatcaataaatagataaatcaaactcatcagacattaattaagagaaacctttcttccttctgtcctatgaactgagctaataaatccaatattcccgcttctcgcatctgtagagtaaacccatgatactgcaagaaaattcactgttgccttgaataactcgaagaaattatcaccataatgtttgctctttctttttagtaacgtagattttatatatctctcttatgcaaatcccacagattctgaatattttcgatattatcaaacaaacccgttgaatccatcaacgtatttaacccgctgttgtcctcaccgcacacaatttaactgactttggcaccagctaaattgaacaagacctgctcatgtgaatagacggtcatcgtcagtaaccagccaaccacataaacagtacgaggccccctaaacagtaaccagttatcaacagtagttggcccacaataaaccagcccaaaagaaatcggaaatgctttccatcgagcgtccaatcagacgctactttggacgcctcctctttcttcccgatttgatttacctttcccatagtgcaatggactttaaaaatgttgcacatatatagtattagttagatatttcaatgagtaattatttttatgtttcattagttcctttgtaagagttgcgtgccatactttttaatgatccagtaaagatttcgctttcaatagttatagatagatgattcatgtataaattgaaaatgtttcagttagaaatatatttttttcattctaaatatagccacgtgtgatcttattttgaagatttatttgcaacaaatataattaataatacaatcaaatcgtggatctgatcaatagtttttctgttaaatgcattgagcaggtaagtagtagcatatctctaatttttgtcaaattgtaatagcataaccctacacagacgaatagtaatggtattttttaattcgaagaagttgtaatagcatgatccaattaaccgtagtttgtacaaatgtggcttatatattacaaaatgtagaatatgtgcacttgacggtcaagacatttaaaattatttttcaacatccaaaaattaagaaacatatagcacagacctatctatctgtaacggctcagcaggcattacaaacaattggttacacatgtgtccaatcatctgtaacggccggagacccttaaggataaaactcatctataacagcttaaaattagcagccgttacacatagaggggacagttctagggtcttcctcttggttaaagataaaactcactagcaatagaagcacactacgctgcgccgcctgaatcaatcgcctgaatcaattgaagtccaatatgttcgaggaataatatgcatatactattcacccatagcattggtttatttttcgtctatatcccataaactacccttataaaaaaattgcacatacaaaaatatagtgtataggctaaaggagaaaaccaaaaggtattggaagtttgaataaatagaaaaaaggggcaaattacatgtcaattacaatgagtttacataggtttcaatgctaccccttttctctctatacgctagaatcacattggactattggatgctaaaaacagaagacctaaatgcctactgttggtccatattaaacatatgcaaagctaaaatgaacagatagaaaatgatgttttttaagtgcaacatgcaagtgccctagtcaacaacaatcctccgttatgtgcggttagtgacatcggtacacctaaaaaaaagtatactacctccgtcccaaaatatatcgcaattttgagctgtgtacctaaacatacctttcaagatatagggccagaagtttttatattttgggacaaaggtagtagaaagttttaatagtaatgttagtacagctaaaacagtatagtatcaaccacttatatagagagataatattttcgcttggcatcacaattctaaacacatgcaaccaatttttctaccaaaagttctatcttttttggagtggagtagtacaaagtgctgctaccatgtggccacgtggcaaagtttatgagcgaaagcatgcataatcacttaaccaaagtatggatgcaataacataagccttatagttctacaatgcatatatacttcttcaggttaggttccatttttttcttccctgttccttttaagtagccggcaaaatatacaacgcggaaacaaagagcttgtaaaagcacagtggcagcaggctacactacagtttgacgaaacagatcgactgcacaacttttaggatttaaaagtgtgctttcacaaataatgaaaaaaacatgtgtaaaatagactggtgaactaaacagtgaaataatctatctgagcacagacatgtaaaagcaaaccaactgaaagacaaaatataaaaaaaaatggactatgatattgctttacctttgcatcgtaacggttaggatatgtctagcaaagcattccgattgaacagttgatgcacaaactaaattgaaatgtaccttcaaaagaaatttacgttcgtctcagatatgaacaggaaatcagctttccgtgatggatccaatccatccatgtctttttcgacctaataaaaaaagaatatagagatatgtgatgaagcatgaataaatgaaggtcattctcgagactgctaatgttttcatgactcaaaaatggagccatccttcttttaaagaaaatgattgaagacatatcctaacagtgtatatagtcataatcaactgataacattcttttggcgcccttcatgttttgtagagatggcatgaaagatacacatcaatgctagtttaaaattccatctcaagtgaatctcagtggaaacaatataccttgatgaggtaactaaagtagaaactaaatattttaaatgggtgtaactcaatcatcaatgacataatggagctactgaaatggtgagaatcatttcctccattagctacttaaaagaggctaacagagcatgaatactcaattcacatcatatcacactggaagaggcactggcaacacatggatgaacaaattcttcgtactcagcaacaccaacagaaaaaatctcttcatgcaagcaggagaaagctttaaaaacgaattggtgagatcaaatagtagagacacaaaggctatcaaagtacaatgtatatatggaagaaatttcatcagagcatatgagagcagtataataacgccggttgttatgttaccaatgtaactcagaagttgtactggatggtctttacaaaaattaagctcaattatgtagttatgttgttatacaacaatttgtgtattattcagcaaatgaaatgcaagatacatgacgacgatatacataattaaccttaatcatagaatcattatcataagattaaagatcaagcaaaatagcaatatagtctatatggctctggggaacttgaacggagctggcagtatttttcccttacatatgcaagcagtgtaagtaacattttacacttgatggtgtaaatatccatgtctaaatatttttttgtataaaaagaattagtaagaatagctaatcaggttgtactggtcgaaaaagaattaaaacaatagcaggagcatctgtaatatagaaacctataaagggtgaaggagatgtaacaatgtacaataccttcaatagctttgataataataacagctttgataataataactccatgcaactcccactaaaagtatgatctaacattgttaatgttatgataggatactctgcatagagatgaagagatcaattaaagaacacatctcaacaacatatggatttagaatataacatgtgaatataaataactctgatatggtgacatacatctagttcttatgtagcaaaaaatagggaagcaacctagataagttaaaaatgcgaggcgactgatagagaggattttaacattgaactcataaatcccttccctaagaaatgtgctatcacttgccatatactttttgcttgtctgatgcactctacagatatttttatgatcatatatagacataaaaggctaatgaattagcttcagtcacttactgattgtactttgagataccggtcgatcaatgcagtaaacatttacccaatcaagttaattaacatgtaaagcaaggcagaatgggtatctacatccaagtggtgtatgtgtatttgcaggaaaaggtattaattagcaaacagacatacatatgtgatcctttcgtttatgcttccaaaaataaatgcaggctgcacataaaaaaaaaagttttgaatcaacggaatatggccttctaacagcgaaatctgtggttccaaaaatagatgcaggcctgcacataaaaatgagttttgaatcaacgaaatatggccttctaacagtgaaatttgagaagcataatgcaggtaaagcatttgtaacctcatatcttcagacttgattgaccatgcaccacagaaaaatcaagtagagatttccaccagtcatataagcctgatatgaagaaagcatgagatgcaggactgtaaagagaactgagaaatcaatttgaggagtagtatcagcaggaggagatttggctgctgccacccatgtcgagtttcacctgttggttgccgcgtgcttgtaggcgctcgatgcggaacagatcttgcagaaccaagttctcgtgggatggagaaagagacgaaatggcggcgacagtggacatcgaactcgcaagaagggggcagcagccgccgctagctcgctgggaagacgacgacagtaaccactggctccgcaccgcggcagcaacggctggctcagcgagcttgagaggaaggcagcggctccggcttcgcgagctcgaggggaaggcggcggctggccataggctccatgagaccatgagcagacggcggaggatttctgggaggggaaaacgtgagacaaaggaaaaaggaaagcacgaatgaccagacaaccatcgtcgccgagccgcggttgtcttcgtcatggtcgtgctcgagcctacacagggtggtggcggcggcctgctgaccccgtccgggcggcaacggcggctctcattcctctttaggacgccggatccgccggtaccggcggttctcgttcctttctctggagcgccggatccgccggcgaggagaacggggtcaccggatccagcggccccggcctcctcactgggagatccggcggctcattggtagggagcggcaatggtggcacggcgagtaggttgagggagtggaggaggagtgaggcggcaatggcggcaccgcgagtaggttgagggagtggaggaggagggagttgcggcggcgacgacgcacgcgagggaaggaggacggagaggctgcggcacgattgaaggtggtgggcaaggcggcgcgcgtgggaagaagaggacgggcggctagggtttgtacgggctggcgaatccagaccatccgtttccaatccaacgatctgacgatggtggaagggtagtcaggctgggacacgtggacggccagatcgaccttagcatgtgatccgacgggccacattaacggggatgtacatgctattagcgaaaagaacaagggattttctgaaaaaaaaacgatgacgtggcgccctaatcctcagccattcccacgattttaagtaaacaaatatatgtcacggttgctactctgtggcacattttcttttttaaaaaaagatccaattaaccagataattcaaagcatcattagaaacatttagaacacataactcatcaaaaaacttgttgaacctgaacaagaattcatcacagagaatcaacactacaatatgaacatgagaatcaccttgccccccagaatcctcacagagaattgacattcagcccgactaccatctcctctctgcgacgctgccacaccaccgtgagccgtgtcatcccttcatcatccaaaccaccactaggcgccacgagcttgaggaaggtggctcaccttagttggatcctagtgaccgtgtagtcaacgtcatcgcagccctcacgctagccatcaccatgccgacgcccacgcccttcgtcagccgaggctcgccactgccgcccattgtcgcatgatatggcggttccaaggccagctcaccgccgtcgccgagtttagccgttgatatatatgccatcccggctatggggagagggagctcccaaggcagtggcgtcggtggatccgctcacctctgctgcacccacggccactgttgtcgctctgggccccaccgccacctgcgccaatcgccgtaaacaggaaaagagggagggaggagggggcaaccaacgtgaggaccgttaacagagataaggagagagttgcaagctggtgacggatatggggaaggaggggaggggaaatgagaattcagggggagtgggcgggtagaagaagtttgagtaagttggagttgattataactagaaatcatatgcaacgacttccaatgttgagcaattatataggagggatacagatgtaacggctcctaaaatagagtcattacagataaggtgcacacatctgtaacggcacacatgagatggctgacatctgtaacagcttatcaagatgagtgctaatccctaatggcccgaatgtcgcccgttacaaatatgtggtatgtaatggcacacttagacccattacagatgactcgttacaatattatactccatctgtttcaggttataagatgttttgactttgtttaaagttaaactatttaaagtttgactaagtttatagtcaaatatagtaatatttataatactaaattagtttaatcaaatcaataattaagtatatttttataataaatttatcttggattaaaaatgttactatttttttctacaaacttagtaaaacttaaagcagtttgactttgaccaaagtgaaaacgtcttataacctgaaacggagggagtatatatacaattgatggataccgattggagaggccattaaattttccattctcacacgatacatttataattttattgtaaaggtaaatgacatgaagaaggtacataacaataacacaagtactacctttgaccaaattattttatttatgatcctagacacatatagaggtagctggcgtgtctaattaatcaggtggcggtataattggcgttgagcttgagtatttgttgttggaaggcgtcgacgtggtcgggcgtaacacagccagacatcaccctagccccttcctttgtgggcatgagcatgaagcagatgggtgtagttttctccagtagagagaagagcatcctctgcgggtaagtcatcaccctcgccgtcttcccgctgccgaaatccacctcctccaacccgatgtttcgccatgatgtcaagtaaagcaagctctcgtatccatccacctgctgcccatcgctgagctcccgtaccatcctgtcgctgccttctccgaactgctccggtatgcgctccttggctcgccgtatgatctccacaacgtccatgatgtcgccgttcgccaccgcgccgctcttcgccatggccatgtgcatcatgctgcagttcccgtagtagccgtcgttgacgcctgctaggtactttcgtgcgttcactacgaagactagtatggcgggagcctctggactcgccatcaccgctcgtgtacggcacttccaaagcacggcggcgactgcctcgaacgccgtgatggtgggggtggagtgctgcccaccatcgtcgttggttcgtcgtcctcggaatcgtcggatgtggttgatcaagcttgtcgggacggtgacgttgttgaaggtgaggtctaatggcttggaggccgggtaaaacctggaaaagggccttggggaagggaggtccaacttgggttgcgacaatgtcgtcttgcctgaccgggacgatggacggcgagggcagcccacgggcaagctcgccgacggcttgtatgaactgtgctatgccgacaccgtcagccaggccatggctccatgtcaccccgacgacgaagcctccacaggatagcgtggtcacctgcacccacagcagaggaggagggccgtcgtcgccgacgtcgggcgtgcagttgaaggcgagctgctgcaccaccgccgtctcgtcgtcggtaggttggttgtcggcgacacgcatgagctcctccatggtgcagtcggcggacgcggccacgaacatgactccgagctcgctggtgcagtcgatgtagaaatcgccgccaccgtcttcgtcatcgttgcaggaaagacggccggcgataggatagtagtggacgagtgcttgagcgagagccatcttgatggtgtccgccgtgggctgatggtgatggatgatgggatgctcgaacgcaagcagcactgtcattggcaccatggcaagaggcatctccagtggagagagaacgatcttgctgctggaagtcttcaccggcggctccgatggtcggacgactaccggcgccgacttgctcaccacagtgctcatacttctctatatctagctctaacaataagtcagcatctcgtaagcaaaaatataaacaaaagcatcaacttgttacgtttattgtggtgcaaccaatctactagagtttaagttctagacttaatataagtgttcgtatttatgactaattttttcagtggtaggcggcgtatccgtccataagaattaacgagacgtcttagttactttgtcaatctttatatatgtcggtatagatttttgaaattgctcgtaaggatagagtgtgattgtgtgtgttaatagagagaagtgtatgcacattgtggacgtatagatttgtactctatttaaaaaaaattatatgaacaaaatcatcgtaccagtagacagtagttgactcttgcctcacttcagttacgaaccagctgctgttgcctgacgagggagtggagcaatgccgagacggtatgagctatgatccccttttaaaggagccccatcttacccctaaccattaatacgtaattctttttctaatttaaaatatgtattttcatggttcaattaaaaaattaatagcttgaaaggagaggagcattacacgtaacatgcatgccaaattaatcatgcacggcgggaattaattagggaactagttattccacgtcatgcatgtttttcagaaagatagcttttcatgtcattttaaattctcataatttagtgtaaggtgggtgcaatttagtgtaaggtgggtgcacaaacttgtaaggtgggtgcaatttagtgtaaaaacttgaaaaactctcgtttcggtacacaaacttgcgtagtgcgtgcgaaccaagggcaagacatgacttcatcaccaatcttattgagttggcttgtgattaggatgccacattggcgcatacacacgttatgggggcgtgagttggctacacatatttgcaaataacccctcatacatcttccgattcctccaaatcttcttttgtgttgtagcccacgatgatgcccatgctagagatcagttttacgatagcctaccgccaattgagttagcaacaaaaggagataaatcaggagattgatatttggatcaaggtggaaggccgcgaattggatccaggcggtaggactttgctgggagaaaacacgccggccacgtttagggcagcggtggcagtacgttgccgccggcgctgaggcaacatggtgccagggctgcgaagtgaaggtgcacgatctcctgtatacagtgagtactttagtttatcatggtcaaaaatgagattgtctttctcaattccaatttttatggagatttcttcctcttattgtcgatttattaggtattgcaaacgagaaggactatcagttgttttaatttatgccaagagctagttcatggtacacaaaagctataatttttgttgacatttatggtatagaagtgatcatggcaaatttgtatttttggagagcaatttgatcattaatgtactgctagcttctgttgttaactatgctttcttcctggatatacccttaaacatctgaacctaaagtaaactattctgaagatgaataattatctgtacacaatatatgtagattccaaagatgaagaattcagcattgagatgcaccacggaggcttttttatgggaaatggtgtaaaccgggcttatgttgatggtagagtaagctggtttgaccattgtgagtcagattcttggtcactgttgtgggttgatgatttcattgaagaattaggatatgagaaatctgataacaccaaaatttactggttgcttcctggcaaacaattaaatgatgggttgaggagggttaagtgtgatgcagacactaatagtatggtcgctcttgtacctagggtccgatcatttgttttgtatgcagatcatcaagacatagtcgacgctattgacttagatgatgtggcaattattggttcagatcctttgcgtactgctgtgaaaccaagtaaaataattagggctaagagtgatggtggggagttgattgtagataaacgtgctaccgacgctaaaattgatgatgaagaggagtcaagaactgaagatctagattttgttgatagtgattatgagattgatcatggggatgatgacttgtttgataattgtgttgaagggcaaattgagttagcacataataaagaggagggttcagactatggttcatctgaagatgaaaggttgatgatgccagatatttctgaagaagaagaagaagaagaagaaatcaagttcagttttaagagttttagggctgatgtagacatggagacacctgagttcaaggttagcatgatgtttgcagatgctgtagagcttaggaaagcaatagatcaatatactataaagaaccgagttgctattaagaagacacggaataccaaaacaagaattgaagctaagtgtgctgaaggttgtccatggatgttgtctgcatctatggataatagagtcaaatgcttagtggtaagggaatatatanataancnngccctgcttggttctttnggagatcaaggccgtcacagctaagtatcttacaaaaaggtacattgaggaatttagagataatgacaaaatgacactgatgagctttgctaagaaaattctgacggaactacacttaacaccatctaggctcatgctaggtagagctagaaggatggctatgagggccatatatggagatgaaatatctcagtacaaccaattatggcactatggacaagaattgagaacctctaacccaaggagctcattctacctgaacctactttttggttgcttccatactttgtatatgacattcaatgcttgcaagaaagggttttttgtctgggcgtagacctatcatatggctcgctggatgccatataaaacaaaatctggtggccatatcctaactgctgttggtatggacccaaatgactgcatttttcccattcgcaattgtagtagttgaagttgagagcttgaaaagctggagttggtttcttgacactctaaaaaaagaccttgccattgagaatacatctgcatggacagtgatgactgatacgcagaaggtataacttcgtctgatttttcataatatacataacttacattttagttcctaactataattctttataattcgtttccaggggcttgttccagctgtgagaagggagttttctcatgctg

SEQ ID NO: 72247 - DNA, 1887 bp, Oryza sativa
ctggtcctggacagggatttcatgtacattcagcttagaaattctggttcgtgaatttctggacgtgacacaggtcctaatacttgtgaggtatcatgtcctgatacctaaccagtatcatctcgtaccaactggattatgttgtatagcagctccaataaaaaagcagaacgaaattcttcgcctcgggcgaccggcgcgggggagcaaaatcgcccccccccccagcgcgacgtggatgcctcctgggccccaccatttgtcatgcctccacctaccacgtgtccttaccaaacatgtttcacctagtgtactcacaatgttcactatgtacagatctaatgttgcaatgaattgaaacattcttttgcaacaaatcacccacatattttgaaaaccctctattaaggaattcgttttaatttttgttccataaaaaatgtttcacctagtgtactcacaatgttttactacgtatagatccaatattgcagtgaacgaaacattcttttgcaacaaatcacccacatattttgaaaaccctctattgagggaattcgtttcattttttgttccaccaaaaatgtttcacctagtgtaatcagaatgtttcactatttatagatctaatattgcggtggattgaaacattcttttactattcgctgaaacattgtttttatataaggtgaaacaatgcccgatttaaacgattgaaatatttttgatctacttagtgaaataattccgatatacttggtggaacatagtgcaatatttaaaaataattcaataataagctaaaaaaattcgtcggaatatatccatgtgtggtcttgttttgaagctttaattttaacgaatttaatggtacaatcgaatcatgatttggataaataatttaagagaaaaattagtttaaagtggttttacacgcatccggtggcgctgacgtcttttttttttgcccgatcggtagtggatttggatcgtctgacttcaccctgtgaaggcacgggcgtgccgtcatcacttatccaccgtccatgcaatccaacagctcccgagcacagagacctatgtcagcccaacaagaagcacgttctccagactttaggggttgtttggcaggactcctctccaagaaaatagctccatctccaagttttttttgccaaacacgagtagtggagtagctccggctcttgaatcgcagctccatctccaggaatattctggagctcctcaaggggtactccaccaaaacctggagtcatatgtcctcatggagatggtaaaaaattacccaccattgccattggtcacaaaaaaaacgattcgcttctatttcactgtaccgccccgttcccgttcctcattcgtgaaaaaattgattccaccagagcgccgcccaagtctgcaggcagatcgccgccgccgccaaccctagagccgccgccgccgagatggccggatccgcctctgtccaagatggatccggcctagaggaggaagtcccggccgccgagatgaccatgggcgccggactggagcatggccatgggcgcggcttccctcctcccgcaaccggccaggggcgcggctgcccgcctcctgctgccggccagtggcgtggccaggggcgcggctgcccgcctcccgctgccggagccgccctgcgcccgcctcccgctgccggagcagccctggggcgcggctgcccgcctcccgctataggagccgtcctggggcacgacaaccctgccgcaggagcagccgtggggcgcagctgctcacccgccggggctgcactgtggcgcgggtcccagccgactggcgatgcccagcagcaagctcgtcccccgcgtactggagcaacgaaccagg

SEQ ID NO: 72248 - DNA, 7148 bp, Oryza sativa
tttgtggcatggcaaaaattaatgaggcagcaaactggaacaggatgggatcactcaagaggcgtgattgtaatggatgatgagtggtggagaaaggcaaaaaaggtgaattagctttatacctgccccttaattattaactagaattagcttgcttctaacacattgtttcatggttgaaattgaataggatattcctggatgcggcaagtttaggaagaaacccttgcagaatgtagatgaccttaacattatgttttctgacattattaatgatgcatccgatcattggaatcctatgagtgagaaccccatcatacctgagcacatgactgaggaggtccaggaagataatcttgtagttgatgatgaagaggtccaagagacccccatggaggaaatgaatgacgaggcccaggagtgccatgaggtttctccttccattggtattggaaagagaagatctcgggctgttcttgacaaaggcaagaaaccaaagatagggacagcacttgttattcaagaacaaatcaccaagattgctgagtcagcctcctctttcacatcaaaaaagtcaaatgaagtaaccgtgcaacaaatcatggatctagttttggattgtggggcagattatggtagtgatgagcattttattgctacagagttatttgtcaaaaaggaccaaagggacatgtttatgaccctaccaaataaagagtttaggtttaattggcttaggagaaagtacaatgccaagtatggagcatgatccatacttgctgttatgcaggccttcttgttatttcataatttctcccatttgaaatatttgtaatggatttggtgtaataatagtactgttagactcatgcttgtttgtctgattgaatggatttggatgaaggctaggaaaagaaatggcatctacagattgatgtcacttggatgaagtttttttttctgtgattgtgttaagttaattagtataatttaacaagtgctgtgatggcgtctacagatataatatatgttaagtttattttttatactatttgtaacaagtgctgtgatctaacaagtgttgttctctttttttttgcctgcaggtgactgacggtgaaagtgagagtgagtcaggggactctactgatggtgaccagttctggaaacttgttttaggtggtgcccaaatagctcaagtttatgctgatatataccttcacaaaaatccaccaaggacatcaattcttagtggcatgggatggttgctagagacattgcggactcctggtgaatgtcattcacagcttcgtatgaacacagatctttttttggacctaaatgatttgttggtgcaaaggtatggactcgaaccatccctgcatatgagtactcatgagatgcttgcaatgtttctgtttacatgtggtggaaatgagtccaataggagagctcaaaataggttcaaacattctggtgaaaccattagtagaaaatttgatgaggttttaaattctttgatggccatggcaaaagattacattcgaccaaaagatcccaattttcgttcggttcataagaggataagagatgatagaagagcttttccccatttcaaaggttgtattggtgctcttgatggaactcatatccgtgtgtcattgtcacctgatgagcaagttagatatattggaaaaactggaattcccactcaaaatgtgcttgccgtttgtgactttgacatgcgttttacttatgttgcaacgggtcaaccgggagctatgcatgacacaagtgttttatacaatgcattaagagtggatgaaaaattcttccctcatcctccacaaggtaccacacttgtattatgctctctatttgtgctgactgtgcatgtgttactaaaatgtatcaataatcatactatgctatcttttgtaggcaaatactatgttgttgacgcaggacatcctaatcgtcccggttatcttgctccatacaagggtgagagataccatttaccagagtggcacagaggtatggaacccaatactccaatggaaaaattcaatcgtgtgcactcttccatccgcaatgttattgagcgatcatttggattactaaaaatgaagtggcaaattctgtacaagatgccgtgctaccccatatacaagcaaaaaatgatcgttgtggctgctatggtccttcataattacattcgtgagcatggaggtgaggatcctgattttgctaggtttgatcgtgaccctaattttattccaacaataccagaacggtacaacaaatacgcagttcctcgaacggcatctgatgagtcaactcccgaaagaagtgcaggaactatggatctcttccgtgatgaactagccaccgctttatcaatttcttggcgctagatttgtaagacataagatgataatgtatctttgttggacttcaattatgaacctttgattaaaatgtggtaccttgtgcggattttgctatgtgcggattttgctcccaactcgtttctcaattgtggcagatttgcatgtgttccattaagatgtaaaataaatattacgataaaaaattagctactcggaggtgcaattccctactacagtagcagcattgccatgcgtgttgctttgcactatgactgtgcgctctccagtctactgtgtagctcgatcgtggccattttggcgttttgctgcaacattacctctcgcagcaggattgaaataggtgcttgcatcgtcttgaaaaaagtctattttataattttttttattttttattataaaaaaattagctattcgagctaattttgtaccgttcttgaaatagctacttgcatcgtcttgcaacaagtctattttgtaatatattttattttttattattgttatggctgtgagaaatattaaacatcactatatattagtaatcaacatccatacaagatccatgggcaaaacagtcctttcactcctcctcctaccaaatctggagctggaccatatgtattattacccaaacaggtgctagctccaggagctccacggtggagaagatttcctggagaggagctcatttttttgtagagtcagtttggtagacttgtagtgccgccatcgctgctgccggcgaatagctggagctcgtctttcgctacgcgctgccaccgccgccgtcttgagcttcatatggaagctttgccattccatcttcctactaggactggatgtatcaatcggtagtgatgcagcatgcttgctgcccggaatttggattttggaacattattacaatgagcagagcagagcatgcattcgattcaactagtcagcaagtaaagcatgcattccatcagacaattcataggtttcaaacaacaccattcattactaactacaacagagaataagccacatcgtaaatcaaaagagatagagaatagaataagccacatcgtaaatcaaaagagatagagaatagagatcgtaaatcaaaagggattgaaaagaacaaaagcaacgcactagaaactacaatctccatagctaaaatatgtcttcagtaccatcaacagttgaacaaatgaagaacaacaaaaaatgaagaactaaaatatgtctttggtactttggccccgaaaaatgaagaacaacaaagaaaaagttgggcccaggcgatggctggtgacggcgcacgcttacaagcagacgagctccgagctagctagtcaccgccatcgtcggcatcgacagtggcggcggcggcagcagcgacgagaggcctcatcggattaactcatcagtgtgtcttgtcgggctgccatggactgatttcaatagcagttaagtatgcatgacacgtgagccgttggattgcatggacggtggataagtgatgactgcacgaccgtgccttcacagggtgaaggaaagcagatccaaatccgatcggtaggaaaaataaaatcttccttctcgaaatcgccggccgcaccgtctcctctctccccggccgtcgctgcgcctcctctctcgctggcgcgccacgccgccccagctccggtcgtcgtcctcctggcccctccgcgtccgcgtccccaagcgagcgctcgagctttgctttcaagctctcgctgagctccggagggtagagatgtcgtcctcctccgccgccgccttagccagaggcaaatccggaatctctgccgctaaattcgaagtacgaattctcccccaacccctctccctaacacacatggagtacacttgaatttagctgcggccagatccagacggctggctacctctccaaaatctaaatcgaaatcgatcttgatgcgcaggcgtctaagggattgggcgccaagccgaagcgatccgcctccgccaccggcagcagagggaagaccgagaagaaggtctactcgctgccaggccagaaattcgacccccctgaggaggtcagcttatttccactcaaccaaatctcatctcatctcatctgtgttgttgcctgatgccattaatttcgtccagagagagcctctcaggatattctacgagtccttatccaagcagataccctccagtgagatggctgaattctggtacgcacaaatttttacaccttttagcgtaatatataaattttcttctatctcaactgttagaaatactcctacccctatatggaatatatatacagtagtagtacatactagtgacattcaggtgtctgtctaactagtggagtactagctatctagtaggattctgacagtaaattcttctaagaatacttgtagcttcaacgcatgaagcttactgctatcaactgactaatatcgcctactcaaagcagacactagtactaaatttggttgcctcatgttagcacaagttcacacatcattctaatgaagggcatgaaaccattcatataaataagttctctcacttaccaatgataaatcctaggtttgtcttacaaactgcagtgatcaattatattaccctagtacctcatccacgaaaatgtacaacaggttgatggaacacgggttgttatctcccgaaagagcaaagaaagcatacgaaaaaaagcaaaagcggcaacagcaaatacgatcaggaacaccaattaaacccagcgtaaagaaagacaaaccggaaagttcaaaaaaaccaagctcatataatagttcagattcaaaggcaaaaaaaagagtcgattacagcgatgacgatgacgatttcattgtaaaactgaagagatccaggggatgatagttttcagataccagcatattcctatagcaccaaggctaataaacaggtgctgctctgaggtttccatggcaatggtaacaaccaaatgggttcatgatgattctggtggaacaacatttctgtttattgtcaatattggagtagaaagaaaaatggagatcctttacaatgataaaataaagtcatattggcagcattgtgtcttatgtaaagacaggcactttgtggagctaaagataaataggtttccctttgctttgctggtgtcgttgtattctgcaatttgtacctgcacggtaccgtaccttacctttggtagataagatttggtttgttgcattgctgttactcttgcattgggaatggacattgttatgctgaagttgcctagaaagaaaagattagatttgttgtgttacttacagtactagagctacggctagagcatgttggatgtgggactctgcactgcagcttaatatggaaattgattagaattacaaagcaatagaggcaaatgagaaaaatggtattgtcaaagggggggactggtttcttgctgttacgttgattgaatattatattatagggacaattgcatccatgcccccactttcaaacccaattgttgttttaccctcactttttagggtttgcagttttacccccaccttttgaatctgaatcagccgtctgccccccacttgtaatagttgattttaacagtgttagaggtagagaaaaggacatttatacccttggcggttattgcatttttgcccccattttttcagctgtgttattttgcccctattttgtgatttcagcttgtgtgattgttataaataattcaaatatgagcatctcttgtgatgtttttgtacttttaacaaaaaaaaatcacaaatactagggaaattacaaaatttgaccaaaatttgaacaaaattttgacagaatttcaacacaactagtacaagtcacatataacaaagtgtccacaaacataactacaaagtgtgtccacggcagtggtaggggacggaaaaaaaatgaggtatggctcatagacacatacatcagagactagaaggtagatgagaacagtatcaatcgcactacggcacgacattgtatcaacattcagcatggcaataatcactgatcacaatccgttatccatttgcaaacaagcctaaatagaagaataggcattgaaaaatacctcaagtaatgaagtttcagtaataaatcacatataggaatcagggaggatagatatacatagaatctgaaaaaaggagagcaaggattgattagggactagggtggattgaatcgggaggaaggccacttgcttctgaggcggtttcacgagtttcagctgatcaaatatctcaagcaacccatgcatcattccaacaacaacgcctcctgtcacagggatcagcagtattctgtgccaagtatcagctagcctctgaaggcagagccaagctgcaccttcgttgggggtacctgcccaaacccattcatggatgatatgaacctaaaaattccataacaggagctatctatagaatcagtcatgcaaggcagaactgaaaaatctcaaccttaacttacattggaatcactaggaaggttttaaattttaacaaaatttatcgtgttttgggcaaccgcagataccgtgtgacataaggcttttcatttactgctttcagtgcactgttaagttgctttgagtttgcacaattaaatgaaactgattttgcatcatttgggtgaattcatttgcactagtttagtctgcacacttccgtcaaaaaa

SEQ ID NO: 72249 - DNA, 699 bp, Oryza sativa
tgacgcggcggagctgaggaggaaggggtccttcttcaactggtacaccttcatgatcaacagcgggtcgctcctggcgtccacggtgctggtctggctgcaggacaatgtgggctgggggatcagcttcgtgatcgtcgtcgtggtcatggccttcttcctcgccgtcttcttcgccggctcgagggtttacaggtacaggccggtcagggggagcccactcaccggtgtctgccaggtggtggtcgccgccgtcaggaaatggcatttggagttgccggatgatagctcgcttctgtatgaggctcaagtcgcagatcaccggattaagcatactgatcaattcaggtattcctttgttttattattggtcaaaatatgatttatttgagcatcaacgtgtgatggatttgagtcaaaagtcttgaaataattaaatagaaattatagcctgctcatatttctttatcggcttaaattttttgatataattggttactgggtacatttacagtactgctaatactccctccgtttcaaaatgtttgataccgttgactttttagcacatgtttcaccgttcgtcttattaaaaaaaattgtgaaatatataaaactatatgtgtacatgaaagtatatttaacaatgaatcaaatgatatgaaaagaataaataattacttaaattttttgaataag

SEQ ID NO: 72250 - DNA, 3681 bp, Oryza sativa
agtttttttactttttcatttattaatctttaacagtgtcaaataagcttcactagtttttaagcaattaaaaccggtgaaaagggtttgaatgacaaataaaaaatttacatttaagtcccttaacgccttctggaaagggaatttttagaaaacgatctcccagagggcgtgaggcatctagatttgtaaatttcgaaacgaaaatctgttttgtaaatattttaataaaaaaatgtaaaaataggaaaaagaagttaaaagatcaagcctgtaggatcgtaaagggcatttcccacccaaaaagccattgaggtgaggggctccccgacttatatcttaggtcctttacccttctacaaccaatacctttgattttacaaagcctaccagaataccataataaacgttccctccgttacatacatatgagaagttattttaggtttgttctatgtcaaggtttcctaactttaagcgagtttattgaaaaaaaaatacaacactatggatttcagtgaaattaatttgattttgtaattcaattcactggcacataaaacattttgtgatggcgatccataacttatttatataggcattgtttgaaccgcttaatatttgcatagacggatcctagaaccgcttaatatttcacatgcaactcccttaaggaaccaatttgtagttttttatttttgtaggcataaaataatctgaaaaaatatgtacaagtgcgtatataggatttgatccagaactctttcttcttgcttagcctcttaccatctcacctatgaagcacttcgtgaatgtggattggatgctatcttttaacttcacctctccaaaacttggcacattattatactctaaatgatattaaatacaaaggttcttaactacaaacctgtaaatcccgtcgacttctacaactatcatatcgatcatattttcaattgaggtaatttgaaaaactcaaaaaaaaaatcaaaatagatctgagagcatgtaagaaatattaacatctcaaatgaaaaacgttcaactaaaatgttgaagatctcttcaagagatacaaatttggttacaaagtttatcatcattcaacttcatataagttatgatttttttcactttagtagtgcctccattttcagtggcagttttttttaagagatccgcatatgaaattatttcataggtagctctctaagaagtctgccaataaaatcattaaagagtgttttttcaagaagtccgcttataaaactgtttttcttgtcatttatagaaagtccattttaacttcgatagaggtgaaccattttaacttagatggaggtgaaacatatatgcagtaatagatatacataacacagaactgagttaaacactacatatacaatagtgattagacaatcttgtgttacacagaagttgcttctctgctttcaaatacagagaacataaatgagagatagatgcttgaaatcaatctatttcaaatgaaagtacattgatttataaaacaggttacacatatataacacaagataaatatattgcttattaaacctaatctcttccagtcgtcgatctataggttagagagttctttgtggctagattggataaaagctctgcactgctacttgagctgttgtcatcaaagctcttagggagttcatctatactattctcctcaaagaactgttgacgacttatgttgtagttttcttgtttaagcttcctagatcttcgcagcatcataagtcgtgccactacctccttcatatcaggacgctcgtcaatcttttcgtttaaacattccatcgctaacctaccaatttcttctaggattaagacatcttcctcgatggcaatatccttgtcgaacaataacctcccactatttgcttgatcatatgcctcttggaactcaataatgaggctgcggttcttgccatatattgtttgccttctgctgatgagctccagcaatacaactccaaaactaaacacatcacttttttgtgttaagtgaccagtcatatagaacactgggtctatgtaccccatgcttcctgccacaaccatggtgaattctttgtctacagtaagaagcttggatgtcccaaagtcggagatctttgcaacaaacttgtcagttagaagtatgttggcgggcttaacatcaccatgccgtatggtatgacttatggacgagtgcatgtatcttagaccttctgcagattcaattgcaatgtctaggcgtagatctagtgtgagagggactaggtgactggcatcactatggagaatgtcttttaggctaccattagcggcaaactcatataccaacattggaacatccatctccaaacaacagcccaatagcttgataatgttattgtgcatcattcgcgattgtatgataacttcgtttgtgaaatcctccttttgagcttcagttacctcaattgaagtcgtcactgctaccagggtattgtctttaagtctacctttgtagaccttaccaaagcctccttgaccaataacttctgaattgttttttaggattttcttcatctcatctttggagaaaatcacaatattgtccacattctgtagtattgaaccaccattctttttgaaatattcgttcatttttctcctttgaagcatcattagtgtgaaaagaacaacaacaaccaggaaggaaaatcccaaactgacacctagaaggatcacaaattcatgtgagctaatataataaattcatgattttgtattactccctccatcccaaactataaggtacactaacacaaagactaataaataatttaattactcccttggttggaccacctcaatgcatgcaagtaatgtgattattggggggggggggaggggagatgggtgttgagggtagaggatttaaaacaaagtgaatttagaggagaaagaggttctagttaatatatgcatgtatacacgccttatattacgagatatgaagaaattgggttgtgccttatggtttgagatggagggagttgattttgtgacaatagaaagagaggcgaattctcactttcatgaacataactatcaactattgttgtattaatattatatatgtacattggacatgttatattagaattattttaatctataacaacataatagcatctgcatgcactttcctaccctaattttggctccttaaaactagaaatccaaacttcttttttgagaagctggaaatccaaacttgaaacaaagtagttgagtgtacgctgtgtaccttcttctattttacactaggtactaggtgtttagtgattgcactcaacgtaaagtcaaagtatgcatgaaaataaatcagtgtaaaattaattcaatttactcaaaatagtatacacggaggtacataaatagtcgcataccaagggcaagctgtgctgcaactggaaactttggattgcactcctgtttctttggaccaccaccacttggctggtaaccagtatgacagctgcattcgtaatctcctacaatgttcttgcaaaccccatagcaggggtacttgtccttgttggatggatcgcactcgttgatatctgcatacatgggtgcatataaactattcattggccggttcattcgaag

SEQ ID NO: 72251 - DNA, 1275 bp, Oryza sativa
  unsure (1)..(1275): unsure at all n locations
caagtcattaacacgtcttctctatcagaaaggacaattgagagctacactggaggacatagaagatctgaaaagacaagaaagatcccgtcagcaaaggatcttgaaggctaaggaagcccttgctgctgctgagagggaacttgatgatctacaaccatatgaagcacctaaagctgaaatggttggtttattcaccttattttccctagtttttgctgtcatttattttagataacgagcttttgctgtcatacatctttttttttgtttgcaattttgcatatgtagcatacaagtattgtgtacggtttatctgctctagtaattatttaagcccgttaataattttatgtttcttcacagattcaactcacggaggaaattgcacgactgacttgcgatataaatgagctaaaaaggaaaaagacagatatggagtcccagttagttcgagagagagaaaatctgaggaactgctctgataggtactcgttttgtctattaatttctactttgtccaagacttgggtacctactagctagttattatttatcacaggttgaagcaaatggaaaataaaaacaataagctgctccaagcattgcgatattctggtgctgagaaaatcaatgaagcatacaactgggtgcaagataaccgacacatgttcagggctgaagtttatggacctgttctccttgaggtttgtttacttgcatgttcaccaactattgtctgctttgctgatcatacaagtaatagtacatcttctttgtactgctgtcaggtaaatgtccannnnnnnnnnnnnnnnnnnnnnntggaaggccatgtcgcaagctatatatggaaggtatagatactacgatagcaccttatgttcctctctgctaattagtgtgatgcttatgttttactttattttagcatttccatgaaacaatggaaagccaagaggaacacacttaccagtggctgctggttctgttgtgcactgcacattgtgttttgtttttccttcacatagtcaatgtgctgttgcaaatttatcctccagttgctggacatggttagtgtccagtaggatggcatctcattaaaccatttctagacaaggtcccttatttattgtcatcattgacttggaaaccataaaacactaccatgccatcttattctttcctcctatggaagatactgcatctgtaattaactgccattttgcttttatgtggcagtcattcattactcaggatgcttccgatcgtgac

SEQ ID NO: 72252 - DNA, 13582 bp, Oryza sativa
cctccgtcgtcgtcgacttggatggacatggtggtggcggcggggggcacgtggggccgcccagggtgcttgcccttgcgccggcgcaggcggcagttgatccaggtgacttcgttggccgtctccagggcgaggctgtaggggagcgccggggtgccgatgcggacaaccaccacgtacatgcccacctgcgcgatgttgagcgcgcttcgcatcggcagctcgaacatgtccgtcttggacatgagctccggcacctgccgcatcatccgcctcatgtccttggccatcaacgcccggaagtgctcgcgccgctcctcccccgactccggaacgtggggcgcccacaccggaagggtgaagctgctgctgcctccctcctggtcctggacctcctcctcttcctcctcctcctcgtgctggaggcgcccatggatccctgccaccaacagcagcaggcttaggaggaggaccaccaccaagggaccgggaccggccggcatcatcgatccttcgcttccttccttcctttcctcttcttctttgtttaatttgccaattagctagctaccctcatccatccatccatccatccattctactactccatcctcctgcgcgtgcatgctttgtttcttccgcacaattaagatgattctatgttaagccctgtggccatgagctctttcaggaacacccaccactcctgaattactattttactatatatattcccccttattttccttctacatacatacttacatacaagagaagcgatcttcatctgcatgcatggcattgcctctcctcttcagtcttgcggccttgccagcttatatatatatgggccttttaattacatgggccaccaccgtaatcggaattggaacaagaactgaaaagataaggagtaagttcactataaatccctcaattcactaggcccatcccccggcggtatagtagctggttttggttgacgggatgagtgggatccacatgtcaaccgccaacccttcttcctcatctatttctctcccggactcctcctctcccctctcattccccatctctcgctccaagtcgggaggggggaggcgtgcgacggagagaaaggcggtggtcgacggggagaggggtgacggtcacggaggagctcatcggcgagctgtggcatttccctctccttctccaactatttcgacatcatgctggtggtgctatcgtgatgtgtgaagcaatgcggcccgctgttcaacccgctcatgctgatgctggtggtggtggcccgtgctgggctccctcctcaacgagaagatgcatcttggaaatctactcaacggcgtgctcatcgtcgtcggcctctactctgtgctctgtagcaagcagtacgagcaggggactatgggtcaagacgagttgtgcgaccgcttagggcctaggtcagcagggggccatcatcaccacacctgcccaatgcaggtcacccaatattgctgctgggcaccgaggcaggtcacccaataccgctactattctcggtgccttgagggaagaatgagggaggcagggagacgcggtcgtgtggctgtcgccgatctcaatgagtcgatcgaggcctcgaggacatgacgcaatgcgttgtttcatgttctcacttctaatctcacctcttcctcgtgtcgccattttatctcacgcatcactgtagcgcccgttccgtcgtggcgcctagcgggaaaattatctcttaaaaaccctaattgcgaaatttgtttccttgcttgttgtctagtgtccatgccatctcaagatctcaatccccgatctatcgtcaagttcaattctgaatccaattccttccaaatcaaatttctccgcaaaagtctatttggcctcccccgaggtcgatgggccgaatctcgctcggcccatctccccctcctctccctcgctctccgtctccccatccctcgctgccgctccccgcgctcgttcgcgcgcgcacccgcatggatgccgcccggtcccgctgccctgccgcctgcagccgagcagccgcccggtcccgctagccagcgcgcgcgcccgagccacgccgctcaaaaccaccgcgcctcccgttgtttcccgcgcgcgcgtgccgagtggccgaccgcccggtcgccgccgccgtcaccctctgccgcgccagcccgcgcctgtcgcccgtgtcgtcgcgccgctccaaaccgccccgctgtcatcgccgtcgtcatcgcccggccccgccactccgcgcgcaagccgccaagggacggaggcagcgcccctcctctctctgccgcgtcgcccccgctcccctcctcctttttcccaaatcggcaaaggggcaagcccctttctccccctcctttctccccttttcctcccgccggcgtcattcccctctccctcctgtcgccgttttggccgctagccggagcgccagctcgcgccttgaccgccaaagtcggtttccaaaccgacattgccgccccctataaaccccggcgccctcctttcctctcccattcacctccgcgccattgccgcccctctgttcgccatcgccgttcgtcgttgcgcgtgtcggaggagccagcatgagcaaggacgcggaaggggacttcggccgcgccctctccttcctcttccccggcctgaggccggagagattactcccgcgccgtcggcctctcgtcactgcgccccgcccgcacggtagtgcaaccctccgttcttcctcctcgctccatcttccccccttagattttggtagtagcccgagtagcctccccgtagttagccggcgccgccccgaccgttgccgtcgctcgccgtgtgctcgccaccgtcgccgctcgagcgccgtagcacccgcacgtcgccagcctcgcttggcgtagctccgtccaatccgacgctagcatcgagttcccgaagccgcgtagatgctctcaccgctgggaatcgacctctcgtggcctcgtcgccgtttccctcttctcccgccgccggttgccgccgccgcaatccgccgccgtcgagcaacccccggcaaatccgagccgttggctcgtctccccttgtcctgtacaaccgcccggtgtgctcgcttttgcccgtatcaccgtggttcgctccgccgctcgccgccgccgcccgccgtccattcgcggccgggtcatcgtctacctcccgccagcccacgtggcagccacgtaggcgccacgtcggcgccagctcagcctagaccgggtcgagccgaccccggtcagtccctcccgtgcgcgcgttccaccgcaagccatgaggctgcgcgtgggcccgcctcatcctttccaccgtgaaccgtgcgcgtgcaccgcgtccctttccgcccgcgcgcgtgcgccgcgtgctccctccgcacggtgagccgagccgctgacaagcgggtcccacccgggaccgcgcgtggtgagcccggtccaccggccctctccctctcctcccctctcgcgcgcgcgcttgggccgccttgggccggccggcccgttaagctaggccgagccgccccaaatctcttgggccgcaccctagccgcccgagaaaagtctaatttccatccctcttttctttcttttcttttctttttcaaaaaggatttaattaaatccttttcctttagaccaaaaattcaataatcttagaaattcaatatcttcccaaccgtaaatccgtttgactccgttcgacttccaaaattccccaaatctcgagatctatctaatggcacgcttagaggtcattaatagggctttattttcgccgtttgttgagttgtcccgtttcgcgtgtagttccggagcccgaagacccgcagtgcgaggatttcgaggatcaagctccagatctcgagcaaggcaagccacctttgaacatcttgagcctatatttgaaatttaattatgttacttgcaaaatattatgcattgataggatcacacttaatctgttgtcccgtctgcgaggcagattggcggacttacctaatttgtcgcatttgatccttccattgttaattgctataccatgtccccttgtaaccacccagttgcgcctcgatactcgtgcactctgtgcgagtatcgacggtcgccttcaaacttaaaatctgagtaacaacttgggtaaaactggagttttacaaaagacttggaaaacccaacacttgggtcggtgcttgcgaactaaatgaatttccaaaaccgcggaccgggaaacgtaccgggtgtacagtttcccgctcttgcacttaaggaccgtttccttggaatttcatccgaacataagacaagtacgaccacatgggtggaatgggacacccctggctgagtaactagcttatcaggggagccttgatgctgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgacccgggttagtaatgtcgtgtgggtaaagtgtaccccctctgcagaggtcattaaactgttcgaacagccgtgcccacggtcatgggcggatgtgaggtgattcctagcgtagttttgtttgactactgcttgtgaaattgctgttgtgaaactgggttcgatgtttggaaaatcagcagctgacgggatcagctaggcccgggtggccgtttgaaaagttgttggcccgggtggccgtttgaaaagctgttggccgggtgccaaccctgtttcaagatctaaagactgatacattgcacatactccgaccggacgagacgcactgtctcatccgtgtcgtttgagaagcactcacttagttgtttttagaaaagagtttaaataaaataaattgcgaaaacaacagcctttccttgaagcctgcattaaacacttatttcccctggcttgctgagtactcccgtactcacccttgctctatataaatatcccccctcagttgctgaagaagataaagcggatcctgctgatgaggagttcttccaggagcaagccggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatattctgtctccctgtgataccagcactgcttcctgggactggtatcgattaacaggttaaattggagcgtcacgggccagttccggtcgggactagttcggggcgtgacaatcacgctaacttgctgactcgccaccaggaaagaaggaagatggccgacgtagcgaaccggctggcgacgtcgtcgcccacgcgccatgcagccacgccttgcccttgtggccttgccttaccttcacgaggcatctgattagcagaaaagactagggcaaggtgaggtcttctgatcttatttgcatctatgtagttcgaaaattaggttatagttttgttttgctctttttgtttaatgaatttagtttatgatttcaggtgttagaaattagaatattgcctcagaagcatctttcaggcctcaccttctggtatacaccaagtagccagcgtgcgggtcttgccttctcgttggctccctagcgtaacccctgcaagccgcttaccacatcgaatccgtagttcccggtctctacaatatcgccctatgcctccgcgctgccctactccttgggggtgggaggaggatgaagattagggtactaacttgtggggtttacgagggttccacgcttactctactgatttgattttattatactaaacttgtcacatcagtaaaacctggacataataccgtcttaagacctcgggtgctctggttttacaagttaagagacatgttatgtctggtattacgggcttgtttggcacagccaaatagtttcagctccacctaaagtgggagtggagttgggtggagctctctcacaaaatgaactagagaggtggagctgggtttaggcagctccacaactccactccaaacccaactcctgaagctaaatttaagagttggagctctactaaacatgccctacaattaaaaaatgtgattaaaacttgacatatctaaagtgaactcattcggaaagacaacaacaaacactcattctgcagtgcagctaggaggaatgtggcatcaccatcagcttctgcattggagtggattttcatccctggaggggatatcctctcgttatttgcgtatcactcaaatggttatgaaaaaattttaaaaaaaaagagagaagatgtattaacatgtatatcacttcacaaacatgcaagttcaaattcaacttctatatctcgcaacgaaaaaaacaaattaaactacaactagttaacagttaacgtatatccacaatcaagtttgtttttttcgttacgaaatatagaagctgaatttgaacttacatatttgtagagcgatatatcacatcttaatacatcttctcaaattttttaattttttttcataatcatttaagtgacatgcatacaacgagggaatatcccctccagggatgaaaatagtttccggcttctgcataccttgtgatgtccctctcttgtctagtactggcatgaatcggcacgcagcactgctgtggctgctgctgcttcatgtcatagtaacagtacattctcatgcaccggtgaccgatgcactgactggtcgtccgccacgcccaacaagaacaactactaggctagtactggaggactatcttttttccgagaaaattactctccatcccttcttatggagtaggagtattaaacaaacagaagaaaggataatgatactctgtttgggagtcctttccctccctttgatgcagcagcagcgtttttgattgcgcatttgcatggcgcgcggccagcccaacatcgcaacgcatcaaagtagggacgatatatatatatatactccgacgatcgatcccttgccttgctcacgtaccgagctgcttcaagaaaaaaaaatcaatggcgtctcagaagaaagcaaggacttgaagaagagctcatagtatggctctgcggcctcagcttgtgcctccgctgctctcccaccgccgccgccttgtcatacctctgcttgtcttgctcctcgccgccgccgccagcgacgagcagctgctaagcctgcgtgggcaggctgctgtccttgtgtccatcaaagacgccttctccccgcctctcccgacgccattgcgcactacctggagcatcgccaacgacgcctctctctgctcctcgtggcatgccgtccgctgcgcccccgacaaccgcaccgtcgtctccctcgacctctccgcccacaacctctccggcgagctctcctctgccatcgcccacctccagggcctccgcttcctctccctcgccgccaactccctggccggcgacctaccgcccaccatcgccgccctccggcacctgcgctacctcaacctctccaacaaccagttcaacggcaccctccactactacttgtccaccatgaacagcctcgaggtcctggacgtctacgacaacgacctctccggcccgctcccgctcccggacaccaacagcaacctccgccacctcgacctcggtggcaacttcttctccggcagcatcccgaccagcttcggccgcctgcaggccatccagttcctctcggtcgccggcaacagtctcagcggccgcatcccgccggagctcggcaacctcaccgccctgcgccagctctacctgggctactacaaccagttcgacggcggcatccccgcgtcgctgggccgcctcgccagcctggtgcacctggacctggccagctgcggactgcagggggagataccgccgtcgctgggaggcctcgccaacctcgacacgctctacctgcagaccaaccagctgaacggcaccatcccgcccgcgctcgccaacctcaccgctctcaggttcctcgacgtctccaacaacgcgctcaccggcgagatcccgcccgagctcgccgcgctcacccacctccgcctcctcaacatgttcatcaaccgcttccgtggcggcatcccggagttcatcgccgacctccgctcgctccaggtcctcaagctctggcagaacaacttcaccggctccatccccggggctctcggccgcgtcgcgccgctccgtgagctggacctgtccaccaacaggctcaccggcgaggtgccgcgctggctgtgcgcgctccgcaaactcgacatcctcatcctcctcgacaacttcctcttcggcccggtgccggaggggctcggcgcgtgccggacgctcacgcgggtgcgcctggcccggaactacctcaccggcccgctcccgcgcggcttcctctacctgccggcgctcaccacgctggagctgcagggcaactacctgacggggcagctccataatgaggatgaggacgctggcagcccgctgtctttgctcaatctctccggcaacaggctcaacggctccctcccggcctccatcggcaacttctcctccctgcagacgctcctgctcagcggcaaccacttcaccggcgagatcccgcctgaggttggccagctgaggcggctgctgaagctggacctgagcggcaacaacctgagcggcgaggtccctggcgaggtcggcgagtgcgcgtcgctgacgtacctagacctgagcgcgaaccagctgtggggcgccatgccagcgcgggtggtgcagatcaggatgctcaactacctcaacgtgtcgtggaacaagctcaacggcagcatccccgcggagatgggcagcatgaagagcctcaccgacgccgatctctcccacaacgacttctccggccacgtgccccacaacgggcagttcgcctacttcaacgcgtcgtccttcgcgggcaacccgcggctggtgctgtgcggcacgcccgcccccggccccgcccccgggacgacgacgcctggcagcgggggggacgggcgggcgccggtgatgtggctggcggcggcgctggggctgctggcttgctcggtggcgttcgcggcggcggcggtggcgacgacgcgatcggcgattgagcggaggcggcggtcggggtggcagatgagggcgttccagaaggtgcggttcggatgcgaggacgtgatgcggtgcgtgaaggagaacagcgtggtggggcgtggcggggctggggtggtgtacgccggggagatgcccggcggggagtgggtggcggtgaagcggatcgtcgacggtgggttctcggcggaggtgcagacgctggggaggatccggcaccgccacatcgtgcggctgctggccatgtgctggagcgcggaggcgaagctgctggtgtacgagtacatggccggggggagcctgggcgacgcgctgcacggccaccaccggcaccacgacgagtacgacgacgatggcagcaatactaatattattgggtcgttgttgttgccgtgggcggcgcgtcttcgtgtggcgacggaggccgccaaggggctgtgctacctgcaccacgactgctcccctcccatcctccaccgcgacgtcaagtccaacaacatccttctcgacgcccgcctggaggcgcacgtcgccgacttcggcctcgccaagtacctgcgcgccggcgcctccgagtgcatgtccgccatcgccggctcctacggctacatcgcgccaggtataagcttactactcctactaggcagctttcaatctttgaccgactaaaattaagggtatgtttggtagaactttaactcctaaattttgctataaaagttaggtctggtgtggagttgactaaatccagctccacctctctagtttattttataagagagctctatcaaactctgtttctatttttggtagagctgaaactatttggctgggctccagttctaaaagagatggaaagctgaagctgtgacaaacagtcccttactccactactctagactccagctactagctagacggaccaatcatgcatccatccagcattccatattggacggacgttggtggtgtagtgtactagtcgtcgtacgtggtgctaatctcctctcctactacagttattattattattagggtgtgcgcattcttttctttccatgcaagcatgtactccgtactgtgtgtcaccacaccacatttggcctgcactgcatctgcatgccattgccagccaaaggaaaccaagcagcagccctctgctgcgtctgatgatgactagactcctcaaaggacgagcctttctttctttttcttttctttgctgcatagtagtacggatgcatgcatggatcgactgaatctttcgctttcgcttttacttttactgctagtacatgtcttgcggttgatgatttgcctcaatgagtcgtcctcctatcctacctagacaagcgatgcgatgcggcggcagcagaacaacaaagccttgtttgcttttaaacagagtctaaaaagaatgaacaaagtctcttttcatttggtctttcttcttcacaaagcatatgctcctcttttagttagttttttttaaatttctgctgattaattgagtatataaatgtgcttttgcagagtatgcatacacgctgaaggtggacgaaaagagcgacgtttacagctttggggtggtgctgctggagctgataacggggcaaaaaccggtgggagagcacctgcagctgcatcaagaggaggaggaggaagcaaatacgacgacgacggtggtggacctggtgcagtgggtgcgggcacgctgcggcagcggcaaggacggagtgtggcgcgtcctcgatcggcggctgggcggcgacgtgccggcagcggaggccacgcacatgttcttcgtggcgatgctgtgcgtgcaggagcacagcgtcgagcgccccaccatgcgcgaggtcgtgcagatgctcgagcaggcaaagcagcagctcagccgctgccaccctcctcctcctcctccaacatccacgtcgatcgaccatgcatgcatgatataatatgatatgatatgcctgctactgtatatgcttagcgtacgtctcctaattgccttgctaataggagtacttctacaccacatatgcatatgcgtgcggatcgtttcgagccgacatacatgtccaacggatgctcatatgtctgatgacaacgtacgatcgagatatatatatatacgacatgcatggagctccggccggccggcttgctgactattaggaatactttgccatatatgtacatattgtattgtattgtttctttccttgtattctcctctaattgagaatcctgtacatgtgcttcctatattaatacatggccacccctcccattgggtgtgtggtgttctccccattccattctacatggtatcagattccaagttttcttctcctcttccgttgctctagcgctgcttcctctccggtcgctgcgtccaccgagcgtcgccgcctccctggctgccgcgcccctcttccctcaccatgtccacttcctcggctacttccgctaccaccgactccgctacggtgttgtcttccacctctaccgtcgccccggttttcgtcaacccgtatgcgaccgtcgccgtcaagtcccatgttccgatctccctcgagcttcataaccccaactacaacaagtggaaggccttcttccgctcgatgtgtgggaaattcggtctcctcgatcatcttgacgctgctcctcccgccaaccctgacgccgcctgggaacaggccgattgctgcctctgcagctggctcttcggctccgtcgccgacgacgtcctcgacctcgccatggagcatgatcaatcggcccaggacttgtggatcgccatcgacaacctctttcaagccaacaaggagcctcgcgcgatctatccgcatcacgagttccactccatgacccaaggcgatctctccgtcgccgactattgtcagcgcatgaagacggcggctgatgccctccgcgacgtcggccaccccgtcaccgagtcccagctcgtcctcaacctcctccgcggcgtcaattcgcgcttcaccagcacggccgacaacatcgcgagcgcccctatcttgtcatcctttgcctctgcgaggaacatgctggttctcaaggagcttcgcaacaccaactcggtacaagtccagtccgagactgccctcgtcgcagccaacaacgcccactccaactgcaccgggggcacttgccactcctctggcagcggtgggcagcagcagaaccgcgccggcggcagcaagaacaagggcaagaacggcggccgccctggtggacagaacaacggcagcaacagcttcggcaccagcactttctccatccctgctccacgccaagctgcaccatgggtgtgcttctcgccctgggcaggacagcagcaaccctggcgtgctcccagcgccgagatacttgggccgtatccttaggctcacattgccttcgccgggccatactcctcgccactgcctgcagggtctgtccagccggcttgggaccaagctggccttgtcgccgctctcaatggaatgatgctttacaaccccaactcgtgggttctcgacacgggtgcaacttcgcacatgtccaccgacggtatactcgttactcgcctccccaactcacaaacttatattaccgttggtaatggtcactccattccggttgtttgccgtggcacttcctttctccctattggcaccactagatttgaccttcatcatgttcttgttgctccctctttggttcgcaatttactctcctttcgccaatttacccatgacaataaatgttccattgagtttgacgagtttggtttttctattaaggaccctcggacccggcgcgtgattcttcgttgcaatagccatggcgacctctacaccctcccgaccgatgcaccttccatcgcctcccactgcaacctcgccacctcctccacgttatggcatcgccgcctcggtcatccgggtccaaccgccgtcaccactctccaacatttatccgccatacctcgctccaagacaaataattccctttgccatgcttgtcagttagggaaacacactcgtcttccttttaataagtccacctccagtacctcttctccttttgaacttgtgcactgtgatgtatggacttctcccgttatgagcatttcgggcttcaaattttatttagtgctagttgatgattttactcatttttgctagacgtttcctctttgccacaaatccgatgttcatcgcca

SEQ ID NO: 72253 - DNA, 26297 bp, Oryza sativa
cacttatgatgcttgtttttgtattctaattactgtgattcctaataggtagctgttagatcttgtttgtaaaaaggaatagctgttccatgatcatgtcaggcatctattgcctattttttgtagcatgatcaaagtaatcctgtcagtggccatctaaaacttttcaaggtcatgtacgaaaatagagtaattcgcacctgcaatgagttagttctctgtggtgtcttgggagtgagaaattacatggtagttgactggtcattgaaccgttcgtttgattgcttaatttccatgttttaaatcatgaaaattcatggttaattttgcaggctacaaattcgatgaacatgatcgcaattcaccccatttacggctccagtttgctcgttttactggccccaggggaggttcaggacctggtggtggtcgtgttaggcgttaagttgttcgtccttttatcaggtgatttgacaactctggctgctcaatgtttttttagaaacaacttgacctcaagttcttcggtggaccagataacatgagtcaatcgcttttcctaccttgtaggcatgatcacatcgaatgttcaagtgaaatgatgatagttcgttggtcgctctagatatattactccatagtgctaggattggtaaccttctgttgttccaagttccaactttggtgccttggctttgtgagatgctttctgacattaactagttattaaacatcaaagctgaaaacaattcgtggcatcgtgcagatgtgatgcttatggccggttatattgggatatatatatatacttctggagacaattttgccgattaatgcgtgttgggagaattttggtgcacatcacatatttgtgtacaacatattatctcccttccgcgtggtgttatatttagtagtctgttctggtttctgatttgcacgactcggcatgcttacattgttttgctacttgtaatcctctcggagattctaaaatgcctcctctggagcgaaaggtagaaattttacagctgcttccatgactcagaaatttcacatgttttttgctgaaactagtttaattcccacaaaacccctccaaaattatgtggtaaatttagatatgaatacctttgaactattttgcttgatgtgggctatgtggcctaggcctgtttagattcaggggtataaagttttggcgtgtcacatcggatgtacggacacacatttgaagtattaaacgcagtctaataacaaaacaaattacaaaatccgcatgtaaaccgcgagatggatttattaagcctaattaattcatcattagcaaatgtttactgtagcaccacattgtcaaatcacggcgcaattaagcttaaaagatttatctcgcaatttacacgcaatctgtgtaagtagtgatttttttcgtttatattaatacttcatgcataagtccaaacatttgacgtgacagaaggtaaaattttgccaatgtgacggaaggtaaaattttgccagaatctaaacagggcctaacagcatggagcaggacgatcgcatcaatcaaccgtgttatcctgtacataataaataaataaaagataccatcgagccataaaaaatgctgaaagagacggcccgcttgcctctattgtaaggcttgtagcattggatcgaacgaattgtcctcctcacagcgacgcaattctcccaaatctgccgtttcattcgtccattagctgaaaaagaaactctacaatctatctataaacagaaggttaggtacctgtgtctcaattttctcactgatgcctacaggtccggagtaaaatttgccgcaccttggacatggactgaaccaaaactttgcagatgcaggcagatttttgcacaaaaagtcaagagtccacataagctactccacggctactagctacaaaggcaggcactctggctctctggcacactggcacagctcccaactcctcccattatccatccatggcgtcctcccatcaccaagaagtacaagagcaaggccatggagatggagaggaagaggaacaagataatagccaaatcacctctccactgtgtaagcacggcaaagcctagtcgtctcagctgttttctttttcccgccatggaacaccactagaagaaagcaaactgttctgttgcctgatgagttcttctcgtgcagtgcgatcctcaatgcggctcggctcgccggaggagaactcgccggtggagcaggtggcgctgacggtgccggtgggggacgacccggcgacgccggtgctgacgttccggatatgggtgctgggcacggcgtcctgcgtcgtgctgtccttcctcaacaccttcttctggtaccgcaaggagccgctcaccgtcacggccatctcggcgcagatcgccgtcgtgccgctcggccgcctcatggccgccgcgctgccggagcgcgtcttcttccgtggccggccgtgggaattcaccctcaaccctggcccgttcaacgtcaaggagcacgtgctcatcaccatcttcgccaacgccggtgccggttccgtcttcgccattaacgtcatcaccgccgtccgagtcttctacgggaagcgcatctccttcttcgtctccctcctcgtcgtcctcaccagccaggtagaggtgacatcaacgtgctgcagtaataacagtacaaggtgtcatgtacactcatgttcatgaacttgagcttcattttgtaggtgctgggattcgggtgggcgggaatattccggcggtatctggtggagccggcggcgatgtggtggccgtccaacctcgtgcaggtctccctcttcaggtaataagcaaatagtaattcacaataatttactctccacatgtgctataaatctgattattcagatatagcttgcctatgattggttaaaaggagttgaattgccacttgtaaagtaatctttccaccagtagaatacattttttttgcgtcgcatgatgtgtgcagccagttgcttgcaattgatgtgttaataaggtacagctaagtgctagactacccaaagataaccaaccaaccaccttcccaaatctcaaaaccaacgtcaacaaaaaaaaagatactttgaactttgaaggacaaataagggtttttattaagctggtgttcaagtcgtatgttgtgtgaacagcactgaatacgatggcactgctattcagcaatatgctaattatataaaaaatattatctgtcctatatcatggttttgtcattttcattcataataagcagagatatattggcacatcatgaattgtctaaaaagtagatattgacataatgactcaagcgaacaggaatcatttaccagtcaattcaataataaaacccacccagcatcatcttcatctgaattctacgcaacaattaggagatttaggcgacttggacactcagctatgcaagtgcatgctgctgcagaaaaccagaattccgtgtatttggagatatcctgagtaataaaagaagcagtcaatcaattttgacagataaaattcaaagaaagaaaacaagatatataaaatatcatatcacttcaattatagacgaagagcagctattaaaactataacaagatttttcgtcccaaaccaaggcataacaattttccatttacgaccaaggaaacaagatcagttacaaccagcaacaagcatcaactaaaccttatacaatatcaagattcatttgagtaaacccgactagacattttaaaacaagatgtttacttccctagaggcttcaatgatttgtcagaaaaacatggatacaatttgtctgcaaataaaaaaaaaggttcagcattttgttgagatgacacttataaatcataataaggcataaatctgtgttgctctgccaatgagtgaattcatctaaaactttcagtggcaatctgaaaagtgagcttaatagccatactggacacacttgcaaatgcagaatcaaattagcagtaaaataataactttctccgtagtcaaaggatggctaaaaaaaaactaccatagaaaagtgaataacagatttgctgcacatgttcatcagggcacttcatgaaaaggaacggaggagcaaaggcggcatgacacgcacccagttcttcttggtagcatttgtgtgcagctttgcctactacattttcccaggctacctattccagatgctcacttccctctcctggatttgttggatctttcccaaatctgtgctcgcacaacagcttggatcaggtctccatggccttggcattggtgcaattggactcgactggtcatccatctcgtcatatctcggaagcccactggctagcccatggtttgccactgccaacattgctgccggcttcttcatctacatttatgtaatcacaccaatcgcctactggattaatctctacaaggcacaaaacttccctatcttttcagatggccttttcacagtgactggacagaagtacaacatctctaccattatagactcacagtttcattttgatacaaaagcctatgagaagaatggaccattatacatcagcaccttcttttctatcagctatggtcttggttttgcatgtcttactgcaacagttgtccacgttcttcttttccatggaaggtatcctccccttccttctccctctaggtctattatgtaaaattagatacacagataaatttgtgacacctgtgtccagtgaaatttggcagctaagcagatcagcttttcaagataaaaagatggacatacatacaaagcttatgaagaggtacaaacaggttcctgaatggtggttcatctccatccttatagccagtgttgcaatcaccatgttcacttgtgagtattacatagaacaattgcagttaccctggtggggggtactacttgcatgtgcccttgcaattttcttcacccttccaattggaatcgtcacagcaacgacaaaccaggtaagaagtaaaagcataaaggcaaatgctaatgcacacatccaagtgtagcacttcagcttattatactgtatgtgacagactccaggcttgaatatcatcacggaatacatcatggggtacttgtatcctggacgacctgtcgcaaacatgtgcttcaaggtatatggttacattggcccacagcaagccctagcattcctacaagattttaagctgggacactacatgaagattccaccaaggaccatgtttatggctcaggtcagcttcactagtcacatgaataaatgggtgtattgcttgtaaaaaaggaggataagcagattatcattttattcagtgttgattatgtccctaatagcaattcaaaaatagcaggtggtgggcactttgatagcagcatttgtgtaccttggaacagcatggtggctcatggatacaatccctaacatatgcaacaccgagctcctccccccaggcagcccttggacctgcccttatgatcatttattctatgatgcatcagtcatatggggccttattggcccacgcagaatatttggtgatttaggcacttattctgctgtcaactggttcttcttggggggtgccattgctcccctcctcgtctggtttgcacacaaggcattcccaggtcagaaatggatcctacttgtcaacatgcctgtgctgatcgccggaatcagccagatgcctcctgccacttcagtcaactacacggcatggatatttgtagcatttttgtcaggttatgtggtctataagtaccgtcgtgactggtgggagagacacaattatctactttcaggtgcccttgatgctggtttggcattcatggctgtcttgctatatttatgcctaggactagagaaaatcagtttgaactggtggggtaatgatttggatggttgtccattagcttcttgccccattgcggaaggtataactgtacaggggtgtccagtggcaagtgcatagccaagtttcttctcatccacagtaccgccggcaatggtatctcaatcatcttaaggaggatgcaaagatcaaagaaccatgcagagaggctttaaacaactcaaaatgaagaccaaaaagaaaatgtccatatgttacaaggaagatgatactacaaggtgtaccgaatacaaaaataagtaaagttatttggtgcatgctaaattgttgccggtgacagaaaacagattatgataatagatgaactgaatttctgaaaccaacactgaattgaaagacagtagccatcgtccatagaaatagttaaagtctgaacatgattccacttacctgtaaaggtaacatcaggatcaccttagcctttaatcatcacaagaaccttgcaggaaaaagtaagaaattcagatgttacttttgctttgagggaaaatgaaacaatacggtcagcatgtaatcctgtatgaaacatggataatataaactgcattatatattgtttcattggaagtataaacagttctgattcatcgtcatgagctagcatatgctactagaatatggtgggaagtgcggtgctgttcacctactatcggcattccatgatttctcaactctataatacacacacacacacacacaccacgattgcaccagcttcagtgcagtatgactactcttacggttctcgctaggaaaataacagagaatgtgaatggacgggtgaatctacaaacgtactctttccgatccaaaataaacttagtgctggatgtgacacatcctagtacaataagtctagatacaaagatattcagattcatcatgtgtgacatccggtacgaggttggtttattttggaacggagagaggaacaaatacagcaagggggaaatcatggagctgttgcccgaatatacttaccacttgccatctcccgcaacaataggtgtactctgaggccttgagcaacacctggtggaatactggagatttggagtgcgtgatggcatcatccagggcgtgctacgcgccagcaagccgggtaggcatttggacgagcaccgtgtgagcgaaaccgacgccgcgccaccagtgtaactttgggaattgggagcacctcgagcgagcgaggccgcacgccgccggggacgaacaggagccagagccggttagcggaggaaggtcttcgcctagggtttaggaaccagaggcggctgccggcggagggcaaggggtgcgcgcggcgcaggagctggagaggtgagaagcgcgtgggcgtttggagaagaagcggatggtgaccgcgccggccgggggcgtgtggagcgcggcggcgaccgacgaggtcgccggcgcctgacgcggcttgccgcgtgtccttgaagatgggcctgaccgggccggccttttagagatgtgggtgggctggatgggctgcatttcgtgaggcctaatagcaccgtggaatacaattcagattagcggacgccaaaactgaagctcttcagagagagccaaaaaaagaagaagaagaagaagcaaactataacatctcttttggacgacacatcaaccaatgcaattcagttttgaattggataccatcaaaacaagagcaaaataacagatgaaagatggaagtataactttcagatgacacaaacttcaccatccatggagaaatataacacatgtttcatttcattctgattctgaacagagattacatgtagaatgaatgatgaaagaatttgattgtaataataatgttgtataataacagccggagacactaatagtgactgtgagagatgctgcccctgctaatctatctactgcttctttgctttctttcttctacatgcagctacattttgcaggggactctctctcaacagccaaaagaatatttataaagaattacaatctaaaaattgaattgaatttgatttaattgaatctttccacctatcaatctataaaacaaaaaactacacctttctttcttctttcttttctctgaatgtataaaagaattgtcatactgtatgaactaatcatcattaacaaaagaagcactgtaaaaaaaggctttgttctttctttctcttcacctaatcaccattcatcgtcagcttagctttgctgagaatgtgatgctgttgtggacgccgacacggtgctgcctcccgcgccgtcgcccgccggcgtccacgccgtcacggtgtacagcggctggtccagccaccggagcgtgagcgcctcgccgccgccgctgccgccgccgccgtgcgcctgcacggtgtacttgtccggcccgaacatcctcgcgatcatgcgcccctgcatcgcctcgcgctcgccgatgccggcgttcttgaacccgccgccgtcctccatgcgccgccgccacccggcgaagctctcgtggcgctcgaaccgctcggggccctcgaacgccaccgcgttgcggatctcccgcgcgaacatctcctccgccttggccctcgcggggctcgcctccggcagccccgccgcgtccaccgcgtcgaacgccgcggcgtagtaccgcagcgcgcgcgcgaaccgcgcctcccacctccccgagttgaggccgccgccctcgtgctcgccgaggaggaggatggtggcgcccgtgctgcgcgctagccccaggaagtcggtcagcgcggcgtcgtcgcggagcaggcggtgcatggcgaggacgcagttcacggccacgcactcgccgcgcttgacgtggagcatccacaggcggacgtcctcgagccggtcgaccacggcgtggaactcgaacgccaggccgagcgcggcggcgacgcgcgccagccgcgctcccgtctcctgcagctcctgcctcgactcgccgactccggtgatccgcacgtgcgccggaggcaccgcccgcgcggccaggctctggagcaagcccggccattggagcccctgcttgatgtcgaagtcgatgacgtggacgcgctcgtgcccctcgaactcgcggaggaggcgctcgttgagcgtgaagtgcaggaacctcgggatgggcgtgatggcgttgagtatccgcagcgccatggcgtcgtcgtcgccgccgccgaaggcgtcgtcggtgagctcccgcggcgggccgatgtcgaacatgtgcggccacatgcgcacgacgcggagcgcgagcgcctcggtgaagtaggcggccacgcggtgcatcggcgtgggccccgccggcgaggccatctcgccgagccgggccaggtagtagttggcggcctcgtggttgccggcggagagggagtcggcgcacgcggtgagcgcgcgcaccagctccagcgcctcccgctccgcctgccccggcgccggcacgccgttcctcgcgtcgaactcgggcggctgcggcggcggcatcatcgccgacgagccgccgtccgtgcccgacgaggacgacgagtcggacggcgacttgctgtactcctccttcttggccgcggccagcgatggccccgcggcggccatgccgtgcgggaacgccgccgcgctcggcaccaagaagaccttctcctcctccgcctcctctccttctcccgccgccgtcgcttgcatcgtccctgcaatggattgatggaaccatacctcatcgccgtcgccgcccatccgcgtccgcttggcgcgaacaatggggccatactcctcgaccgcgtcctcgtcatgcgcccgcttaacggcgcggtgggcgccattgccattgccgccgggctccggcttggcgccccaggacacggactgggtgaccggcggcgcggggtgcgtccggaaggagcaggtggtggcgccgctcctggcgtcgccggcgacccgcggggcggcgccgtcgccgcggctgccgcgcttggagaagccgcaggggaggatgtcgaaacgctgcgcggtgctcatctgatgcctcgacgacgagaacgagcaacccgccaacatcccggagacacgtcactcgccggaacgcgacgtgccaagaagagacctcctcctcctcctgctcctcctcctcctcctcctcgtcttcttcttcttcttcctcctctgtttctcactctgatttctctcacactctctctgtggtatctggctaaggctttggtggaatggaaatgtatatgattcgatgtacaaaagaatgagcagataaaaaccagatgatcttgttgttcttccaaagaatttggtcagtaaatcaacaaagaaaaaactgagaaaaaaagagagagaaataatgtttgtgagatcagatgggggctatgtgtttgtaagtatatatgcaggaaagaatgggtggcttcgccttagaatgcttagtacaaaagaatcaaagaataggatcaagaacaaatgggccctaaaacatgtagaaaaaacaaatcacgaacgatcggacatgccggggcagagcccgcacggcctcctcatcggcgacgacgacgacgagcagcaggcggcgaatcccaacaatacctccattcgtcaaaacaacaaaccaaaagaaaaatcaagaaccctagtagaacatcctaaaatgatggatgcaatgcgaatcaatggcgatggagatggagatgcagcctacaaactacgctatcctagtgatgatatgaaatggaacctactcttgttgcctcaccattaccactcctctctcactaacctctccggtggtggtggtctctgctctcactctctcactctcactcacctctccggtgtggtggaagggaagggaagaagaggccgggaggggcaacccaaggggaggaaaagagtgcgggaggcgcgaatctcgaggcggctcccacgccgtcggatcgcgaccggacggtgcgagatggggtggtccgggatgtgaccgttgcctgattgcctccccccctctctggtcaatgtgaccgttgcggtcaggtgcgacgcacgtgaccaccccccctaacgctgtcacgcacgcgtggacgcggtcacgcagcacgcccccgttcttttgttaccgttgggctcccaccacctgacacgcgtgtctgacgcgtgggcccccgcgccgaaccgacggcccagatcgcgtgagccggacgccacgcggtgcggccacgtcagcgcggcaacggacgctgagctgtacgtacaggctagtgtacagggtggggtacggtgtgctgtacgacgtactacgtggctgtatcctgcgtgtctggtgatgatgatgtttgtgtgtttgccaccgtcggatcgggacacgtacgcacgcatgcgtgtcccgtgttttggcgtcaatgcggggctcagttaatgatgtgccattgctgtcagaaaaaaaagtgtcattttggtacgtgacaaaataccgggtgttttacttgcagacagctattgtcattagctgggttagctgctggtatatttgttttggctactaagtaagctcgagttttgggtttgttttgatcttgaaatgcatcattgtgttgtgccaccacttttgagtcttaatttgtttcttcctcttacttgaaattttgtgggaaattacaagaaatgcgacggtgatgagtagcatcggatcaagctgtacaataaccgttacaattgaaatgactgtttagtacaaccgttatgcgttgccctagcttctactcctaaatggcaacattagtattgcctatctatgaaccactcgtacatatacgcctgtaatggttgatttgcatgatattttgctgtctaaatgttaacattagacgtcggggacgtaaattcaattaccaggttaactacatgtaatatttcacactgtagttcgcgctataaacaaacgttggtttgcttattaacagagtagtttatttcaagtttttttttcaaacaatgtatgtgaaccggcaagaaaacatgagattaaatccacaactgcagttcatagggtccacgtctaactactggagttactcataaattcatatccaaagagccatttgtatttcatacacacagcacctctctaacaggacgtatagtagcagtaccatccaggaacattatggtaacaataaatgaagtttcaatcggatgttattcctggcgcgagcttgaaatcttcaaatcgaaatcttaaaggcacatttcctaaatgtgtgttttatactaataagaatttaacttctcctctctcgtttcatatgtacgcatttcctcaattattgaacgatatgtttttataaaggttttctatagaaaaatattaaaaaacaaaattaatttagttttaagttttttatataatacttaatttattatgcattaatgaatggttctgtttgacatgcgcagcgagaagtttccaaccattttaccgagcacaccctaatttgctttacctaggccgtgtttagttccaatttttttttcaaacttccaacttttctatcctatcaaaatttttctacacacacaaatttttaacattttcgtcacatcgttccaattttaaccagactttcaattttggcgtgaactaaacacacccctagctaaccggagaaagtgtgaggtccaaagcaatagccgttattccgttacaggctttattacaggtcttcttatcgccggtcgtacgttggcccacaatcccggcccgctcaaatcttagctctaaccacgcggcccaacctggaatttgggcccactacacaactggatgttgggcctgatctgcgacaggtgccggcccatatagagtggatcgcggcgcatttaacctccttttccccaattcacggggcggctggcttgacgcgtcatcttccccgcgaaaatttcaaagcagccgaggagaaatccaaaatttccccccaaatctttcccggcacggcgccctcctgctccttccctcgcaagccacccccgccgccgccgccaccaaggcgcgaaatccaaaattcgcgcgcgcccgccgctataaaggcgaggaggggatgcctcctcctccacacccactcgccgagccaactccaatccccaaaccaccagatcgaatcgcggttgccgcggcggaggcgaggaggaagacgaggatgccggcggcggcggcggcgaagacgctggtgccagcccgcggcggcggcgacatggaggagccgctgctggcggagtcgtcggatcgcttctcgatgttcccgatcaggtacccgcagatctgggagttctacaagaaggcggtggcgtcgttctggacggcggaggaggtggacctctccgccgacgcgcgccactgggacgccgcgctgtcgcccgacgagcgccacttcgtctcccacgtgctcgccttcttcgcggcctccgatggcatcgtgctcgagaacctcgcctccaggttcatgtccgacgtgcaggtcgccgaggctcgcgccttctacggcttccagatcgccatcgagaacatccactcggagatgtactcgcttctgctcgagacgtacatccgcgacgacgtcgagaaggaccgcctcttccgcgccatcgacaccgtccccgccgtgcgccgcaaggccgactgggccatgcgatggatcgacggcggcgagcgcttcgccgagcggctcgtcgccttcgcctgcgtcgaggggatcttcttctcgggttcattctgcgccatcttctggctcaagaagcgcggactcatgccgggcctcaccttctccaacgagctcatctcccgcgacgagggtctccactgcgacttcgcctgcctcctctacgacctcctccgcggcaagctcgacgagtcacgcgtccaggagatcgtcgccgacgccgtggacatcgagagggagttcgtctgcgacgcgctccccgtcgcgctcgtcgggatgaacggcgagctcatgagccagtacatcgagttcgtcgccgaccggctgctcatggcgctcgggtgcaagaagatgtacaacgtcgccaacccgttcgactggatggagctcatctccctgcagggcaagaccaacttcttcgagaagcgcgtcggcgactaccagaaggcgtccgtaatgtccagcctcaacggcggcgcttcttgcaaccatgtcttcagcatcgacgaggacttctgatcacatcgactgccatagtagtattaaagtagaaatacatgttctcccaaagtgttcgtatggtttcttgttttatttgttctggtttgacatgtactcctgtaatgaatcaagtaaaaagtttctcaatacatcaactggtcattgcctgtatgcggtgtgttcgacgaaatgcttattagaactcatgccattctgggggcgcaaccagggcgttcgatgaaatgtctctgagcataagatgttccaagcgaaggagattgtgttggggaaatggattatggatcgcttggctccagccgcacgcgcgtcgcctgttccgtttctgttcaccaatccccttcccttcaatccttcccgaaagacgaaacgagcgccgcgccggcgactccaaccaaccgtccaacagaaccaagagttggagacttgctgacagctgactttagcattcgttttcccctgttggcctctcctacacatgaacacatctgttttagagctaggagagagtttaagagaaagggttcagatcggcgattcttgcagacaaccatggtatgattttcttgattattacataggagtacaatacaactaagggtgtgtttatttcacgccaaaattgaaagtttgattgaaattggaatgatgtgatgaaaaagtttaaagtttgaacaaaaagtttggaactaaactcggcctaatatatttttttgctgccttgcaaggttctaaagactatataatatatttttaggtgtttttttaagagattagagcttgccttcttcatgtttcgttgacacgttttcagattccagccgatttgcaatttgcaaatcaaggtactactatattgtacatttgtactactgttcttggtattatgtcagtcaggaagtatttatctagaagtgaaaaaggaaaaaaaaaaggaaacgagtagatgagttaactgaatcttaatgggagcaatcgagaagttctttaggaataatactgattcctttagaaatcccgatgaattggctttagttgttttcaacgagcaaattaatgacagttctagagaataccaataaggcaatagcatcaatcagaatgaagatgtcaataacttgagtgagcatgaaacctaacatgattcggctgatacaaattctgtgggtgttgatgaacaaccaacttttgctattgaatttttgatccaagaaattggggtaatcttgataataaagcaggagatatctaaataccgatttcagggtgcaatctctaccgaatcattgggccacgtggccaaagctaaaagcaagctcacatctcgttaaaatgtgccatgtgtccagaagagcacgttccattccgcacgactgtgaagactctagataaaacaaaggaaaaatccagagcattccaaactcggttgaaaatcacaccaaaacacggaaagaactggtgaaaaagattgcataccgaggaaacaatggagaagaaaaaaaagtgtctaaaaaagtgccccaagttttttaaaggaattttttttaaatctaactataatataattgtaatataattccactataactatactataacaatattataacttgtatataaggtcctttttagttggtgaaatgaaaatttttgggtatcacatcggacgtttgaccggatgtcggaaagggttttcggacacgaatgagaaaactaatttcataactcgctggaaactacaactatactatactatatattgtagttacactgcaactatactatagtaatatttgaaagtttttttttccaaaaaatataaacagcgagccgatgttagctgtcgtaaaccggcgacgaggaagacatctacaacagtattttccggatccacggaagctatttccaacgagcaagatccactcactcaacggatcaagcgaagggcgtcgagccgtaccagctgtgatggtccgcgagtgtggacgcatcaaccagccggtgagcgtcgaggtcgaacacgtccacgccatccacggtagcaacgaccacgacctcgagctcgaccacatccaggagaaagagagagggatgaagaagggcccaatgaggatacccagatttggaggatcaagggacgagggcgatgttgcctctgctaccatcatcttcctctttttctccttattctcgcaagcgtcatcttcctcaattgctcatgcctttctcccagcaccgacgcggcaatccggccttgttctcgcaagcgacatcttccccaacggttgtcgcctttctcccagcaccgacgtgccaatccttgttctcgcaagtgtcgtcttccccaaaggttgtcgagctgagaggtaaaaagaaaagaaaatattaaaacatgaggttttatcaacacttatcataaaacaaacaaatgataaccgtaatattgataagtatatgttaaatattataaaaataataggtatatttgttaaaatattattaaaataatgtgagcgatgatgattagatatacttacatgttgatttgtagaattaaataaattatagatgatgttatacgctagcatgagtttaaatatataaatattgcttttatctgtagtgattgggccacgtgtcctctctcacatggtagataaatctggagaacaccaaaaggggaaaaaatgataccaagagttgggcagttgtgcgtcgagtgcgaaggaaaaaacagggttgtgggtccaatcaatggcgtgcccacatataacttaccggtgtcacaggacaccgggtaaaattgttaaattctaactaatttatgctattttgattagtatactagtgaataattagataactactatgtagtggacctcgagtaatgtagtggaccccgggtaatttttattctagattcgccgctggctccaatcctcccttgcagatgaaaggataatctaaaaggatcgattaggcaatcagcaaatgcctctgtcaatggagccaatggtggccacctgctcaaaatgtatacgttcgctgtgtgtctaggagtacgagggaagagcatggctgtggcagctccagtcctctcacgcagaggaaggataatctggaagtatctatatatcaggggaaggagcaaatgcctctgtcaatggagctcacttgctctacatgtacatgttcaaagatagagtattctatagtacatttgcaaaaaatgttagaatgcatatacaactactcatattcatatatatctctataagtattttcgaaatattgagctgcatatcttaaatgaaaaaaaaaactattttatctcttcgaaccaattcaatggacactactaaaaaaatctatcatgagttaataacttaattgtaatttaaaaaaaacaaaggaataactaatggcatggatggaaaaagggagaaaatttgatgattttctcaacaatatgatctattacgttaaactggaactcaaaaaattccattcaactaagatttttttaaacttttatgaacaatgtgctaattaataacacaaaaataatatatacgggctataaatcatgcgcgccaggtgcgcatgattttctagttttagtggaaatggggcctacaagagaagaaaatattgttttttttgttgtgttcaacttatgaaaagtattattaggcgattggaaattggaatgacagttagtatgacttacggatgtttttgttcaataatataatgaattattatattcactattgcaaaaaaaaaagttatgagggcctctatctttatttcacccaagggcttccaagaagttaggactggccctgaataaaaccttcattggaatgaatggatgaattttcagtgtttgttttgtgagaatcgaactaatttcgatgatgatcctgtgaaatcttaaactattttctcactaattacttcaggctgtgtttagttcacatcaaaattagaagtttggttgaaattggaacgatgtgacggaaaagttagaaatttgtgtgtgtagaaaagttttgatgtgataaaaaaattggaagtttgaagaaaaacctttggaactaaacacggcctcaatcttcgtaaaatttctccgaaattcgtcaagtccaaaggctgcatgccttgctgaattctgtccacacaacaaacgctggtctcgtgtcatctccacatcgccggagaagaagacgatgatgacgtcgacgacgatggcgaggcccacgacgttgctggcgtgctgcaagctctacatctccgagagccgcaacgacgccgccctgcgcgccatcgagcaggcggcgcgcggcggcggcggcggcgccgtcgtcgtcaaccgcttcaccgacgacgcctacaaccgggtgggctacacgctcgtcgcgccgctcaccccctcaccggcgccgccgccgctccggcacgccgtgctcggcatggtcagggcggcgctggaggccatcgacttcggcgcccacgccggcacgcacccgcgcctcggcgccgtcgaccacatctgcttccaccccctcgcccatgcctccctccgccacgtcgccgacctcgccggagccgtggccgccgacatcggagacgagctccaaggttggtgctgctctccactcctcttctcctcaattttcacttcaagaaacaatctaatggcgagctcgccgctgccgaggccgcagtgccgacgtttctgtacggcgcggcgcaccgggaggggaggacgctggcctccatcaggaggcagctcggctacttcaagcccaactcctccggcgaccaatggcggggagcgccggagacggacgccctgcccgtcgcccctgacgccgggccggagaggccgccgagatccaagggcgtggtggtcgtcggcgccaccagctgggtcgacaactacaacgtgcccgtccacaccggcgacgtggaggcggcgaggcggatcgcccgcgccgtcagcgagcgcggcggcgggctcccgtccgtgcaggcgatggggctcgcgcacggcggcggcgtcgtggaggtcgcctgcaacctgctcgacccggcgagggtcggggccgagcaggtgcagggcatggtggagcggctcgccgccggcgagggcctctccgtcggcaagggatatttcactgatttttcccaggataaaatcgtcgacttatacttcagatcagcagccaacactgagggttaactgcagcgcgagtgaaaagtaaatctttacagaaataaatttgatatgatttcacagaaacaagctctcaaccagtggatcactgatgagttctaagttccaactcaagaaatgcaatcacattatcatgcgtaaaatttaccaaaaaaaacagaacaaacgaattgattcaacttaaacttcggtctctgctatatatatatatagagattacatctcaactgctggccagttgattgaactaatcatttgcatatcttgggctacttaactcctgactgattaagctaaacctttagtttgtaccgtgatggccacttgattgaagcggctagctatctctctagctaggctcagtgaagattttgcgagggaagctgagattttagaagaaactgagagtatgtctaaattttcagtgaaattccacgtttctctccattagagttaagtgagttttttaaagaaaattgttactatttccactagcaaggtatatgagacaatatatcgttttccaagtgttgtcactagttaccaattgtttcttacacttgccatctcataaacccactaacctcgcgttattaggtacccatatataaagaaaaataagcgatttaagcatataaactccattgcttagctcttaacattatagcactccctctctctctctctctctctctctctctctctctctctctctctcttataatagttgtataataatatgaaagggaagaagtgttattcgagttctcactttttcttttttctttttacttcaattcagcagactgatttttttatgacacatgatgtatggtatctcgttggcgtatctcagtgaaaactatcatgatggagaggattagaaaagtcagaatatcattggtagtataaaaaaacacatggaggcaactggaaaaggcacaaacaaatctaaccagacttagtttggactaatcagctcaggtcacagggagctaaatgcttaggcttgaacaacaactacagtaatcctcctgtccacttgtgaaacacaggtagaggagatgtagatccagaaaaggcattcttctttaactaaggctgagtttagatccaaagtttgaatccaaatttcagtccttttccatcacatcaacctgtcatacatacacaacttttcagtcacatcatctccaatttcaatcaaaatccaaactttgcgctgaactaaacacagcctaacctcaaattaaacaatcacaatggactgatccccagaaacatttcgatatccagagtcttcttgtgcattcatagaagaaaatattcagactttttgcagatctgaaccagcctttgtcagattgggaaaatagctgtttttgttgttgcaaggatagattcttacatacataccatggttggtggtgtcatgtagaagtagttagtttcagaacttgttggccggttgttgcctaccctgtttgtcactgacctggttagatatctctgaaaagaatgaaaaaaaaaagtattagctttgacaaacgcacacacccatccaataaaaaacaccattcgtgcaagtacaatcctgtggtctgtcattctgtaaatcaacaagaacatgagcagcaatttttcaacgagaacacaaaagatttgcgtgaataagagcaacaaaaccaggccaataaaccattcttgacacttgacaggatacagtgacactgtgttgttgcacatggtaatggcaatcagctattgagctcaccaagcactagcatccatgacactatgacagtatgacatcttgcagtttgcaacaggtgtccaccttccatctcaagcaagcacctttcaaccacctcccctctcttcctcccttctccacacgatctgaattgcacaacagtgaacgaatctgaactatctgaccgaggagatagcaaatttcagttcttgatcggtgattgattcagtgattattcccaaatttccagtagctggcaaaggggaggagaagtcagcggccatgctgctgcgtaccatgaagctcccgctccccgccatggccgccgtcgtggcgctctgcgccgcctcctacctcctcgccgtgtggacgcaccctgccccgccgctccccgcctcctccctcgccgccgtcccgtgcaacacgcggcagccaccggcgcccgcggcctcgaagaacgacaccgccctcgacttctcgatccaccacggcgcgtccgaggaggacgcggccgaggcgggggcgccgccatcgcgccgcgtcccggcgtgcgacgcggggtactcggagcacaccccgtgcgaggggcagcggtggtcgctgcgccagccgcggcggcggttcgcgtacagggagaggcactgccccccgccggccgagcggcggcggtgcctcgtcccggcgccgcggggctaccgcgcgccgctccggtggccgcggagccgcgacgcggcgtggtacgcgaacgcgccgcacgaggagctggtgacggagaagggcgtgcagaactggatcaggcgggacggcgacgtgctccgcttccccggcggcgggaccatgttcccgcacggcgccgaccggtacatcgacgacatcgccgcggcggccggcatcacgctgggcggcggcggcgcggtcaggacggcgctggacaccggctgcggggttagttacttttaccgcgtttacttctcagattaacctggtgatgatagtcactgactggtgggcccagtccccagtgcagtttttccttgttggttgactggtggtcaacgtaatctcgaccgcacatctctgatctgacggctagtggtagagtttgactggttgaggttgatatttcaccatcgagtccctattttattttccaaaatttgtttgcaattcaatccctatgaaattcgggctgctatcaatatttctccaccacagttgtgttgttttcatgtttttttttactgtttcttgatcatcagcgcgtagatcagtgtacactttttggagcttgtgttgtgtaccagcgagttaaacacccatgattgtgtttcctagtgctggtttgtttgtagtgaaaaatttcctgatgtagcgagttaaacacccttgtttttttctatcgtatttttgccaaaatgtaggggaaaaaacccttttttttagccctgcgaaaaaagtatggttttttttctactgggtaaatgcctgtggatctccatgtagtcatctgtgattaacaccttcaccagttatccttgccttatctgtttgttaattgttggattaaaaatgccactaggatagttgaatgttcacaactagtactagacatagagtacatggatgcttcgaggacagacagcaaaattagatatatttggatcagcttctggatgtggatcaaagctggttttatgttaactaagtaccctctccatgtgtagagtcggtgtgagaaattgaaaaaagaaacaatggattaattgatgttaggtctgagtcggtgattgatatctagtttggtaggagagttcgatagaagtgtgcacatggaattgtgtactgatgagagcttatttggataagaaaatactaatcatagtccaactaaccagacggcagatagctttatctgaactcaactgtgcatctttggatctggttgctcgtactccctccgttcttaaaaaaaataatcaaaaatcaagtttttaaattagaaattggttttctttcaggacgaagagcttaccttactaattgatcattcttgctacctttgtgttcactgtaaagatggtacaagatgtctgatgcgacatatatatccagctatcaacactattgaacaaaatgtccaagacatgattttcttcccccttgttgttggcttgtgtttcttggctaacttcaaccggagtacgacgagtttaacactagtatcgtttacccttcggcctgtaatttaatcatcataaataaaacgatggttgtataaaacgcgtcaaataagatttctcgtaaacaaagttttttcatcagacaaatcatccttactcgggaaacactcatgcatgagtcaagctgttggctatgacaattgatgagaaatgcccaggggttttccggctagctccacagggtggtgggctagacgacttgggttcagagcttcacctcttctaattatttgatattaggtcatttcctaatatccgtgtcttctttgctatgacaattgacaaatcaatctgatgctaatgtgcactgtctactactctgaactctgaagtgtgaacgaaccacatgtgcaggtcgcgagctggggagcgtacctgctgtcgcgcgacgtgctgacgatgtcgttcgcgcccaaggacacgcacgaggcgcaggtgctcttcgccctggagcgcggcgtcccggccatgctcggcatcatggccaccaagcgccttccttacccggctcgcgccttcgacatggcgcactgctcccgctgcctcatcccctggagcaagtacagtacgtgctttgtaactccaccacctcaaatttcacccctgcaaaatcaaacttgtgcttaatttgatttggaagccaccaagttgacaggctttttcgaagttaaggacgagattcggtcaaacttttgaaattccaaccatccatggataatacctcaaatgcttattttaaaaacgaaagaagaaaaagtactaaagtagtatcattgtatcatacttattataataaaaaactagcatggtggcccgcgcagattgcgcggctagtatcattatattttctctcatataatagcatatatgttttctcattatattattcaaatatattaaaatgacaacataattttaaattttgcaataactttacaaaactactaatgtgtaatattcatattatattttatatatgtttagttattaattatttttaatatcaaattttagttatttgtaaattatatatattcctatatggactctagacttgtcttttaatatttattttttctaattccgaattttctgtaaattatatttctatataggctctatgctcttcttccaatattatttatttttatttttgaatgttcatattatattttatatacgtgttagttattaattatttttaatatcaaattttagttatttgtaaattatatatatatatatatacatatatatatatatatatatatatatataaaatttaaaaatatatatatatatatatatatattcctatatggactctagactcgtcttttaatatttctttttttaattctgaattttccataaattgtatttctatatagactctacgctcttcttccaatattatttatttttatttctgaatttttattatttctaattgtatttctatgtggactctaaactcatctttcaatattctttaatttttagttttgaatttcagttacttctaaattgtatttctatattgaccttaaactcttcttcccatgtttttcttaatttcgaattttagttatttgcaaattatatttttatacgaactctaaactttacttttaattttcttatgtttattccaaattttatttagtttaaaatccctatatggactctatactctacttctaatattcctttttttaattccgaatttcttttttttcttaattgtatttctatatggactctatactctacttctaatattccttatttttaattccaaatttatattatttcctaattgtattcttatatggactctatactatacttttaatattccgaatttctgttatttcctaattgtatttctatatggactctatactctacttttaatattccttatttttaattccgaatttcagttatttcctaattgtatttctatatggactctagtctcctcttctaatattccttatttttaattccgaatttcaactatttcctaattgtatttctatatggactctagtctcctcttctaatattccttattttttaattccgaattttaggtatttctaaattgtatttctatatggactctgttttttctttttctccgattaatgtgagaatttctaggccatgagagcgaacgtagaaattctattcctttaataatataatagatttttggtcgggaatttcgaagtttgattaaatcttgttctaaacatcgaatatttatgatcggaggggtagctttgattgatcatggcaatatcaacaatggttgttgcatttcagacgggctctacatgattgaggtggaccgggttctccggcccggcgggtactgggtcctgtcagggccgccggtgaactgggagagacatttcaaggggtggaagaggacgccggaggacttgagctccgagcaatcggccattgaggccattgccaagagcctttgctggaccaaggtgcagcagatgggtgacattgctgtttggcagaaacaaatcaaccatgtcagctgcaaggctagcagaaatgagcttggtggtcttggtttctgcaattccaaccaagatcctgatgctggctggtatgcatgtttatcacctgaaaatgatccaaacatgattccattcgaatgaaaatttaagatttgatttgattaacaatatgtagttttacacattataccttaaatctgtagtttcgtggtaaactcggcattaaatctgtagtttttttatactccgtcgtaaatatgtagttttacaatagtttggtcaaaatatcagtagttttcggaaaatactaaaaaagggggatcc

SEQ ID NO: 72254 - DNA, 4056 bp, Oryza sativa
tactgtagcatcacattgtcaaatcatggtgtaattagactcaaaagattcgtctcgcgaattagtccaaggttatagaataggttttataattagtgtatgtttaatactctaaattagtgtataaacatccgatgtgacagggacttaaaatagtcactgtttcccaaacaggccctcagttgcatggccctgaagaggggagcagaggaggtttctttcaatttcatttcaattggtacaaggaaaagagaaaagagtgatgggataggagtcctcatacatcttggcactcacaatggcacccacatgccacatccatccgttcatccatcaatgcctcctgaactgaagcatttctttgaacaccatttctagatccatcatggaatagagatagcctcccttgtgtagaagagtagccgtactgtagtactgtagttaaggatgtgagaggtttcttgtaggtgtgaaaagtggctgccatgtggggccatggtcgaacaatcaaaacaaaagctggtgctatcatcttagggggatgggaacctgcagtgcatagtactgtatatgtatggtggtagactgtggagtgtatgctggtagaaaactttatttattaattatactactcccaaccaaaggtccttctatcaccttcctataggagtgctgcatttttggagtatgtgtgtgtccatgctccataaatttcaagattgacaaaatgctgcattttggatggatatctgaactttatactctatccagtactctttgttaggagtatatgatttatgaagaattattgaggtctaatgggtttttatgtgatagcatgcagtttcttagagtaggtgccagaagagcatgggttcttttaccactaaacttcatttgtctatgcaaaaatagtaactagtggagtaagtaaatagactagactaatgactgtacttactgtatgaaaagctgcaaaatatatataccttgaaattcgggcattgggatatggcgtcaagatgataccataaacctgcaattggtgctgaaactgctgaacctgagatccacatcatcaccagccagggtatgtaggagaagaggaacattctgatccaagtaacctggcccacccaccagtggagcacagacaactgggccctcaccacaggccccacacctcagcacaaaacaggattatcagaaccattcaccattgccactgcaattccccaggattagtaggcgtttgcaggccaaagccacacagtgacacatattccctctctgaatatcttgcacagaagatagctgctgtagagctgagaggaaaagatatggcttttcagttacagcaacaactttgcatctgatcagatcagatcagatcactatctgtggagagagaccagagaatgtgattgtagtagtagtaataaccatctaattggcttaattactctggtcaagtggtggtcagctcaccaaaacaagaatcctaagccaggattgcattgatgatcccagcctgatctgcttccttccttccttgtcacatggccatgaagaacaagtctttggcgacactgtggatggacatcactcctcctaactaactcggccgcccaacttaaaaatcactgctccctcctctgcctccatcgccatcaccgacaccagccgacccgacaaccaaatctacttatcaaacccgtcacgagtagctcgcagctgccactgcagcctaaattctccaatttcttatctatacagggatcagaagcattctcaggacggttgtatcatcttgatgtaattggtcgagttcagtaaactctcgccgcgtgtcatcggatatcggcggtttgcaatcactcactgacaggtgggcccctcgccagcatgtgaacttcgtcccagctcacatgtcatctgcaatcgatcgaataccggtggtgagatgaggatttgtttcttggttcttggtaataagaaacagtgaagttcgtatgctcatgatcaggatgtacaggggaggtggaccaaccataggtggtgtggtgctgctgctgcgagatccagctctgtgcgacggcacatgcattgcgtccatccgcgccttttcttttcttttcttttctccgtgatgctgcgaaaaatcgcaaatgggggcgctaaatgggccatgcggatgagtaaacgtccacctgctgctgctgccatggcgatcgcgacgctggcttcgtccggacatgattagctcctcgtcgcctcaccaattggccaccaccaatcattcttctccaatcatgagatggcttatctggattctggatttgtagagcttgcttagatctgggcatcagctgataaaaatggctatatgattctggattggtagagctatttgcctcagtttgaaataggttattgtacatattgttgctgcagattatctacttgattatattttgattatatggatggacaaaatattttgataaataaacttaacaaatgacctaaaataagtgatctaagaaatacaatatataatataagaaagtttttttttgagaaaatgcatttttaaagcgtggagcgcaaataattcgtttcaacaatccaataaataattcaaaaagaactaaagccaaaggttttaatagacctgggcatcaactgatggttcgctcgtgtgttcagtttcagttgtgatggcatctcaagaatttgatcttttcaggctttcagataggcctgcaagagggcagaaagagttcggtttaagtgacgataactgaaataccagtatatggcatggaattcgaaagtatctgcacacggtacaaagaaagtaacggaacagtggtatatgtaaatttttagcagtgtttgtttacatgactgttttggtacgggttgaagctatgggcgtttatttacaccgtgagttcatctttagcttcccctctcaaatggctcatgaaatatagggttttcttgtacatgtacatgttacagatggcaagggatatcaatgcctgaatgggcgcgcgaccacttgcaaaccaatagttatgttgaggagatggtaatactggccaaattaaaactgctgatgcatagggcgcaccattgtctagtgtcaacttgaaccaaattcttcgttccatttctctagctcgtcccacttgctcttctgcaggcttggcctaatcacagtcatggctttcttgaaatcttcgtatttcaggggccgcaactacaatgaagtaagaaaaggagggatatgattaggacacttcagaaagctcacactgtatgaagatgtaactcgaaatacctgatttgcttttatagtgagaatattttgtggaccaagctctctgattggcatcatggcagcttcctcacacaatgctctcagatcactcccggaatatcctataacatatttatttcagcaccaagtaacacatatgtcgtcttatcagaatggcaatataccagaaaaataaaactaccttcagtatctgcagcaagcctttcaagatcatgacctgaaaggggacagttccagatttagagtggtactacatatacaaaagccgaaagacatgcagacatacagaataatctgggaaattccccagttctttcgaactagtctttccacaatgcagtgatcactaagtgagaagtccatgtttcaggtaaggaacaaaaggctgatttccaaagaagcttttagtatgaaaatccagagttggtgacttttgaagggggccattgcaaatttaggtcactgtgatttttgaaaactatttagggatcatctaggaaaaattaaattgtgatatagactcaatcatgttaggattaaaagaagaggcgaaaacatcattttttaatgatctccagtagtcaaatattcaaatatataaactgtaatccagggcgaacttttgtttccaagaaattttacttttggttaatgtacttctgtgaaggaatgaacactagtgctgtagtccaaagaagctaccaaga

SEQ ID NO: 72255 - DNA, 2683 bp, Oryza sativa
atcctccggttcaactccattttgagatccgacctccggaatcggtactcctccttgtcgacgaggaaggcatagtcgcaggggctgaagtccacctgttcgccgcgcggccattgctcgaagtagacgacgttgtcggtgagctccggcgggatgtcgacgtggcagcagccgacgccggcgcacttgccgtccatggcgctccgcgagtcgctgcagtaggtgacacagccggcgtagtagaggttgcggtagaggcctttgccaccgctgtccccgtgctggttccacgccacggtgttgcagccgatgacgacgaacatgttgcgctcgtcggagatgcggtacacgccctcgttgttgagctccacgtcgccgtcgaactgcctggtgacgttgccgccggagttgtagcacgtgtacgccaccggcagcatcaccttcacctccggccgcgggaacaccgtcagcttctggacctggatggcatggcggcgggcggcggcgagggtgggcactaggacaccggtgctgttggtggtgttgcaggcgatgtcgaagccgtccccgcgggagcagttggggccgatgccgaatggataagggatatcgacgtcgccgcacctatccgggcagccggtgattccgtcggcggcgaaagcgaaacggagaagaagcagcaggccgccggcggcaattagccagaacgccattcaacttctgtgcaacagctacctcttcccgcgcatatttatatttcaattggatcgacgacgatatgatccagtcaaggaatatatatatatatatggagagcagaaatcaacgatctgtcacttgctactaaaataactccatttctagaatttagttcgtctaccctttgtactaagataaatttattatttccatactctttaccaatccacccaataatactgctttggtactgatgaatgactctttaatcttttttccactatatttgttttgagcgtccaacactaagataaatttatttttggcacggaggaaatatgaatttaattttgcttacatagtgataagagtaagcggccaatatatataatcaaggaaaattaatgcagatataatatattggtactttttcctatgtccattataattggttttcgtctcttatagtttgtatagtttgtgttagaggacgtactcgtagatatatgagtatggtgttgcgtgtaataaaaaaagagagagagagactgaaaataccttgtatagtgtgtggagcacctagcatatatattgcacctggttaaatctttgaacttatgcgttttacataacactccccgctttttagatcataagtcgttttgactttggtcaaaatcaaactgctccaagtttatataaaaaaatagttatattttcaacccaagataaatataatacgaaaatatattcaattattgatttaataaaactagtgtggtgttgtaaatatatataactagatttgtctataaagttagtcaaatatgaagtagtttgactttataccaaagtcaaaatggcttataatatgaaacagagggagtagttgtaaacccactctttgcttcaactgagttaaacttcagccacttagttcttggatcaaagtccaagtaaagtataacaaaataaaagaaagggagacaaaaagatgacaaaaaccaacacaccaacaccaatcacaagaaatgaacatctaattcaaagttcaagtctattgctaaatcgttatacaaagttggtgaaaatctgcatgacaattaactctaaatttctacattcggtgtgcatggcttccttgtcctcttcacatctttgtagcttgatccagaatcgaagccaatatattgatctgaataatacctacatataccattttgttggagttatgttaaaagccatgtcatttctattaagccattaagcctaacataatgcaaatgcaccaattaaaatatatttcttggtttttgacttcatgccaacaggccggttcccaaaatgtgagagacattacagggacttcgcaaaccaaaggaaatgaagactgctctgcatagaaatttagcaaaatgacatttaaagaatagatgttagatagtttcattatacataaaaaacaacagtttgtactaccattccgatttctttttgctaaattatctttagtcaacacaactcctttgattaaatagcaaataaaaatcttcacttttataggcatctttaattttcataacaccttattcctatccactttcccattacacctgtcactacttggcaatacaataatacaattagtattactaattttgcttacgtagtgataattaagaggcagtactggccagtacgatatatcgagcaaaatgtggatatgattagattggtacccgtttcttgtgtacatgcatattgtccattaattaatatatcaaagagagaaattggagtaccttttatagtttaaatttgtgtggacaaacctagctagcactagcagattgcaccatcctcaaatcgtcaaactcaaacgttgaacttcttgtatccttagccagcacaacattcacacgtactgatccattttcttatagtgtgccctgcctgcttagcaacattatactccctccgtttc

SEQ ID NO: 72256 - DNA, 2429 bp, Oryza sativa
acgaaacggagggagtattaacatagcatgtatcatccatcgatcatacactacttaaaaaaaggtttttcctgccggccaaaacatgttttcgctgacggctggctgtgccgccagtgtcgccagtgaaaataagtcatttgtgctggcggacagccgaccgccagaaaaaatcagttatcgctggcggcaaagttaagtcggccgccagcgaaaatcggccaagctaagatagccaccagcaaaagtcagtttttgctggcggcagagttaagagacctgacagcgaatatatttttggagcaaattttttttttttgaaaatttggatccataacaacctgcagaaaatcacaaattcgaaattattgtccccaaatcctaaatcattgtcccaaatccccaatcacagttcacatttagctgcagaagtaaatcacagtcacaatcccaaaacaacaacaggttgccatcggtgagggagccaagttgccgtcgtcgagctcccgctcaaggcagcccagggccgccgtcgtggtcgccgcgcggtcgctgttgtcgctgcccgccgaagcccgcccgcgagaccaccgccgccgccatcgtcgccacccgccgaagcccacgcccgagccgaagcgcgtgcacgcgaccaccaccgcctgccgaagcccgcaccctcaccacgttgaatccgtcgtccgcgccactcccgccgcccgagcacttcccgctgctgtctggcggacagatccgacgcccgcgcctctcccgcgaccggatttgccgcctgcggccctctggcggccggatttgccgccggcgcctctctcgcgccggtcgatgcggcagctcgacgaggaggaaggaggaaggagactcgccagatctggagggcaaggggaggccgcaccatccacggtcagctccgcgccccgtgcaccatgtgcgtatcgctggcgtcgccgtcgcaggctgccggctgccgagaggagggggagaggcgtgggtgtgggaatggggaagaggcgcgggcgtggaggaggaggaggcacggtgcagtgctgagacttgagagagagagagagagaaaatatcgatggggacgcgtttatattatcatgtggctaactttcctggcggtcctctttagcagcagcaagcgaaaataactttatttttacaatcggacctcttaactaaacgctagtgaagattctccatttttgttggcggtggtttaagtggttcgccagtgaaaataaagatatctcgctggcggcccgtctaacgctgccgtcagtgaagatccattttcactggcgataagtgcccctcacccccctcattatgtacttgttggcggttttcgtattttttccgccagcgaaaatcatagggcaacgccatgaaaaatcttttttctagtagtgatacaacagatcaacttcaaaaattaatttattcaaaatgaagaatatataataaacaaattcggtgatgcatcgtgaattcgtgatagtactatttatttcaaatttgtgtttttggttatatgatgtgtagattgaaattaatgttattacgtgtttgtggagacattgtaatgtatgctatttttttttaaaaaaaaaatcgtcaccaccattggatgacgtatggcatatttggcaatgtaaatatatgcgcaacagctgcaattccacacaactgttgctgacggcagtggtatacgtactacgtacgtcctttatgattggcacaaattgcatgaaaactattggtaaatatgccaaaatttcaatgtacggttgtgccgtcccaatcatatcgaaaatatcagaacagaatgcacgacccggccgaacttgtggtgcatagtttgtgacgtcaaccttcgagtgtaatgaaataatctccgacatcaatgttgtacagtggttgaaacatatattgtcggtcagtcatcaaaactaaagcacacgagatgaatctgatatcttggatgtgtatcatatgttgcaacgttgacctaagagcatgtctaataggccaacctagctggactggcgatagcgttgggaatggtagagagagaccacgagtcgacgatagaattatcaccggctgtagcacgcggtgcaatgaagaaagagaaataagcctgatggagattggttcgtgcttggaacaatagtaaataatgtagtaattagtaggacccatatcaattaaaatatatattagctgttaccacaaatgatagtaataaagaccattgttatatgagcagcctatagtaacgggctatagacgatgtggttgttttatagctagcaaattgacgatattattaaacctgctctaactaaggttaattttgttccgttaatccctaaaggaaggtctagaaaaggattaaaggtaat

SEQ ID NO: 72257 - DNA, 1651 bp, Oryza sativa
caaaggccagatatgtgctttgtagacatcgaggttggcgccacctaagagatttcttttctcatcactgagccaacctagcaaagactcaccttcgctggctcttctccattccaccttgagaactggcaatccccttgaccaagctcaccatgtccctccgcactagcattgccatctattaattatcgattcttcttggcctctgcgccaacgccctcaactccatcgcctcatggagcaacccccgagctcgaggcggtggggttcggcatccctcgaccttggggagacccgttttggattccccaatcccaggggcacctaatctgattgctttaaaggtcatggtgggtgcgactggtctgccctttccttatggtgcaatggcatgaggtcccggttctaatgcacagtggcgacaatcaaccttcgtgccaatggcaatgggcttctgaggggatgtcaatggtgatggatctggttagtcaatccttttcatcgaaggccccggttataacgcacgatggcaataatagcaacattcgtgtcgatggtgatggaactccgaggggcatgacaacggtgagggacctggttagtcaaccatcttcatcgaggttccggttccaatgcatgtcattgacaatagaaggtgggctttctgagggccatgacaatggtgacagatctgattagtcaaccatcttccctcttctcaagcttccttggtgttgccctgctctccttcgatgcataatctctatttggctcctctatgtggatagcgacagcctgccttgacatattgtctccctggagcagctaatagctacgagtagtcaggcatattgacagcactggcgagctgacctacgggcacaattttagttgtattttcagcacatttttggtggaatttttctttatcttagcacattttttggttgcattttcctttatcttggctgcgcgatcagttatgggtcaccatttaataataataataataattttggtgggtaacccattatagatggggtcaccatggtgaaccattcaagtgtttatcgcgtgcacatgcgagacgagcgaaagcacgtgtttcactagctatcttcaccacatattactaaagtggctaggagagcgcacactcaccctcttttaagaagttatccatcttctagaattagcaagacgatggtactaaatatttacatatatactacatccattttttttttttgaaatgggtcttaatgatttccctaccaattattgtctatatgggccttagcccacatgccaatttccatatgtagatgatccacgtcatctctgaccgttaatatattatgttaggtgggtcggtgcactgacataagtaggggttatgtggtagtggggtttcattggcttaatatcgaggtaaatggtaattatatatttccctcggtttcataaggtaagcctttctaccatggccaccattaatatagaggttaataaatttaaacatatatgggcaaatagattcattaacatctatatgaatgtggacaatgctagaaagtcttacaatatgaaacagagggagtaactttttctctccaatcttaataagatttagttgggctctggcccaacc

SEQ ID NO: 72258 - DNA, 7378 bp, Oryza sativa
cttaatttttgaggattttactttaaaaaaatatgctccaatagatttcctattcagatgctaaacttgtggagtttctatcctgtaatattcgctctcaatactgaggctgagtgagggctcctctcctattcccaatcctacgctcccgcgtcttctcagcctgcgaggagtgaaaaatcatctttttcgcgtggctatgtcaaggcgtctccaaccaccgccgctgactcgatctggtcagatcgagcgccctccgtccaggtctccactgctagcatggagcctcatctcgtcggccctctcatccatgtccactgggcctgcgccgatctggacccacctttttccctaacgtcacgctagcctcctccgcctcgtctcttgattttcaccgccgcctgggctgctactaccttcgtctgcaggccttcaccccgccgccgaggggacggcgcctcctcgccgtcggccggggaacacgccttcttcctcgtcactactggtcgagacccaccgcatacagtcgtcaccatcaaattgactccgccgccagcaaccatgtccccttcgctgcctcactcctagtggcaagcactccaggctagacacctcaagcgaacaggcctcctgccgtcctgcctcgttggttcctatgctatgagaccttttctttctctgtttatctggtaggaatgaggaggaagagagggtctagcagcctagcagggtgagaactgagaaggggttgacctgtttgtgtggttatgctagcttggaacctcctatgcgttggacatatatcaaagtattggtactgtatcattttttttcttgctcagagagaattaagtcacccatggtctcactctcatggacctctacacgtccaacaacatcatcggcacgcagcaggacaaataagttgatttcttttggtagctttacatcggactcacttttttgttttagggatttaattttacctaatcttttggaggaataaaaaattttacacattaaatttcatttaggattcccaagattatttttttggatggaatatagaaaaaacttttggtgatgcatatgtgcaagaatgaaagaatacatatcgaaccaacttttaccttgccatgatggatggacgattaagtagaggcaaaatggatagagctttggcaggaaataaacggagaacaacaaatgtgaagaaaccgatgagactggaaaagcgaaagggaagggaaaaaatgaaaagcaaagcaacaattttgtagtgctgtggagcaaggggaaaaaaattaattcagaccctacaaatttacatccaccaataagcaacaagcacctaagcgtctaatggcagaccggcccatcaatcaaccaaacagctgtgtctactcaattgtagcaccgaataaaatcgataatatacactgtagcatatatcattgctagaccaacaccaatggagtagaacacagctcgggcccacaatacagagatgaaggatgtataggcaatgtccaccatataggaacgatatgactgaggagaccaggagtaatctagccaatagcatcttgcatactcttgcagtagtggagtgggcacacagtgctcccactacagacgtggtcttcgaagcacgcattaaaatccacccataaacaaaaaaaaatgttgtcacacaaggacaagggaacggcatggacatattctaccactgtgtgcatcaaacactggctggctgtacacggcaacagcaagagagagccatacaccatgcctacccaaaaacaaagcaacaacttagtattagctacttgtgtttttcgtcgctgcttgcgtgctctttcgtcaaccatccacctgtcaaggtgggccttgctgagtctgtctgccattggtccattgcggtgccgtatcgatgattgccagagccacacgatgatgatcgaacggtgtatgaaccaagcaaccacatgactcgaaacccagccaaaatccagcgccggatgacgtgtcggcacccagcgagggccacgccagggcaaaagccattttgagccgctaatccagctggtttgaagtatttaaataaatgtaccagtctacccacgtggcaagctcttgtataataaaatggtgatgtacggactccataaaattaatgtccatgaagccataaaataggaacgctttaattgtaccagccaccaaacagaaacaaatagataaactttccaataatttttattccttgcaaggcacagccgctttcctagcccatactataccaattactaatattctacggaaagcctctaattacgtgtatgtaatcacatatggaaatcagcaacatgatattttgcgacaatcataattacacatgatcttctctctagcattttataaaatatatatataaacttttattttgagaattacacagtacaatgcagacactcacaacacacactcacccttatgaacgcacgtacgcaaaccctacccctatgagcatcttcacacactcacctctatgaacgcacgtacgcaaaccctactcctattagcattttcgaaaactggaccagcaaatcatggagattgacgaagtcaccataggcgtctcgctgtcaatgagtatgttgcttaccactgaaagcacaatgtcgttaaatcctggaaaattcgctccccatgggagcgaacccaggacataaggtgctactgaggctcttttaaccaataggctagatgccctttcgcaaaatatattgaaaaactaattaacataaaaatcctacaagtaaaaatccaaagttgatgtcaaaatatcaatttccaaatgatataagcaatgttttctagttaaaacatacatttaaaatgctgaaagaatctatatattgaaattagggatgagaagactgctctgaaacatgtggaaactacctatttttgcttccatattttttggaatcagaattggaaattctgaaatccgtccctaaatatttaataccattgacttttttaaacttgtttgaccgttcgtctaattcaaaaacttttgtgaaatatgtaaaactatgtgtacataaaatgatgaggatgtaggtcccgatcttccgataggtattgataaacaacgatttgggcgaagtcgcgacacaactcgatctggcttctgaacgaacacgctattgagccccgcaattgcagcaccacgtctcctctgattatcaaccatgtcgaaacccggttgacctcgccgagaaggctaatccctgcatgcgaatcaaagaacacaagcaagaataagatatattgcaacacaattgcatatgaatgattaagcactcgaatttggggttccacaaaccgatctagcggcgaaactgttcttgacagaattatctaagcaaaacccaactctaaacgatgacggctactgaataaatgtgattagggacgtcctagggttgccctagggcgcgcacccccttgggctaagcccacaacacaattacaaggcccaaaacccaaatcagattcggacatggcttgttttgcaaattcccggcagctcggtaggaattttgacgtgggaccaaaaccatctaaaagtagacttcataagctttccaacaagtacttatgggccccgaaattccttctagatcatttcttgtagaacttcatttcttgtcttctatggaccaaaagtgacgtggtgagatgaaagaagaattggagaaggtcttggtttggtacccaatcaacttcttcaatcatccatgctttccttaagcttggtctcttttctttcgcccaagcaagtacctctgcaaacgaaaacacacaaaactcattgtgtagcaacgtttgttcaaatatataacaagtaaatctaatgtagaacatatgcacctttggtttattaatacataaggtagtcatggttatatccgagctagttgtgtcatcatcataaataaagtatatttaacaatgaatcaaatgacgaattaataattatttaaattttttaaataagacgaatggtcaaatatgtttaaaaaaatcaacggcgtcaaacatttagggatggagtatcaaacacaaacacaaagcaaacatgaatcaaagcgaacatggtaatgaatatttataggaatataaaaccccataaactgagcttcaaaattttgtctaaagcaatagataaaaattccaaaacttagcaactaacgatactacgagaccactttatcataaggaaatatcacagatcacagttgactttgccaagtccaaattttcatcttttgagatagtaaacacttcccttaaaaaaaatctcaaagtgaagaacaccacatctcatactgatatttatagggcagaagtgcacatctcagtatcacatatcacatttataagttattaacaatacaacatctcacggaggacaactggcatttatagagtaggaaatgcgcaacacaaacacagtcattcactgactcacaccacagacttagttcatttccgtttccaataaaaaaaattgaattcgtttcggtgaaattttctggaaagtttttgctttccgacagatagtgcccttcttgtgtctctgttgtcgagaaaaaataaatccaaattcgttttcgatgatttgtgaaaatattctgatagacccttttctttctttttcgaaaacaggtctggcatcaaaacaactttctgaaccattttcaaccaatttcaaatatacacttattgcaattttttatgggaaaagctcaggtattgcaaatttgagaatttaaaatgacatgaaaagctatctttctgaaaaacatgcatgacgtggaataactagttccctaattaattcccgccgtgcatgattaatttggcatgcatgttacgtgtaatgctcctctcctttcaagctattaattttttaagagtaaattgcgtccgtggtacacaaacttgttaggtgggtgcaatttagtgtaaaaacttgaaaaactctcgttttggtgcacaaacttgtataggtgcgtgcggactatgactaaatagaatagcaaatctaattttgctgagttggatgatgagtagaccgccaactaagcattcacgtaagaaggacaggtttgcctgctcgtaagcaatggccctgttttatcagaaaaccccttctattgtttggtatttcgatcatgtataatttttcagtgaaacgaatctgagaggtgttcatagcggcggggagctggggaggtcgaatccgcggtggctgtagtgatgggggtcgagcccgatagctacgtcgtggggggagtcgagtccgacggtggctacaatgggtaggtcaagtttgacggcagtggctgcaacagtattgccgagactgacgatagtgacagatggcgaggaggtcaagtttagtgggagagcttagaagttgatgctgcggtaggcatttgagtggcttgctttaggccaacatcggttatctcagactctgacaattcatatagcaactttgaagcctagctccaatgcttcagtgcagacattgaagcagcaaggaattaagccattgtgccgtcagattaacagcatgaacattaaatccactgaagcaacaaggatgtaatgcttaattgtacacattgtgacaaaatctgaacacaatgaaacacgtgagtgcatattttgaacagaaactgagatcctgaataaaattcagtgaatagcctgaatgaaaactaaatgcataacttgacatgaatttgattgtgcactagtaatgtagctcaaaatcgataacatggaaccaactttatgaatgcatagtataaactactgtttctttttcttgggagagtttttcttcttgggtgctgcacttctcttcctcaatgtggccctgccttgtttggttgatgtggttagtggtggttgaaccccttctctcctattagtagcaatgaaagcagactctagcactgctcctggattcaccctttcttgatggttgctagcagcctgtaaaagattatgtactaattttatgatggttgctattagctgacaaaatgctagcttaatgaaggattgttttttctttgagaacttaatgaaggattgtcacctccttaataaaagcttccaccacagatgaactcagatagttagaattttgttggggtatgctaagcaggtgcatttcctgaaacaaatatatgttatgtttaaaattccttgttagtgcagctaaacatatacacaagcaaaatgagcatcaatagtacctgagtgatgacaggttcctaaaacaaatatacaatgagtttaaaattcatagttagtggagataaacaaatacacaagcaaaataagtataaatattacccgagtgatgacaagctcttctgaatcaacaattgatgaagtcgccatttgctgcataggttgcttctgaagttttaagtcagccttcctctgtttacaactagttttgttgtgaccaccatttttgcagtagctacaatgcatctctactccatgctttgaaattttagtcccaccctctagttcttggggctattttctcctagttttctttggcctccccactttcttctcatatactggtggcttcacctctataccctgcatcttctcccagtggatactatctctcagtggcattatgttgtagctataagcttgttcatagcacctggttgaatagcaaaatgacactacatcctctggcttgattctttcatgtcttagacagaaaatggcatggttacaaggaatcccagtgagctgccacctcctgcaatcacatctctttacattaagttcaacaatgtattgagatcctctgtcgctaacctgaaatgctcccatcccagcaggcaaaacatagcatgtattagccatctctgtatttttctcgaccttccgttttatttttgggcagaggccacatggccaattcctttctagttctttttgcttggtgtacaacctgttcatgatctgatttctaatcctctcaagcatagacaaaataggcatctccctggcatcaagaatgtacttgttaaacacttctgagttattgttaagaaggatatcacacttcggaaagtcactgaaaaaggctcgacaccattggtttggaggaatttcttcaaggtacttataagcttcactacttaatgccttcatcttttccatattggcattccactcgggcacagtgctagatcttgcaatagcccaaagttggttctttagtgtctcccctttatgtaacacttgaaaa

SEQ ID NO: 72259 - DNA, 10278 bp, Oryza sativa
ttaggtgctgatgacatttcatttatttcaagccgatgtcatgcgtacatcgatcggcaaatatcaataagtaaatcagaactaaatctactcgatcggctatagatattaatgatatataatccttatattgatatatacttaaatcaagtgattgggatagatcggtcgtcttgccgagacagtataaatcacttagatcaaaatatatattaatagtgggattatatacatttatagcatagccggtcaagtggatctagcacgtatcggctaatgctccgatactactctatattaagatgttaaagcaagtagaatataccaaacagaagcctaatatacctagatgcgacaagatcctaacataaagggcagatttaacatatagattaagcatatggaataaaagtagttaaatcagataagatcggctgaaactccgatactaccctaatcggcaaccagaaagtaggctagagattgcaattctaagcatgacttaatagatcaaactcaattgatgcagcattaagtatgaaaagaagaacaatatctagacaatcaagccgctgaaagtttcatagagtggtagatatatcacataatctaagttaacgtcattatgtaacctaatcggctgccttccattaacagatgttagccgattataggttagataaagatattatcaaagattatgtgagatatatgataactcgacgaattatatagacaagattagagtatcataaagatggaagcactaatcctgagaacataagtcatcatgacaagttttacctctttgttgaagatcgaaaccgatgcagctcaacccgagagtacgaactcgtcgaaataaaagtaaagcaaaaagggtggcgatgcgccgagattgtattggatgtctctttttttacatagggctcgggtctacttatacccgagaattacaagatacgtccataacggacacgactattatctctaacaaactctaagatactataagtctttacggcagacttttgcccaaacatatctctaaggaaattacacagaatatcctaattaatagatacaattgccttcccaggactctatccatgcgtggcaatcatcttgaagcacatcaacttgaacccgacgacatacgccgagtcatattatcggaatcggctgtattggctagccccgtccgactcgaactctgccgacctgaccttagccgatttggactgcagccgattcttactctgcttccgcaacgatcttcatcttggattccacttcgatctgatcttcagctccgatgccaatagtgatagaatttaccaaatttggtcgttaacacaccctcctattgggccgaaggtctagccaccgccacatacctcctgaaccgccgaccctcgtcctcggtaaacaactcaatcccattccagcttcttcatcgcaagattcccgattattccatgttacgagtgtttgggtgtttatgctatcctaaccttagtgccaccgctgcccacaaacttgcaccccgctccaccgcttgcgtctttttgggctacccctcctcgcacaaaggttatcgctgcctcaacatatccacccgccacatcattatttcgcgccatgtcatttttgatgagacacagtttccattttcgggagatcccgtcgatgcttcctctttggattttctactacaggatgctcctgctccctctgtggtcgctccaccactggctggtgttgagcagccgcacctgccgcacgctccgttccctgtgaacgttgagcagcggctacccacgggtgctccctcggctgaggacgagcacctgccctactacgtgcagccgcatcacactgcgggcgggacgacggcaagttccacatagccggctgccatatctccatcttcctcaagcaaggcaccgtcgtcaccagctatccggccgtccacgtcttcttcacgaccagccggcacggtggcgccattcccgtaccactaccaacgacgaccggcgccgactcctccaccccaagtcgtcgctccggctgcacccacacctccccagcgggtccacaccatggtgacacgctccaagaccggttctctcaagccagtggaccgactcgtgctctcggcatcccacagcgccatttctccactgccggccaactaccgctctgcccttgccgaccccaactggcgtgcagccatggccgaagagttcaaggctttgatcgacaatggcacgtggcggctcgtccctcgtccacctggtgcaaacgtcgttaccggcaagtggatcttcaagcacaagttccactccaatggctcgctcgcccgtcacaaggcacgttgggttgttcgtggctactcccaacaacatggcatcgactacgacgagaccttcagccccgtcgtcaagccctctaccattcgtgtcgtcctcagcatcgccacctcccgctcctggccgattcatcaacttgatgtgaagaacgctttcctccacggcaccctcgatgagacggtgtattgccagcagccgtccggcttcatcgaccccgctgctcccaatgctgtgtgcctcctccagcgctccctctacggcctcaagcaagcgcctcgggcttggtaccaacggttcgctacatacatttgtcagctgggtttcacgccatcggcctccgacacatcgctcttcatcctccaggacggtgatcgcctcgcctacctgctgctctacgtcgacgacatcatcctcacggcctcctccactgagcttcttcgccacatcacggctcggttgcacaccgagttcgccatgaaggatcttggtgacctccacttcttcctcggcatctccgtccgtcgcacacccgacgacctcttcctatcccagcgacagtacaccgtcgatctcctgcaacgagccggcatgtttgaatgccacccaccgccaccccggttgatgctcgcgccaagctctccgcctcggagggtgcccccgtcgccgatcctactgagtacaggagcctcgccggtgccctccagtatctcaccctcacccgtcctgagatcgcctatgccgttcaacaggtgtgtctttttatgcatgaccccgcgagcctcacctcgcgttggttaaacgcatcctgcgctacatcaagggctcactctccgccagcctccacatcggcaccggtccggtcgggtctctgaccgcctactccgacgcagactgggccggctgccccgactctcatcgctccacctcaggctactacatcttcctcggcgataacctggtgtcttggtcctccaagcgacagacgacggtctcccgctctagtgccgaagcggagtatcgtgccgttgctcacatggttgccgagtgctgttggctctgccagctactccaggagttgcatgctcccatctccaccacgaccgttgtcttttgcgacaacgtcagtgctgtctacatgaccgccaacccggttcaccaccgccgcaccaagcacattgagatcgatatccactttgttcgggaaaaggtggctctgggacaggtccgtgtgctccatgttccatctacgcatcagttcgccgatatcatgaccaagggcttgcctgtgcagatatttacagattttcgatccagcctttacgtccgtgatcctcctgctgcgactgcgggcgggtattaggaatactttgccatatatgtacagattgtactgtattgtttctttccttgtattctcctctaattgaggatcctgtacatgtgcttcctatattaatacatggccacccctcccattgggtgtgtggtgttctccccattccattctacactgacgatcgacctgatctgatcaatgtgtatattaattttatatatatatatatatatatatatatatatatatatatatatatatatatatatatatatatatatatatatatccaagagatcaatgtccctacgtacctactccctccgtttcacaatgtatgtcattctaacatttcccacatgttaatcattaacatcaatatgaatatgagaaatcctagaatgacttacattatgaaacgggggaagtaactagctactactacctccgtttcaggttataagactttttagcattgctcacattcatatagatgttaatgaattaaggcacacatatatgtctaaattcattaacatatatatgaatgtgggtaatgctagaaagtcttataatatgtgaaagggtcaattaggcctagagggggtgaataggctaatttaaaattttatgcggaagctaaaactgagttagggtcagaaagtctgatccacagtcagactatccgaaaatatcagatagtctgatgttggatcagactgtctgatccactaaagtaacactacaagtagatctagtgcacaaacaagaatatgccacaaacagcgactagatctatagcggcacaaaaaagcaaagctaaatgaggggagaagtgatatcaccaacaatgaagttcaccgagttgtttccggagttcaaatccttgagggattctactctccgttgaggagctcactaagagccgggtctttgctaaccctttcctcaagaggttgcactaagcactcctccttccactaaggggtatctctttccttgctgaggcgagatccggccttcacaaacttctcccggccaaccacacgtagatcggtggctcggaagtgacacctagccgtctaggagtcctcaacctccaagagtaacaaacaccacacaactcttggtcaaaccctagtgctcaagatcgagtgaaacacacactaggccctcaaacaccaaatccacaaccaccaagatccaccacacaaagaacaaggagggatttgagagagggagagagagctcaaagatccaaagcaccttagcaccaagctcaacccaaagtgaatgagaatgaaatgagttgggtaaccctagaaaagggttaggtggggggtatttatagatgcccctaaaatgtggccgttgggagagaatcttttcatcccacctcggaaagtccgaggtgacatcggatagtccgatgtttttgacacccaagcaggccagagacaaagaacgaaattctggagaatttcggacaatccgatcgatcggatagtctgatgtcatatcggatattccgttatttttgaaccaagaatttcatcctctcacagagactcaagttccattgaatttcggagtctttgggtcatcggatactccgatcacatcggatagtctgatttgaaactcactcaagaggaataaaaagcaatttaaaacagagagtgaagttctgggaaatttcagatagtccaaagtatcggatagtccgaccttatattggatagtccgatatttttagccaacactcagaccaaagacagagagcaaagttctgtgaaatttcggatagtctgagcatcggatagtctgatcaagatcggatagtccgacaggaataaaacaggaacacttcaaataaatgattttgagcactagtgttctaccaaatatatgcatgtggtatccctcttaatagtacggcatcctaatactcaagaacacaagatatacatggattagaagacaattaccacaaaagatgccgcaatacttattgtgttgacatccactcctttttcatccttgcatacatctcaacaaaaagcattagttaccctctaattgtgttgtcattaacaccaaaataaatgaggggtcctagatgcactttcaatatgaaatggggaagtacctcttttgatcgagatggtatgatgttgggtcgtatctaaaaaagtttcaatatgcggagactgagaaagcggcttgatatgcatgtagtcctaggcaaagtggggcaaacccagcccagccgagcaggtaagagggcctcaatctcccctccaacggggattgataggcccgggccattaatgtctcaactgaaaaaacgggtataacgcatcctccatcttcaaaaaccggtacagatagactacttcaattgtttgagaagtgactacactgacgtagcaagtttaccgcggtttgagttagcacagggcaagtgtccaccttgggttcgatgctcttagagaacaaaaaaaactcaatgtcagtggaggaggagatcagacgggtgttatccatggccatccagcaacacctcagcgttgaaatagaggtagtggccagcgtcctgagggacccgaggtctggtggcaaagatgacgacgagagtactaggagcaagacacgagcctttgacgctactacccaagccacggtggaggaagacgagttgacaggtgccgaggagcaaggccatgacgagattagtcggagtgaggtgcatggctctagaagcaagccattgccaaggagcaacgtgacgatggtggcagactcatgtactcgacggatgggccaccaacacgagctcgaccatagtgccagatctggaaagagggaagaagaggtgggtagaagctcgtggtcatcggggagaaatcttttgggtggtgggtgtaagcgatgttagtgaagatggccactcgcacaatctaggctttgccgccgtccgccactactgatcttcaccacccatcgagttggcaaatggcgagcgagacacgagcgtgcagtggcagtggctggttgacaagatgtgagcagctctcggacgaccggtttgacaagtacaagactatgttcggtgatggtgtaggggtagcgacatgggctgggtcgatacagagatgatcttggggttaccgagaggcacgacaatggaacctgcaagggtggccaccaagacggggttaattttgcaacaaaaatctcaaatagggatgatattttgtaaaaaatgagaatgtgatccttggttgagcctcgagttttttatagtaccgagcaccacctcagcctcgagctcaacctcctcctccttgtggcgtttagcgagctcccttttgattccgctatgcctccatggctccatcaagagaggaggtagagagattgagggagggagcctggtaaggagaaagtacccctggcatgtgggtcccacattatttgtcctaattttttccctaactaacattgacaggtgggtcctattggtatttttattatttattttgtgtttaatgtcacgtaggacaaaactgctatccaagttgttttttgggtggtaaattcactcgatttaaagagttgagggagtttttatatcgtgttttatgattgagggatacgaatcaaactctaaccacagttgaggtgttataaaaccgaccctattctgtttctgatttgcactaattgaaagtcggagttataaaataaaagaaaaattaaaggtagagagttcggagagaaatacaatttatttagaaagagagggacggtaggagagaatcttttagcgtccaaaatctttctgtcgtgtatccgtcttcccctctgcgtcgaaggaaatctcccgtctcgtcgtcgctccttgcgccgatctccatcccgcgagtcgcgagcagagagcaggggaggggaggggaggggcgcagtcacccgtcctgctgcatcctggtgaacatccacatcctctctctcccacctacttttatctcgaatttgcttgcgttaaccctagcttctcttctagatctggaagaagctcttcgatctcttaatttcagagccttaaccttactacaagtaacgatttgtttgttcccctcaaaacccccatgtcccaagttggatccgcccctgctacttagcacctgttcctattctctaccttgtacttacggtagcacacctcataaggccttataacaatacaacttaaaaggataggtatgccctgcttcaatgtgaagctatgttcaaaatacctggctcaatgtgcaattcactatctgtttttttttacccccaaatcatcatcaacaacaaaaaacaatctaactcctgcatccagcttatgttgtacgcgcatgcgccaattacaataagaagagatggaaatttctttcaaactactccaggcattaaatgaataatcaatcctaaacatgcaagtatgacaggggcggatccaggaacaaaagattgggggggctcaattacacagtttctttaacctccagctatctagggacctttagtttatcattcatggtgaaaaaattgaagggggtgctccgggggtatccatgagtcttgtgggtgtaggggggacttgagtcctgggacttgagtccccctgcacccacgttggatccgcccctgagtatgactagctaacatttttgggcttccaacacagtagtcaactacttgtattttcctgagctccccctttatacaaacagtattaaatactataaataaatttctctctagtaggagtatcatcttatccattgtccgttgacagttatttgcattgtgttaaacagactatgctctttctaatagaggtaacatagttggatggatgatgtttatggaaggatagaggtcttcccccagcacttcttaccatcacaacaatccatggagacccctgctgatggtctctccacaagtaagactaacctggattctccaccaaggtgatactttcaaccaaaggaattctctggctctgaaattattttcccccctttcttactgcaatagtatgttgctcttgtcatgttaacagttcacgtagacgttcctggactccgaaacgagtaatgggagctgcatcacttttgcatttattgtctcttcctcgcataagatggtcttccagcactgaggatgatgacaaggttaatcaagtacttcctagtgtagaaattttacatcatgctaccgtgatctctgtcttatatagcacaagcatttttcattggtaacagattgagttaaccagagctgaagtagaatcattaagaaccgagattgctgatgctgaagagagggaatctcagttaaaagctcggtacggtacattagttaaccaagtttattgaccttattttccaacaatgtcacagtatgtaagcattttttttcccgccatatgtgattgatatagtttgtgtcttccaggttggaaaatattgatgaagttttgagatatgcacggctctctgggtatctctatattagaagtgtaagaaacctttgcactttgaccttctccccattgcttcactcttgtcacgtggaggctgatatgatattttgttgcatatagagatggactcaacttcctggagagccacctattctagatgatgctgatgtcgatgattggcttcctcggtttgttgttctgcaagggcaatgtgtatactattatcttaaatctacaggtaaatattttgttatggagtatgtcatgtgttggtcactcaatcacacattaattagtggcgggtcaaggatttgaacatgaggcggggcaagaggcaatggcataaaagatgacaatatatattctgcatctagggtaatagagcatatctatatatattacatatgcgtttaggcatcttaggcaacacaaaagaatattttgccctaactgtcttgtaaaagcaatctaacattcttttgccttttcattagtctgataaacacataaattacatattcacaaaattacccagcaaaaatgtctaaccaacattccagtatccactaagatttcataataactaaaagtgaaccctaagacaaataacatgcatactgtgatcttctagaggcatggctaattaaccgattgatcacagggatgactcctggcttgtttcctgctttagcccattagcagttggctgcattagagcttagataatacataatttggtacttagctggtttggagaaaaaaaattgttggggtggctctgccactaaatacagtcgaaacatatgtacttaatgccccagcaacagcatattttgccgggtatgctggaatcttgatacagttagatcgactaaattcataaaccttctagcagggtttacaaaaccgtgcggttatcacgtgcgataaccttctcagtttttgatacctcacgataaccacgtggttaccacggtaaccgccaaaaccgtggggtggcagtaaccccaccccaaacggtttggtaaacc

SEQ ID NO: 72260 - DNA, 1005 bp, Oryza sativa
agtagaaggagacgatccaaagcagctaaaattaattccgacaagtgcagccgcgactacggcgcctctcttccaccttggcctcgccctccccctacacacaaaggctgggccttgcaccttggatcctttcctctcctcctcctcctcctcctcctcctccaccagctagaagcttctagaagccaaggttccttccttcactggcagctcgtcctctccaggagttactttaatttgtttcttcctcttactacttccttggcttgagcaagtcgccttcttcgatcttggcaaacctccctcgcactcttggctggctgtctgcaagagccttcctgcaagcatactgcaaccatgccaaacgatgcatcagtcagtgtcagtcagtcagtcagtctccttgtttgtactattattcatcagcctcaatcagcttctctaattaatcatgtagtagtaccttctctgtccttatgttctcttttttcttttctttgaaaaattaaaaaggaagaggacaatatatagttttaccttgatctttctgccaaagtttctcttcaccttcttctttctgtacctagatagcttctgcttcctttcttcagatttcaggtcactgatggttacaagcctctcgcaagatgctaattgagcgtttcctgagttcccgggtcgaggggtgctagctccaagattctgttggaaagacaactagcatcgtaagtacaattcttcaacaacctagcagggtctgcaaatgtttactcgaacaatctcacggcctttctaaaataatacagtatataaaaacaaaaaaccataggatatacacgtacgctttggcacctaggtagtctcttagaaaccaactttgtatgcaggagcttgcatgtaaaagtatcttgaaagaaaattaaaaccacaaggaaaaggcctactttgggcagaaatagtaaaatcagtgtcatagctttgatggcctttaatttgagtaaagaa

SEQ ID NO: 72261 - DNA, 8252 bp, Oryza sativa
aaaccctccccgcacctcctccgtccgtttccgcctctcgccgcccttcctcctcgctagattcgagcccgcgacgtcgctctctctctccgccgtcgccgccgagctccggtccgccgccgtcgtcgccccggaccgcctcctacctcggcgccgcctccttcggcttcgccgcatcctcgccgacctcgtccacctctccgtttcagtcgccgaccgccggaacgccgtcgaccccgtcgacccgagccgcgccgccgcctccctctgctccgaccgccccctccgtcgccgtcgtcgccccggggtgagccgtggaccgtcgcctcctttcccccttccctcccctctctcggccgccgttccgctgcgccggtggtcgccggcggcgaccatcggggcgcgggcgcgccgcctcccaccgaccgcgccggcgtggccgccctcgtgcgcgccgagtggctgccgcgtggggcccagccgtcagcagcccgcgccctcgggtgcggctaacgtgtggggcccacggcgccggccggtgcgagccgggtgcgcccggtccaccgtgaaccgtgaggctgccgcgtgggccccactcccgtggacccggtccgcgcgcccctccccctcggctgacgcaataaaccctttttaaattacaatttaaatgaagaaattcgcgaatattcatttaaagagcatataaacttcagatggccataacttggccatttgaactcgaaattggaccgttcaagtctctaatttttccttaagaagtcaagaacccatttttgtactttgttcctgcttgttatatggagtttattagagtaaaagccttttcttttccattggttgtgtagacgctgcagcttcggaagatccactcttcgtggaggttgaagccgacgtttgggaaagcgagcaaggcaagtcacatcatccttgagcatattgaatcccagtttataaaattattttgatttaaattattgcattatcactttacttaaattcccgcgttatcactgttttatttagccatacctatttacctttgttatgaccttattattattgttattgatattattaccttgttcaccctagattaaacaaaaccccaactagtggacactctactcatggtaccactagtatgatgttaggtagatgcttcgctggttaattaggcaacattaggtggttttacaactctagactttgggaatattctcatcacctggacactatgaaatggatggattattgtggaattggattcacacctccccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggttggtactcttgtctatggctaggatgggttggaaactatgtcacgtcttccgtccgtataccgtggtggtatgtggcacgtggttacatgttaggaagatgtgtcttgtgggtaaagatgtacacctctgatcagagtataatctattcgaatacccgcgcccttggttatggccaagccgagcaatgtacccaagttagtgtttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctaggactgtatttacaaaatagctttgagcaactaagtgtcttttaatgctgtttactgcaaaccctaaccctttatattttaacccccttgtactcccttgcattgattctgcacttatgggtgtgtcttgttgagtacggtggttgtactcagtcttgctcaattttgcccaaacccaaaagaggagcccctggaagatgaaggctttggtgtctagctcatgcctgccgtcaagcgcctgtggtcgtcgccctagtcttccgctgtttttcgtttgtcttcttgtgtgctgggtcttcgctgcccatgtaataaattaattaattacgcttccgcttgttaaactctgaattgtatcaacttttggtgtaccttgcctcttgggacaaggaataatgcacgcacgtaaggaacgcccgttgggttatttccggtcgtgacaatggtcaatgaaaaattgtagtctattagcttcaattgtagaaaatatatcaacatcaatttgatcacttaatcgaccataacatgtcaaaggatttggttcatttagtctatagtgcatcatatatctataatattctggcattgtgacgtattttcttccaactccgtcataattattatatttaatgccaagatggaatccgcgttcaccatatgggaataataaagggtactgcaaggccatataagatgggtgcaatggagaaatctggtgcagtccatggtttttatcatacacaagcatatcaaatttgtattcttttgcagaaaattcacctactattattccacgatttcaccacttgttggtaggttatactgaacatcgtcttttgcgttgcaacctaaacggcgaagggttatttgctgatcaccatgttcagaaagacgttctttagcatatctgaagttttggacaagggcattctcagcatcaaacatcaatgacagggcagcaagtatttcagaatctgctttatctacattatcaccatcattttcaaatatatttagcctgttttgtatttcattttctgaatcatagatgtataattgagcgaatttcggaggtgaaccacgagatcgcacaagagtaccaattcggtggtgcacaactccattgatcttgaaaacataaggtgcattcccagtattaatcgatttgtcaacagtagcacccattgaagtgaaaacaaacattgagttatataatcgtatttgtctcaaaaatctttttgatcgtgcatcaccattaaagtttaataatgttgcaagtggttcaggaggaggacgtaacttaggtaattgtatttgaccacctttgcaacatagattgtaaactatttttcttttcgtgatagcagaagtgcttttgactctttcttggtaccaaaacatggcaccacaatatgggcattcatatgttggaggaccgtagtatgatctgtctgggtacaatgctgcaatgcgtgtattgaagaatgtcagaaagttttttttcggaacaaaaatagtatagtttgtatttagtatagtgtgcaaaccctttagtgatagaatatattctttatcggcccgtgatgaactaccgatgctcttagtgttgatagctgcagtgtacaaatataggggaaatgatgaacccagatacgaagaataacacgatccacatctaagaaaattgaaatagcataccatgtctacggccttcagtcggcgacgaaggtatttttgaacgcaagaagcaacgcctttgtctatttaatttagtcaattcaggtgtaaaatccatgagtgatctcttacggtcactttgttcactcgcttgatttggtatgattatagcatgttctatatgcatcgcaggttgccgagaaagaatatttgcaactcgtctttgccggctagcacgaactctgcgtactctattggtactttcttcattcatttgtgaaaacatttcacacatacagattgaaggaattgagggaaaaaaatacaggccccaacttaaatcaagagataaaataacacatggtccgttgttccatattacattatagatgttcatgatattaagttaagcatagctgcagtcttgcaaaagggcctatatggatttaaagtacgtacacataggaacaataaaaaaactacaatgatatgaatccgagcttactattgtcaataaaataactaaactatattgaacaacatgcgcaagtgatatcgttagaaagtgattgtctgtatgatcggcatgatttaaaccgtcaaatacaacctagaagcagattaaagggcagatcatcctaactttctgtgcactaccattgactgaaaactataatcgtgcactacaaaatcatatagtcagtagctacaggctcgtgcgtagtttcaatgagatctgtcgtttcaccaaaaaaaataatggctacaactcaactgggacaacaatggatggaacaagtagttctatggctacaagcaacctatcatcataatgaaattcccaaagaaaagaaggggtcagaagcatgagctgtcgtacagcaatattcagtagggaaacatgagagacatctatggctaactacaaaggaagaaagatggccatggaaagttggaaacataagctttgaccatatatctaatgacgaaataccgaggagaaggtaagaagtatgtatatataagaaggcgacatactatcatcgcaagataaagttgagaagaaagctatgcacacccatcgacttaacagatagtaaaaggaacaaattggtcgttataacaattgtgacaattgtaacttgtagcgtctctcttttgctactaatacccaaaactatagggggaagaagggatcactttcaatatatgcacacagcacagaaccatctaattatataaaaaaatgacaaagctagggaggaactgcagttgcacacacataaacttactggggcacacatataccatataatatcatgcaaagaattaaacaaccagagaaatatagtaatgtataacaataaagaagaagaaaataccttcagcacaaaggcagaccgaactgacaggaaggggaaaaggcagggaaacaagagcaatatcaacccctaattaaacaatagactgaaacagcaagcttcgcagcaaggaaagttaaccaacactatcttgagcgaataaacaaccagagctgcatggtacaaacatcatggttagacactagcaagtttaaatctaacgcgtaacagtagaagaactcctcagagaaatgccagactgaacagaaggatgaactgaaattacctgccaagtattttgtcacatcctgattttcgtcttaggatttataaattatttaataaatcattattagaatttatattaaatgttcattaatttacaagtgaagttaaatgtgagaaataaaatttcctaaatataaagcatggctggatttaatttttattaaattctccatggttaattatactctctggaattttctcggatttttcggagctcaattcctaattttaatcatacaaagaacatttcagtaattatccacatattaaattaatcattaaatggtctgattataatttttttaaatactttgagggtccaagtattttcaagatttttcttgaaattatttgaggaatagaagtatttttaacaattcaaagatcatttcagtgattaatttaattagaaaagtaattaaaattcaccttttccttttcgggccgaattaggaaaagtcctctcactctcggcccagtctcctctcatcctgcagtcctttccctctctttccccaagtctgctttttgtccctcctttaatcagtccttggaagtggaagcccaggagaagtctgttttagatcccctcgctacagtaccttcttcttcctccagccggccggctgccaagcccgagccgccgcctctctccgccaaatccgcctcaatcggtcgccctcgagtccgattgcttgagggtaaatcatctcctccttatcctcttcctttcccctaaggtttcggagatcaaatttgcccggataaaccaaatcgaattcgttttgagtttatctctccaaactaaccctagtttttcccggcttgatttctcgcggttggagtccgatctcttcaatacaagcctataaatagcatctccttggcgtcccctttcgtttgccccaactccagagttccctcgtcgctcgtagcgccgccgccgcgtcgtcttagtcgccgccgctgccggccgtcgtgcagccgcgtcgcgccgccgccagcgccgtggccgacgcctcttttcgccgccgttgggtgcgcacggaggaggagcatcctggccgccccttcgcagccgccgaagaccgccggagcgctgccgtcgacgtcgacccgagccgtgccgccgctagagctcgccgccggccaccattcgtcgtcgtccatcgcgtttgctagtaccggtgagttcgcgtcgtcgtcctctacgtgtagatgcctttagatagccctgccgacctctctatcgccggcgaggtcgtcgccggtgtcgtgccggcgatgatgacgtcagcatgacgtcatatttcctttttccagttttttttccagatgcaaatagattaaaacttcagaaattcataactaattcatcgtaactccaattcaagtggttcaagttgctaaatttttctaaaatcgagatctacatgttaaaaatatccacatatactatttatgcttgttttttactgtttatttggtttttattagtctttttcttcgttttgcgtgttagcttgttgtttccgtcgttgcgaaggttcgtgagtgcgtcggaagtgttcaagaagattaattgaagaccgattattgcaaggcaagtcacaaagatcctaaacacaatcctttgagcatgttgatcctatatttaaattctctatttatttcaactgtgtatttattttcgaatgtcaccggatggtgtgaacctattcctttgttatggccaatttgcattgaatgccctattccttgataccttgggtaataaattgattagcttgaaccttatgtattggtttggttcagctaaatgttatatatataattacttagccatgcttagaaacattagctcactaatgggatgaatcatatatactacattattatttatggttatatttaatgtagctcacgatggttaatcgtgttatgataattaactgataattaaaacttgtcaatggtgggttgtgagcacatggttgtgaaggtcgtgctcatggcaattaaggaccggttcgcgagctactattgtgaaacattaaccgtaccaaccaaaagccagcgtgggcaacggccttatcttttatatagcatgattcattacggggtgctagactgagaagcggcgagaagttcgtgggggtcgctggggagtccattgcctctggttttgagggggagattatgatccaggaatggtgcactgtggtgagttgtgttgtgcgaagggtattgtcacgatttccccctttgaagtgccgtggtggtacttcggggcatggcaacatgtgtggaatcgtgccttgtgggtacagtggtacacctctagccagagtaaaactattcgaatagccgtgcccgcggttatgggcgggttgagcaatgtttttcgtgattagtctcacacctctcaaataattattgatgcaataactggtaataatttgtttagctcctagtttggagttagatctgtacagccgggtatggttgttcaggatggttgggcctgtgcagcattggggtgctgttcagtgttgattaaaattgatgattaattactctactattttacttctcttaaatgtttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtatgtaacgttattattatgatggatttgtatattgaatt

SEQ ID NO: 72262 - DNA, 11952 bp, Oryza sativa
agtacacgagtacagaagtattccgatgaggatcaagaggagcagcgatacgatgatgtgaatctactcgaggaacatcgcgattgagttgccgttcgagcagccagctaccaacatgcccttcgccgttaccacgagaagcgcatccgagcacgcacactttcgatcggcgactacgtcctccgacgggttcaaagccaagcagggcgaaacaagctctcacccaaatgggaaggaccgtacacgatcacacaagttctgcggccaggcgcattcaaaattgcagacggcgatggtcgcgagttggcaaattcttggaacattgatcaattacgtaaattctatgtataagtcaatagtatccatacttgtaaggcatcttacagcttcaataattcctattttcaggtcaagaccacaatcaaagtgttccttcccgatgatcccttacccagatgacacctagcgttgaaacctatcctcatgtccctttacgccgtcttgacaaggcctccgaggaacctaagggaacttcggctggggaagcccagagccgataaggccttgtcggatcctgtagagatgaaagaccatgtaagatctggtcgtgtaagagttcttgccgtgcgtattaaccaagccttgtaatcggaaataaactttgcaacttcatggctggaggctaggaacagtgcttgttcaaccaaggcaggtcaaaggtccaagagccttatcttccgagaagaattccccgatgacaaggctaggggctagggagggtgtataactcaaacgactgatcaaagttgcgaagtgacaagacactcatacacactacatccagagtaagaaagcttagttagatagatttcttttctattccacaagtatttcttacaattccatcaaaatccaaaactatattacactttttccctaagacatttgtcacaggacacaaagactaccaggaaggccaacgccagtccatcgactggaaaaccttctccgccagcggcgctatcaacttcgcttggccatctatctctgtaggagttctccgagaatgagaaacccttcgcggaggaactcgaggtgcagctgcggacgatgatctcgtatgcaggccaacacgtgccccccggcatattggcttgagcgacgacactcctgcttcaaggcctcgtcgaaacaatgaccgatgccttcgagctaggggcaggccccgttcagccacaagatgtatccggccgccgattcctcgggatccccacggggtactcggagctctctacagactctcgacatggatgtgcagcaactcttcagatacgagttgaaccacacctcacgacccgggagtgtctctacggcctggtcctttctcacttccagcatagtcctttcgagttccgcgacctcaaacttcgtcctccaatactggatgcgacgatcctggtcagcaagcgcactctcgagatctgctcagcatggaaacgactaagtcaagctgctcttctctccagagaacacaacaaatcaagtcgatccagatggaagggcaaaggaaatgatgacaaagacaatcaacctaagggagtcgtcgccatgctcgtttccacaggcgaacttcgatctacatcgccctccagcacatgtggctcggacgcaagtaacggaatgatcactggcaactcaggctgcccgcgctgctggacatcctcgacatcaacatctctacaaataacaacaaagtactcgagatcaaaatgctaaagaaatctaaggcaatgaccgcacacactaaggcggttgggaccaataaaagttttacaaagcatgactaaagagtacaagagagctaagaccctactcttcaaaaagcgggaggacggactcccccagatcgccgacctcctccatcacatccttccgcgcgtcgctagccgccccctgatccaggatcttccgcagatcgagtttagggagcgccagcctcacacacgcaaggacgtggcacgccccggtgtagatcccgttagacgtctcctctccgatcctggccgcatgctttgaggggatctcctccatcgccgtcactagcttcgcaagagaagacgtcagcgagaactaatcgggattcaccgggatggtggacttgatatcgcactccccggtgagctggtgcagaccagtattggtcacccgaaacgagccacggatttccgacaagttgttctcgagctccgacatgcggtgctcgaacccctgccattgtcgctcgttgccggccactagttccctcatcttctggaggtcctcgcgaacctccgccagatcgcgcgccagccgatcggtgcgctcgttcgccgacgacgcagccgctgccctcgcctccgcaatctcgtggctaacaccgcgagcaccagcctcgaggaggcaccccatctcgacctggagctcctcccatgtgaggacggcagtcgacggaccccgaccagccgagggatcgccggctgggccgctcggcgtcacctcgcggctcctgggtacgaccacgacatctgtcgaggccacggcaggagacgcgctggaagtccctccggacattcacttacttctcgccgagacgcactgcaattgagacagactgcaagagtttgacgaagtcacgaaacttcaaagtcattcacttacttctcgtcgagcgtcacaagccgctgccgtcgcggaggcgggggagacgcatccgaggcctagagtacaacgtatatgaggtgaggtggaagttttccgactacgcgaccaaagggcaggagaacttactgagggggtgggcggattccgacgatgtccgatcacagaggagaatgtcctccccttatatcgatatatacttaaatcaagtgattgggatagatcggtcatcatgccgagacaatataaatcacttagatcgaaatatatatcaataacaagactatatatgtttatagcgtagccgatcggataaatctagcatgtatcggctaatactccgatactactctatattaggatattaaagcaagaataatatatcgaacaagagcctactaaacttagacacagcaatatcttgatataaagggtagatttaacatatcaatgaagcatatagaacaaataaagttaaatcagatacgatcagctgaaactccgatgctattctaatcggcaactagaaggcaggctagagatcgatattctaagcatgacttaataggtcaaactcaactgatacagcattaagtatgaaaagaagaacgatatctagacaatcaagccgctagaagtttcatagaatggtagatatctcatataatctagatcaacatcaagatctaacctaatcggcagctttctgtatgcagatgttaaccgataatagattaggtggtgatattgctagagattatgtaagatatatgataacttgacgaactacataaacatgattagagtatcataaagatggaaacactaatcctgagaacgcaagtcgtcataacatgttttacctcttgttgaagatcgaaactgatgcagctcaacccgaaagcaagaactcgtcgaaacaaaactaaaacaaaaggatggcgatgcgccgagattgtattgaacgtgtgtgttgttaattacatagggctcgaggtctatttatacccgagaattacaagatatacccataccagacacgactattatctctaacaaactctaagataccataagtctttgcggcagacttttgcccacatttatctataaggaatttacataagatatcctaattaatagatacaattgccttcctaggactctatccgtgcatggcaatcatcttgaagaacattaacttgaacccgatgtcgcgtacaagtcatattgtcgggatcggctacatcggcttacctagcccgactcagacccagccgatcttatcgtagccgatctggactccagccgattcctgctctgttttcaaactcgatctccgcttccgactttgcttcgatctagtcttctctcccaacgctgatgttaccaaatttggttgttaacaaagtcataatacgatctcggaagaaaaacgcaaaaggaccgctgagtacactcacattgatggcagcgtcgcgctcggccgcccctttctcggaaaggggcacggggacgttgctcgccgtagtgggaccactgatcatcagttggccgacacggcgcttcacggttgcactatccaaacctgtagatcgtgactaggatccgataagtcgggaagaacacgcgcataagggagtcaatttaattaacaagaaaaataccccgaggagaaacctaggtcgcgtcctccagcccagaataattaaaggctggatgggctcgagcctggagcggctggatccgcctaccaatgaagtcggcagcgacttcacaccccgacaacccccgtactcggaggtcatcaatgatatctatgaaagattggagggatggtatcaaggcgggtttcgtagtctaagacgggatcttgtctagttgctcctcgggaacaataaagaccggatccgaatcttctatttgaagatagaaccacctcccccaccatttgctgtgagaagaagggcaccggaaagggatatagcgcgactttaggccatcccggagtcggaaaccgacgcatccagataccctgttggattccatccagcgcaactcatagtaaaagcggaagaggtcaagaaatggctctaccccaatgtaggcctcacaaagatgcgaaaacatactcaagaaggcgatggaattggggttcaagtggaggaaggaaagaccatagaaattcaagaccaagagaagaaattcagaaggtggaggaagaaaaccacagagaataaagtcctcgatcgcaaccatgcgacctaggactggctggggttcagtacctcctacttctctctccgcggtcctgcgaccgggaagggtgccatcttcctgcaacttcttgagcgacgcgctggtggaggtagacttgtcgagatccatttctgccggggatcaccggagaaaggaccgagatgagctaggtaaggttttttgtgggagcagaaaaaatgagggacgttcgaaggctggagagttttttcacaacaaacgggcttcaacttggattcccaaaactcccttaaataggcgcaccttcgacggtgcgaattcaaaggaaaggagagagatggccgccggaaatttctaggcccgttacgcgcagcagtttttcggacttcaatttaaattcactcatgaccgttgagcttcacccgacgttgtcgatcactccttgtgtctcggtcctcacaccgagaacaacgacaacttcaacatcataagtcgcgatcggtttcacgagttcatttaagcagaagtcgggggctactgtcagggttacgggtaaggtataccctctacccttcgatatacgtcacatatcgatatggtatgctcgcgcgtatatggacgttttcggcatacgttaaggaaattcatcatggagttcacagatggaaggagtcctactcggtcagaactgggtcgtcattgtgcgatataaaagggaccccctgggaggacctaaggcatcgaatcttagagccaacacatccaccacagcctacgaagtcggagcttatcggagccaggtcgccgggagatctagtcggatcaactcgactacgatcttgtcggtatcgtcgagttccactattccctttgtaatctatggtttccatcatataatcccatatcaactggattaggggtattacctaccaaggggcctgaaccagtataatccctgcttcctgtttgcttgatgtcgtactacgtagatcctcgtaccagcgtaccctaataccctctatatccggtctacgggtatccccgatcgacacagtggggctggtgtgggccaagtccaccaaaggtgggccccacgcgttagcggcacagggagccaccggtccaccgtggaccgggaccaaagggcggtccaccgctggtccacgggaaggacagcctagatcagccaagccgatcgggcggtagagggcgagccgctggggcatgggcgcggccgagaccggcccggccggccatggcacggtggcggcgcgcggccacctgcagacggcgcggggagctgcggcaggcacgggcggtggcggaggaagtggaatattaaaagaggaggaggcgacaagggagggcggccgatggtgaggagaggcggcggcgctgcgcgggcaaacggcgcgggcgaagcactgacgatgaccattaggtgaggaagggcggccgagcacctcctcgacctgtagaaccatgaggaggggttaggggaggatagggtggctcgaggcagcgtgaagcgccgatcggaggggattggaaaagggggagctcaccggtgcatgaggggaaacagattccagtggtggaggacgcgaaccgagcggcggccggggttctcattgtccttgcggaaccgatggaggcgacgacgcagtgcggggtcggccggagaggcgacgcggtgtagtgggcgacggtggcggagagagatggtgaatgtggcaacggcgtttcggcaatggattggggaagaggagaagtggacggggtgcagtggggcatggcggctgcatggctgggcaaggcaacgctcgccagcgggaggcggctgtaggcggtggtggctcgggttggtggtggggtggtggttccagtggcggaatggaggagcggaggggacgccggggtggagcgtggcgtggtgaagctagcggcgcaagtggcgggatgcggcggcgacgggagcggctgtgtcggccggttggagctcgacggcacgcggcggtgcacggctcggcgtggggagagcgcgggggcggcacagggatggattttatagctcgatgaagtgacggggagaccggggagtgatgaatttgaaagggaagtggtgtgtcggcaatgggtttaaatcggccccaaccggcgccgatttgcgagggagggggggaacgtgggcgcgggttggaggaggtggatggcggttgcgggcgagcggacggagtggggcggaggggcattgggcgcgcgggaaaccggcgacgtggagcggcaatggcggcagttggggcgtgggaggccaaaggtagggtaaggacctgacatgtgggccccgaccctccatgttagtgggaggagagaagagattgggctagggggcctcaagcagactttgggaggggggatggaagcagagtgggccgacggcccaggaatggggggagggggggatggagattgggccggtggcctgaaagggaggaagggggagtttatattttttttataattatttctcgagctccgaaaattcatggaaaaatctggagagtataatagggctcagagaatattacaaaatatttgcggccaatgatttttaaaggaaatttttaattctcccattatttcactttataaattttctttaacttttatttattttctagaaaatgcattattaaatgatttttaatcccgaacgaaaatcgggacattacagtctgcgccctagggcacccctaggacgtccctaatcatacttaatcactagccgtcattgtttagattccggttttgtttagattaatctgtcaagaacaatttcgccgctagatcggtttgtgtaaccccaaattcgagtgcttaatcattcatatgcaattatgtttcaatctatcttgatcttgcttgtgttcttcgattcgcatgcagggattagccttctcggcgaggtcaaccgggtttcgacacggttgataaccagaggagacgtggtgctgcgattgcggggctcagtagcgcgttcgttcagaagccggatctagttgtgtcgccactccgcccaaaacgactttttatcatcacctatcggaagatcgggacctaactccctcatcaagatttgttgggcacttatttcatccccaagaaatctttgtggcatttgttactcttggtggttgaggacacctagacagcttggagtcaacctcaagacaccgatttgtttgtggtgcggcgacggagtttgtgaaggtcggatctcaccttccttagtggaagtaggagtgtatttgtgcaacctcacaaggataaggttggaaaagactcggttcattgtgagctcctcaatgaagagtagaatcccctcaaggatttgaactttggtaacacatcaacttggaaaaatcctagtgatatcaacttggaaattttctataggaaagttgctttaaaaaatcatattaatccatttttgaagtttaaaatagttaatactcaattaattatgcgctaatggttcacctcgttttgcgtatcttcccaatcttctctatttccttctcctcaaacacagccttagtcactgtttgtgcaaacctattaactacttgtgccattgtctctttttgtttgccttactagcttgctaaaaactgagattttcggaatatcagaaaatatttcgaaatattcaaaaatattccaaaatattaaattattctgaaatatccaaaaagtttagcttccccatttacataatagttttaaatgcctattcacccccctcttggcgacattaaggtcctttcacccttaaaacttgtcaccgtccgagctccctcggtctcccctcatctcctcgcgtcttcctatctctccaccacaccggcgaactccagccaagcctccctgtcggccggagcagcgccaaaccacgccaccacctttcgtagcatcgcagcgacctcctcttccccggcttggcctccgttctgcccgaggcaagccagagcgccatgtacaccgacgtctagaacatcatcatcctccagcagcccctccccattgagccgggtgctgccagcccatgctgccgccgccgaccgccccacctcaccgtgctcatcctcgacatccccttccctaagcccgaagctattaacgaccaaatttggtaatatcagcatcgaaaaagaggattagatcgaagtggaatcaaaggcgaagatcgattcaggaacagaatgagaatcggctggagtccaaatcggatacgatcgggatcggctgaatccgagtcagactgggtgagccgatacagccgattccgacaatacgacttggtgtacgacatcaggttgagttcatatgcttcaagatgattgccacgcatggatagagtcctgagaaggcaattgtatctattaattaggatattttatgtaatttccttagagatatgtttgggcaaaagtctgccgtaaagacttacggtatcttagggtttgttagagataagagtcttgtccgatatggtggacatagtttgtatttttcgggtataaatagaccccgaaccccatgtaatcatttaacacacatgttcaatacaatctcggcgcattgccacccttttgctttagttttatttcgacgagttcttgttttcgggttgtgctgcatcggtttcgatcttcaacaagaggtaaaacttgtcatgacgacttgcgttctcgggattagtgcttccatctttatgatactctaatcttgtatatgtaattcgtcgagttatcatatatcttgcaaaatctccggcaatatcgctatttaatctattatcggctaacatctgtaggtagagggcagccgattaggttaaacatcgatgttgacttagattacgtaggatatccaccactctatgaaacatccagcagcttgattgtctagatattgttcttcttttcatacttaatgctgcatcagttgagtttgatctattaagtcgggcttagaatatcaatctatagcctgccttctggttgccgattagggtagtatcggggtttcagccgatcttatctgatttaactatatttgctctatatgcttcatagatatgttaaatctaccgtttatgttaagatcttgttgcatttaagtatattacacttttgtttgatatattctacttgttttaatatcttagtatagagtggtatcggagtattagccggtacatgctagatctatctgatctgctatgctatgaacatatataatcccactattaatatatatttcgatctaagtgatttatactgtctcggcatggcgaccgatctatcgcaatcacttgatttaagtatatatcaatataaggagtatatattgttaatatctacagccgatcgagtagatctagttctttcttatttatttatgactgccgatcgatacatatatgacatcggctcaaagataaatgatatgtcatcggcacttagccgatcggctatcgtttataggtttaaccgcaatttctttgtctttatttcttgttgattgcaggatcgaatcaactggcacgctagcatacctgaaggcgagttttggacctgcactagagttaagcagatctcccaggcctcgtgttttccgtcaacacgcttttggcacgcccggtggaaccgattagaagtcagaagttttctctcatggacgacaagccgccagcgtcgccgtcctcgtctagccccgattttgttaaagagaagattcagcagttgggcctatccgaggttaatgaaagcaacatcgtgaccatcactccagacaagctgacatccgatcaaacgaaggattttgaagcgatgatgcagcaagcacggaaccagttcttgagctcatttatgcaaacccgcaagggaacagtggtgcagaagtataaggtaaaggtagttgctgatgttcctgggattagttcttccaaggatggagaggtgaaataagctccagatggctcgggtcaaccgagtgacaaaggtgcttcagatggttctcaaggaaatcaaggtgacaactcccaaggagtacagggagttcaaggtgatggtactcagggggttcaaggtgaaggccctaatcaagacgacaatacagcacagttgccgttcaacaacttccaagatcaagttgactatgctgtacaccatgctttgatcaatcaatctggaatattaaccaatactttggcaaacatggtgaaatcaatggttgatggttcgatggctgggtatcaagctacaggaccggtcttcctaccggaaggagtgttcccaaattatcggccattaatcactcacaatcaaccagttgcctagtcaatccccctcaatgcaccatcggctcagccgatggcaccagtatcggctcccgcacttgctgcagcaccgtcagctccaggccagttagttaatccccggttgttggtgagagaacaaccacagcacagcggacagaacgtgaatcggctaatgcaagaccaggttgcatctatgttcttacctccttagcataccgttaatccaacccagcagcagccgattcaacaaacaccgccaaggcagcaggttgtacagccgattcagcaaacacccccaatccaacaggttgtccaaccagctcagcagacgccgtagagacgccaggttttgcaaccaattcaacagacgccattaaggcagcaggttgtctagccaattcagcagcaaggcttaatgaatgcatcggctgggtttgcgacacctggtggtcagcctgtgcagcatgctgcaaatcaagttgtcccggagcacttggttcatcacgtacaaccagatggcatggtgatacctcaagttattcctgagcatttggtgcgcaacattcagccggatcttcagaattaccaggggggcaatttgaattatcagtatcagccaccatcaccgcaag

SEQ ID NO: 72263 - DNA, 8530 bp, Oryza sativa
ttcaacctaatcggttcaaagttctagatttttcaaaattctcagggcaagatagcacatcaacttatgagcatattagccgatttttagctcagtgtggtaaagcatcggctgtggatgccttgagggcttggttattccggttgtctttgtctggatcggctttcacttggctttcttctttgccatatgggtcgattaacagttgggctgatttggataagcattttcacagctatttctatagtggggtacatgagatgaaattgtccgatttgatagcaattaagcaaagacatgatgagcctgtgtatgagtatattcagaggttcagagaaatgaggaataagtgctacaacttaagtttgactgatgcccagttagccgatttggctttttagggtatgattgctctaatcagggagaaattctcatatgaagactttgaaagcttgtcgcatcttacacagaaggtaaccttgcatgaacagaggtttgcagaggctaggaagaattctagaaaggttaatcatgtctgtccttatatatatgggtcggatgatgaggatgatgactctgagatagctgcagccgaatgggtaaggagcaaaaaggttattccatcccaatgggtgaagaactcagggaaagaggagaggtatgactttgatatcaccaaggctgacaaaagttttgacttgctactccgagagaagcaaattcaacttgctgccggtcacacaattccatcggctgaagaattgggcaagaaaaggtattgcaagtggcataattctaggtctcatactactaatgattgcaaggtcttcaggcagcagatccaagcggctattgaaggaagcaaaatcaagtttgatgattctatgcggccgatgaaggttgatggcaatccttttcctgtcaatatggtgcatacagctggccgaacagccgatgggggtcgtgcaagaggttttcaggtaaattcagctaagattatcaacaaatatcagaggaagtatgataaacagcaggagaagcattatgaagaatatgatgatggctttgatcctcattggggttgcgagttctttagattttgttggaatgaaggtttgagactatcatctattgaggactgtcctgggtgcagtgatattgcggagagctcaagccgatcgtatagtaggggcaatcggctaaggcatacaagggttccctgttcatcaaagattgggtccagtaaacaaagatcgtggccaggaggactatgaaaacaggaaaactcaatggtgtccttctggtatctttacaaagaatcagaatagaagggttaatcaagttcctgtagccgatgaagccacagccgatgaagcaagaagattggataaggggaaaagtgttgtaactgcttcggtcaacatggttttcacgttgcctgccgagtttgggatcaagcaagccgatgtcgatgaagttgaagaggaatcggctaaattaattttatcaccagaacatgcagttttcgagaagccagagggtacagagaatcggcatctcaagccattatatataaatggttatgtcaatgggaagccgatgtccaagatgatggtcgatggtggggctgcagtaaacttgatgccttacactacgttcaggaagctgggcagaaacgccgaagatctcatcaagacaaacatggtgctcaaggactttggcagcaatccatcagaaaccaaagaagttttgaatgtggagttgacagtcggcaacaaaaccatccctacaacgttctctgtcattgatgggaagggttcttacagcttgttgcttggaagggattggattcatgccaattgttgtattccttcaactatgcatcaatgcttgattcaatggcaaggcgacaagattaaaattgtgccagacgacaggtcagtcaatgttgccagtgccgatttagctctttgggagatgaatggtcttgattgtttatctggaaaagtttgggatggagattttctaaaagtgtccgattctgatatacatccaattgaagatggagagcccaagctattattttgaaggcgtcatggagggttcaaatgtctacaccgaggacacaatagatgatctcgatgaaaaaaaaaggacagggtttcgtgttggccgatgatttggaagaaattgatataggtccaagtgatcgaccaaggccgacatttattagtaagaatttatcctcggaattcagagccaagttgatagagctgttgaaagaattcagaattgcttcgcttgggagtattatgaaattcctagacttagccgatcgattgtcgaacatcggctacctatcaaaccaggggttaggccacaccaacaacctccgagaagatgcaaagctgatatgctccaacctgtcaaggctgagattaaacgcttatatgatgctggttttattcgtccttgccgatatgctgagtgggtttctagtatagttcctgttatcaaaaggaacggtaaggtcagggtgtgcattgattttcgaaatttgaataaagctaccccaaaggtcgaatatccaatgccagtagccgatcagctggttgatgctgcatcgggacacaagattttgagttttatggatggtaatgcaggatacattcagatctttatggccgaaaaagatatccataagacagcttttaggtctcctggtgcaatcggcttgtttgagtgggttgtgatgactttcggcttaaagagtgctggagctacatatcaaagagccatgaatatatatcatgatctaattggctggttggttgaggtctatattgatgatgtggttgttatgtctaaagagattgaagaccatatagccgatttgaggaaggtttttgagaggactatcacgtcccaaaacgaccctaaaatatatcctttaaattatgccaagaataattaaaatcagtgtgaaagcctccaaaaattaaaatgtgcaaagtaaaagtcaaataaggcttagaggatttttgtatatttcctaaaagcctgaaatgtgtaaataaattttagtggaattttcagagcacaaataataattattaagaaataaacaaagttgaaaaggttttataaaaagaaaaaccctaaaaccctccctccctctcttgggccggctcggcccacttccctccccctctctcctcttcccccgcggcccactcggcccctccccgtgcgcgcgccgctgacgggcgggcccgcccgccaccctctgacgggtggagcccacccgtcatctccttcctcccgccgctcccgccacctcgcccgcgcctagcgccgccgccgccgcgaatcccgccgcctcccgtcgtcccctcgtgaaatcaataggggggaattactccccgtgatcccctctccctttccccccattttcccctctctctctcacattcaaacggccggatttgctcccgcaaatctcgccggcgccattgatggcggctggacctcccggccggtttccttccttccccggccgccctctcccccttccaaccctatttaaaccctcttcgcgcctccctcgcccgtttccgccccttgccgcactgtctcctttccggcatcgagctcgcgccatcgccgtctctctcctccgtcgccgacgaccttcggccggctctctccgctcgccgggaccgtttcccgccccggcgtcgcctcctccggcttcgccgcaccgtcgccgtccccgtccaccccctcgtcgagttcaccgaccgccggagcgccgccgtccccgtcgacccgagccgcgccgccgccttcctccgctccggccgcctttttcgtcgtcgccgtcgacctagggtgagccgtggaccgccgcctcgtttcctcctttccctcccctctctcagccgccgctccgccgtgcctatggccgccgccggcgaccataggggcgcgggcgcgccgcctccggccggccgcgccgacgtggctgccttcgggcgcgctgagcggctgccgcgtggggcccggccgtcagccgcccgcgccctcgggtgcggctgacgcgtggggcccacggcgccggccggtgtgagcccgggagcgcccggtccaccgtggaccgtgaggctgccgcgtggcccccactcccgtggacccggttcgcgcgccctctcccctcggctgacgcaataaaccatttttaaattaaaatttaaatgaagaaattagtaaatattcacttaaagagcatataaacttcaaatggccataacttggccatttgaactcggaattggaccgttcatgtctctaatttttccttaagaagtcaagaacccattttggtgctttgttcctacttgttatatggagtttattagagtaaaagcctttttcctttccgttggtcgtgtagacgctgcagcttcggaagatccgctctacgtggaggttgaagccaacgtttgggaaagcgagcaaggcaagtcacatcatccttgaacatattgaatcccagtttataaaattattttgatttaaattattgcattatcgctttatttaaattcccgcgttatcactgttttatttagccatgcctatttaccattcttatgaccttattattattgttattgttattattaccttgttcaccctagaataaacaaaaccccaactagtgggtactctattcatggtaccactagtatgaatttaggtagatgcttcgctgtttaattaggcaacattaggtggttttacaactctagactttgggaatattcatgtcacctggacactatggaatggttggattattgtggaattggattcacacctccccctctattcaaaatcctcaaaaaggttttaagctgggctcggggtgcatggttttgatagtagtacctcggccatataaggaccggtcttcgggcctctgctgcaaagcactaccgtacttccacatgtctagtgggtaaggcttagtttgtggctcagtctggttataaacaaaagtacacggatggagatggacaaagtcaggggacgatggacatctctagggcaaatgaaggctacacgagctgtggcccggtagtcaagatgtcatggcacagggctggtgtcctgctgctaggggctcaatcctgcctacctgtcccggaggttccggccgtaggtggttcggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtggtttaattcttaaaacctgcttaacaactaaaatgtggaatggttggcctgggttggcttgggacgagctgggacccaaggtcgggttgccagttcggtccaaatcatcgtaggccttaggttaaggcaggttcgtgggggttcacggccttgattaataatattgcatagctctaggatcgtgtttacaaagtagctttgagcaactaagtgacttttaatgctgtttactgcaaaccctaaccccctatattataactcccttgtactcccttgcatttattctacactcgtgggtgtgtcttgttgagtacggtggttgtacccagtcttgctcaatttttcccaatcccagaagaggagttcctagatgatgaaggctttggtgtctagctcgtgcctgccgtcaagcgcctgtggtcgtcgccctagtcttccgctgtttttcgtttgtcttcctgtgtgctgggccttcgccgcccatgtaataaattatctatttacgcttccgcttgttaaactctgtattgtatcaacttttggtgtaccttgcctcctgggacaaggaataatacacgcacgtaaggaacgcccgttgggttatttccggtcgtgacaaggaccaggaaatatggcctgaagatggacccgacaatatgtgcttttggcgtatcggctggccagtttttggggtttcttgttcatgagagggggattgagataactcagaggagtgttaatgcaatcaagaatattcagcctccggagaacaagacagaactgcaagagatgatcggcaagatcaattttgttagaaggtttatttctaatttgtccggaaggttagagccttttacaccattgttgtgattgaaagctgatcaacagtttacatggggggcagagcaacagaaagctttggataacattaaggaatatcttagttctcctccagttttgattcctccacagaaggggataccttttcggttatatctgtcggccggtgacaagtcaatcggctcggttttgattcaggagcttgaagggaaagagagagttgtgttttatctaagtcgtctgctcttggattcataaactagatattcccctgtggagaagttatgcttgtgcttatatttttcatgtacaaggttaaggcattatctattgtccaatgaatgcactgtcatatgcaaggccaatgttgtcaagtacatgttattagctccaattttgaaaggaagggttggaaagtggatatttttcttaactgagtttgatcttcggtatgagtcaccgaaggcgattaaaggacaagctatagccaattttattgtagaacatcgtgatgatttagtcggctcggtcgagattatgccatggactttattttttgatggatcggtgtgtactcatggttgtggtattgggttagttataatttcccctaggggggcatgttttgagttttcttatactatcaaaccttatgcaaccaataatcaagctgagtatgaggcagtgctcaaagggttgcagttactcaaggaggttgaagctgatactattgaaatcatgggagattctttgctagtaatcagtcaattggcaagggaatatgagtgcaagaatgatacattaatggtttataataagaagtgccaagaactaatgaaggaatttcagctggttactttaaagcatgtatctcgagagcaaaatattgaagctaatgatttagcccaaggggcatcggggtataagccgatgatcaaagatattaaggtcgaaattgcagcaataacagccgatgattggagatatgatgtgcatcagtatttacaaaatccatctcaatcggcttctcggaaattaagatataaagcgttgaagtatactttattggatgatgaacttaggtgtgttgcttaggtgtttgagtgccaatcaggctaaagttgcaatcggtgatgttcatgaagggatttgtggtactcatcaattgactcataaaatgaagtggttgcttcggcgtgcagggtatttttggccgacaatgcttgaagattttttcaggtattacaaaggatgtcaagattgtcagaaatttggagcaattcagtgagcgccgacgtcggctatgaatcctatcgttaaaccaaggccattcaggggttggggaattgatatgatcggcatgattaatccaccatcgagtaaaggacataagcttatactggtggcgaccgattatttcaccaaatgggtagaggcgattcctttgaagaaggttgattctggggatgcgatacagtttgttcaagagcatataaaataccgatttggtattcctcgaactattataactgatcagggttcaattttcgtgtccgatggtttgttcaatttgccgaaagtatgggaatcaaactgttaaattcttcaccatattatgcacaagctaatgggcaagccaaggcatctaacaaaagcttgatcaagttgattaagaggaagatttctgattatcctcggcaatggcatgctcggttgcccgaagcattgtggtcttatcggatggcttatcatggatcaatccaggtccctccttataaacttgtttatggtcatgaggttgttctgccatgggaagtgaggatcggctccaggagaacgaagttgcaaaatgatttaacagccgatgagtattataaccttatggccgatgagagggaagacctggttcaatcacggttacgagcacttgcaaaggttaccagggataaggagagaattgctcgacgctataacaagaaagtggtgcccaaggatttttgggaaggcgaacttgtatggaagttgattttgccaattgagactcgggatagcaaattcggcaagtggtcgccgaattgggaaggaccgttccaaattcataaagtaatgtctaaaggggcttacatgttgcaaggactcgatggtgaagtgtatggaagagcattgaatggcaaatacttttagaaatattaccccaagtgtttcggttaatgcatgatcggctgatgttgccgataaatgatagccgatgtat

SEQ ID NO: 72264 - DNA, 9082 bp, Oryza sativa
atttttgaaaactatttagggatcatctaggaaaaattaaattgtgatatagactcaatcatgttaggattaaaagaagaggcgaaaacatcattttttaatgatctccagtagtcaaatattcaaatatataaactgtaatccagggcgaacttttgtttccaagaaattttacttttggttaatgtacttctgtgaaggaatgaacactagtgctgtagtccaaagaagctaccaagagaaggccttaaacaacaactagacagagcatttgtgaaacctaaaacgtaataaagaagcagctacttactggataatttgaatgattgtcctttgagctgagttttcagcagtaatcttcggacatttggatcaggtaatggcacatatattctctttacctgtttataggaataaatgttatggcattcacaaaaaaaggagcaaagctagttcaaattactggctcctatacatactactacaatatataagcactagaaattcaggagtaaaaggtttatataaacaagctgcattatgtaccaaaatataagtgctcagccttttttcaagaatatggatatatgcattatttataagtaataacacctcagactcttctttctaaaagaacctggctaccacaacaagctgcctgcttgtaaacagtgaaaaatagcattttctttagtccagttcctaaccaattgcttgtaccacaatacccacgggcaaaggtggaacttgtaccaggcattaagcagcagaaactattgcatagaaattttgaagacctaaatgcaatgcaggaaacatgaagccaaaatagtggcagtagtcccaaatatatatcaatcttaccagtctacggagaacagcatcatccagctcttgtggcttattggtagcacctaaacaaataaattccattaatagatgacgcaagtaataaaagaagacacttagtataaaaaaatattggcgacaaagaatttttgtttttcgttttaacatacactcactaagtgagaaaacgacctacatacatgcactaaaatcaggaaagctgtatcactcaagatcacaaacttttgctgataatgttggaaactatttagaagtatcctagtatacaaaaaataataccaaaaaaatgagtttggagttatttaacaacacccgaacacacttttaacaatttcttatataaatgaattgaatcaggaaacaaatcagtagcatgtcataaatactttccctatttcagaaatgcttttaacatggacactcagtaatatatgaccatgacaaatagttatacgatactagtagtaaataaatattttctccataaccaatcataacacaagctaacttcaattaagtaactagaaaaagatagtgatgctaacctataacaataacaagatcatcagggtttgaagtgaccccatcaaactggataagaaattcagatttcaaccgcctgctagcatcattctcattagctaaccttgctgacatgacactatcaatctgtaaaaggcagtcaacatgggcaataagcaactatctaaaataataaaaataaagtagctaaacacattaagatcctagaccgactaagctagcacagaaagccagatatgcagataacatctttgcattcatctatatttcttgatagatttgaatggaaaggaatgctttagaaccaaacgttaacgttctggtagaatttgtggacaacaataacaataaaaaaatattctcgatgtattaaacaaatgacctcagcaggcaagcatcacaaaagttcaaaataataaaaggggtgacatgaaaccatagaagccttaatgacaacatcacagcataacagagtaagcctaatagcagaatgctatgatgagcacattctggtattctgtggaaagtttacacaaaacacgtgtgatgcagaacacatatatttacatgttctaatcacatggtttaaatggatagaagttctcagaagcaaactatttagagaaacatccttttttttcattccaaaaagatgatagacatggttccaactcatgttgatgggctacactaaaaacactcctaaggaaaaaaatggagtcgagaaaacattttgtgttgacatcaatttatacttcataaatttaactacaagtgcactacaagaagggtttataatgaggacctcatccataaaaattacagatggttgtctatcgacagcgaccatgaagagtgtccgtacaagcttttcagcctctcctacctgttttgcaatgaaagaataaacttgattcagagtggggaatatgtgtaagcatgtaacgtatggagggatggccacatacccactttgatgtcagtgaagaagctgaaacattaaaaaatgttgcttcagattctgatgcaacagctttggcaagcatcgtctttccattccccgggggaccaaagagaagaagccctaaggtatattatgatgtacataagatggctattattacaaaacaatgtatataacagaaattatcagagcgaagatgtttacctctagcaggcctccgaagaccagtaaacaaatcccttcgcttggtaggtaaaatgaccatttccatgagtgcttgctttgccttgtcaaggccagctgcagatcaaagcagaggataagaacactacaatgaacactaggttttatttgccatagcatgaaaaacaaattataagcttcctaccaacatcttcccatttaacagcaggacttctatccacaatggtcgtatttatcatttcaacaagcttatcatcatagtttgcaccagctctttgcacaggtttggcacctccactgctactcttctgatgagaagatgcttgaccacctctattaaaggtagggctaggctgcgaagtaggcctatggaagctagttgatgcggctctgtcattcctattaacaggattgtttgtaacaacctgtaaaatataatacacagctattgaaaaaaatacataatcgattcgcttgccacaagtaactcgttaagaaaatacagtgttcaaaacctcaacataactttgcaaacaatcttacttaattttcttagattggacattttgctgaacgcatgtcattaaagcagcaaaccgtcaaagccaaataagtagagacctaattgcattttgaagtttcatgagttacttcaattttcaaattttattattgaaattacaaatactcattagaaaaggctacattgatagcaatcacacttgaatggctaagtcagaagtgaagtgtagaaaataaacagctgagtaaacaattattgaacaaaaggaaaaaaaaccaacaggcacgctcgctccacctagaaaacatgccatcttatttagaagtaagagagttgaccctactgcatattcagtttcgcatgcagcactcatgttaattgcaacaaacaaacaccaatgcactaagattcacagcctggaaaacaattaaagctaaatttgacagaattacaacgttaacaactacagttcaatgaaatccataccttctttggcactggtgcagccgctcctgcaaaatcagatgatatagatagttaactcccagtgaactacaatacaaaaccaaagcaagcacaagtttatgtacgttaacaaaacaaaagacaaaagaaactcaagcgtccatgtattatgttggtatgaactatcatagaaactgaaaagcagaacattaagacctgtaactgaaaacacaccccacttgcttgttgtttaatccaagcatacaagcaatggacgttctaagcttctatctatatcatatacgtaaattcctaaattaacaccaacacgcaggggcggaactgggcctagggcagcttgggcccgaggcctactcgtgagagaaattttagtggacttgtactagggatggcaacggggacccgaatcctgaatccccgtggggaaaaactctattaggggctataaataggtccatattactccccatggggttgttaacgggcaaaagcaagccccgtcgggtggggcgggttcgggggcgttctctaggcccccgtccccgaatccccgagcccccgagtgtagcacatgtgcacctctcctcagcccatctagagatcagaagcccaactatccaggcccaattcacatggacagatacacatataaatagagaaaccctaggtcacaacacagctcgtttagtcactcggctaggtacccaagcgccgccacacacccaagctacagacgccggcgtagatcgatgcatcaccgaggcagcgacgactccaggctgtgccccacgccgcgtcctgaccctctgccgttgttcgccttgggcaccggccgcgtcgtcgcttcgctgcgcgcctgggctgagccgccgccgatgtagcggcctgccgatgcaaagcacagcgtgagagctgcacagcagccacatgaactttgattctactgcttttgattggtgcatagcttgctcttgggaattggaatgaatcatgtaacttctctcttctgattcatggatctgatgtgtgtctttatcaaaaaagaaagaaagaaaggatttgtcatctgggtgcatgactaagcatttccttttcttaattcttgtgcatctattctctctactcccaaattcccaaacttttctgaatttgtatttgtgtctcctctcaattcccaaattgatgcaccgtgctgcactgtgtttcctctcgggtgcgcgcccccgtcagagccccggaaccccggttggggcggggacgggaggaagattgcccccgactgcagggacagggatggggagcgggggatttccaactgctcgggggaggggacgggcgggcactatccgtcggggatgtccccgttgccatccctaacttgtacccatatattttcagattttgtcaaactccaatggcccagccctatgcgtggccattctcagcctcgtgtccttcaacccaattggaagcccatagcagcccagtagcaactaaccctaatccccaccaatcccaccgtccccctagccacgacacacgagcgcttgcgccgcatctgctcccaaccacagccattgacgcagcaggatgctcgtcgcctcgccctcacctcacctcctctcgtctcgccacatagatggccacggcacgcatcggcatcggcagcgagctagcaacagcaacgacgtttccccttcctcagcaacttcgtctcccaacccagcatctttgctcaagtctcaggcctcaagtcaagcacccaagaaagtttgattcctaaaatataggttggtcttctctcaaatgttcgatccgtattctcattgtgcatttggtagctattaatcaattagaaatcttgtttgatttcctagatgaagagcagagtgataaaatcattctatcaagtcttccaatgaatccacaccaacctcataaatagtataaattgatgattcctcgcggtattaattgatgaggcatgagatggcgaaaagcaatcgattgtttccgttgccaagtgttgctcttctatcttagattttttaaaaaaactaaactaatttgattgccaacactgttaattaagactgagccttcttagctatgtatataattaaaacatagctcacaaacaagatgaatgatggctggatgaatattgcatgttatgctatattgcgctagatttgtttgctagcattgaaaatcggcggattatactatacttctaccgtactgcagtgtacaaattttcatgggtagttttagccttcaatttgagccctaggcgtcgagaaatcctggctccaccactgccaacacgcaatggttcacgagtaaactatggagtacaagttaatgtctctagacgaataagtggaggacatggctgggaaaccacatttcatgagctcggtggtagttgctctctagacgaataagacggaggtaaattgatggggggaaagaagtggatcgactcaccactcctctggccgagcacccggagtcgttcctccacctgagtctgccactttgcgatcttctcctggtagaccctaacctgccccctctcgctgcaatcaaaaacgcactcacgccaatcagcaatcacaaaccctaaccgcgcagtggggaagggaagggcgcacgcacgcacggacctggaggatacggcgtccgggacgcgggcggccttggcctcgagcatgacgcggagcgcgttgcggtagtgcgcggcggcgtcgtcggggagcccccactcctcggcgcgcacggccttgtcgatctcctccttggccagctcgaagtatcccctgagcttcaccgccacgcgctcccccaccaccgccgccggcgacggcgccgccgcggccccgtccatgtctccccccttcgcagccgccgagtacagcagcgacgacagggagtccgcgagcgcgcggaggaagctcatgcgccgacggcgagcagcgccgccgggagcatccggattccgcgacgcgcgatcgagttggtggggaggaggaggaaggggaggatcgcgtattcgcgtgggcgtccactagtccacgcaagcggcggaggggaacgaacactatcgggctcggggctacatgggctcatgggctgagcccaatacaataccgctatacacttatcaggccagaccagtgggccacactgattcatctcccagtctaaataagtctatttggcatccctccagtcttgcccatggtcgaattgcatcgcatacctccagacttattccgtataagagcacttcagagatactccaatacttactacacaggcataggattattcatgtctgttatgttagcatcctgataattcaatttcaagtcatgtgccattgatttgctcttgtgatgaaaagagtaatacactacttcagagatactccaatacaggctgcacaagtcatagtattatttcagatgaaaaaattggcccttggagttattttctgctgaagctccttgcctttgtagactcttgttactggcttactgcagaactcagcctctcattgttgaattcagtttcatcttccctgagacaagaacaagggagcttttcgaatcattgtagtacttcagacaagaacaagggagtagtatattttttttagaccagaggcgaggaaggtcaaacctatttacagtatttaccttctcgtgtagtcatgtaattattctcgctaaatatatttgattaaaaaaatctccaaaatgactcagtatgttctctgccgaattaattgtttttctattgcagacttccagtgcttcgactgttagcttgttgctaaccaggggcggagctacattgaagagggggtgcccagaaacccggtcaataaatttttttagttgtagttcatttattttcaccatataggcacccctctaatccaaactcaggcactcatatcaacctaaactcggcctaaagtagagtaaagcaagcgaatggcacccctctccattttgttctagctccgcccctgttgctaaccaaatccaaggatgaaagcaagccgatatttcctccattttcccttgatatgaactaagattagatttatggccatgcaaagttggaaaccttggggtgaatgacaatgacacggcaactgataaagagtcgtagagtctcatcttttcgcttaggcttatcagccaaaatttaaactttcaaccttaaatttagagttaattttgagttttttttatcaaaatttattttacaacctttatttttaaatcgttaagaacatgtatataaaaattttatttataaaatatttttcgtttataaatatcctgtttaacttattccctcaagaaaccaaatgatagggcgtgtactctctctataaaaaggaatccaattgtgattttgaaactgaacatacacgcactttggataattggatggtctcggacagctgcgacgtcacgcagatgcagtttgtcagatttgccagttccaatcaacagacttttttcgtttctgcatcccaatcagatagagccacaacgctcgtgacaatgaagtgaagtggcgatggccttcagcttctagaaggaaaccacaaaaatgcactattccataattaatgcaattgtccccagcagtatgtgtcgccttccgaaaggaaaaagtcggagagaaggccgcccaaaaacaggtacccctccgtcccataaaagtagtcattttaccccttgctaaatgtcccgtaaagactgtcgctgcagttccgtgctgccattactacctcttctggtgattctggtccattcatttgaactgagtgcatacacattaattcttttttatttctcaagcacttaaacacactgacaactggagggcacattggtaactttaactgtgagctaatttatctcataactactagaacgtccacctttgtgggacggaggtagtattatcataaagtcgttatataagatgaaatgaaagtatgcatttacgtatgcagacttgtaaaatacgagtagtatttggttgcaaagtctcactgaatttgaagatctcgtggatgacagttctgcagttcacttctgctcaacagttcagaactgagatttattcttcaccaaccaaaaaaagaaaaagaaaaaacatttgagattctttagagcaatcaaacaatatactgttatccatatgccatagcacatgacatgactgcctaaatagatactcatattacaatagtagacattgtagtacttcagaaacgggatcaattattgaaaagagacgtgttcttctagaaggcaagggatgcacacaaaaacaaaagcaatggccctgtttggatccggaggccctccagaatcttgttatttaggagtattaaacgtagattagtgacaaaacccattccgtaacccctaggctattttgcgagacgaatctaacga

SEQ ID NO: 72265 - DNA, 15141 bp, Oryza sativa
  unsure (1)..(15141): unsure at all n locations
aaatcgtcattgtcttctttcgacagtgaggttacaattggcagcgttctggtacacacattgtaatttacaaggtcaccttaaaaggtttcctttcatgtaacgtgttttaggcgagagctaggcagctagcatagtgagattcatgagaggacaagtgcctcacaattttgttggtgagaaatttatcacatatgtttatgtatctcttgtggcctgagtttttggagctcttctcgttgaacttgtgttggcaacttgaaatgttgtcatttaaagctcctcaaagtcgcctttctaaggctgatttcatttttggatgttcccaacttacgttttttgttcgcacggtttccaaactgttaaactgtatttttttctaaactaagttataggaaagttgtttaaaaaattatattaattcattcttaaattgttttaactaatacttaatcagccatgaactaatctgttttgttttctgtgcatgggatcagttcccaatccactccaaagaacacatctctaaattttcatgacatggtaccatactacaaatccatcgcaatggcttgttttgatgtaacagtagaaatttaaatgaattttgtttttgatatataggatgactcttcggaatcaaacaaaattattggttgtgtcaaagcccagttccggttttgacactatcaaatttgagaattcgtactagcctaggtaaaatttggaaccaaacaaaaaatccatacagtacactattgaaatagtcaaaaaatagcttcaatccaaaccacaaatttgctcatttgagaaaatttgggcctgaactgtacagcacatagacagacaggtgggcccgaactgtcagcctcctaggtagcaaaatccccaacccaaccgtaaatttccccgaccaaatccacgcaaaaaccctttcgcatctaaaccctcccctcccgtggatcatcgccgccgccgccggtatctcgctgacctttcctctcgtcggaccaagttttcgcgcgtcccaatctgcggatccgtcggtcgtcgccgtcgtgatgctgtccttgtcgagggcgctggggaggcggctcttctcctcctcctccgccgccgcatctgatgccaccgccgcggccgccgcggtggtgaggaaggcgcaaaacccactggaggagttcttcgaggtcgagaggagcaccgaggaagacaagccccctccgcactacggtatccatacctcccatttttccttcctatataatcattcacacgttctacatctccactagatattttattttgttttgttttgtttgcgtgtggtttgcgaaattcgcaacgagtcggctctaaaatgtcttatggttgggaatttcattgtgttaatagttagtggaaaaggctctggaagcacagaacaactggttctgttagagagcatgccattacattgtattgctcatgattgtaatccagattaacgaaaataatagcacaatttttggacctgctggtcaagcatagagccgagttttccttttaagaaaattaatgatttcgtataccagggtctatatagacggcttacgatgatctgtgtatgaatcttctgtcttggtctttgtaaagccagaaaccaggcatctccagatacattctgttgatgccagtggtagattgtatgtgttcttaagtgcttctgtcggtacacataggggtgctaatgggttgaaatccaatccattattgccccaaccaaaccaacccagaccacttctccttcttcaagctccaaaccaatccaatccatgaacattttcaaaccaaaccagtccataccattctagtaaagtgggttcaatccattctaaatccatggactggaaccgcagtgtccaatccttgattcaactgtccctgggaaaaccatggtggcatgcaccatgcattggacaccatgcttggatgcgtatatatccactgcagtatcacaaaagctgtggttgctgagaccctcctccacgcatcaggctgaccaccggtgccgctgtcgctgttgctgagaactccggccacatgggagccccgctgctgaccgtcagcttgcatgtcaccacattattgctgctgtccaacagcccggtgagccagagcagaggcgaaaacgtctttgctgttactggtccaccagtgacagccgatgccgcgctccccaccagcagtggcgccgcgccgagcgcgaacagccagccgagcaggcccgcatgctgggaagaggtcaccgatgccggcgggagcggcgcgaggtgatgatgatgagccggtggggtgctgtggcggcactggcgaagtggacggcaacgaagtgatgatgatgaaccatggtgatctccctgtcgtactcctgccgccgccggcaatgactggtggcgcagaagggtgcaggaggtggagaggaatgtgttgagccaccggtggcgttgagcacagtggtggcggcgccgtggctttcacctgccagtgtcgcaggaagacgaacgggatttgggcacaatccaatggatgcccatgggctgaatccactttctatctgaactttcctaaccaaaaccaatccaatactttcctaaccaaaaccaatgcaatcaaaaccgttctgcatctccatccaatccacccctatccattagctgcatcaatccatttccacccaccgaaagccaacccacactgaaatccagcccattgaatccattagcaagcctaggtacacgtacatatggtacagctatcagaagaatgatatattaggaattttaaagcttaccgatcagaattaataatttactatggttagtttgcaaatgtttttcttgcatgttgacatctagtttttgggtttcttctgatgcactaagccaatgctagaagcctgaagtgttgctttgatactgtgcttgacaaggacatagttattaacatgtcggtgcttctttatggtcatgtcatagccctagcactttgcatttaatccaggtgtttaggtatgaagttctctgttatgatcaaataaaattatccaatgatctttgtcaagaaagcttatcagtgccgccttttctttttattaattggcaggccgtagttggaaggcttccgagttacgcctaaaatcctgggatgaccttcagaagctatggtatgtccttctgaaggaaaagaacatgcttatgagtcagcgccagatgctacattcagagaatatgcgttttccaaaccctgaacgtgtttccaaggtattgcacggccatcttaacaccctgcctcatgcaagtaactgagactatttaagttctcagttttgtgtaactaggtcaatacgggacaaaatttggaagaattgtgactaatcaaataactatatcatgctttttgttgatattatcttgtttattctgtggatggtaatctaacgacaacatgttttttgttagacgttatcttgtttattctgtggacggtaatatgctaattgcaaatcaaaaggtttcttgacttcttggtttggctgttcatttcttaacgtttgaactttacttattggaatatccttatcaattacaacttgttcttgtttgattgagaaacagagcagacattggcctctctcataatcatgtctagttaatccaatgccacaactgatccaagttacacaattttgtttctcttagaacattatttttttttgtccttgaataatgctaattttagtgatttaatcatataactgaaattcttcacacctactatttgtgtgttaggactccagaagcactgtccttttgtacttaaactaaatgatcccttccatatattgtcgatagacagttatgtggaatgcctgaaagcaatttccatagcagaattacagataattttgtgactacggatatgacttgcttcctaagataacattttcttagaatttcttgtcagggtgcatatcaaacatatttcatggcgtcttttctgttcttcaatcagtagttgaaacattgcatcattgattcttgtcatgatttcaggtgaagaagtcaatgtgtcgaataaagcatgtcttgactgaaagggccatagcagaacctgacccaaggagatccgcagaaatgaagcggatgatcaacgccctttgatcagctttcatgtttcatgttggattaacggttgaaaggacgagtagctatttttagaaatatctgcttcttttctgttgtatgctattctttatctcggaaagcggtacaagactggatccttttgatacccatggaatgcttgaaagatcctactatactattgacattaatagctccagggctaataattttgatgtcatctagaatccatgcaatgtgttttgcatgtccatgtttctgcctcactagaaacgaattcgttcctctgtcagtttcaagtacactgtactgttctgatcctcacttggcagcaataaaagtttgctgttaagtccatgagaaaattgctcatagtttgctagtggttggcggtggttaccgccatgcagattcaggtgtcaattttgcctgaaagcaagaaatttggtagctgtctgcagactgcagggccaaaatatcatgtgacgactgattatgagtgagacttgtgtcagcagcagatcttgtgctgcgtcaaatgggtgtgtgtatcttctgaaacaaagatggcacagctgctagcctggtaggctgcccgttgctgcagctgacgattctgaattattttttttggcgccgctgatgaggaacggatgatgtaccgacgccggttttgacaaaatgtggccgtcaaattaataatatgtacctttttttatgggtggtgttttggtagaagtattatgcaagtgaacatcataattgtgttttgttttgctgtcttcagaagaaattggggattgctgctgttaaaggtacagcactggcctgcttggttgacgaggctacgacattatcaacagtcagaaaatacagtactcctacacccaatcaatgtctatttgtcatatgctatccgacgcaatataggatggatctttgaaatgcaggaattttactgaatttcatgtgaaacagtttaattcctacgaaattccttgaataaatcctatgttctaaaataggcctaaattaatctgagatctgcacttcagaacaagggagttttatctgcctaaaccaggctcacctgccaaccaccccttcttgcctatccttatcatatccttcattcacatttctctccttttttttttagggaacacatttctcttcttcttctttcttagaaaaagggagaatgtttgccattctctgatgtcctctacatttatttgattgtagcgtttttcgccatgctttgctttgacgcttcgtccaccacagttgagctagaagtagtgacaaactgacaattaaccagcagatagatatatcacccaaaagtccgcaatacacacggaacttgtatcactagtcaccggtcattgttaacttatactcactctgattttgaatatttaatgtttacgataagactcatcaaacttttaaaattgttaaaactttagtcatcaataaaagaaaatcatatgcatagattcctctcaaaagcatattatcattttatcatgaattcactctattaaaaaacacagcaacatctacaaccccaaagtacttatattaaatctaatattaaatatgtattgatattatatttgttttgcgttcaaaattcaaagcatcttataatacgatgaaacggatggagtattatcacactgtgtaggccccacgagcagtgggtcccatgtataattcagcggcacataagtgggtgcgagtgttgatactgccgtaaacgaaagtaattatccggctagtgatgatgtgcgattccgtgggggcaatcgtattgctacgttgcgttgcattggatcaggtcgttttcggttgcgccacccaatcacgcacacgtatgcagggcgtcctgctacgtgcacaccgctttgcaccccgttttgttttatttcttacacgtgtaagatgtgttggccttctggctactacctgagtagttgtgtacttgtgtgtgttgaatcttgcatgtaaataaagtatagaggcatgttgtcttttagttatctaacaagttgaaacattgttaggggaaaagcttgtattaaatattaatgatttctgtaggttctctaaacagtgattttctttttggcaaagtctatgtggttggtaactagtggttttgctaggaatttttaagtgtagtttaatattaaatatttctttttaagcgatgagtgcgcacgcttctcgagtttcaaagcgacacttttttttctttttaaaaaactttgtgtatataaattttaggactattttaaatctagttttaactttataaaatttaatcatttataccctcgaataattatcataagttagtcaatcatccggtccaaaataacatgttggtgtctccaaattagcatatgtacatccttactaataattatgtagctctttgcaagtaatcaagttgaaatgacaattttatgcaaagggtttagagggcaattgaaacggtttcatcttgtggataacacatgcctctctaaaattgacaaggctgatgacttggcgtggatgaagcaatttttcagcatttcttgttttcttgcaagaatcgaacacctcagagagatgagtttgctgtggccacgcttccagattcctactagattctgttactttcagcttacggatgtagattccatcaacgatagatatatatatccccagacaaaaaatatttattaggtgtttaatcgataataattactccatcagttaaaaaaagacaatgaatctggacataagattatccagattcatcattctaagtagtgccaaattcttatcttaggttgtttttttagcaaaggaagtatgttgtgacgatgacaagttcatgctttttttttacgtaggtgtcctggatggaacaatttattttgaactcagtccatctcattctcacatcctatttctgacaagagatcgaatattgctgcttcacggcacagctatatacttgctccattccaaaatgcagctataccttatataatgcaaactacatatcgtatagaagactcaatcttctgatccaatagtaatattactacttgattgttaaattacaattgttcatttgaaatgcttttccttaacaacatatattttttcgttgtatgctgttatcattaccttttattctgttgcctgcaaattcatcagtgtatagatatatgcatggggtttggtattagtatgatgttatatatatatattaattgtaatgagatgacatgtcctttgcattggactactttcctaacgattacctaattccttgaaaccaatcagagattgagagtccattgctcttgaacaaaatttgagatattataacattaattgattggtatcctctacgtccattggaggcactgacttcatttcgaggggtcttattcaaagtcgctattatcttttttgataataataacaacaacatcttctattatttttataagataaacatggaatacattgatactatatataaaagagtttgctggttaatttcttctccaaatttttctactccggctcatcgatggactctagttaaataagttatctttctaattattatagatatatagtgggcccaaatttgttgagacatgatggacgtgtattctggtaatattgcattatctttgttaccactagattatttttactagctggcttagaggtctgtggttgcctagtttgactagattatttgatcagggtacatttcgaatttaatattaggacgttccccctttaatttttgcaatgggaaattcctcctttagatctgtaagaggtttacatgttctgtgtactgtcaagcgacaactaaccaaggctaatcttgtttttttatttacaagacaaattcccatcagatgaaaaaaattgcctgaagcactagatagatcaaattaaagacaaattaaggaggctaattaccgatcgactgttatggcatatgttgccaagattgattagtaactagtagtactctagcttgatatagggctattttaggagcttatagaggttataactttttctagaattagaagctcttcaaattaaatcaccagaagctatatatagctgcagaaaataaattaaaagctagaagctgtttttctccagtttctctaaattctcaccaggtaaatttctttgaactgcttttgggaatctaaaaactccctattcaaggttcatacgagtacaggactgtactagcttctacagtagttaatgctagggggttggcagatgggcactacctctaaatccacttcaaacatataatgcaaaaatgtgacagcggcatacatgaatatgatctcaaccctaccctaccatttgtgacaaaaaaaaaaaagctcacatccaaatttgtacccatttctgaggcaaccaagatgcctagctacaccacataatcaacagatccacagggatgtttctgcaaattaggccacacacaaataattaatgcactaatcatgcccagcttctaggctctccagccagcttagccccttgatatacatacatacataccaattaagagatcatgtatcactcactatatatgagggacacaaaatgagaggagatgagatggatgtgtagtttgtgtacatggttagcttagctctagtactactagcttttgccaacaacccagctaagctgagctgatctcttcacgtttgtggcgtgagctagctgagcttattaactatctctctaccaaatcaagctaagttaattagctggatagctagctcggtgtggtggtggttgtcgtcgtcgtcgtcgtctccggcgtcggtgagacggcggccggcgaagaagggggtgcgtatatatggggaattcgcttggctgcgtggggcttggggagaggttggcggcggcggcgaaggacggcgacgcggcggaggcgcagcggctgctggcggcgaaccccgggctggctcggtgcaccaccttcggcaacctcaactcgccgctccatgtcgccgccgccaaaggccaccacgaggtaagcatacgtccacaatgaactgatcacctctagtacaaaaaccatctccattgatggtgcagcaagctagctaagctatgagctagcttctcctgtttttttttctttcagattgttcattgaatcattgaaatnnnnnnnnnnnnnnnnnnnnnnnngcaatcctgctgcactcatttttttagaaaaaaaaacttttcttaaaaatattcattatattgcattgaagaaaccacttgtagtacttgttttaagatattagttaagtttatttctataataaaatagataatttactgtaataatatgctcaatgatcaaatcacagacgaggtaatagctagattggtttgctatgttttttactattaaccaggcatatgagtgatgttgccctaggaacaagttttttaatcttttcgtttttaattaatttgccaaaagaatatattcaactgattttttttggaaaaagtttatacacacacacacacatatgcatgtcattaaagaaaaaaaagaattcgaaagaaagagagagtaaaaaaaaaagaatttactgctgtcctggtagatcccatattaattattaatcttttaagtgttgcgcaaaaaatggaaatcacaatcagtcctagctagctttatcccgcgatggctgaatgaggtgacagaaaacctaacggcaggatgattaattcttcaaatgaccaattgatcactcgtctcttaatctgatttgcgtgccaaaaatgaagaagaaaacgtcatcattagtgagatgtaacatttacgcatgcaagttgcctctattcattttgcgggttattgttatgctgatgtgtgtgatttgtaattgtgtaccaacacttatatacttaaaattccttttcatgttgattgggaatcgatgcaactataaaagaaagtgacactattaatggaattcgtcaattatcatgcttctcctttgtagaacggtaaaaactaattacaaaacaaaaaaaaacaattattcatcatggaaagagagagagagataaactaaaaatttagtctaaaaaatgtgtgaagttatttgctgcaaaatcattatgaaaagtatggccatggacccatactaatttgttccccaatcgtacagcctagtacgttgcaccagaaaatttaatgccgtcgtgttcagaaacactatcaacgaaaaagggacgtggtcgtacgtgtccgacgtccctgacgattcagacgacaaatctttcgctaaatcaactcaaaccattgtttattttgtcaaaaaagagagagcaaatttcatctgctgttcaatctctgaacaattgatatgttctgaattttgaacagttttgacagtctgttcaactaaccaactgtgatgttatcgattaaaaggagcaaatttcatctgctgttcattctctgaacaactgatatgttctgaattcttatcagtttttgacagtctgttcaactaaccaactgtgtgcccagaatcttcggtaatcagctcaaatcaattgtcttattatcgattaaaaggagaaaaaaattcagctgctgttcaatctctgaacaatcgatatgttctgaattcttaccagttttgacagtgttcaactaaccaaactgtgtgctcagattgctgcattgctgctggagaatggagcagatgtgaatgcgaggaacatctatggacaggtgagcgaactcaaactgtacaagcttagctctgcacaagctaagccaagccatcggtttttgactcgaattaatatcgagccgtttgatcgatcgcccaaccgaccaaccagctagtccatgtttctgacctggatcttgaattctgaatgcacatggggattgattgaactgaagacgccattgatgcaagcttgccggttcggtcactgggaggtggttcagacgctgctggttttcagatgcaatgtacagtaaactgattagctcctgcacttcagttaattgcaacgattaatcagtaaattagaaattaacttttgtttttactgaaggtgtggagggtggagaacctgagtgggcggacggcgctgcacatggcggcggccggcggacatgtcaagtgcgtcaggctgctggtggcggacgccgccggcgacagagacgggtaagccattgttgttgttgaggagctcgagcgaggtggcggccatggtgatctcgagttggttaattgacaggtacgtgaacaaggcggcgaacggcggcgtgacggcgctgcacctggcggcgctgcacgggcacgtcgagtgcgtccacctgctcatcgacgagcgcgccagcctcgccgcgcagacgctgccctgcgccgcgccgcccatggcatccatcggcgccggcagcacgccgctgcactacgccgcgtgcggcggcgaggtcaagtgctgtcaggtagtatacgattccctttttcttcctttctttgatgatagccaaatttagtgtgtgatagtgaaagtttggttggtatgattcagtcattaattgagcaattagtcgatttgaaaaatattagtttattgttgatttggttgttagtcggttagtgtcgacaatcccatcaattgaatagatggatgagttgaaatgttaactcactcgagttaaaacgaatcagttaaaaaagcgaattcaagtttcagactgatcatttcttggccatcgatttcctctctgaaataacagaaacttcttcaggtttcagactgatcatttcttggccatcattttcctctctgaataacacaaacttcttcaagttgctgactgatcatttctttgaacatcgattgctctctgaataactccaaaacctttcctgctgttcttgttcagatactcgtgtcaagaggagcagacagaacagccatcaattgcaatgggtaaattagccagctcaattatcccccagattaattgtcactagcatatcaacaaatttgatgctcatcgctgcaaggattgtggtagtcaggtggctcccaatcgacgcagccagaatctggggctgcaactggcttgaacacgtcctctcccccaagtcgcatcttccgatccccaagttccctccttccggctacctctcccagccactccccagcctcatcgccattgcaaggtactttaactgatcgctgatcaccaatgcaattctgcaaattcaatgtgatctgatcagtgatattcagaacttgaaatgcactgagttggagtggtgttttgtgtgttgttttgtactatggttttgtttggtttggtgagatttgcagggagcaaggtctgaacttgtcttcggaggtttctgatggcttcgatgaaggagcagatgcctgcgccgtctgtcttgagaggccctgcactgtagctgctgaaggtatcatttttcttgtttatctccatccatgcacaaaaacattcagacatcgaggcaaagaactaactactccatcttgttatacatatttgatgtttataagattcaatcagacattttgatcatcaataatttctcaaatgctgattttagaaagaaaagaatggcatgcgtagatttatcttgaaaggtattatcatagtattgtacctaattagattctatgaacttactcgaatgtaaaataaaatatgatgctcaaaatttcaaaagttgaagtaatattactgtaaactttagatatttgtgagcgaaagaagcaatcgagtgctcccgccgtttcataatataagtcgctctaacttttctcttagtaaaacctttttaggtttgactaaatttatagagaaaaaaactagcaatatctacaacactaaattaaattcattaaatgtaatattgttatattttgataatatgtttgcactgtgttacaaatattgttatacttttctataaaattggttgaacttggactaggaaaaatgttgacatgacttagacagtaattaggcggtgaatttaaattaacctgcaatgattgtattagtaatactagtaatagtgttttgcttggtgaattaaatatagtacttgatcacttgtgctgtgcaggttgcgatcacgagctgtgcgtgaaatgcgcgatggatctctgctcggtgatcaaatcctacgactcggcggggatcgccggcgagatcccgtgcccgctctgccggaccgggatagcctccttccggacaaccgccgccccgccgccgccgagcctcgccgggtcgcccgcccgccgcagccgccgcaacaactccggcggcggcggcggcgagcacgaggcctccaactccggcggcagcgagaagggatacggcagcatcgaccccgacgccggcgccgtcgtccccctctactacgcgccgcccttcgcgccttctgccatcctgacctgatcggagattggagattcagttctgaagcaaaaatgtttgtctttgcaagagctctgaatttggcagagagatatgtttctcggtttctgaagagatgtgtctcgcaaaaaaaaggcagctctgaatttgggagaggtgtgtctcttctttgattcgtcaagcaaagatcattaaggtgataactgataaagattaaaatttgttgtatgcaatgtataattagttggggttaggagtgtacatgggtgatttgatttgatctgttttgtttggtttggtggtggcgttgatgacttgatgctggctgggggagtattgggttgtgttgtgttgggttggtctgaatgtatgtagggtgggctgtagggaaaaagaataaacttttttttattttttttgcattctatggtaaattaaggcattctctttttaaaaagatgtgctcgataacgatggcttgtgatggtcctgatggatctcagtagttgtaccgttgtaagacgcggatactaggaaattaactaatatcaaataattagaaaagatttaatattaaataattagaaggattggtgcttcaaatttaagttgtctagccaaccacctcgtgaagctagtcggaagacctctgagcgtttctctctgtaccgttgtaagatctaatcatttatttttcgtacgctttctttgtttttcccaaattaatcatgtggttctaaagttctttaacacctgattttacttataaactgaataaattctcctcatcctactgaaagaaggagctcctggaccccttttgacccccccccaccccacacacacacacaaaatcataacaagttagcaatacatgtgtacattatcaagcaatccaaaagggggcaaaaagcaataataagttcttttcgacttagggtttctcttatcaattcatctcacaatcaagtggtagcaatcatttatacagttacaattacaaaacccctgcaaccccctggtcccacagttcagtcacatatacaccaccaatccgagtacagccacttatgattgatactatacgtacgtgggttgtatgtacatacgtatagctgcgagaggaagcttccgggcatgtacgtacgtatatacgtacacacgcagaacaacgcgacgagccgacgagacgtttgaccaacccattaccgggttagtcaacgtctcgatcagaacaaaaaataaataaaaataagtccgacccggcgatgaatttttccaccgtttttccacgggtagtctctctcgttgcctcgccgcgtcgcgatcgatcaccgcgacgccgccgcctcgccgccccacgccgcccacgccggcatccccaccacggcggcggatgtccccgacaccgggatgcccatcgcc

SEQ ID NO: 72266 - DNA, 33724 bp, Oryza sativa
caagatttcgaagggctatttaatagctcagaggatccaaacaaggccaatatagctgttgcctttagccttgtgaccttgtcaactgcagagataagattcagtgagtataaagtagagaagtgagcttactcaaatcagcaagcaacatcagtatagcagctatggttacccagctcacctacctagctgcatcagcaggagtgtgcttggcttcagctctagccatcgccttgctgtccatcgccctctacatcatcggcgtcgtcgcctccttcgccgtcctctgcgccaaggagttcgccgagagagcccacgaccggccgccgctcgtcggaacagttttccggcagctcaagaacttcgacagaatgttcgatgaacatgtcaactatgcaaccgcgcatcgcaccagcaggattgtgtatcccggtcactgcgaggtctttacttctgatccggccgtcgttgagcatgtcctcaagaacagcttcagtaaatacagcaaggttttttacttcaatctttcttaccaaaattttccgcctgtgattctgtatgtcaggcgtttattacctgcaagatttgtacaaacgatgatcaaaagcttgcatgctgtacaatacggcatatgctatgatatgttctattataaaaaaaaatatagcttagtgcaatacacatgactatattcatttctgaaataaaagctaaaatgaccgagtaacattaccatatatggctcggttaaaaaaaaacacatttccatataaataattaacttaagagaacagtatatttatataaagttagttagcatgtccatatgagttaaactcataagcaagttactagtaactatggaaagtatatatagttgagcctatgagatcttacagtgtttgagcctgattcacagggggacttcctcactacagccatgaaggatctctttggagatggaatttttgcaacagatggggatatgtggcgtcatcagaggaagctagcgagctacgaattctcaaccaaagtgttacgtgacttcagcagtgacacattcagaaggaatgctgcaaaactggcagagaagatctcatgtgcagcagctaacagaattagcataaatattcaggtacttccatgactaagatcagcacaaaagaaagttttggtaaatgctaagatcaaatttatagctgtaatctatacgcgttttagttcagcacctttacagaactgcaaaaattaaaacaaaacctacatataaatgaaaaaactggtagttctcactatttcacccttttaattgcaaatcaagttattgtcattcaattttcctcaggatcttttgatgagagcaactatggactcaatctttaaagtggggtttggttttgagctcaacacactatctggatcagatgaatctggcattcaattcagcaaggcctttgatgagccaaactcccttgtttactaccgatttgttgacataatgtggaaactgaaaaggtatcttaacattggatcagaagccaaactcaagaggaacattcagatcatcgacagctttgtgatgaaactgatccatcagaagagagagcaaatgaagattgcagctgactatgtaagggactcaaaattctatctgtaatgttgttttctacagtttatgatatcatgcctttccaaatagctcatgtttctggagcaacaagtagatgcataaagttgaatttgctagtgaaataacagcagcttcccaaatatttcattttcaacttgcttgaatgcagttctgtggtctgatgtgctccacaaatccaaaatgaactctgaatttagtcactctaagttttcttaatacaaaaaaatataagacagagctaacatactgcattgttttatttctaattcttttttatggcacgcagaaaaccaaagaggacatcctatcaagatttgtactagcaagtgagcaagatcctggaacaatggatgaccgctacttgcgtgacatagtcctcaacttcctgatagctgggaaagacaccacaggaaatacccttacctggttcttctacctgctatgcaagaaccccatagtgcaggataaggttgcccttgaaatcagagagtttgttgaatggagcaaggaagataacactattgaaagcttcaccaaacgactggacgaaggtgcaattagcaaaatgcactacctccaggctacaatttccgagacactccggctatatcctgctgtcccagtggtatgaataactttcacggctattccctgtatagagtggagttgaactaaaataaatctagtcatgatttggctcgatatggatctggtattaagtaggtcacatgccaacaatggatattagtattggaagtgttatctcatattgaagggttcattcctcagcatggaaacctacattaccatgagatatctgaatataacagtaaataatgagaaacaaagtaaagagaatcttagttatccttgggaattcttgcccaaaagaaaaaaatattaaggagtattttcatttgtccaccatctttttgtaaagtaaggaaatattataggaagaggctgcaaggcaagtgttgttcaaagagaagtcttaattatgcagcatagctttatggtactgttagattttagtgcaatctgcaatattcattaaagggaaaatcaatatcacatttctcaaacgttgtacgcacaaaaaaaaaatatgactaaaaacatcatcgccttcgtaaaaatacttttatattgtttttgcaggatgctaagatggcagacgaggatgatgtactaccaaatggctatagagtggtaaaaggagatggaattaactacatgatttatgccatggggaggatgacatacctttggggtgaggatgcacaggagttcaggcctgaaagatggcttgtgaatggagtttatcagcaagagagcccgttcaagtttgtgtctttcaatgtaagtactaccagcaagaatcatttacctcaacatgtttaaatctagccttctgtagatcaagaagaaaagtcaaatatacaataccgcattccaactgaagcagggaaaaagaatatcatgctacaaaattgcaagtaacaataaatcatcccatgcatgtctttcttttcagaatgaggtgataatatcacctgtattttgaggatgaggattgaaacttgcatcatgcggttacatttagccaaataaaaccataattgcatgtgttaacacttaacaccagttctcatattctaaaaataacccaagacaatttcactttcctgtagacaagaatctccattaataagtctattttaccatgatcaggctgggccacgtatctgcttggggaaagaatttgcacacaggcagatgaagatcatggctgctaccctgatacatttcttcaagttcagactggaagatgaatccaaggagccaatctataaaacaatgttcactctccatatcgacaatggtctccatctgcttgcaaaccctcgagaaatttcaccatgaaccccaaacaagctactgcatccttttgttattttattggaacatatgcatttctaacatccgtcctattaggcaagtaataataatctgtcccaagtagtcgtatgaaaacaacaaagtagcaatgggacaatttgcccggtaaaagtaaggtgcttgtacaatttaatatgcttgtaatagggtgcttaaagaaagaggatgcagctatatcatcaactacgtatttaagcttcatttctttggatgcaagaacctctttgtatgtgcctggaaagctatagcttatattgtccataactaaagatagtctttgtgcataagaaacttttaagtatcaatccagagccaggtaagcatcctgccaatcctatgaggtaaggaaaagtagccttcattgtgctaaaaacctactgagaatgaaaccaaacattttatcaatcacataaaacctattaccagtattaaaaagattacttcaagaaaataaacagagtagatgacccagaacacaaaaatcaacgtttgttacaaaattgcctacaagagggtacaagacctgtactataagctactctgatttcagcagagtaagttcgctaaggatacaatgagaagatatgaaataaatggtcacaatgatttattttcagctagagttggaagctggagcccaggccttgatgtccaacccttgatatttctgtagttctcaatcgcctcttttcttagcatctcacgagtagcgtctaaagcattcttcaccttcgaaagaagaataccacatttaatccagaaaatagattaagtgaaaggagtttggattgagagattagggtgcggagaagggaagataccttagggaatgacaactttggtggagcctcaacaacttcaccgaatttaaccttttcacgtccagggaattctggaagagtttccatcttgtcgcccttgcgcttctttttcttttcatccaggtacctgtgacattgagatatgttattcatgtctataccttccaatgggtgagacagatagcacaacgattccctttaggcaatcatcagacatgtccaacttccaatagagattattagactagcatcaattcataagggaatatccgtgttcttggaaacaaaagggcaatcttcgatttacatgatgcaacaaagaaataatcaaagtgatatctctagtgtatcagacatttagacaataaacaacttacttcttccttttctgcttctttgaaactgcaactgcctcatctaattctttaaaacgaagatccacagctttccccctcttccgcttccttcggttttcatctacactcgcgttctcatcgccaaccggtccatccttgccactaatctctgcggctttgctatcagcagtaggctccaagttctgcttcttagttttctacatggaacatacagaatatgacaaggtaccaactgcggaagcaaatcgggcacaagctaacaaattgcattaatactagagtagtagagttctcttgcatttccaaagagcaaacgatagaatgcgatgaacaaaagtattacagcaaccagatgaacggactaaatgcaacgtaatagcaggaaaatgtacttaaagataccgtgtttatccaggaaattaatccgcagtaccttgtctttgcgagccttgttcttcgccgcatcgctctctccttgtttccctgtagaggacgtaggaatttcatcaggctataactacagttcagcggcagccggggtgaaaggcgtaaggggagcgcacctgaggagtctccggcaacggcgcccttctcgccgcccttgtgcttctcctggatggcgatgaggcggcggagcttggacgggagcgcgtcgagctcccgctgcttcggtggtgggggcagccgcgattcgccgccgtgcgccgcccggtagttcttctccctccgcctctgccctttccccggcatctcctcctccgccgccgccgctgccgccgcctctcactgctcccttggtcgccgccgccgccgccgctcggttcgattcgaggaggaaggcgaggtttacacaatgggccagttgccacatgggcccaaagcctatttatcattaggctttaggcccatgtagatataatggaatatgtctaccaacaatccctcttatttaattggcatccgcaacaactgaaatcttgaacctccaacttataaaatcaagttaaactagttgggtggcccgtgcaattgcgcggctagcacccaaacaaaatcatatatttttcagtatgattttacttaaaatttattaaattgctatcacgttgtcttaagactttgaaagaccaaagcttatcatccccgtatttctaattatatagtttttaaaagtcacaccagctactaccccttacttctatcatatcctttttatttgcttgcttgatctaccactatttgaaacctttaaaaatcagatcatatagtttttataatttctagaagtcccgtcaaacgcagtcataatactcctctacgagccgtgaactgtcttttctctatattgtcattgggattttacaaatcgaacataattatcgttcgggttcattttttacgttctaaagtcccgctaaaccgtcagcggctttgccattgttttcctttatggcacgcccgctgcctcccttctttatcgtcattgagattttaaaatcgaacatgattatcattgtgttttttttactttttagaagttccaaacctttaaaaattggacctcgtagtttttagagtttatagtcttgttggtttcttttttataatttttagaaatcccgttaaatgatgtcactatactcctctgcccttccgccacctactctttattgtcattgagattctaaaaatctaacataactatcgttggaattcattttttatattctagaagtcccgccaaccgtcggcggctctactatacatcccgcccactgcttctcctttttattatcattgagattttaaaaatccaatatgattagcattgtttttttttactttctagaagtcccggcaaccgccttgatcgattgcttcacggcctacccgtcgtccttcatttcaatcgttattaggattctatttggtgttttattaacagtttttatatgtcgtatcaaccgccaccattctactcctttataggcatgttacttaattaatctcgccatgtgttttagatggtattttctttcaatagtcttgattttttatcaccaattttagttatttataaatggtattcctagtatttttcttttcctaatttcacaatttattttatttttcgtattgtgttcttttggtatttttattttttattttcaatttcaattgtttcaaaattgtattcctactttaactctctttttaattcgcctaatttcggattttattttattttttattttgaattttaattaatctactattaggttgttatatgtactcttattttcaacacttcttatatttaatttcgaatttaagttaattttaaattgtattctgaactcttcttttcttttttctaattttgatttttttaaaaattttcattccgaattttaattaatcttgtattggattcttatatggactcttatttcaatattccttatttttaattctgaatttcagttatttttaaattgtattcctactcgaactcctatttttcctttttctaatttcgattttttttatttttattccgaattttaattaatcacgtattgagttcctatatggactcctctttcaatattgcatatttttagttccaaatttcagctatttttgattgtatttctatttggactcttcttttctttttctccgattaatgtgggaatttctagcctccacagcaaacgtggttatgtatttttggcttgctaatttttggcttggttatgtatttattggcatgacaatactgatacaattcggaaacggcagagtttgattaggattgttttgcctttcaatgtttctaaaagtggtgtgaacacacgtattcccaaaatattgtccgtttccaatatgattatgtttttctttttttttttgtttttgaccgattgtacatttcgtttccagtagattaggttttcctttttttgtttgtttgtttcttttttttaagacagattgtccgattccgtttccagtagtatgattaggttttccttttttttttgtttttaacgattgtccgattcgagtttcttaatatgccttttttctttctttcttcagtttttaatttttaactaatcctaatctagttctatttttcctttttcttattttttgattaatgtgagaatttttaggccatgagagcgaacgtggagactcctttttctattactttaaagatataatagatagattaggtcctccggtattagagatagttggtttaccgacatgacaaattgacctgatccactcgtattaattagaagtttatctggcaaaaataaagtggacctcacatatcatcctcactctcctcccctattctctccctcatccatccccttgtccctcaggcctcagggcgaggagagccgccgccattaacgtgatgtgaagccgtcgtcattgccgacacgatgtggaggcgttgctaccgccagactcctccctccaccgctttaccccctctcatgcaggccatcaaaaaaacatgtcgtggcgtggatggatgagggaggagtccaagagtgctgacggcgaagcggcttaaggcaaaaagagtcaccgaccgggtcaccatctctgttccctcttctttacccttttctcccgtctcctctttttctctcttgctttgatccaattttataagttggagggtgaatattttcggtattgcggtttagagatatgatttaagctcgatgaaaacatgaggaacgtttggtggacttaacccggagataaactctaggattacattgtaatgggcttttgatgggccgttccggcccacgaaggatagcagatggtggtggactggactggactggacctggatgggtgcgtggaatttctcttctcggcgagatggcggcggcggcggcgcgtcagtgtctgcttggattccgacgagcagcgccgccgcctctcccgctcctgagcacgcgcgctccctctcccgctccgtccagccgccgcggcgcgcgcatggcctcgtccggcgaccacgcgccgcagctcagcaccgccgtcgcggtgcccggcgcgggcgcgcccgtccgcgtcgtggccgcgccgggcctcaccgaggcggatttcacgagcgcggtggaatcctcgctgttcaggcagtggctgaagaacctgcaggaggagaagggggtcctcacctacgggaggctgaacctgaggcaaatcctcatccaggtgagccacgctactgtctcactgtgttgaatccgctacatttctcgatcaaaaatgagctgcgcaagcaaattttttttgcgtgaatcttaattttcgtcgctgcattgggtgcagggggttgacatgtttgggaaacgcgtggggtttgtcaagttcaaggctgacatcatcgacgaggagaccaaagccaaggtgatcgaaatgttgctgccgccgttccctgctctctttttattaaaaccttggataatctgcagcttgctctactagaaatctagaaggaagatccctgaaaaaacgattacatcttagatagtctgctgattactctactggaatgagtatccttgaaaattggttgctactgaaactgatatgaatatctcaagttttgcttgttacaaatagatgttcttcatctgaaatatgttttttgccaccatggtttgcaattgctgatgcagaatatcgtataaccatagtctccacacgagtaagttttagtggcaccaggttttgctttgatcgtggcacaaaatggttatggtttcaaatgaattttttggactgtgtctatgtatatgtttcgtgaattcattgatattccttgtagcatgttgaattagatgtggtcgttgtataggattcaaagtaagcggattttgtgtgtattatattttgagttttgacaatatatccagattccaggaattgtatttgcaagagggcctgctgttgctgtgttgattcttttggagtctaaagggcaaacttacgctgttcttacagaacaggtatgttatcatcagttactgtgaatggctcatattctggtattagaaccttgtgttgagtatcgaccgctctgaaaattttaggttagagttcctgttggaaaatttatattggaactacctgctgggatgctagacgatgaaaagggagattttgttggcactgcagtccgtgaggttagtatccctgtttttctttatctagaggtatgtgctgttgttggagattagtaatgctagcactcgtccggtctttgccagtttggttcacagaccatagtaatactgtatataacattgagtcagaagttcaccatatttgaagtatagtgataaagggtctttcattactgacaggttgaagaagaaactggaattaagctaaatttagaggatatgattgaccttactgcattgctgaaccctgacactggatgcagaatgcttccttcaccggtaaatgacaaatatttcccttctctgcgcaatatctggcataacttctcttcaagaaatgaagctatgtataagcatataggtgtatagtgttagtgtgttactcaatttggctcgagtattaggcatcactgcatcaggggggcatattattcttgcttggtcgtccactagtccttgcctggtcattccttgtgttttacttgtcgcaagtcagatttagacaacacatagagaagctaaaaatgttttcttgcaagaggaattaaaatagcgtcaagatgcagatgcgatgcagagggatgggaaattacatttctgtgcagaatccctcctgcctatatgtaatcgagtagcaagaattacaagagatttccactgtttatgggtctgaaactctgaatgtgctatagatctgtgctatgtacagtaacctgcataaaagattacaaattttttgatctatcacgagctcttcagtcttgaccaactgtctccttacccatagggtggctgcgacgaagagattgggctgttcctgtacagaggccacgccgacgaggacacccttagggctctccaagggaaggagactgggctgcgcgaccatggcgagctgatcaagctgcgggtggtgccgtacagccagctgtggcgcgccaccgccgacgccaaggcgctcagcgccatcgccctgtacgagatggccaagagggaaggcctcctgccgtcgtctccgacgacctctcgccgccgtggcagctcgtcgtcggccaacttgtaagagccagtcagctatagctagctagccgtgtgctttgtcagaacagctaatgagcagagcgagccaattactgtggagtgtgtgccttaatacaacagcaagatcgacctgtgtaaatgactaattgcatgcattttgatgtagaatatgagaaattaataaagcgtatgtaaacaccgtcagtcacgcggcaaacagctatctgcatgatatacatgaccatcagttgcaacccatagtctgttactatttaccaacaaaattgtcttaattgtctaagttcatgtgatcagaatctgaccaccgtttaccaacaaaagttgtcatgattgcttaaggttatgtgattaaaatctttaccacaccttagcaagtccaagaaattctatcacatttcttcaagtcatcaacgcgtgggatctgatttgttcaaagaaaatcttttttctcgaatgcgcaaaaggattgcacgtcaatatattggaagataagttcaaagaaaatcttatcacaactatagttgaaaccatacaattgtttaagtcatagttagctaactttagacgtggcaaaatatgaccgacaaccaattaagcccaaatacatgtacgcggccactatgtatcttcacaaacaaacttcacttgacacaaaccaaatccctttgttactgagagttcgctatatgacatctactccccatacaaacttgtccaaagattacaatactgaatttaattctacgagagtacattttccaaagataaatgatgatggacggacagacaataatgtgatatcgacatactccctccgtccaaaaaaatacaacctaaatggtgatttaatatcacctaggacaacgaatttggacatatcttaggttatctttttttgggacggagggaagggagtatatatgatgatgatgttcttgtttaattattgatatatccatatgctgaatgatatatcttattctattattcgatctagagcagaatgggcgggtggcagtagggtcccctgagccagccgccggcgatgacccggttcgccgcctccgtcgtgtgcgcgccgtcccagcacacggcgctcgacgggttggcgcacgcggcggcgcccctcatgccgcaccgcgccacgtactcccagttgtactcgccgccccccgcgccgcagcacgccgcgatgccgctcctgaaccccagccgcgccggggcctgcatcatctccgccacgacggcgtagtagtcggcgtacatgatcctcaccgccgccgccggcgacggcgacgacggcgatgacgacggcgacctgcggtgcctggcctggacggcggcgaggctggtctgcagcagcgagttgtggtggatggccagctcgttgagcggcttcaggcagccgtagtcgtcgtagtcggacttgttgctgctcttgagctccgtcaggtagagcgcgaagcatccgaacggcatgactcccgggacgatgatgtccactgcacccatcgctatcagcttctgcatatgcgattgccatatgatttactattactagctaaatggcagtactttactatggaaaaatgtgagatatatgcacttcgtccctacagatatataaacttcattttagagatgatagataaccacggtttatagaatgactatcttgtaatatatagtactccctctgtttggtatttattagatcgctttcactattttcatagtcaattttttttaatttgatcaagtttatataaaaatataataattttttaacacaaacaattatgtttattaaaactaatttggtgttgtagatgttgctatatataaatttggttaaacataaaataattgactaagaaaaaagtcaaaccgaattataatatgaaatggaaggagtatgtaatatgaaaatgttggtggcagattttttttttcaaatataaacgaaaatatatttcaaaaatattttgcagagatcaattaatcaaggttaactccacacgaattatttgattatgaccggttctagcttagctactccctctatctgtaagattatttagaccaattaaggaggaaagacgaaaaaaaaagtatcccaccatataaatctgtgcacttgatacaatttactctaattaatattctcttcgttccaatataagtgtaagctagtatatacgtgtcaagatttttagtcttaaataggatatgtcacatctatattaaattatacttatactggaacggaaagagtatatgtgatgttaattacctcgacgccacttgcaatttggtcgacaattttgggcgtgtagttcctggcttgatcaatggtgaagccgaacaagaccatagcgttgtagtcgtttccgcctagtgagccgaacaagaagagggactcggccaggtaggctctgcaacttgatcgatcgaggtcaaaatcaaataataacattaattcagattgtacttttgtcaactactccctccgtttcaaaatatttgatacagataactttttagtacgtgtttgaccattcgtattattcaaaaaatttaagtaattatttattattttcatattatcagggttatggataccatatatctaatagtagtcgactagatctcggcaggacccaccacataccatgttctatacggaaacaacctgcggatataggaggagttccggataaggaaagacaaccagagttctacatggaaacgacaagaaatactcggattgtatccatattggtatccctaattctacttggacaaggggacacctatgggtataaatacaagaccccctaggaggagaggggacaaccaagacaactgtcacgccccgaactagcctcgaacggaaccaacccgtgacgctccaaattaacctgttaacggataccagtcccaggaaacagtgctggtatcacaggaagacagaatatcacagcaacagaggtctctttattatagagtaggtttacagtcatgttgggctacagacagaccccgagctcacaactgcattacaaaagaggaaagcggaagccaagacttggaccatacatcacaggcacgacttaggaactagatcgaaaccctaaaactcatcatagccgacttgctcctggaagaactcctcgtcagcgggatccatctcatctttttcagcaactgggggggatatttatatagagcaagggtgagtacaggagtactccgcaaagtcatgggaattttgtgtttaatgaaggattcaaaggaaaggctgttgtttttacaattgatttttagttaaactcctttttaaaacaactaagtgagtgcttctcaaacgacacggatgagacagtgcatctcgtccggtcggagtatgtgtaatgtatcagtctttgatagattcaagatttgccacccggccacaactttcaaatggccacccgggcctagctgatcccgtcagccacagatgttccaaacatcgaacccaagtccacaacagcaatttcacagagcagtagtcaaacaaaactacgctaaggaatcaccttacatccgtccatgactgtgggcacggctgttcgaacagtttaataacctctgcagagggggcacactttactcacacgacattactaacccggatcacccagcccgtgcagaacagccacgtctggtgaccttgaggttttcatgacaaggcatttcgagagccgacacaggtttactatatgccagaccaacaacaggttaggtcccagataatactgtgccaggaagcccaggggtcctccccgacactatcctggcgaatccacttgtctcccggcatcaaggctcccctgattagctaattactcagccatgggtgtcccattccacccatgtggtcgtacttgttatatgtacggatgaaattccaaaggaatcggtccttaagtgcaagagcgggaaaccgtgctcccggcacgtcccccggtctgtgatttttggaaattcatttagttcgcaagcaccgacccaggtgtcgggttttccaagtcttttgtaaaaccccaagttttacccatcgttggatattttaagtttgaggggaggtgctcccatgcacttgctcgaaggcccgtgcatcgaagcacaacagttgacaaaggagttttaattgttcaataattcaaggagggtaattgcagcaattaggattggggccggtaggctatctcgcaagccgcggccgaattacttgtgttaaacctattcacgcaatatttgcggaagagaaatacttagatttaaattataggtgcaagatgatcaaatgtgacttgccttgctcgagatcttgagcttgatcctcgaaatccttgcactgcgggtcttcgggctccgaaactacacgcgaaacgggacaactcaacaaacggcaaaaataaagccctattattgacctctaagcgtgccattagatagatctcgagatttgaggaattttggaagttgaacggagtcaaacggatgtacggttgagaagatttggaattttctaagactaaaggatttactgggctaaaagaaaaggatttagtaacctcctttttggattagaaacgagatagggaggagatgtagacttcgcgggcggcttgagcgcggcccgagaggagttggcgcggctcgaccaattaattgggcggacgcggcctcaggaggcggtccaacagagggaggcggggagagagagagggagacccggatccatcgtgcagggtcccggggcgagcccacgagtcagtgactcggtgcacgggagagagggtttacgcggcacgggggagctagggtttgcggacgcggttcacagatggtgcaccgggtggactaggaggcggcgggcccacgcgcagccggctgactctcagtggaccacgcgcgcacgagagaacggatcgaaggaacggctaaccgggttcaaaccgtcctggcccgcggccgagctggcgccgacgtggcgccttcgtggctgccacatgggccggctggaggaggacgaagggagaccggccggaaatggacggcgggcgacggcggtgttcaccggagctcgttgggacatcttcggccaaggggagatgcaccggtgtgacgacaagaacgagagggatcatgccttcggcttggatgcaccgaagatggctcgacaacgttgaatcgcggcggcgcacaccggcggcggcaaaagagggaaaaggcgacgagaccatgaggggccgattcctggcggcgagagcatctacgcggctacgggattgcattcctagcaccggattgggcggggttacgccgagaggggctggcgacgagcggtggcttgcggtggcgagcggcaacggcggcgagaccgtgccgggcggcggcgagacttggggcggcgcctacaggctacgaggagtgctacgatcgctaccgccaaatctaaggggaggagagagagcgaggaggaagaatgggagaggtgttctaccgagacgagacgagcgctgtgacgagaggccgacggcacgggagtgatctctccggcctcgggtcagggaagaggaagaagacgagcgcccggagtccccttccgcgtcctagcgcgcaccggctcctccggcacacgcgacgacggcggtcagcggaagcgagacagagggggcggcaatggcgcggtggagcgagagtgaatgggagaggggaaggaagaaagggcgccttggtttaataggagggcaatgtcggtttggaaaccgacctagggcggtcagggagcgagctggcgctcggcgctcacggccaaaacggcgacagagggcatgacgccggcgaggaagaaaaagaagaaaagaaagagggaaaggaggcttgcctcttgccactttggaaaaagaaagagggagagagggcgatgaggcagaaggaggaggagctctgcctccattccttggagtggagtggctgggagtggctgggccgggtcgatgacgacggcgatgctggcggggtggtttggaagggcgcggctacagggcgtcagacgcgggctcaggcgtggcaggtgctgatggcagcggcgactggccggtcggccaccacggcacgcgcgcgcgcgggaagcaacggcgcggcgatttgggcggcgtcggcgggagagggagcgagagggagcgagagcagagagagagggaggaaagaaagagagagcgagctctctctctctctctctcggtctgcgcccgggcggcgcacgtgcctcgcacgtgcgggcaaggatggaggggagagaagagatgggctgagaggaaatgggccggggagaagagatcggcccacaaacttgagggaggcaaaatagacttttcgagaggatttgatttgggacagatttgagattagggtttggattcgatgatggattggggatttgagatctgaaatggcgcggacactggacaacaaataaagaaacaattttcgtatttaggatttttaaaagatagttttcccactaggcgccacgacggaacgggcactacaacaaccaacacacacggacaatatagacgccacaaagccacaagccgatacaagccaacatacgccaagacaagacgccagatatcgacatcaaagataggcacggctagtcccctacggtgtctccggatactgtcaggagagacgaatgcgctatctctgatctcgccgggcacggattcgaggaggaaggctaccctgttgtcgactacgagtcagaccttcagaccaccatgtcgacaacagttagataggttacctcacatattgtactggtgtgattatggtgaataaaaagcaactccggcttcggccaacaggatgtagggttattacctgacaattcaggggcccgaacctgtataaaaatccctgtctccatctcttttacctcagtctcgcgtatatcctagtaccaacgatccccatgccatgcaaataccgtagtcgagatatcaaacgtcgacacacatcatttgattcattgttaaatatactttcatgtacacatatagttttacatatttcacaattttttttaataagacgaacggtcaaacatgtgctaaaaagtcaacggtgtcaaatattttgaaacggagggagtaattagctgaaagaaataatggtgtttgtaacgacagctagctagctactaggaacagtcgaacagatagccaaatactccctctggtaaaaaaaacatgttggcccttcatctttgttgaaaaaggaaaaaatttctcttataactaaccttaaccccgcaaatcgagaaattttatacagtccatattcttaataataaacaatttaatcttttatcctgacctaggttgtcaattttggtaacttcgtcctccgtcggcaagcaaatatgtcggccaaaattttttggtttttctttgtattttttaaatttgatcaaattttattaaaatttaatcagtttttattgcattttcaaataattttggacaaaaagtatgaaaattctaaaaattttcagtgcaccgaaattttagtccaaaacaaaattgacaaccctacgtccctaccctcaccattaacctgttaacttttatttataaaatggagtttgtggggggcaaaggaagtacttgccacgacattattcttgtttaaatttgatgatctttggtctttttgtgggaaaaaaattatacaactcttaaaaaagatgcttatgttatcaaaatatttcgcatcatttagaaagacattaaaattctgttcacgtagtccatgttggtgctaaatatttcctaagcaggggatcagagaagaggagcagagaagcttgtgctagttttaactggtttctttacttgcttgcttgagggctgaacagtacacttgcttgtacgttgggcagcacaccatcatcagtctatacacatgcactggctttctatttataggcttgataaaccgatatgtaggaagcttcaggacctagctagagacttgtagtactactacattgtcaaacttcactggtactagtactactgtcaaatcacatcatgcatgtctacacactacactgttctagaaaatttatagagcaaggacttcaaccttgactttagtttcacgagtagtagagagggttagagagtaggctggtatgttctagaaataaattaactccaacagaaaaaaattatacaactcttaaaaaagatgcttatgttatcaaaatatttcgcatcatttagaaagacattaaaattctgttcacgtagtccaaacatttgaaaatcggttaaaatttaaaaatagtactcctgttgatcaacaggtacaagtatataatttgctttgttttgcttttattttgttttgcttttattttttatatagcccttttttatttaatatatataccgtgaaagcctcctccactgtgctttccttataaaaaaaacagctacaagtatctaaacacatgaaacaacgtacatactctgtggtgcagcagtggcgcagatggagggcagcaagtcgcggaaccaccggagctggacgttcatggagccgtagttccagaacgggaagccgacgccgatggactcgaagaagtcgaagtccagcgccgtgccgccgacgatggccatgttggctccccggcggaagtcgccgccgatcaccttcgacggcggcagcagcggcagccccaacccctccgctgcatcaaattatacatcgatatcatttcatgatcatatattatatatatcgatgaaataataagcagcttcgatcgatcagcaatggcgatcgaattgaaccgaggaagtcgacgacgaggcggccgtcggagcagcggcaggtggggtggccgaagaaggtgatgccgtagggaggctgcgccatggtgagctcggtacgattcaccgccgacatgttcacgcagatgttgcccgtgtccgtcagcgagtcaccgaagctgaacatggccttgtactgcctcttaatatcgccgccgccgccgccatgctcgccggcgacgacgccgacgaacaagcagaggcagcagtagagcagtacgccgacgacgacggcagcagcgtgtgcttgctgcgccatatggctttcgttttcctgcactctctgcacttcacttctgctggctgcacgaagccggccggacaatactagcacacactccacagtccacaaagtagatatatatacacacgaccaggccacaaattaatttaagttatatatacgagcaaagttgagggaaatttaactatttgttgctccactctttatttgccacatatacaataattggcactatatatttgtcactagagagttatggtttcttaaaaaaaaaaaaaccatttttgccactctggctgtatggtatgtcaatgtactaatgatgagaaaagtctattttgcccctagctattcccttgtgttcatcctctctcccccctcccccaaaacaataaacaacatggtgcaattgtttggactgatgcaggcaaaatgtctcaccagcgccaagatgtactccgactacaatgacgaccacagtgacaatatagcttctaccactacccgcagggagaacaccattgctgctatggtcgagatgcactcatgcacagctaaatactggggtgtccatcacacctcggttccatcaaaaaaggtttctcggagctggatcttgactccgatgaccacgactacgaggatgcggacaggaggagatggcggtggtggcggaggatgacgtgtgcgttctagaaggatgagcgtcggcgccacaccatgcttcccatggaagtggtgtttcctagtgccacaaccatgggatagaagcgtcctaaggactaggagcaaaggcatatccagcccaaatgtaaggcttggtccaacctactgatttttcatgaggttggacaacatagtgaaaactcttaatactgggcccaggttcctgtggcttaagtcagcccataactatgggctcaaccatgtttgcctcctccatgccaatgccggggccacctccttcctagccgcacatccacccttccactaccaacgttcaccgcccagagctccagcgagaagcttggtgactctggtgtggtacctacatattaatattaagaaccctaaggaaaataaatattatgtgtttatggattaggaaaataaatattatgtgtttatggcactctctcgtaaaaaaatcattcagaataaatgtgaacaagtatttatttatatttatttttagaatgatttttttttgaaatagatggttaaatagtctgataaattacccgacggaaacctgacaaaatcatgtcccataaatcataatataagataccccttagtataagagatcctcaggtaaaatagtttgggatagtaaaatggattttttttctaatttgaaacaaaatttatatccctggatccattgtattacattatagaactgatgaagtagtaactaaggttgatcactcatgtgtaggagtactgtgatcagtgattactcctgaggagtactgaccatcttcaatggcgattaagacttgatactactaccaactacccagagagagagacagagagcatactgcataccagggttcactctatcggttcaggggtttctatcgggggtcaccgaaatcccgaaatttcggtccaaaattttcgaaattttgaacaaaatttttagttgaatttgaacaaatattatccaaattcatgaaaaaattcaaaaatttcggtcgaattaatatcgtatcgggggtcaccgaaatgaccgaaattccaaaatttccaaccctgctgcatactactagtgcctttgctgagtggtaccgatactgactagtgcgaccgtcttcaatggcgattgagagtttagactagacaacctgagagtgccaattggcccaaggtcgtagagagagagagagagagagagagagagagagagagagagagagagagagagagcactttaccaacatgatcttgaatccgctttactaggggaagttacatactttaacaaaattcctatgttaacttaaaaaattaaccattgattagatgaattatatgatcgttgccatgtaagctaatcgatgtttaatatcatggaccattttgcaaagcccatgcaacatggcatgcatatggccgttgttatgttttggcccacttttaaagcccatataataatctagtatgtgataaataaaatacatatgtcattggaaatccgcgggctctaagctatataagttcaattagcaactcactatttgcatattgttaaattaaggaaaatactaaactaagactcggacacgagaacaaataagtagtgattacttcataattttaaaatttaaataatgaaaatgaattgagattaattccaaacaagcacgagctgtgacaacagaccatgcaataaacctgttgacaactacttctatttgatgttttggatggaattaagtgaagtatttgatactttgtccatcaataactttataaggcttaaggcttactatcaaaaaataaatgttgtatatgtacatattgatttttcatgaaaggtacttttcataatatctcttaagcttaatgtatcttagtataaatttattctaatataaaatttgaaaggtcatgcatcaaagaccatgaaaaaaaagttaaacatcatataaattaatgggatcacgataaccagataggtagatgtggttgttgaataattaattagatgtatcgtagtaatggtcaatcttatatcgtaaccacagacttttaaaaaatatctaatcttgcatccttggcactttgaaggaaaaaaatatgtgtacaaaatacatatgtagtgaaaaccggaaaactcccgttaaatcaaaatagacgttcaaacattatttttatatctaacagtaattcttaggttttcactatttttctcttttgaagtccaacaaattcaagttatgggccaaactctcaaattccaatgaagctctgcacaaattgatattcgcagattgtgcactccggtcatgactcagaatgcgagtactctagtctctagcactcgagacagcagccacgctgcacgtagacctcagttgccgccggtgatctaggacaaaatgggtggcagtataaaaagagtactataaattttatatttgggatgaaagaagtactaaatttatagtaaaaattattagaagtagttgccgcccagacttcgtttacttttctcggtaacatatgtaaaaattattaattgctacagtatgctctttatcactcaggcttggaactccacaactgaagtagccagtcataggcgataatctgcttctagtagagacaagagagttagtagtacaccttgtgctttaataacatatctccgatatatatcttacaagaaggagcatatttttttttccattctgacaaaatcaaacgtaccttggacttggagatcaatatgaaccggcaggggctaaactcctaaacaaaacactatctaaattacttcgagttaaagacagtcgcagggcaactctcctttggcaggccgttttggtgaattcaatcgctacatggcgatcgatcaaagctagtagcagctggtatatacatacatgcacataaccaaccgatatatgatggtctatcaaaggccaccatgtatatatatacacaatgcaatcacatatggatgattgcaatgtagcaccatggccggactgtatataccttggatgcatatacaattacaaaatcacctagaatgcacctgccagaggagagctgcctactactgtcttcaactagttcttgcacctctctcacatccacgctcacactcacacacctacgaatgcatcacaaagacttagaagacttgcctcttgtcttcctacaaacacatggatgcatcagaaaacttaaaatttttatctgtttggttgttggtgacctgagtagtgtgcctcttgtgcctttctgttggcagaattctagctcctcttatagctagggcgacaggaagaagatgaagcagcagcgaaacggcatatgccattgtggtggtgagatgagacagtgagatatatgcattctgactttttagggagggtttgtaccatggatatcctccccagctattccttcgaccctgcaactttatcctattctctctcgatatggagaataatcgatcgaaatcgccccaatggtccacgctgatccatagatgatggtatatagcatctctccttgatattgtcttgcattgtgtgtgtcccgtctttccatggtcgctgtctcgccaaattgccttcatttcccttgtgaattcgccgctgtgtttgtgtcaaatagaactactcaaatgtcctggagaaccgttcagaagaaaaagaagtcctggagaggaaaggtccattccattttcaacctaccaaactttgaaagttcactttatggcaatgtttaggttctttaacaagacaacacaaatccacaagactgacatggcaacaagtttctcaatcagcagctttgccggccttcaaaatctgaacttcagatagaaagcacgttttgatcttaaccaaaatcttcgtcttctcgttgcatacaacacgagagaacagagatgcatccatctaacgaagtgtccaatgtgaccagcacatcatagagaagatgcatgacagaatggagaggcatcgatcatagatcaaaactgatcaaaattttacagagcatgccatgcacgcttcagctgcgatattacagccaaatcgaatcgattgagataactacatactgttgtcccttcgggcaacgacagttctaaaatcatcatggaacaggttgatgccatcagaagagggagttgtacgtcaggaaggttgacgcgatcgaagcagcgcagatcaccagagacggcagcaaggtcacattgaggagctttccgattcccaggtaccctgctgcagtgattgtgcagtcggcgaccacccgggccaaggtcccagcctccgtcgagggaagccccccattgtaggtgccacgggagagacgggacgacatcacgcttgataggagggagaggttcactcctgcatttgcagatacaaaatttagacggtttattcagtgctggctgaagaaatgagccgtagatgaacattccaagaaaaaaaaatgcttctcagatgtctcaccttcaagaacttcagcagacacaaatgtgaccagtgctgagacgacatactggacaaccgagtatgtgctcgtgattttgaagctgaaaataatgccgaccagcagtgtgatttgagacaccatcaggagttgcctgtcaaaaacatcacgcaatttggtaaagaggtcaacagagtctgaaatattgttttcagatgcagatcaagattctaaggttatcccttggttatggacttgctgcaaaacaaaaggaaagtgaatcatgtgatgccagcgataaagcatggaggcacaaacctgtcctcgaacatgttgctgatatatgtcccaacaacagcattaacaggaagaactgttaggccaagaattgctagaaatatcgccactgcacttgtattccaattgaaatagtgattggtaataacacttgactcagaaagtaaaatctccatcgcgtatttgagcatgaaatatatcagcaattggacctacacaggagaagcagagtaagtaataaagaaattgtggtcacagacttcgttttcagcagtacaattggcctaccatcaatgcaatgcaatgtaggggttggaacctaaggctctttaatgatttattctatcccgagatttattttttcagtgaaaaattcagttgtaacaacagatcgtctttatataaaagaatgaacgagtcaactaaaaatcaaaacccaaattgcatattggggaccatgaggctaactgtgctacttaaagatgcatgatatcaagttaatgctagatttcctctattgacttgaataaattagtaaagaaacaactttatgtgggtaaaagaaaaagaaagtcaggcaaataatgcaagcagtgatcaatttagctgaaataatattatacctttactgaaggtgtaagcaatctgtatgctgaaccaatcgaagtcgcgggtttgcgagaatcatgtgtgccttcttcgctatcatcgacttcttcgtcatcatcttcatcttttttgcttgaatctcttagtaatggttgtgcaagtccattttctagttgctcgatatctgccctttgtactgccatcataatgaacataaaataaaatcatgaggatggattagataattctttatagtgcaatatccaaccagttatgaagtaataaaaagcattagaggcagtacataccagaagcaggattttgctgggtaccattcacctcagtggcacgatttggttccttgaacgagatccatagccaaactaagtacagaagccatgcaacagccatcacccaaccaggtagagttgattggttgaaagtaaccatgtaaatcttaaatttccactgaagtaagccagctaatgcaggcccacaagccatgccaagtgcgcttgcactgacaaatcctgctgaagcctgcatgcgtatccttgcagggacacaatcactgatgtatcggcgattgacagctcttgcagaacccattctgcatgacaacaattacattaactaaacatgagacaatgctgaaaagatatttaactagcatgtccaatatcactaaaattttcttgtggccacaaaaacttattgacaggaaattgtgctcagatagaaacaatatgacctttgtagttgtatgtgaattttctaatcaataaaaacttgctttcctactatggttgcaaccaacgatgtcacaggaaaataacaaatggggtgtgttatatatattcaacagaaacacgttctatcccacactagaatatagggatgataactgaaaaatgcaaacataagactaattttgaagcaataaacacacgtgcagacacacacacaccccaaaaaaaacatacaaaaaagctaaaacagaagatgcttactagtatttaggacgcttacccacagagtagacggccaataatgaggactgttagggacttcatatcatatgccattgcgtagcagacattacccaagaaaagaacaatactgctgaaaataagtggtctgaaatatgacttgttggaccatgcgctgaagtaaactgaggaaaatatttgcgcaacagccatcgaaccaataacaacaccacaaacagtggaagcagccccaaggctcactgagtagtcatctgcagtcgggacaatgatatatgtgttgaccatgtaaaggaatgtgttcaccaagttcagcataagggacatgaaatggtatttttgatcttctatttcttcttcctctgcagtactaggagactcctcaccaacaattagggcatgttgccccaaaaatctaagaaaatttgttgagcgtgttagcttatccactgatgaatttatcatatcaatgattgggtcctgcgacgaatcaagaacaactcagtaaaaatgaagtccctataacaagctattctatcatttttcgtacaggatagcagcaaaaaagatgaacgaaccttaagagcagtagatggctgatcgtaaattgacaagtaacttccctgccgctcttgaaggtcagcaaggttacgtgacaacgctccaacaacagctccaacaccctggttgcataaaacgtgtaagttatactggtttgtgtttcatggaattcaaaaggcaagatcacagatccatagatgcaaatagtacaatacaatgcaaatgaaaagcagtataaaaatttgatgatactttaatctggagtcagtacattaccacatgcttgaagacctgctgtagctgagaatatgggtgattcgatctacttgtcacatagtaatcagtaaatctgtagccgaaacgcttgtcaaacttcttcaaaattttccgaatgccagtcgcattgagatcaacaaatttgagaagtttgataagatccaggccaacttccctgtaagcttctcgcaactcagcaatggcagatatatctggctgttctgctaatattgccctttgctttcctaatttctctatcctgcttgccaacgctccttgttgctccaacagaaataggacaatcttctcaatctgatgccacaggaaaacagaacatcagtaatgtaaaacacaaattttagtatggtcaattagataaatttgttgcatcaaaatctcgcacaagggatggaaccaggtgaaaacagggctcacatgtgagcaccagaaagaaaaaaaataaagaacagtaagtcgtcaactagaactgttggcttgtaacattttgatagtattactcagtttctacaagaaaattggtgacaaaactccgctacagtttatttaaaataaaactattgaaattcctttgcttagaaaggccatgcatggataatttgatatatgagcatatgtgggtaaacactgacatacagattacacatgctcaccatgttgatgctacactcagcaagctaaatatccacagagaagctaaagtctgcaattaaagcagatcagggagaatgaagtaatggcttttcatagcatctatctcttggcattacctgatcatcaagcatcttcgagaaatccttaagaacccggcgacgatctttctcaccctgttgaacctgctgcccgtactgttttactttcttcttcatcaacttgtagtttatgtagtacctggaaacatcggtataaaaaagaggcaaagctaaatttcggtaactaagtatcaactatttcaatgtatcattagactatcaggtttgttaagaaaaaaataataagtttccatagaaaaaattatctggtgaggggtggaagactgatgatatttacagaactggtaagcgtagaatggtccataaaaattaaagtaataaaagccctgaatcataccctttccattccggaatttgatcagccatcaatttcttcccaaagttaaccatcttgacttggagatattaaactgcaaaggaacttatgtatgtcaatacttgtcagcagcacagctggaattatgaacatatttaatacaattgatgagatgcgtgccatcaaaatggaacaggactggcaatttacaaagttaggaaagtaatctgcttctgaacaaatgagcactgctcaatgtatctcagtgcctttgtgcagacaaactgtgcaagctgttttaagcggaacaaaacgacaaacttagtagcggagatcaaaataagtgcaccagaaatacacttcatatgactggtttgcaataaggtcgctttgttgtgatgtcattcaagtgcaaggtttactatgcataaaaccaaaatcatgttgtagttttgtgcgcgtaaccgacgccctttcaatactcttaattttatttaggcagtcacacactactctgttctcagtaaccaatgagacatgcatgaacttatattgacaacgattccccggtccttttcagttgacctaacatattggaccaatgattaagaaaaaaaaacatggatgaacttggacaacacaaaaatgattcatggaaaatgaaggcacaaaaagcaaactatgcaactaactgtaacagtttagcaccagaatcccatgcaggcaactagaactgaacctataattcgtaaatacatccgagggaatggctacagacagcttttcgaagactggcgaaattcagtgtaaaggtaacttgtttttttttccaactgggccgtgcatgtagatcgcaaagtgaaggtatgaatctaatagcataaattctacaattccagccttacaaattccaagcataataaaccaacaaatacgaaaatcatacaaccctagacagacatgtagtagaagctaagtaaatcctaacttgtcaacctattcccaaaacctgtaacagatcacaaatcggagcggagcgactctgctcccaaccccaaccccaaccccaaccccaagttagcagttaccacaggtgcaacacctacgccaaaatcgagcgaaccggcggggatgagccggaaggaggtggcggcggcggctggagggggcgcgggtgcggaatcgggagcggagggatcttcctcggcgggagacggcggcggcggctataccgggaggtgacgctggcgctgcgcgacgccaaggccgacttctccttcctccgcgcgcgggggctccgcaccgcagcctcctcggctccctcctccgctccaccgcctccgccaccgacgactcgcagctgctcctcttccggcattcccagcctatccccgaaccaccccgcgctaaccctcctcgcgtaaacaagtaaaatcgaagcgcgaattcgcttgcagccggaggcgatctcgccattacctctctcttcagcccaacagcgcagcagaagatcggagatccgccgcgagggagcgcggattggggggaaggcggaggaggaggaggagcgcgggaggcggcggcggggcggggggtatttataggcgcgagaagctaccgcggcggcgagctcgcctctcttctcttctcttctcgggcgagccaatttcggaaagggaacaccagctttccgcttaaatcgcggtgatatattttttatttttttaaaaaaaaatatattccggagtgtccacatcacacgccacgtggcgctcgcttgttccgatcattgcagcagcggcggcggtgggtagatcgaggggtacggttgtgaatattacgaaaggttgagggggttttgacgaaatgtttgctctcggcttagctggcagccgaccgatgcgcgcgtgggtggtggggattttgcggcggccgcacgttctcttgctccagcagtactaggttggggcccacccgtaagagcaagttcaatagtatagcccattaatgactccaattcacctatagtcaattcatacaacagctatttactatgctatttatatgtggtcccatctatcatacgcacaatgtgtcttaaagtccatactgcaattggctacagatctgtagcccgctgcttttttctctcatattttattttattaaaatatgtttataactggctaatagtccgctattgtttttactctaagtatgcagtgaacaagtggatcatgttgcatcgtgaggggaaaaaataaataaataatccgatcaaatgttggcgccggcggctcaacaagtccacatcattgctggttggtggacaaacattccatcttaaactaattgtttgagccatgattgataagtaaaacgaatattttattataagtcgaaatttctatgtattttttgtttgcggtttataaaatcaacattgaaaaataaaccatgataaaaaaatttagaattaaattacaaaactcaatttttagcagtgaataattaataataagttgacaagcatacgacgatggccacacacgcaacagaactgttgaacaccattccgaaaagaaaatctctggtgcggtaatagctgcacttgtattttaggtctggtaagaaacgatattattcctgagtaatttatttccctttccccgaaaaaaaaagaaaagaaaaaaaaataaagttgaacaccacaccataaacatgcggcaaaacgcaagatgaaaagaaaagcaattattaaaacccgtcaaaaatggcagtcaggcgagtcattaaccctgaccacaagatcgacagccagattacaaaagccaagttggtttggctcttctcgccttcaaaccggctgaagattagctcgcgtccgatcgggacaaaaaaacttgatttggcagcaagctgaagccgacatcaaaataaataccatgataataataatgcaacacatggccatccttatcctaattatggagtattaatcaactgaaatatttactcctagtcacactactgggccggattagtgcatcatcacgatctgtctgtctatctatcgaatcaatatagaatccaaaccgattgagatggccggaatgaatggagctttcagtttcaggccagaccatgacttatgatcgccaaccaacgaattttttttaaactaaggcaattcgatatgtgcctgcgagcactgtagcatcactgtagcgcactgttcacgcaaccctatcgaactttggctgttcgatatgtccctgcctagcattgtagtgatactgttcatgtaattttttatttatttttggaccacctaccctgtcgaactcacgcagttcgacatgtacctgtcgaactgtggttgttcgataggtatccctgtcgaaccgcggttgttcgacagggtgctaaacttgcgatttcgcctaactgacctatagttttgcgattttccattaaaatcatattgcttttaaaaaaaattcgccaaccaacctcacattgttttccatgtgacttgtcgtagctaaaatttaaattttaaaagttactattctttaactaaatttgatagattatattttagaaaatacaacacagatgtagatgttcataaaacacacactcatttgtataaacgcacgcaatcacattttatttttataagcatcggcgaaagactgaactgacgtatttgagattgacgaagaacaaatatataaatatataaaagttctaccatataagttttctatgacttatcaacggtcgatagagcaaacgagatgaggctagaagggaaaaagaaaacaaaaggcaatgtaatcaatggttcaaatcgtggtaggctctgctgatgtgggctatactcactacgacgctatcttcggacagtgtagatcaatcatgctatgagatgagatgagatatgatcgacggcgacgagacgctgcatgtggatttgtgctggaacgacattatcttttcgattatacttatatttataagctaaaatttaaattttcaattttaaatttgaagttgattgtaaggttttttcatcgaagttttatttttcagtctttgcttttaaatcgctaaaaacacttatgcaaaagttttatttataaattattttttgtttgcgaatatgccgtttcggggacggaatcaataaactgccggatgattatatatgaagatgataattaaagaaacctttttggtagcatgttgccgtcacctgaatatagggaaatgatcaggcctgtttggaagagtgtagggttcatatattatttcgtccatataggaatatatatatatatatatatatatatatatatat

SEQ ID NO: 72267 - DNA, 687 bp, Oryza sativa
aaggtattacctacttattaggttcaccgaaggacacgaagctatggtgggaaaagggtagagaggatttcctagtgagaaacagtgtctagggtatgcgtaattttaatgctaacgcgatacttcatgtactggcaacctgctgttccccgatgtcgctctactatgtacctagacagggaggacttaagtgctcttgagggctatcaccacctctacacccacctcaatcgtactgtgggacacgcaacaattactggatataaattacctaaacacctcgtctaagcattataactcactaaagtaatcactatattttagtgaacaataatccagtatgatgattaggaactaaccaagaggtaattctcacaagcaaatctaaattactcggaaagatatttctattgaaaacagagtaattaacataataaaagaaacatgagaggattaccgacaactccggaatccctccgacttcttctactctactctcttcctaattctagtatagaaaatagtacaatagagcctcttataattcagctcaagtgtgttgagtgtgaaggagtgaagcttgttttatagggtaggtaatgacggttgtagaaggggaaatgtccgaagtgccctccaatcatcatcaaggagtgatccggagcatccatgccaaacctcacatca

SEQ ID NO: 72268 - DNA, 1439 bp, Oryza sativa
actgtttcactatgttctctgtacccgcagggagcgtgagcgtctcgagcattgtgggtccccagcatctctttctctgattccgggacaaagctgtcatcacccccgcgtgcccttgttctgcgccagtacaccttgctgacaggcacgttatccctcacaacccaaccactgtggcgtacaaaattcttggctgcttatgccggggcactaggtcggccgtctgcgtccacctcagttatgatgtgccgaccctctatcttcttcgcggcacctcgttgtccgcgtgccctcttctgtccagcggagggatgacttccactaacctcctcctcgttcccctctgcatccctctccgcgttcccctcctcgttcaagtgctggtttggttcctcgttcccctcttcttcgttccagaactggctgcttcccgatgcgattgtatcgtacagtatttgttcctcatcgcgatcagccatctgttcatagaagaaatatttgctaagcgtaatattaacactatactaatcttgtattaaaactcaaataatcatatatgctaagtctaagtgtcgtgtatttgtacggtagataatcatatatgctaagtttaattaagtttcgaatattacatctctaataatcttatattaaatctctaacactcacatatgctaagtctaattaagtttcgtatattaaacctctaataatcttatatcaaatctctaactatctctaacactcaaatatgctaagtctaataatctaataatctctaacactcacatatgctaactctagtaatctaataatcttatattagaaatctaacaatcttatattatatctctaacaatcacatctttacatcacttgcctgcgcgaattccttcgagggctagctaccacttcggcttgagggacgacgacgacgacgtcttctctgcaacatgcaaaaaaaatgtattagtctaaatgcaaaggaacatataatgtatttcacgttttcaagtatatataatcatatatatatgctaagttcaacaatagtttaattatctcgttcgtacacatttcgctcgcgttcgttctcacacttttagttcaagtgcattcacgttcgttaacgtttcaatcacgttcgttcgtgtttcattcacgttcgttcgcgttcgttcactaacactcacgttcgttcacgtttcagtcacgttcgttcgtgttcgttcacgtttcattcgtgttcgttcacgtttctttaacgtttcgttcgcgttcgttcacgttcgttcgcgtccgttaagcgttcgttcgcgttcgttcaccttcgttcgcgttcgttcacgtttcagtcacgttcgttcgcgttcgttcacgttcgttcacgtttctttaacgtttcgttcgtgttcgttaagcgttcgttcgcgttcgtt

SEQ ID NO: 72269 - DNA, 3521 bp, Oryza sativa
ttttgctgtatgatagtttgacataccagcggagaaagtggagcaaatcaaaccaaacaggcgcatccaagccaccaccaccaccacctcctgcagtagagcgggccacgaattcagaacctgctgtgaagggtgaagacgtgccttgcacatcagcataatagtaatctatgcagccccaaattttgtgtaacttttggtgcttctttccctcatactgcctccttttttttctcttttctgggctgtttctttgcaccatgtgcttgaaattcgcagtccaccttaggctgggctagatgctaacaagatcttaacgataaatcccaaaatcttatttatattttcatatgcttgttcatccacattgtatgttagtatgctccctccgttcctttgtggatggcgccgttgttaataatacttatagatggtttatcatatcataaacgaaagctttgtgattatatttaggatgcaacacacttggataatatagaatcatttgaagtgtaaatgatctttttattaaaaaaaagacaagctctaaagttttactatgaatagtgcccggtgccatgtgactaataacttactccctctgtcccaaattagatgtcgttttgattttttttttgcaatgtttgacaattcgccttatttaaaaaatagtgcaaatataaaaaaagataagccatacttaaaatacttttgataataaaacaagtcatatacaaaataaataataacttcataatcttttaaataagaaaatggtcaaacgttaaaaaaatgataagtattttggaacggatgtagtattaatttgctgtcatcagaagataattacacaagctaaaatcgccacgaacaggaggtatacagggtagataaaaccagtagtgcagcatttgccatagatgctactatcccctgacgatttgctctccagcagcagcatggcatgtcttctcctgcgacgccgagacctccacttttcgagggcgtcggggaggggcatgaccaagagaggggacatgaggcggaacacgagcaacttccgcagggggcggaggtggaagaggccgagctcgacgcggcgctcgcggtaggctcggaggacggcggcgatggcggcggtggcggcggcgatgtccgggaggtggcgcgcgtaggcgtcccaggtgcggatgccgtcgacggcgtagatggtttggtcgaagatgagcaggtgccaccggagccacacctcccggcccagcggcgtcgtcttcaacctctcgccatcctgcatggacatcgtgccccccggggttcgcaccagcagcctgaatcgcttcctcggaatcttgaaccttaacgccgccattgttcttgctcttgctctgctagctaattcgtcgacgcgcgctctgtatgattttcttttctttttttttttttttagacagagagggagatgctctgtatgatcttggtcgatacttgcacagttattacacgtcgaaacttaattggtttttatataggagtctggacggtgacagctacaaattgtgtgacaacttaacgacgcggcccagtttaatctgggtatgtacatacaattggcccagcccggctgtctgagcggtcgttgtaagttgtaacacggatcggacacgacacgaacacgatcgatatatccaaaaagaagaaaagaaagtaaaaaagatggttcaaaaaaaaaagaaacaagtgagaaagatcgaacatacggtcgaatccggaggccaggcagggagatcagatggcagctcatggtggctgatggcactaatgcactagcatactcaaccaagccaaaaatgccaaaatattcgtcatttgatttcattgtaaccgaaaaagaaaatgccttgccaaattatgggtgagtttgaggagaaggagattgagaagattgaaaagatacgcaaaacgaggtgagtcattagcgcatgattaattgagtattaactattttaaactttaaaaatggattaatatgattttttaaagcaacttttctatagaaattttttacaaaaaacacaccgtttagtagtttaagaagcgtgcacgcggaatagaggtactttctcacctaaactcaccggaacgaacgcaccctatgtcaagatgcaactttggtacaaaaccccccaaaaaaatgactagccaatttctgccaaaaaaaaatcaacattgcagtttttttttttttggagaactgcatatgaatatcagtcaattagctagttagtgttagtgtaagagtaggcccgtgcgtgctacttgtgctaaatttgtggtctgcaagagatggtcataacgaacgcgaggaagcaaaaacctcttcaaatcaacatgcatgatcaaacgtactaatccaagcaaaatagaggctaggttattaaacccgcgtgcatcgatcatcacaccaagaaatgcatcaccacataggagtaacatatatccccagatcagcatatcacatatatatctttgttcaaatacgacgatcgagtgcaaaaccatacgtacacacagatatccatcgatcggcgatcgctactgatcctatcacagacaacatgcaagctacgtagtccaaactaaaatgcaacgaaaggtaatccagttctcaacgtaggccaacccgaccgcatgcagatagtatacctcagctcagacggcggcggtctcggtctcggtcgcctcgcctccggtggtggcagcagcacgtaggtcggtagttgccggcgccggctccacctcctcctcctcgtcccaaggaccaccagcagcagcaggagcgacgacggggtcggccgcggcggcggcggcggcggcgatgtcggggttggcgacgtcgatggggtcgccgtcgcaacgacccgtcacagtagcgacgacgaaggggtcgcgaggcgtggcgcgcatgaccgtcatgttgttgatggactgcagcattccgcgcgtgaaggagcggcggtcggagttgctgccgcggccgcgcgcctgaggagccgacgacttcttgttcttcttgttcttgttcttcttcttcttccccatgcccggcggccggcttttgctctgctcgtctactctcgtcggaggagtgggtggggtggggtgagaggcgtgagactccttatgtaacccgcgtttatatactcgagctggttacttgcgtggtttagccgtctcctctctctctctgacacctcttgtaacaagaaatgattcctcctagttatctctctctagctctctctctctctctctctctctctctgacaccttgtaacaagaaatgattcctcctagttaatgataacccgtctcctctctcacacggattgacacaggtgaaaacctgacacctgacacacaccctccccctcctctctgatcgctcgtctctccctctaatcgctcctctcttgcacggagtaatcatctagaataagtaaagaaaaatatctagaataaaa

SEQ ID NO: 72270 - DNA, 8550 bp, Oryza sativa
aaactgtaaaccaaacccgatacacaaaaaagggccgctctcacggattcgttcaatcgatgttgacgaaatttgaaggacggatacctggaatggtcggaatcgatttgcaccggctggatgggatcgggactgaaatcggttcagaggcatcagagccaagaggattaggtgccaagaggatgcatgcatcctctgaatgcaggaaggaaacgtgaccgtgccgccgccgttcgtccgttcctcgcctcgcagcctccgcctctccccgtcggccatcggacgccgagccgtcgtcgttgtctgcccgggtcaatccgcggaggatggaggcgtagaccaccgcgaggcaggcgccgaggccccgaccggcgaccgtgtcctcccgcggcgccgtgcctggttgatttccgccctgcccctacccggctactcggcttgcccaaacctggttgattcaagtgtacccttgttactttgtcaccccattatttggttctatcatcctccttaaaacttttaaaacttgaaccgtactataagagttcattgtctctttgattttcatttttataatctttaaaagtttaacgagatcattgtctctttaattttcatttttataatttttaaaagttccgttaaccgctgccactatactcctctgcagcccgcttgctgcctcctctttttattgtaattagggttttaaaaatcaaatataattattatttaggttcattttttattttctagaagttccgtcaactattagtggctacgccactatactcctctacggctcggcttattgaaattttaaaaattgaacatgattattgtcgacgtttgatatcgcgactatggtatttggatggtatggggaccgtcggtatcagggtatatgcgagattgaggtaaaagaaatggagacaagaatttttatacaggttcggaccccttatttgataggtaatagccctacatcctgttggccaaaaccggtgttgctctttattcatctggatcacacaaatacaatatttgggataacctatctagttgtcatcgacttagcggctagataaccgactcgtagtcgatgacagggtagtcttcctcctcaagtacgaattcgtcgagatcatagatggcgtatccctcttgctgacccctgcaggtaccggatggggtacgtctaggctaatctttgatgtcgagatctagcggcgtgtgcatatgttatgtcttgttggtcttgtggctttgtagattgtggtaggtgtgtcctctctcctcctaggggggcttgtatttatacccataagtgtgtccccttgtctaagtagaactagggagataaatatggatacgatcggactaatccttgtcgtttccatgcagaactcttctggtcattccttatccggaactccttctatatacaaggtttgtttccatacaaggcatggtgtgtggtgggccccgccgagcttagtcgattaatattgggtatgtggtatctatgaccctgacaattattattggggtttaatttttactttctataagtcctgccaaccgtcatgactgtgctgcttaatggcctgcccatcgtccctcctcattgagattctatttgaggttttgcttatagtttttagatgtcacatcaaccgccaccactctactcctttatagccctattgcttctcccctcatttgtcatggttgtgttctagatgcacttttttttttgaaattccatatttttcgctctgatatttttttttataaattgtattcctacttggacttttatttttatttttctattttcagaatttattttatttgttatttcgaattttaattaatctcgtcatgtgttctaaatgaacccttctatcaagagtctttatttttattacaaattttagttatttataaagtgtattagtagttgaactcttaatttttttctaattcctgaatttattttattttttatgttaaattttaattaatctcgtattatgtttcatatgggctattatttcaatattccttttctattttcaattttagttgtttcaaaattgtattcctctttgaactgtcttttttatttttcttacaatttcggaatttattatactttttattttgaattttaattaatctcgtatttggttcttatgtgtactatttttctaatattgctatttttaattctgaattttagttattttaaaattgtatttctacttggactctctttttttctctccgattataatgtgggaatttttagcatccacagcaaacgtggtgcttcctttcgaagctgtctcaataatataatagatttgtattagcatatgggatttgtggggtttgaaattttttatatgatttgaacttctaaaataagacttcccaacgacaatttcctgactatactacaccactgcctctcatgtgtgctagtttataagaggtgaagccactactctcattctggactcgatggtggaaacagtgctctcaaattctctgtttttttctatttctttctttgttgctggaagccgacaaaatggatatcatgccacttcatccgtgtggtttcgatgaaatcactacttaaaaatgattttttttggatattatgccactccattcttgtcgtttcaatgaaatcactactgcataaatgattttttctgtatgatgacccatatagtttataggcggaccataattggtcacctctgcaaaaattgatatgcttttttcatacaactcgttaagagactcgtatgtaaaaatcaattatcataggctggcatcttaacttgcccacatgcgatgcatgcaagcctcttaagtggtccgtatgcaaaataccccctgccaccaacccctaccaccaccttccgctcattctctccccactcctcccttatcctgtcttctcctctccccactgtggcaggagcaacgcggactacggcggggcaaagatggccctcacctgcatggagactagcggaggaggtgcgtgtcaacggcggcggcagccttcccccacacggagactagcggaggaggtgcgcgtcaatggcggcgaaagcggccttccccctcgcggagaccagaggaggagacacgcgacgacaacagtggccctcccccttgccgaggctggtggaggaggcgcgtgacggttgtgttaacccatgcatattcacacagccatgcttaaataaaatttattagaaaaaaatatatatatactattataattaattttttatgttttattaggaatgtaaaatttggtataaaaaaattctatatgccttgtttttaaaaatcactaagcaatgatctattacagcagaccgacagacaatgattagctgcaaagaaatgacaaattcgggtcaaacacaccccaatagatagtctggggtgtatatatatatatatatatatatatatatatatatatatatatatatatatatttcatacaaactgatctcacgagatggaaaccaaatcatgcagatgtaaagtgatttaagaatgtgaatttgatttggtaagtaatcaaggcaattagcttaggttcatcccgaatccattccatgtttcttaaacaccctccccccacacggatccggcggtggccgccctcccccacgatgacaatgacctccgcgatgacgatgactggcggtgatggtggtggaagcgagtggctggtgggcggatccaccgcccctgccctcggaccggcggtaggggctggtccgacggctagggtttcaggatatttttcttttttttatttttattcttttcgccgaaatcattttcgcatgcgattggcttcggtgaccgcatgcgaaaattcggttttcgcatgcagttgcgttacccgcatagaaaaaatgacgattttcgcagacaccttggtgcggacgggcctaaggcctgcgtgcgaaaatctcttttggctatccagaaaaaaaaatccatttttagtggtgaatgccactcactaggatgcaccagataaataatactaagtacgatgccttctagatgtagattatagtgccatttcggagagttttagccattttatcagcaaaataccccttgttgttagggttgaaattgattcggatagtttccgtccgttcggactatttttcggattcagatagtttcgaactatccggaaattctcagattcggaaataaattcggataatttttctcggaaaagaaaacgaatatagtaagggtactatccgttggaatcggaaaacggtcgaaaactatccggatttttttttcggatatccatagacattgagcaaattttagaaaaaacacgtatatatacataacttttttatacagaatcagatgaagacaaactttatatcaatattgtagagctcgatgagatctataactttcttactgactatttttattatttgagatcatttaaagatctaaatattcattataatataccgtattattttttacaaaatctcagatctacaattcaaacgacatctgatagagatgtgttccatatcaaagttgtagagctcaacgggatctaccactttatagtttataacatttgtatttaaaaaaaatttaaagtataaaacaaacattgcaagtttcgaagatgtgaaataaaataaataacatctccaatttatacaatggtaagtaagtagtaaaaggttttgggaatagaaaatgataatcatatttgtatatggatctcttagaggaacaaccataaaaatcaattttcacatacggttgtgggaccgtctacaaaattgacgatataaatgttggagatgttgaactaaaataataagcaatatctcttccttgatcaagaaacttaatttgagggttttttttatataccggtaaatattcgctaccgtattcgttctgtcttgtattcgctccgtatctttatttgataatattcgttttcatttccatatccaagttttcgattccaatttaaaaaaaaatatgaaaacgaatatgataaagctggtttccgtctatttccgatccgttttcatcctacttgtggtggagagagcgagggagagcggagtgtggggagggccgagctggaccgtggccatgctcctgggctagctcccttgcgtcgggatacgctagaggcagcgagtagcaagcagacgggtgatggcaaacaacgagtgggcagccgatgctagaggtggtgtgctgtgagtgggcgacactggaggcagcgagcagcgggcgggcatgtggtgctggagatagtgagcgtgcagacaccttctccggcactgcacgaccgctcgcccacattctcgcgtctctaacatcgcctgcccttgcctgctgtcacaccatgaagttattctcccaagccaaaattaaatttataattggtctcgagaaaataccggtgtaaaagcaagagtgaaaccctaaataaattaatgcaaataataatcggaattggcatgtagaactcaattgtaacgccctgattttcgttcgggattaaaaatcatttaataatgtattatctagaaattaaataaaagttaaagctatttaatcaagtgaaatatttgagggaattaaaaatttcctttaaaaaaatcatggccgggaatattttgtaatattctttgtgccctaatgtactctccggaattttccgtgaattttcggagctcaaaaaataattataataatacaaggttcatttaaccaatttaaataaaaagaaaagaaaataatcttccccttcctccctttcgggctcggcccaaattccttcccccttcccctccgggcccgcctccctcccctctcctctttgggccgctcggcccagctcggctcccctctccccccaaagtccagaaaacccccacccggcttcccctctctcttccattggctgacaggtgggacccgtggccccacctgtcatccccttccctaccttcaagcaccccattaccagggacccgcaactgatgacattgacggcccaccccggcggtaaaactgccggctcctggcttctacgcgcacgttcgaccgtgcggacgtggtcgccacccactcctgctgcaccttttcccccactctccccgcgaaaatcggcgctggtttacccccgccacgtgcccacgtcgccactccatctcgccggccgttgccgcccgttgccgcccatcctggccacgatctccctcccccgcgcccatataaacgacccccgtgctcccctcgtccatttccccatttttcccgagcccggcactctccccacgccgctcccgtgcaccgccgctttccggcgagctccggccgcccgccagtgctgctccacccaccgccgcaccaatccgccaccaccgttggcttcgcggcgccgtgctacagcccgacccctactccatttcccctctccgcctccggaacatcgccgcctcgcgcaccacctctctccgtcgccgccgtcgcctccagccacgcgccaccgccgctcccgccgccgctgtgctgcgccgcctccactgccggcttcgccgccgcgcgggcaagctcggtctccgctccgtttccccgttccatcgccggaactccatctcctctgtcaacccgagccgccaccacctcgccgccgccgcgagcgacctccgacctcacgctctccttcgtctgcttcgcaacaacgatagggaacccgacatcccctcatccaagctcttcgtcgccggaaatccattccccgctgtgagtggtgagctccttcccttgtcgccagcttccggccgagttttcccgccgtcttgcgcctcctccctattcatgcgcctcctccctattccctaactttccctccttgttccctagatccttccggccgccgtccgccggttcccgctcacggaacaccgccggaccgccgttgccgtgccaccccgaggagcgtcgccgccatctcgcctccctttggtgccgtgccgcttggtgagcatcccctctcctccgctctttccgccgctctccgcgtgccgacccgcgccaccggtgtcgtcgccggtggtcgccgtctggccgcgcgccgccgctgtcgttcgccgccgctcggccgcgcctgtactttggccgcccgtggaccactcccatggtctgggtccacggtgccgccaggccgcggtggaccgagtccaccttgcgcccttccccttgtgccgctgacgggtggggcccgcctgttggcgccggccctcttttgatgacgtcagcggctatgccttttcctttggaaaataattaatagttgcgcaataattcgttaataattctagaaattcatttaaatggctcaaaacttctaaaattcatatctaattcattcaaactccaaattgggccattcaacttgcaaaattcatctaaaattgagatctacatgtttgtttagtttttatgtattgtttcattggtttttattagagtttttcctccatttgcgtgccagcgtgtagaatccgttgtttcagaagtccgcggtcgcgaggaaaagagttcggaagatcaaagtgaagaagcaaggcaagtcacacattccccttgagcatgttgatcccaagttataaatgttttaccgtttgcaaataaacatgcatgtcttgctaattacatgggatccgggtattacctatctgcttgcttgtgccatgtttacttgatatctatcctttgtcaacattgggtaataaatcgactagctcatgttacttatgtgacctagctagaactatatgcttagccatgcttaattaccactagctcagttgatgggataatggcagtattagacctttttagcatcagaacgagctgcgtgctcgagacacccggccatgtttcagtggccgtaattatccaactaaaatgcgactgaagggtgggctgtgggtgcatggttttgctagtcacacccatggcaattaaggaccggttcgcgggatgccctagaagaacttatcgtacttatcacaagccagcgtgggcaatggctggtcttgtagtgtagctttcctctagctgacgcatccaggcaagggtgggcgtgatggagtttggatgggccctgcgacggcctatgcggcttccggatttacctaggcacgagaggggactgcccgctgccttgcgaggagtgggggtgaaacctgaggtgtggtgtgcttggttagagggggttatgcaaagggttctgtcacggcctctttccggtatgtcgtggtggcatgtcggcgcacggaaacgtgtcgtggggctgtgtcttgtgggtacagttgtacacctctggccagagtaaaactattcgaatagccgtgcccgcggttatgggcggtcgaccagattcaccgtgattagtcccaccttaataaatcg

SEQ ID NO: 72271 - DNA, 8970 bp, Oryza sativa
gtacgcgtcgaatggtcccaaaaattggctcctcacccttgcgcaaatgaagcctctttttgcagttttgttttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacctttctctatataaaccgacccgccgtcttcacgcgataaatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgacttatttatggaataaattaaatcattatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatcttattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaggttgaaaatcaacttgacagaaagataaaaaggcttaggtctgatcgtgggggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtacttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgcaatggtgggggtgagggagttattttgtgcttgtatgttgacgacatactgatatttgggacaaacattgaggtgataaatgaggttaaatcattcttgtctcaaaattttgatatgaaagatttgggagtagctgatgttattttaaacattaagctaattagaggtgagaatgggattacactcttgcagtctcattatgtggagaagatcttgaatcgctttggctacattgatagtaagccttctccaacaccttatgattctagcttgtcgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggttgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctctaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtccatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggtcttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctcgcctggcctggcctgggcagggcagggcagggcagggcagggcaggcggcgcgcgtgcacgacgtacgcgtcgaatggtccgaaaaattggctcctcacccttgcgcagatgcagcctctttttgcagttttgttttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacctttctctatataaaccgacccgccgtcttcacgcgataaatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgacttatttatggaataaattaaatcattatatgcccataatctcaacagtgggcatactcgcatacgtagtagccgcataagttagttcccttgacctgctttgcacactacatgagaaacgatgagagatttaatatactctttatattaactgtaactagagattcaattcaatataattttggatcatgcatgtactccctggaaaatgaaacctccgtccaagttttgctttccaagtcccgcggaccaactgacggaaccgatcccaagccctacatgtgcagttgcaagctatgattaattaaatattacccgagatcaacataatagcaacagagtcccgcgactttgaaatagatggcattatattacctgtctatcagttggaagaccttgtcaaaaaccttctcctctttattcattgagtcgtacacagtgactctgcatgcgtccaagtcgaaaaagaacaggacccagtggaatctggaatatgcgtgagatgagataaatatcagaatgtacatgttatatgtatgggaatgaaatttgttcgaacgacaataaaaactcactctgtgttgtacggcaatagtatgaacgtcttgaaatgctgctgcgttaggagatggacaagattgtcctctgtgtctttctcgtacttgtcgagcatttcggtgttgattttccgagggtcgatgaacccagtattgtaaaccccccgccgtcgggccctttgaatctccattctacaacaatgaaaggaaattattattgcttacatatatgccaggagctaattattgaacgaaacaaatcgaactcaaagatacttacaaaatccatacgcttaaaagagagacgtcgagggcgtcccgatggtacagattgaagacatccttgaaatggatccatagaacatcttctccttgcaagaagttggggtttctgatcctcgctccgaacatctctctaccattggcgctcatttccatgtaccgttcatggaatttgtacatttgtgtcggtagggactgcagctgctcaggcctgacaagcggtttaccgagttcaaacttgtatgccacttccgccttcgggattggtgcgcctccaaccaactgagccatggttagaccggtgtccgaaatgaaatccgttatgccaaagtcttcgccggtcaccaacggctcgaccacttggtgtggttgttctccaagctgaggaactggtttggacttcttgtaataggctttcctaagtgttcggtcatagtccgatagctttaaggcctccttgtttgcggtggacatttccttgaagaaattcttcacgctcgggtcaataggtatcttcttttcaggactccgaggcttgagttgcctcttcacttctcctgccacataagcgtcaagctcctcttgactgcaaccgtacggcggctccttgtttttggtggtgtcaactttggccttcttcgttgcccttgtgctggtaggaggtggagcttggcgagaccttgtcttgggaggtgcaggcggacacggtggaggaggaggcggaggagccggaggagccggaggagatggtgcaggaggaggtggcggaggagccggaggagatggtgcaggaggagacggcggagccggaggagatggtgcacgagatgccgcttgtcgcccaaggaggatgatgtaccgcttgcgccatagtataatggtgtggcttgtgtctcgtagatgcgtctcaccatctcctcctgggtagtccaactcgaggtcctcgtacacggcttccaccagctcaacttcgaccctcgagtatcctgctggaatcggcctgcagtggtaagtccctgaaatgtccgttgggatggccattcctgacgccaccttcacgtgatgagaggttatctattagtaatcaacctaagcagcaacttgcggaacgtacgagtcaaaaatcatatattacatcgagcataccttgattgataagttcttgaagggaatatgcagctcacatggtgtccgatgcgtgatctcatcaacggggcaggtggtttcgtcctagatttgcatggcgtccatgctatgtgatactacctgccccgttgaggcgcagctgctacgattgcctgatgggctgaccattgaaggaggtatgtacggctagggatcgtgtgaccgatgtgctgccatgcgttcatccaccttccgggccacctcctcttgcatgctgagctcgtagctcgataccctgtactcaagatctgcaatcttcgcctcggtatctctcttgctcctcatccgactcctgtacgtgtggatgtcctccttgaatcccatcttccagggaatcacgcctttccctcgtgttcgtcctggatgctcgggagtctgtagggtgagtgacagttcgtccttctctctgtcgggtcggaacgtgccctgagaagaggcttccactgcgcccgttagtcgattcgcagcctcgcgtatctgatcgctgaagaccaaggagccatcaactgggttgagcgttccaccgtgagcatagtaccagaactttgatcgattaggccatttagcggtggccggttcgatacccatctcaagcaagcttgcctctatctcctcccacttcggcatcgcgacgctatagccgcctgaccccaagtggtgatggtacttcttcttggcggcattttctttgtttctttccatcattgcctgcccttgttgacctgtcttgtaagcaacgaacttgtcccagtgatcccttagcttcgggaatacgtcaaagttcggtg

SEQ ID NO: 72272 - DNA, 26291 bp, Oryza sativa
ccccccccccccacccctcacctccattcttgtttctctgtatggagttgcaacggtgtcatttttgttttattttttcggatgtattttcacacttaagatcacgatacaaccaaccacaaaaaaaattaaacttgaactaccacttagctaagtctgaaaatagctagcataccacttaattagtctactttgcaccttcactaaaattagaccataactcttttagtaaaactctttgatcaacatgttaaacataggagagatcctttagtaaattagactatataaaattacttaatctaattcaaaatataaccacatgaaataatagccataagttaaccagtatagagagatgcaatttttttatttttatttcatttttttgatatttttttcatacttaggagaacataggaaccaaccatataaaaaataaactcaaacagacaaattatgtgactcgtagaattttccaaaactctaccgaaatggacaaaatatgtgacttgtagaattttccaaaactctaccgaaacggacaaaatatgccatttattgaaataggcgtaactttctcatacggactcggaatcaagcaaataatatatccacggacatttacagaaaaagttacacccgattctcttcagctttgccggattcggcgatattaaaacctccaaattccacttgcaagattatgttttcgaggagagaagtatttcgatagagctttgaaaaatttcacaggccacatatttcgtccgtttgattttattttttatatggttggttcttgtgagttcctaagtgtgaaaaaaatatcaaaaaaataaaataaaaataaaaaagttgcacatctctcttctctgcactagttcagagagaggagagaagagaaaaaattatacaggtcacatattacgtccatttgagtttttttttatggttggttcctatgtgtccctaagcgtgaaaaaaatatcaaaaaaataaaagaaaaataaaagaaaaataaaaaattttgggggggagggggcaccagccactctggcgcgctccccctagtcacctcagcatcgccccgacacgttggcagggggacggcgccagccactctggcgccccaaaaggaccatttctgaaataagtttttttagggatctatttgtaaaataagttttttaaaaggactaaaatgtgaaaaatccagctctcccaaccgtaacgtttacctcttcttcatcaacgccaagaggcatggtccaaagcctctctgcacaggaacagcagcagcagcagcgcgccgctgtccccggaaagagagggacggcgagagattggcgagtagcaagtggcggagccctcgcccggctagacccagcagccgcttgttttttttttaaaactaaaccggcaaaagaacagccaattatatttttaataagtaggagtaaaaaccctaaatgggttacaagaaaaaaaaaacaccggctggttgaacagctacacagcacacgccacaattcattagcaactgaaaccactaatggaacccaacgtagagttgtcgttaccaagcttgataaaaacaacatgtagggtttggactttgcaaccgtgttatcgttgtcgagcttgccgccaaagcgacacaacagctccgactttaccagcaaccgcttgttatattgataagttaattgatggtaaaatttctatagcaaatactagttatattaaaatttgttcggactcaaaattctttctgactccatcactgcgagtagcgtggcggatccaccccgcgcgtgactgcctctgtgtttgtatgtcagtatgtgttatccttagcctttggttggttcagcgagacgggcacgctggcctcctcctccggtttgcttgcaaacttctatcgtgacacaacacacaggaacggctgctacttgactttgctttgcagcgatttttttgactcgttttttagtactgtagtactccagaaaatttgtcatggctgttgctcacggatgagatgactcttcttatgaagttatgattgattttttttcttcttcacacatattgaactgatcttaggtatggtttagttcctaactttttcttcaaactttcaactttttcatcacatcagaactttcctactcacataaacttttaacttttctgtcacatcgtttcaatttcaatcaaacttctaattttatcgtgaactaaacacacccttaaataaaagggagactgaagatatctgggggcaaggaaagctggttaaagggcgagaggtttggataggaaattcttcttgctgtcagtcagtacggcagcatacatacgtcttctttttctctttctttacaaaaaggagacgaggaaaacacttcagtacacaagcatattgcgtgcctacgcttctcctactttacccctcttttcctcgtgttctcagcaaaagtctaaataacacgagtttcttcctttcggcgcacccgtcttcttcctgttttttttttaaaaaaaaaaagaaaagaaaaagaagaagaggaggaaaatctgccggaccacacgtgggctttaaacaaacaaaagcgttgtgcaaatctagcccagcaatatccttctggcccattacttctgaaccaaaacacagaggccaatctctgggcctctgaatctccgaccagcccaactccaccacaacagcaacgccgccgagtcgccgacgacgccttttggtgctcgcggcggccgatgtaacgagcggttttagagaaagaaaccatgggcaagaacacacgacttcgccccgcgccatccaccatcttcttcttcgccgacgtctcggccggggccttcccttcgtcgctctctctatctctctctgctgctgcacagaaacagctcgtcgtctgcatgcgtgtctggctctctgtgtcgcgttaactgcgtgcatcgatatctgtcacctgataactcaatgcacctggcaatggccacgcggcgccaactgctattactccgtccagcctaaaataacaacttgtattctctaaagtttattttaaaatataacaacttctacactaacattcttttctcaaacaatcaggtaatcacaaccctctaccattcaattttttcacatacatctacttctcatccaaacacaattctttcctatttaattctaattactttcttaataactgtgtccaactttaaaaatacttatattatgggataaatgaaattattccatatttaattttaactactttcttaataaccgtgttcaacttaaaagttaattatattttgagacgaatggagcagagtaacttgtactacctctgtttttcaatagatgacaccgttgactttttctcacatgttcgtcttattcaaaaaatttacgtaattataatttattttgttatgagttgttttatcactcatagtaatttaagtgtgatttatatcttatacatttgcataaaatttttgaataagataaatagtcaaatatgttaaaaaaagtcaacggtatcatctgttatcaatgaatctgaacgtgagaaatttgttctttataggacagatgtttcacaaggctggtccgctggtgtgctcatgatgatcatgcatgcgcagcaacagcacaggtagcgggcacgtctcatgaatgccgcgaggagtacagccactgttgctacgtgtactcttctcctctacttttgttttatactccaacaacgcagcactggagtaaatgcgagggcacgtctcaggaggatgcatgctgctgcgtgtacactttgcgcgtgctactgcgacaactacggttgccggccggccggccggccacccgcggccgctacaggacgcaggtgagggtggtcctcatagctagattggccatacatggcatcacactcaattcaacacgggacaacactaattgtttttcagctagcggaaatttaggccctcttcgattcactgaaaaattataagaatttcgtttctataggaattttcttatatggattttaaaatcagaagaatgaatattatggaatcctacagaatatctcattccatacaagttttaaagtaaatttaacatgaggtataatctctagaaagctttccgtcgagtctttatgtctactcaaatttatatgtttttcatgtggttaaatcagacaaacattcttatgtttttttatgtgttctacaatcatttattttacacttgaattactgttagaatcctgtgtttttttatatgcttttccattattgcgattcaaaatatgtcattaaactataaaactcgtttagaattgatgctgatgttcttttttgttataatttatttttcagcattgtttttgtaagttgtgagtcgtgaccatagcagctacactacatggcatcacactcaactgaaacaggacaaaactaaagcagacgacactccaaataccaccgccgttcctgcatccattttgaacggacaaatttcaggctgcatctgcaattccgcacccatccactactccctggaaaaaagaaaagaaaaccttttctgctctgaaactcgtgtgaagcttctgtcttccaagcaaagtgtgaagcatagcgattcgaatttttttgaacccaaattcggttcaaaaattaaatataaatcacagcaatcaaggaacagcacggatctcgatgcgcacactggacgccgagtgagatacgctacgccctgcggatggacggacgcctgtactgtatgtagtagtagaatggaacccgacaagagctgctctctcacaacatcggatacccacgcgcggtttccgaggcacacgccaaagtacggttttgccccccgcgaataactgcacgggcctctggttttttccttacggagcgaagggtagaatcgggaacagaaaaatatttgttgcgctccggggcgaaacgaggcgacgactcgccgattacgtgcgcgtgggacccacccaaaaggctcacagcgctctcgcaacatttgcagatgacaccctgaaaaattctcctaatcccctccatgttcaaccttacgcttttttagtacggggaggtgaatgtgatgaagtgcagggggtgatttgtaaatgctgccggggtcaaatccggcactggcccgatttcttccggtcccgaccccgcatttcaaatttcctcctccgcctcctcctcctcgtctccggccaccgttaaatacctcgccgccgaccaccaccaccgcggcggccctgaccccaccctgcgagccctagccatggacggcgacgacgaggatatgcgcgacgtctcgtccacgtcgtcctcctcctgcggcggaggggagggcgcggggttcgaggaggggatgggggagggggtgatggtgatggaggtgaggtggttcgaggtggacctggagtacgagttcgacgcgcccaggtggttcgacctcgccgtggaggagtcgccggtggaggcggcggcggcgcagctgtggttcgcctccgcgcccagctacccgccctctcgtgcgtgcccatccatccctacacctcttaatttattgtgatgtttttctgcatggcggggatgattcgggaaggggggttgggtccttggggatgggatttagttcgatcgatcgattcgcggttgaaatcgtcgatttagtatgtgcgccattggtgggatttctattatgcagtgtgttctcccttgcattattgatccgagaaaggaggtttgggagtccctaatttcgaagtgcttctaggggcagcatgcacatgaattttctgaaatactcccaacattttcagaccagcatgattcaatagagtgtgaaatggttgagtgtcatcaattcgggtcagcattgatcacttagatggatgagggatgcatttaacagagattttcctgtttctaattgtgtaatttggcctcgatgttaaagtttgattgtcaaccgcaatgagtccattttcctgataataaatgaagaagaaaaagctatgctgttctcaaggaaaactgatgttcttgagatgttaatggtagagaaggcacccacaggtatccaggcccatagcaaaaaggaatgtatgatgtagcaaggcaatggccattggccttttaggtttctttcatgagcatccacaactaagagacatcttggaacatgtgactgcaacaaacagactttggttagttgcaactaatttggtgtattcaccctaaaactttgacaactaatgctagatataaattgtaagctggtagagttatgtttgttagtatatactttcctggtatttctggtcttctggaattgattaaatttacatgtgttacaaacccaaaatgatatgggaggtgaaagtgaaatatcatccttggttgtatgcatcaatttttggacaaaactacgatggatagttcattgttttactactcaagccttttctattatcattaatatgtaagtacaaatatttttttggttatttctgtagttttaatgtttagctcatgacaaagatagaactatcatattacatgacagggaaacttatggttacaacactagcaaggtagcataaaaaacagtaacaagaagtgaataaaatatgtactactactataatgacacttgtttgattatttgacctgtatgaattatggaaacgttagatgttatttttacagtttaactcgctattgaactgtcattacattcatttttcctttttaattggttattgccctttgttgtcaacttaatatgactgaaattttctctgttgtttctgcagccttaattgccaagatgttggctgaagatcttgggttgcaaagtttaagaagcactgtggatatagatgcagcacattgctctaaatcctctcatgaatgttccaatggtgctgaacaaacgatccatcggccacatataccaaatgaaggtccctataagcccaaagttttctccattatgttttttcctattgcatttcttaccatatttgagcatttcatttagcctgttatgctttgatcttttacccagcttcttttatgtaaaataggaaggataccttgccatcaagtttcagcgaacgagcgaaaacatggcgttcgaactattggaaaaggaactatcccaaagaggtctacactgatgaagcctacagccagtcaattagccaggcaaaacagacaaattgaagtgaagaactccacacagtatgtaaatgttatgccttatgctaattcatattctttagctgtcctagggttggtacatacaaaatttggagtattattctctgttggatgattttataacaattttctgattttgaagagatgcatttaccctgccatacttgcagttccatgaacatgtgtttcttgttggtttactcacctgccattcttgatgaattaaccatccactagcattgatcttaaccgtttatgtcagtatatgcttgtgtagccatcacgtttttctctttcacttcattatttccggactttcaccacctttccttttgttttagatttgcactgcaaggatttttcaatacatttaaagcaaatgctgtcttcatgtttctgaacttatgtaccaatttgctttactatcaggagtaaaaagtacggttggggtgagaagtgatagaagtaccatgagctccaatgactgcacctaccaagctgctaaaaggcagagactagaaagagggcatctcaacaaggtattttgctgttttttattttctggggggtatgaccaccccaaattatctggtgaagttgtttcttaactgtaaaacacagtgaagtttgtcggtacagttttaacttgaaataccacataattttggtagggcatttacctttagttttgagattgcatactagaaactagattatatttgtctggattaatcgagaatacttaattgactacagtcatggttctcatggcaactgacaatggcagctaattttttctgttagcatcgccaaagtaatagccacaaaaccatttatactgttttttcactacagagtgatcagtgcctatttgatattgatttgttgcataactagtcactgaagcttctttacttattgcacaggttgtttcaactaatcaacctgagttgatccataagaatcatgcaaaggtcaagacacctcaaacatttacttctctctcatttcctaggaatatttcagctgttccatttcaattctatagaaaaaattagaaaattatttggactttttatactatagtttttcttaaagtgcttgacatactcctgcaactagccaatcatagctgttatactatgcattaacaattagggatgcaagcgggccgacccgcaagttcacttataggtcaaataaatgataattcatgggttttcgcgtcgtggtccggtttgccgcatctagatatgcaagtggatcgatccataaatccatttataggtcaaattaataggtaacccgctggtcaaacccgcgggttacgtactaattttgcctataagcgggttcgcggacaagcccacttgcacccctattaacaatctctaatatagaatataccttttatgatacaaaacatgctcatcgtgcaagtttatacatgatttctctgaggctgtgcctcaaattttgcttgacgatgctttctcatggttgacacagaatgttatgactagtagctctgatcatgccattgctgtaccaaaattgaagattacaattcccagagaacctgaattggcaacaaagctaagagcagagaggtcaaggatactcagagcagtgtaaagtcattttctctcgctctcctgtttgcctgaatgtcaagtacttctaggcagctcatgtccttttcttgaaatttcaggccaactaattcaaagcagctaaacaaacaggcggcacaatccatttctatgacacaagcgtcatcgattagaaaggtggattacattactgttgggtttttgcagcttgttctggttgtcttcactaactattaaaaaataaagtaggttactcacacttacatacatgagcgagccctgccagacaatatgtatgactcattctatggttttcaatttttggaggatggcaatactcagtttgtttgatagagttccctaatctcaaagaattttagaagacggtggcacctgtgaggccacagaaatattcatagcagagatgtacatgtcaagatctcaagagaatgttgcttttttaatgtataatagcacagcgtcttggtggctgatagtgtaactgtaactgtgacagttcagaaatggtttcatttatgttttgtccaaagaaacaaataatttgtagaaatatttagaaaaaaaacattcagttcaatcagtgaaagtcatacacatagtttttaaatcatcttttccaatttattatgtgcccttgtacactattctggatctaattgcatggttgaagctgttctgtttactgctattttctgccctcaaagttgaatcattgtcctgtactaggacaggcacctctacatttagatggttaacttttaatttgcactatataatctttattctctgtgaataggttgaaacgacttatcatatacacactatccatgcctactaaaaacttggttctctggcaggttgtgcaaccttctgggcgcaatgatcatcagcatgcaagtgttccacatcgcggtattgggtcaaatgtgccagtgtgtactgctaatcgtccaaggcatcttgacaagtaaggcttgttttttatatacctcctcacttctagtcccattactatttacataatatccatcctattcggcagtacaaaggaaagtaaaatatacctcctactattctcttgtaagtatttcctgtaattttctagttttggtcaggacaggtttcttcatggaaccaaataatgcaatagtaaagactgttatgcttttgattctacccagtacctatgattttcccaaggcagtgaaacttcagaatgatgtgatcttctgtaaatagagctgaacttgtggctattttctgtgctctgttaacagcatttgcaaaacgccggatgagtgcagagatgacctgtttaaatttaaagctcgaccagtggataaaaaggttggtgctgtggatggatcttctatgcttgctttgaatcttttagttcatactgctctggacctgtttatctttgaagtttgaaccctagtttccaatggcctggatagcgcctagttgtattgattgatatacctgttgcaatttcatgttctgggtgtcagtggccctacttttataatacagataggaattaattgctgaatatgcagttgcttaagaaacaaccctacagacagaatataggaaagttctagtttcacatatttgattaactgcaaatgcagccattgaatcttacattttctttgccttggaacagatactaggaagcaaaggagatattggtgtatttcaaaatgccaaaaggagcacaacagttcctaaggttctctctttctctgtgtgtgtgtgtgttgtggtttgttataaattcctcactcatatttcttgcttgaaaatcctaggaatttaagttgtcaactggtaggaagggtaagcaggctccattatctgaactcttcaacaaggtacgtactgatagaacagaaactgattgcccttactccttagattatttgctctgatgtttactcgtattatttttgaagctcactttaactactgaagcacgccgtgctttagatcaccggactgctgatcttccaaattatattaccaccaaggttctttccttgtttcaatttagcttgtttttactcccttgcgcctttaaacaaagtaactaaaatatcactcctaatctaatgcaaggactgcaaagagaacatgattggtaacatgcaaagctagctatggtaggtaagtaatatttcactgccatacggggcatttatcatgtcgcttctcaagttagaaacaagtgcatcacacccttccacattttaccatttttcagatccagtcagtcaagacatacaaaacataggaattcttctctttgacaattcctggttcagattccttttctccacctgaacaaaggtaaacgttaactcctaatatttcaggtttcatgattcgcaatttcgcacagtgcatcatgtcatttcacaccctggcaactttccattatttttcagcaatacatttgggtattttcatgacactgatacttggggtgaactactgcattgacattgctctctactaccatgtaggctaagcgtctgttttggacagtaggatctcgacttcatttgagttttgacaaagatggagcgatacattattttgacttgaaggcaccgaccaaggcaccgtcccggccatccccggcaacctcccgtctccgctgccgtgcagctgaacataattccgtacctgctcgcggccatggcggagatcgatttgtacagagaaactaaccatgacgccggtgtgtactccagatctgtaacttgttgccaatcatcatccagcaaagttgcttgcttgcttctctctccttgcatcgttcaaattactgggaaaacaatgttagccaggaaccatggagatatagtcacagagatactaactccatgggacccgtagctctgaattctgatgctggtcgggcaaagacgggcatacaggcttgtccaaccagaaaaatactgtggcatggtcagggtgagcacctgatggctgatgacctgacctgacctacatagagtagatgccatggcagtggtgtcacggtgtacgtgtgagccaaactgtacatgtcaaacaagtgtagccatcatactggagtagcatgggatcagaacggctcaggcatctcatctcaacaaaagttagctgctgctgctgctgttgctgtggctgcgtgttggcacgtcgcgtcgaccggggccaggccggctaaagcatggaagggacatttgctcgcagatctgccattgactagcagacgatgatgcacggaatggtcaggacgccctggccgtggaggacactaggacggcttgcgttttgacgccccaataggagttcacagtccagtccagtttctgctagaacctgtgacagattcaacatcatttgacgaaaaccaatcaaaaaccacggaatttcgaggttccaacgcaggacgaaagtagattccgggtgaaatgtcgaatggtttttgagaattcaaatttgaaatggttaaattcaaatgaaatttattcaaaatttgcagaaaaatgcaatctcgttgggggctgggatccagcactcaatccaaaaggtgaaccctagtcctagccgagaagattgctactgctaggaagggttaacgtctcgacgaatttctaacatcttttgagctggctcgaaatgtgcatatcgaatggttttgttcaaaattttctgaaattcattcaaaattaatggaaaattgatgtcttgaaggggctcgggaattcgctagccaatcaagatcataaacccttagcctaggaaacaagtaaaaggacaaggaattggattactgttctttcaatgcaaaagttaacagtgacatgcctaggagtggatacaggcagcagctatgaatatcattcaacagtaagagcagccagccagctacactccatgtctgatgaacagacacagcaacgagccaacgaagcaggacataaatactaggcatggagattcagagtttcagaggcagcagcagcagcagcagcagcagcaaacagacgtacactaacagcacagcaagagtgaggcagagcaactaataaataccgtcaaaaaaagggcatttacattagcacaatcctgtcgatgcaggaatgcatggtttcaattcaatgcggcgtcgtcacacaccccaggatccaagaactgatggcctccctctgcctctctgatcaaaatatattacatcataaagacggcgacttcatggcgctcacgagacatctctgaacctgacactgatctactcactctctcttgaataccatgaacaacactagtatgtcactgcaaattcctagggacaatctttgggcaatcctagatcaacaccaagaagaagaaagagtcaagaacaatggcattaacatcatcatcatggtcatctaacttcagatcctacatctagctactatttcctgcactgtgctactatccttttagcatcttggggaggagaaaattttggaggtttggagaagatcacattgtgtgcttggatatgacctcgccgaacctgacgaaccactgctcgtcggaggagctgttgtcgccgatgtcggtcacgtcgtgccctcgcatgtcggccgccgtcgtcgtcgacgccagcaaccgggagtagtccaccgtcttgggcgttgtcatggcggaggccggcagcagggagagcagcacccttgcaacctcgtgcatggtcggccggtctgaagggtgcctcttggtgcacagaagggcgagctggaaggccttcctgaccagtcccatgtccgtgcacgtcactgacacctccgagtccactgcctccatgactgtgttgtcatcagctttggagagtatctgaacattgacacaagatcttgtcatacaaatcatccattggatcatgctagaaaagttctagaattggtgataattttgcacaatgtgatgagaggatggagtggaactgtggaagtggggtggcttaccaattgatgcaagttcgattcgttgtcgacggccttcttccctgtgagcaattccagaaggacgatgccgaagctgtacacatcagatttctcattgagcctggaagtcctggcatactccggatcaatgtagccgatggttcctagcacataagtggaggcatgggacttggcagaggggacacatttggctatgccgaaatctgagaggtgcgcttcgaagttctcgtcgagcaggatgttggaggacttgacatctctgtggattatgcgagggttgcagtcatggtggagataggccagcccttgtgcagctccgaccgcgatcctcagtcttgtgtcccagttgagcttcactttctttgatggacctgaaaaggatcatatatagatcataagggagatgcataatgataacaaattatccatgagccaaaggtttcaagccctaaccgtggagaagatcccacaaggaaccattttccatgtaatcatagaagagcaagtttccatgtggagatagcgagaagccatggaggctaacaagattcctgtgccgtatgctgccaattgtctctagttctgtttcaaactctcggaggctatggttatactgactgtaaagccgcttgacagcaatggccttgccgctcttgagttcacatttgtagacagtgcttgaggcgccatagccaatgatgtatttctcgctcaaattctctgtcagcctcatgatgtcctcgtaagtatggatagccatgtccatctggagaacaactagctttggaggtcctgaatatgattaagaaaaggttaagatgaattccattatgccagcatacttgctgttaatttcatcgacgacaactggaggggtgagatatagcgcacacataccttgcactggcttatcggatcctttgacaagtggctgtggttgatttgttttatatatagccaacagcagaacgcagagcaatatgataaagcctaagataatgcaagcaattgctgtctttgaaatattaactgcaatagaaattaagtgaacatgtgtttagcagaaaagcaaatggagtgaaaagctacaaggggttagcttcttgtctgatacctctttgtccatgagagtgtccacagctggaatcttggcagtaaacatgcagtaatggattacccaagaagctgcatttatgatttatgtactggttgcaatcagaaattagaagatgctaatagaaggataacagagattgtgcatggtgccatcttatacctttccattgggaatttcgagaagttctttgccatcgggacatgtccagataaattgttgtatgacaaattcctgaaatgcacttaaggataaataatcctgcccaagttatcaccagtatacaatgctacagagcagagcttgcacacaaaacttacaggttatttaagctgaagcagttggccaattgagcagggatctccccaaccaaattgttgttgttaagaatcctgcatgataacaccatagctcagtaaaatatttaggtgattttcgatctcacacgcataatatgaatttatgatgatatacaactcacaggctatcaaggttttgaagttgtccaagttcctcgggcagactaccagataagttgttgttggacatatcactgagaatttaaattttggttcagctgaatcatgatgataggatggcttcaaacagataatagttagttacatgtgtttcaagggaacacacttacattacttggacgcttctcaagtttccaaactcagcaggaactggcccatcaagatggttcttactcaaattcctgcagtcaaagcataaccatttaggcatcaagtaataatggccatatgaaataagttatggttttttcattaaaaacagtatggtttctaggaggttggtccgcaacatacagttcaagaaggtgctctagatcaccaatggtagcaggaactggtccagagaattcattgtaggaaagatccctgttcaaaaaataataataaaggaacatcatttagcgcccacaggtcttgtaacaccaggtaaataattatagctaaagtttctacttacaatgtgtccaagttgatgatgtgaccaagctcagaaggaatattgcctttgaaattgtttgaagataggttcctgtattttttaaatgtatttttaagcaagaaaaacattaggtgaactacaataatttcgccgagtgaattaaatgattactgtaagcataatgcaacagatacaattactcacaagtaagtcagactctccaacttctggaaaccagcaggaatagaaccatttagcttattgccataaacattgctgagaggcaaaaaaaaaacatgtttaatcatgtggagtaaaaaatgccctgttaacttataagttgacttagtaccggctaacttacaatttgtttagagcagtgcaagaactgatgtttgcaggaataggaccttgaagattgttgttggcaagatttctgcatgcaaaatttggtcaacaattgcacagaataaaataaagcatactacgtaactcatagacatgataaaatttcttacagttcaaaaagctcttcaagtttgccaagctctgctggaattgtgcccaccaattcattatcattcagttgtctgcatggaaaaatttctgaacatcttatagtgttccacaccaactggagcacaacaatatctgcataccatataatcacttacaggtagctaagtttactcatgttcccaagctccggcggtatgactccagtaagtttgttcccatgtaaatatctgaaggaaaaggtgacagtaggtgttagagaagagaagaaagcaatctcagtgaaaaagaaagtctgactgatgatactaacagttttccagtataggatagattgcccagtatagaaggaatgggccctaccagctcgttctcactcaggtctctgagaataaaaaaaatgaatataagaattcattatccaatattacagaaactactgaatttcagtcaaaaaaatattacagaaactactaaaacctatggattgaaatgtcgtgctctactcacagaacagcaagagcttgcatcaggccaatcacatctggaattttcccagtcagtctatttccttgaagtgacctatgaacatgaatagaaatggttcaacataaaggctgtaagtaaagcatctatatgcataagagtgaaacagcagattacatgttagaggatttgcaataactcaggaacacttacagtgtggctacttgaagaaagcctatgttgtaaggtatttctccagagatttggttatacgaaatgtccctgcaatacaaataagaaactcgcattatggtgtctgaaactcatgaacactgaaatattactgaaatcttagcaagaacatacagaatctcaaagctggtgcagttccctatgctctctggaatggtccctgtgagattgtttccccttacatcactgtagattaagaacagtaaccactgtcaacaaggccaagttgcacaatatgcagcaacatctccaaagggagaggagatgacttacaagtaccacaggccagtcagttggcacatgtcaggtgacaaagttccagtcagtgagttacccctcaaacctctgaagattaagagaagcaaagtgttaatgcctgaaaaataccttcttatactaccagctaaaacagttagacaattttcttttataggattcttacaggtattgcagaacttcattccagtatatgagccttgggatatcgcctgtaagctggttctgtgccaggtccctattccaagataattaaggaaggattttatcagtaagtaagaactagtagtacttaagatgcaaaaaatgacacagcaagccatgtttcccgtggcacgcacattataacacaaaaacagttaaacaagtagaagtcagatcacccagtttgtccaagaaccccaaagaagtaaatagtcacggatagagtaaggtactaagaggctcacaatgtcttgagatttggaatttgggacaatgtggaagggatgggtcccgtgagctggttgttcttcaaaatcctgcatcaataaatgagagagaaaaaatgttaccactacaacccaagcatcgcaaaaccatgaaaaaaactactactactccaacaagatgttcagtatcataatctggattctagaacaagatgttccaaaacttaatgtaaatcaattagtctctgatgtctcagtattagcctgaactttccaaagaagggagaggaagtgcccatatctcaacagctataggccatagctcttgctaaagaaaaggtaggaaaagatttaaaaaaagtagagcttacagctcctcaagctgcttgagcttggagatggagaaggggatgtctccatacagcaagttgccagacaaatccctgcatggcaagaatcaaaagagcccaattaaaaaattagctagaacaccctgttacaaaaagtaacagaataaaagaagacttagattaggtgaagtacaaatattttaaggagatgcagtccccaatctcatctgggatttggccagtgagcttgttccccttgagatcactgcagagaggcaaatcattagagcacaaataaactaatcagcgagcaaatccacaggcttaaagtaaaatagtaaagaactgtgtcacatcatggcatgaggggtcaaatcaggtgaagtgtgcaggattataaaaagaaaatacaggctagtcaaatgcacaaaaactcaggtagatgcaaagcaaggggaaatagtactctctactcatatccgtactcacacgaactgtagattcttgagctctccgatggccggcgagatctcacctcctaggtttagatttgacaagttcctgtttttcacacagggaaacactctcatcacaaaaatcctttttagcataacaaacaagatagcctcactaatatccaaagacctacgcaagataacaagaaaaacccgtttcttttccattagatatatacgataacaacaagattatcaagaagaaacattcacagcaatctaggcacaaatagaccaaccaagaaaaggtttttattcagaaaaaaaagggaggcaagaatagaacagaacagttgaactatttgctcctcctgatcagaatgccagagcgagcacggcaagagagaaaaatcacatgaagcacagagtgcacgctggaaaaagaaaagaaaagaaaaaaccaacagccaccacaagagaagattgcaagaacaagaacgcaaccacccgcgccgccgcgcgccatgtctgcccaggaaagaacaccgagcttcgcagggaggaggacgtacagggcgaggacggcgaaggaggcgttgtcgcaggtgacgccgcgccacgcgcagtggtcggcgccgccgtcccagtcgacgagcgcgttggccgcgttcccgaaaccggccttcacgcccatcagcgccttcccctccccatctccccctcctcctcctccggaggccgcctccgccaccgccacaccaacaaccaccaccacccaccaccacagccacggcgccctcgccgccgccattgatccaagaaccaccaccacctagcttattccctctcaagccgctcctcctcccccctttcagggcactcgcactcgttgtgtcactagtgcatcgaccctggccgagttaccaccaccaccacgaccaccatggctctctctctctttctctgagctctgatcgatcgatgggggggagcaatggtgttttgtgggggtggtgccgatagcgacgtgactgttgttgctttcgggaggcagccgctgcactgcactgcaccgcagcacgcagcagcaaccaagagagagaaagaggagagagaagagagagagaggggctcactgtgtgggtgtctgagctgagctgagctggtgccatggtggtggtggcaggagagagaaagaggaggaggaggaggaaggctgacaaagtggggcccacctcgtcagtgagtggacccggtgggtaggggggtacgtgtaggcgtaggggcccgtggcttccagtttttttcaaaaaatctctctaccacggttggctggctgcttgatgagtcgatgacatgtgggcccgggtcggcttgggcgatcacatgtcagtgggtgtgggcccacatgtcagtgtatcggtggacgagggggtttaagctaggcgggtttagaggaggcgcgcgaaaaattaaacgcgatttggtttggttggttaattttagggggggggctcgggatcctctgcggccgtaactctgtgagcggctgccaggtgggcccaccggggccatctcgtgtagtacaattttattttcaattaattaatcttgtagtacaagacggaatgtgtggcgccgttggtgatgactgatgagtgatggccatgaccagccgtgcaccgtacggcctgtcgtctaaaccatcgtcaagagctgatcaagagatgaagagagaaagataatgaaggcaatgaggagtgtagcagatgatactaacatggatggatgtttttgtactgtttgattgccaattaatttctggctagctaaaccaatcaatcgtatgaatcgtggtaggtggtggtctcggtagaccagatgtccctggagtagggtttgctcaattgtacacatgcatgcatcccacatgagctagctgattgacatatgcacctttgagattattcctattaattcgtgaagatggaggtgagatataaatatgggtaaactaaaatactatggctgtgtttagttcctttttaattttttttacgtatacggacacacatttaaaatattaaacgtagactaataacaaaataaattacatattccgttggtaaactgtgagataaatctattaagcttaattaatccaccattagcaaatatttactgtagcacaatattgtcaaatcatggcgtaattaggctcaaaagattagtctcgcgatttacatgcaaactgtgcaattggttttcggaagtttgagggaactaaacacaacctatacatgcaaattaactcggctattgtgggtgtttttcaaattttcatataatatttaatccattcctatagttaacatgatcatccatcagcattcatttatagagatgacctctgaatctcgtgtacataaaaccgaaaaaggtaaaaatatttaaaattgcccacccaacctaccctgaaaaggggaaaaaaaacacttgggctttctttggaacaaagggaaaatgtgaaggatttttagaggatttaaattcttaggataaacttcctatgatgaactcattcaaaacaaaggatatatatgtccgaaaattcctctggaaaacccatggaatgagctagttcatagaaattttggaagaaaacaaaacatgaggttgtacatcacagttctctcttattgtgtctataatttctctgttttttctgcatatcgtctaaatgactatattagagtattcctacatttctaattcccataggaattcttaatataagacattgtaattctatgtagtggcagagccacctctcgggcaggtcgggtaactgcccaggattcgctgttgctgtctctactatcgatggccatcgacacctataaaaattaatcgatcactagaaaacactattagtcatccggacttgacactccgccactgatcctgtgccctctattcttatgttttcgaaatgaacccttagttattagcttgatttagctaattagcttcctctcagcctccagaatttcaactgttctctgcatgccaagttgccaactgccaagtatgcatgcatatgcagttgtgcaggcaggcaggcagccacgtatgcatgcgtacgtacgaaagagaaataccaattaaggacattaacaccttacacaaacatgtagctctgaccccctctcttgtgcagcatctactgcatgcaatgtaattacacatagtatgtgttcctgcatctttctgctatggccttcttcacttcatcaagcctacagctaactactatactagtatatagtataactgctgctgctgctgctgcatatatgtatatgcatatatatgcagtgtgtgcattgtcacacttgctacatgatcgatcgagatgcacacaaggctatccagcaaataatgccgcctctgcatcatgcacacacacataggccgtgtgtatatatgtacttactacatatatctagctaggtgtgccccagtttgtgtatatatgccaatggttcagagtgagcagatgcaattgcaggcttggaattaatcctttcattgatcaactcaccagatcacaggatccaagatgggaaccaccatgtgttgatctttttatttttttggagaactccatatgattacatgagtaaaattttgaaggcctttgttgtgattattttacctgccttagcttggttaatattcagagttgagagttctgttataactttgcataatgagcgcacttattcatatctgaaatttataggtgtattattggttttcattgctgatgtgaccaagacggtacaggtgtctgaaattagacatgcctctacctcctttcaacctttgcaaagctgacctatgcatgttatgtgtgtgatgtagcctcctttgagcagcccaatgcaatgcctggctacttgtaggccagagctgagacaaagaaaaagagtagatgtagaggagagcaatgctttgcaagaggatagcaacaacaatctcaatggctcatgcaaaagtcataccacaaatcagctcagggcctcaggccaactaggactagcttagctcagattttatgctgaaactttgcagccttcaccacaactagagctactagccagctagctctcctctcactgtgagccatgtgtgccatgctaagccaagaaccccaaaggaaaaaacaagataaaaagatgagcagatcagatcagagaaaaaaaattaaacacaagggtcagggcagctcagctcagctagccatacagcaggcagcagattcattcatgcacatgacacaccacaaccaaacaaatatgaacattccaaagactctatctttctcattctctctctctctctctaagttgtgtttagcaattgccaacaggatgcatcaaatctttgccttcaatgaatccatgacattgctgatgaatctctttcttttgctttgggtgaaagttttttgccagaagtatgcaaaggagctgcacctttataactgttgtgtagtaacaaacagagcatggggacacatcacatacataaaaatacatgcatgccatgaccagtgggtaaataagcaattgcagcagcggcagcaatagcatcatccagccaggagacatgggaggacaagagctgcgtgccttattctggactagtcaaaaggttgctgctgccattgtggagatcgatttgcaatgccatccatggaacaccattgctgctgccatgttgttcttggtttggttctcgttttcttgctgccaagaacaccatggagatgatcagatcagccagcccatttgcattgctgattgctctgagtggatctgaactgaactgggtacgattacatggcaccggtttttggcaatgtgaagagctgcagcaacaggagagaggcatgtggtaggggaccagcttgctgcaacagtagagagaaatttttaccatctctctgggtctcatggcaattccttggaaggtttcaggctcccctgcaatgttctgatccctgcacggtggttttttcactgcttcagaaggatcaggtaaaaagaggatgcatactatgtgagtgatccaccaaattaagccaaatgcatgattagtttctttaaagcttcataatatactctgatcaatcatatgtgccatgattgcttagcttgtagattttcttttgggtgcatgttcagagatgcactgtattttcttttgggagtatattttcagcaagatgagtacagtgcaatgtgtacgttaaggaatgctgttgccctgcaacagctgtatgcagatgcatccaggacccttatttgtgcaagatcacaggtcccatcaatcagcaacaggccaacacatgtaggagtagtttctcccctctttctatacacaaaaaactatgggaactcaatagatattggctttagtatatactactattgttctctttttcgccattgccggaaatgttctcagtgcggttgtattaacttgatgtaattggctgagttggataacagtcctcctttatccaaaaaaataataatattgttctctttctaatttttctttcttttcatttctcccccttcttgctctgagagttgaattttactaaggcctggtttagttctaaactttttcttcaaacttccagcttttccatcacatcaaaacttttctacacacacaaactttcagcttttccgtcacatcgttttaatttcaatcaaacttccaattttggcttgaactaaacacaccctaatgataatgtaggtgcactctacaatggataatgcaggtgaacagtagagccctctctcaacttgtttgcatttcataatcaattaatgtatgtactcccatggatcatactactactactacatacactagctagctaggaccatgcagtgaggatggattgattgaacccatcatagaatccgtgatgggtagccctcctttactcctctcctaatgaagaagacatgatggaagaaacatatagcatccaaaaagaaatgaaatgggtagtagtagtagtagtgtagtacatgtgtgtgtctgcatgagagaggctgttgttggcaatggcatacacatgtttgctttgcatgcaaatgtgtgttttgcttccacacatgtcccactcttcagagttggatattgatgggcttgagcaacatccataagcaaaatatgaatgaatacactctagaagcctctgaacccatatctccttttagggctcctttggaactaaggaattttggacgatttttgaacaattgaattcctatggaaataattcatatatggtcctttggaaaataggaatgactttcctttattcctttgaaattccttacgattgtctcagattataggaattttggaggaattacaacatgagcttcaacctctcggaaaaattcctttgtatctatttgtcttttgattcgtgtgtttttcctgtgctccatccatatgatttaagatgctacattttcgctatccctgtgtttccaaaggagctacagtcttgcatgtagagtatgacataaacttttttctttttgcaacttcatattatccatggataataactaaagcatttgtacaacaaagagaatgagaaacaccatggaccacagctaagggcaggtgccagcctagctattctgcagacaatgcaaacctacttcatgtctagccaaaggaaggactgaaaggggagggaggggtaaaagttgatgtggttgagaagttgaggggtttgtttgcaaaaggggaggccaaaagaagggcacagtggctgtgtggcagaggtactgatgccccattactgggtccagtggacatattattgttgggcacaggccatgtgaaggcagagcaaagcatgatgatggcacacccagaaatgaggatagataagataacaaaagttctggtatttgttggtctggtgacaagaggtaaggacagcaaggtgaaaactacttactttaagcctatagctaatctgatcagggtgtgccaaacacttgcactatgatgatacatttcagttagggaaagctgatgttgatttgtacaacatgagtttcttgtgttttctatgtgtagtacattgtaatttgcaacaagataaaagatgtacttctactctatctgttccaaaatataagtatttataacgatgatacatagtcggaaatgattatattttataactgccggactaatatgttagatacataaaggaccaacttttgtccctccttgaaatgaaataactccactactagttctctggatgcctgatagtaatggcatctcattagttgatctattcccatgacaagtgacctccttttaggcaggttcttgtgatgactgtggcacggcactcactca

SEQ ID NO: 72273 - DNA, 17403 bp, Oryza sativa
tggggcggtgggcagcgtgggctaggctggcagtggaggcattgccaacgacgaaggagacgagacggccggtttggttgggttggcttgggaaatttggggggttttggccctccaggctccagtcctgggaggacgtgatctctgctttgcttgctgttgcagacttgcagtgttgctggtaggcaatttattattattattattgttattgttgtttttttttaactttcttttaagttttaatttcaaaaggagctctatgaaaattttgaactaaatattttgtcgcatcattttaataggtgtgatcagatgacattttcacgctcataaaatatcgtggagtataagataaataattgttgccatgccacgaacaatggcacttagtttgagttcgtttgttttacgcgcatactttttcaatttgctaaacattgtattttttttgcaaaactaaatgtactaaatttgttttaaaatatcttattaatctatttttgaaaaagctaatacttaattaatcatgcattaatgattcattctattttgcatgcgcgagggattagtttctaaaatcaacaatcaaatacagtttaaggggttgtttgattcgtgactacatgttgccatactttgctacacatcaagttagctttaattaagttagctatgtattcggttcattgttacacataaccacgattttttttctctctcatcttgatctcatatgttatttgtcttgtaaagtgcggtaagatcatagctttctagtcaaagcgttgcgttagattcatagtctaaccttagctatggttggtgaagaaatgctactagcaacctaaaaacacaaggtagtagataaactaaacatcatactgctatctgatatgatattgtcctaacatgttaactcaaatggtgtggtcaaaaaatttattctatgaaaaataatattatggatgatttgttttaaaaattttaagacaataaaggttcacaataaaaaaaattatgaaaagaaaccggcagcggagggtcgacacaggcatacagtgcagcacgggcaggttgggtttctcagcctcatccggtggtattgcttgtctggaactaccgaagctgaagctgacccggggaaaggtccatttggttggtagatctggtgatggcactcatcaatcactttcgtttcaagttttgatgatttataattaacgtaggtcggagtatatgttttccccgcttttcttggttcctttttaccttcgatagatggcaacaatttgtactattgaaaaccacaatatcggctggtaaaacataaataccatatacgaaaatcatgccgtgttaagatgtctaaattaatactattgtgttgtgtaaattaagtagcacagtactagctaatcacaatacatctggctgtcacatgctacgagtacgaaggtcataggaggcacctagcagatgacatagaataatgttcccattggggaatgtccaatgttccttgtctgctcttaagcataggctaggcatatattattaaaaaaaatgcaagacaccaatatatccaaggaaataaaaaaaaagcaaaacaatgagtatatgagcatcctggattaattaaactactctattcgcttaatctcaaacaatatacattcagacaggacaagtcagtatctatgggcttcttcgaagggcaattttgccgcagcgctacggctgcagcagctcaatttgctgcagctttgccgtgatatttaacagcatcgatggctgccgaacgctacaaaagttattatcatgtcggagcaccatgccttgtgttgtaaaagttcgaattttggcggatactttacctcatgcgtattacttcctcgctaccaagccaggtattatattcactgttcagccgtaaatcgagctggaaatgaacataaaagaatttatctgataatacatacaccacataaatttgcatgatgtcacgccgcataatatatggggatggccgtatttgtaaatttagtgttttattagtatctcacaaaaccttgccgtttctttatatctgcaggtagtaacaatgttaaagctaaagctcaaagactaacacaatctgctggagggaacatcaacatcttctaattttcatccaaaaaggaggcagcattcataaattcattcttaccttggcaacgaccaaaatatttacataaaataagttttgatctcacatacctgcggtaaacaaaaagttaagcatataaacattcacacatcagcagtatttgtagtagtcacctcagtcctcaaatatcaaacgtagcatgagatgatacctcaccagtcaccaccacagccacaaggctttgacaacagtcctcgatcagatcacggtcataggatttagtgggaaaaaatatttacttggattagtaaaaaaaatgcttacatcatggaaacatgtcgaactgttgggtgtttcctcaaagaggaaaattttgcctcctggctttctttcaaacggagttatttgctcctaagctataaatttctgttccccgatatctaaaaacctaaccattcaatttacaatgcagatatggggaagccttctttcattcaaatatggtttgcattttcccttgcaaaagggaattatgtatatagtctatgaaacctctaagctaaccgcggcagcatcgatggcatcactgttattctgctgtgaccacaattcagcatatcggccaccctttgacagcagaaaatcatgtggtccttgttccactacctccccattctccaaaacaataatctgaaaatacaaattttgaaacaagatttataaaagaatcattgaagtgtcatcaaacaagtattcatcagtatcgagtataatggaaagctctgtagctcaaacatatgaacaaatgataaatcagctataattgagatctagcccatgatggtaactatcgatttcttgaatcgatgcaaaagaaaatctgttgctgttaactgatacattactctgaatccctatttttagttcaataaatcatattactttcacaaaatgaagttgcaggtttttttgttctaatgtatttgcatgaacatgcatacctcatcacattgcattgcagttgtcagtcgatgtgcaataaagatagaggtacggtcaacggacaaagtcttcagagaatttaaaattgacgcttcggtggtgctatcaagagcgcttgtagcttcatcacacaatctggtataaattagataacaaaaaaaataagcaaagggaggaatgcagtaaactcatcttttgcaaaattagtgtttgttaacagtgtgaaataattcagatttagcagggttcactctgaccatttggcacaccatcaccatgacatgttaacttcatacaagggcttgcataggaacaataaaaaacagccacttgctcaattgctaaagcatggtaatgctagtcagacaacgctgaatctaaagctttttaaggctaaaatggaaagagggaattacagaatggaaggttccttcaagaatacacgagcaattgatactcgttgtttctccccaccgcttaactgcaaaggaagtaaaatcacagattttgagacattattgctaggaccaacaggttctgactattctggatttggcatgtcataagacactgcatctcacctttaatcctcgctctcccacaactgtgttgtacttgtcaggaaagttcataattgtatcatgaatagcagcccggcgggcaacgtcataaacctgtacgcaaataaactttagcttgaacaaggtcaaatgaccctactccctccgtcccaaaatataagggatttatggggggagtactataacttcataatgtaaatgtattggtagaacacagtacctcctcatctgttgctgataaccgcccatattgtatattatgcttaattgtgtcattaaaaagtacctgcattggataatgcattaacagtgtgagctactgagctcttggagtgaactgtggtaactcctaactgatatgtgaaaagcatgttgatagagctacttctatttactcaacaactttacatatgctaactaaagttgcacaagggcaccagaatgttccaattgtgtatagtctacatgctttatccatttagcatagtaaattcaataagacaagaaaagtaatgcagcattgacagatttagagcagtagatagctaaccgtatcttgcggtacaacaccaatacacttccggagactatccagtgtcacctctcggatatcttgcccatctattcgaatctgcaaagatcaaacaaaaggcatcacaagaatggcaagcttgatacacatctgaagatatacatgctataaaacggatatcaatttcatcatcagggaatcaaaatggaaatagatcgttctttgttcttacagatcctgaagaggagtcaaaaaatctgaagagaagcctaagtatggttgactttcctgtagaggaatacagttaatgaattgttcgttgatcacataaatttgaattttgctaatattgataaaacaagatatctcattccatacaaccccaaaaaaatcactatagtcagccttgaatcagacataaatagacaaaacgtacaaccatgccagatggttatttgaaatgaccttatcagaccataagcatgtttgtccaaattatagaccaaagagaacacctaacccctaattttttttagttaacccaaaattcagattaaagccttaagagacagcccctgttggatattaaaaaggcaaacatttttctaggaaaataacaattacaatatacacccaaagcttattgttgttcagtataggtaggccaagcaggctttaattagtatttgaaaacatccattgctagaaaacttgatatccttcattaataacttttctctctttgccatggcatggaaaaaaatatggaagtattggcttgtgctactctttaatagaaggggggagcccgggaaacaccaaaaagcccatcctctttttaacaaaacaatttgctgatacgaccatgggagaactcatacacgccttcaacttttgagtcaagttaaacaattggtagatgcaatttgacaaaaaaaaagttttaccgctgccactagttccaacgattgcaacactctttcctgcaggtacagtgaacgtggcacccttaagaatcttcctttctggtacgtacctggaagaaatcagttccttcaggtaaactacaacattaactcagataagtctactttacaagttagactacataatagatagtcataaaatttgcttaattgtacttagtgctttgatagattccataatgatatattgccagtcatttacatcccaatatgcacataaattgttgacccacatatgaggtaattaaaggttgttcaaattcaaatcgtgacagcaacgtagatccctaaggcagcagtatctgatactgttttactcagatgccagatggtaaaaaataacaacatgagaatattttacctatttgaacttgattgagaattgaggcgatggtcaagataaaatttaaatattacaggagagcacaaacaaagagaaccactataacaaattaacttgagcaaaacaaggaaagaaattccatctctacggagataaatgttaggagtgcttcaatatttcactttggtgttcagatgctctgagagacgtgactttttaaggaagtggtacaagcatgtaataagtaaacagaacgcaaaatttacccaaaatgcacgttctcaaattcaatgcgtcctcccttgaactgcaaaggctgtgcatgtggttcatcctttattccaggtttttcctgaacaaagtgaaataacagcaatgaagtttctggggttgtgaaaggatgaaactgaaactgcaagccatttaggcccccaacagatagtcacgaagtttttacctcaagcaattgaaacatagacttcatgtcaatcaggctttgcctagattctcgatagacacttccaaggaagttcagaggcaaagaaagttggaatagaagaccattaaccataacctagatatcaaaatttaatcaaattaataaaaatcagtcaaaaataaagaagaaaagcagaaaactggcaacatctggaactgatggttcatggttcaaaattaactattgttccaaatccacataattagttcataatcaatgatcatttgacacccctcgaagtggcatttgatgatttgccaccgctctgcctttgatacatggaccctggggctacatgtcatagaaacatgagtggcaaataatcaatttgacactctaaaggagtagcatatgatcaaaactttccagttagcccttttcacttaaacaaccttcctgactataaaataaacataatattgcaacaacatgctttgccactgtatgaaatggatatggtgctaaccgaacatgtcaaaacgggataagaaatacttgcatcaaataatatataagcggatgtcataaaaaattaccaaatcaccgacagtcagagcaccactcattacaccgtatgaactcaaaaccatagccgtggataaagccgagctaaatatgatattttgtccaaagttcaggtaggcaaggctactttgggttttcagtgcagcatcctcatactctgaccaaattgtgaaaaagaaatagtaattaatagatcaaattttataaaccaatttacgatatatgccaaagcaacatgtcagctaggattcatcagatttacatagcatataactaagcacttgataaatcaatgtgtacaagctcctaattgtttgtgaagattgaaaaaaaaaatccaagatgcaatatcaaccctactgtttctcatggaaaacattttccacatgtatttcatgcctcaatataagtttttttggtagtttttatagaagatgaaaataacattaaaaccagtgaattaaatgcatagagtatatctttcaaaaaaaagtgtatcgagtaacatatgcatgtctacacgttaacaaggtttcttcccagaatgaacattatatatgtactcactctttaaatatttgtcatacttctcaacttcaaattgttcattgttgaagtacttgacagtctggcccaataaaggaagttagaaaaaaaaaggttaatacaattagaatatgaaagcttaagaacatagactagatgccaggccaattgaaaatcatggtattacctcatagttcagaagggagtcaactgccactgtgctagaagcgttatcagctttattcatggctgtcctgaatttggtccgccactgtcataataatgcattacgagtcaaggcattagtgacaaaaaaacagcaaaaaatcttgttagactatgcatggatgacagacacggtctgatagagcacatcattcacacctgcgtcacagccaaggtgaaagcaatataagtagcaacagaaactgaagtaatccaagcaaaggtggaaccaaatttgtatgcaagtatacttgacaccataccaatctgtaaatggaaagaaaaaaaacagaaggcacacatcagacaaaaatgtaaaatgtgactggcatacattacggaaagttagaaacaccaacattgcgcgtatatgcatagttgatgggatataacagtcaatgacaataatctgagtacctccaatattgtgggaacaacattgaacaccatcactgtaaggatgtaatttatcgcacgactacctcgatcaattatgcgatttagggcaccagtttgccggctgaaaatatagaagccaggtaaaggcatataagagctcagataattttcaactttccagttctaaaactcatgaaatatctgattatttgcttgtttcttataacttgtttccacaccaattttcagaagaatcaaagtgggatataggctataaccaccaaaatagtgcagccctagactaggtttctcatcatctcccatgcgtaaatgctgaaatatatacatgcagtcaagctacctaatttggcaattccttgcaattatttgctacaacttgtaagccacctacattaactgtgatgcttttctatatattgtattgtgcatgtgtgcattaacggaaatatatcatttgataaatttaagataaacaaacatataagatgaataggaggcattttctagaagtaccttagatgataacgaagatcaagctcatgcaagtgcgaaaatacctgcaacagcaagagctcagaaggtaagataacccataatttaaccagtaaggtagtgtttggttgcaaggatgggatgggatgggatgggacgaacccacttttaggggtgtttggtttaggggtgggtgggatgggttggtccctggagaggaatattcctctcagatccgggaccaaccgatccgccaaaaactggcggacaaactcgtcccacctgggacgagcgacggcgtcaccgcgccatccaccaccttcgcgagctccgccgggcgcccacgagcgtcgccgcctcgtccacacccgccgccacctccacacgtctttctccgccgccgccgcctccttgagcgccgccgcctctgcctcgtccgcgaccgccgccgcctccatgagcgccgccgcttgcccgcgaccaccacctccgcgcgtccacgagcgccgcctcgcctccacggccgccgccgccgcctccacgagtgccgccgctcatccgtgaccgccacctccgctagcaccgccgccactccactcagatccagccgccgcctcgcctccgcgcccggcgcctcctccgcttggtccatgactgccgccacctccacgagcaccgtgaccgccatctccacaaactccgccacctctgcctcgtctacgaccgccgccgccaccttcgcaagcgccgccgccggtcctctcagatccgggcgccgccgagtgcctctgcccctagacggcactaacggtgagtacaaatccgtccatcccatcccacctcaatcccttctaccaaacaaaaaactataaccatcccataccataaaccaaacagacaactggaaccatcccatcccacaaaactaggataggtctgacccatcccacttcgtccccaaaccaaacactacctaaaggagcatgtagctttattagcataaacagttccatatgattaaaaatgacagaaaatgataaagaattatcatagtcattacagatgggagtgcacatcgggccagtagcatgatcaacagtcaatgaacagctagatgaggatgcagatgtcaagatagtaatagctattttttaatgattttttctcaagcttttttttccatgaatttaatttttttaatatataaatgttgtggaaagtactgtttacaatactagcaacactacataaataagacaagtacatcaatgcgtagaaagaaataaaacttgagataaacaaaagattcataaatcataatgtgctggaacatctagataatagaggaatttagtagatggttggaaaaacatgacaaatgagtggtaacattggaataaaaaaggaaatttcaatagttaccgtactggagactgaacggatggctctcaatgtcactttagaaaagacagcatttcgcagttctggcaacagaaatcgacgaataaatcagtagaatcagtatatatttcaaagaggggcctggcaatgcatgttgctccaagctcacgaaaggaactcattttttcagggaaagaaacaaccatgcttttttttctaaccaaaaagagtttacctgtacaggctgatactcccgatcgtgcaattccatatccaatcagaacagctgctgggcttgcaaagagagccaatagggtagcattagcctctgtgaatgatgcaagtgaagtttcagcaccagcaagggctgcaagccaatcgacagcaagcttaaacaagaaaggcacttgaacatttataacctggtgttcattataaatgaaaacggtcagataaataagttgaaagttccatgtaaactgtaataacagccaacttctgtggttatcatttcttatatgccctaaatgaaggtgcataattattcctttgatttgacaacagtacttgaaaatagttgtgtatctaacaagcggaacttggcaaaaatattttgaggatatacatccaacagataggccatatctagctactagattgcatcatattatgccaaaatgattccttctataagtaaaaaatgtcactgcagaataagaagtgaatatgtatagaactccagccaggaagattagtattgatctcaatccagcataatggtcaatggtactctatcatgagataagtggcagcttataaggaattgccataatgtgcaccttgttattattcattaatgactaattaataacaaaagaaatatcttaacaacagaattaggctgcaggtttatcttagccacaaaatactctgctcatatgggttaccactttcaggtgtagcattacctttgccccaactaagaggcccaatgacaatataagcctgaagcggaaatccgggctatcattcaacaataagtatttcccaaggtttttcagtatctgtgtatctgctatctgatcatcaacatcctttttggagatatctttcttcactttgtcatcagatgatttcccaactgccacagcattggcagatgtggaaaatgcatgtcctctctgcaaacatggcaagaatcacaaaaaaacaaactcaacaaatgagtcctttcatagtacaaaggaaaacaacagagccaagtaaccaaactcagactcaattttctgtattggatattgattactagagttgaaatcaaccgtgagatacttgaagaacatttaataaagatgaaaacaatgcattttaaataccaaaaaattgcttgacagaatcatcacaagcgtagcaaatattattgcttgtaatcatatatatgaaaaaatgtgagtaagcgtgtttgtactttattttgtgatctgatggattaagtctgaaaaaatcatcagaagcataacaaatatcaacttgaacgcacgaatgtcagcaatgacaaaggaaacaagggtatagtaaatttctgataaatttatccttttgcaaggactgagaataacactgaaacaaaaccaaatgcgcccagcaatgccatccacaatgcttaataatccttttttaagttcctgtatcggtcaaactagtaactaatcacatctactacagtctacagccgactgttttgctaggaaactcgcttgtttgactgaagtattgatacaatacaaaatacataatcaaccactactgcctctaaccatccccaaatcgaaactaaaccaaatgcaataagcacaatgcagtaagccagtaaccacaagttaccacatcgcggggaggcggcgggtaggtggagtccgacatgaagcagctgaggcgaccaaagggggcatacttcccgtcgccgggataaacccaacaattcggcccgaagcctccgagcagagggctcgggagaggcctcggcacggtcggcggccgccggaatatgggggcggcagcggcgaccggcgaggggtcgtagcgtgagcgtgagccgcggaggaggtggcccgcggccagtatgcgggaggtcggcctcatggcgctcgccggcgacgacgatgcagatgattggatggaagccgaagcgtggaagaggcggagttggacttggacactgccccgttaaaaaaacggggctgataacgggtcgggctcggctcgcccgcggttccttggaaaccgcagctcggctgttcggagtgggatcggagcggtggagctcggcggcgccggcgatgtcgccggcggcggccagtggagatggggaaaaggcggctactggtgctacgttttttgttttttgtttttttgtgaagcagcaatttgttcagggatcccggatactccatccacctcacgaaaaacgatttttcctgttatttcaaaaaaaaacagataaaagaaaaacaacctttttttttcaaacaaactcttttcaagtttttcccggtgggaaaacaagttgtttctaaagttaagcaataaggacttgtcttagtttcgtctttagaaatttagagtctagagtaaatgtaatttagggttaaattttaaaaactacatgtataatccttacttcattctatgtcgaataaaaaatcaagggaacatgaattgggcatacttcttttttttttatgtgcgtgggcatgaggcatgcgacgcactaacaagatgaatcatcaaagcacatacctgacacatgataccgatcatcgaatttttgtcaacttacttttgcacataaatagctaaaaaaaatgttataataaagttgtgctaatgggtttttctctctccggtttggggccatgtgccgccgctaagttggcacatcttcatagaaaagcatttgacactgactatacttctacattagaaaaaaaaattagagttggttctaatgttatattagcattggagagggtgtaatgttatattaggattatatggttttatactatgttgttgtgatatattagtatgatataattacaagattataatacacacataaatgttataaatatcggtaaaaaaaggctaatccaactattaaataaccagtacacacaggctagagaacccactaaaacacaacccaataacctaattttcaagaataagtagccaaatgtgtagggtgaccctttcaataaagatgtgtagggtgactggatgagattgcttttggttgtattttcttgtaacaagacctgtatgtgtaggatgagggtgggtttttttcccttctcatgtttccttctttcttgataattttgcaaaatttattttgagtaaatttcacaaaactacaaatattatgatcaaactatcacaaaactacagatttaactcggtgtatcacaaaactacatatttaacattaaattatcacaaactatatatttaaaataaagtgttataaaactacatatttagtaataactaaattatcccagtcaaaaaaaatatagctccaacataacaactatgctaaggatttaaactctaaagctatagtttgtgataactttaatattaattgtttagttttgtgatatttagccttaaatctatagttttgggataaatttagtgctaaatctgtagttatgcgatacaacaccttaaatatatagttttgtgatagtttgatcaaaatatatatagttttgtgaatttttattcacttattattttctacaagaatctgaaaagaagatagaagtcatacttaacgggcccagatattcacgaaaggcccagcgcgggaaaccaatgggctgataagcccatggcaacgtggcccaccgagttgatcagactagatccaacggtgaagaacccagaggcttaatccaacggcagctgctttctaggcggccctccggttatagccggcgagcgctccaccccacccgccgaattttccctccaacctgctaaaaccctagcacccgccgcccccgacggcgccgctcgacgacgagtcgccggcgtcggtcgccgacgagagctagggcaagtgcggcggtacagggtttcagaggaggaggggagcatggcgtcgaacaacggcgcggggaccctcaggtcaacctccatcaacggcgtcaagctctactccatcaccggcaaccgctacgtcgccccatgggtcctctcgaagaagaagcgcgccctccgcaaggacgcaggcatcctaactcgcctcacgctcatctgctctctctattttgggttcttttttcttgtgcaaatgacatgtattttctcatttattgtcgtgttgctgtcctttttttttgggggtctttttagagtatcagcggaggctggatttgatccatgacctgaggttcgagaccgccaccaccaagatcaaggtgacaccggatgagcagtatgtgatcgcctcaggtatgcgagctcgctgaatccaccattttctgcaccggcgttgctttgatcaggttaaactccacagtgcatactcagaaaggcatataactaacatataccctggaataaaaggcagtgcgtcaatataacgtaatggtggttcaggagtcagttcgcataagttgctgaaggaataggtgtccaacaatatctttagtctgtagtgtctttctgcgtccatgtccacacctataattgagctttcatccttgcctcactcagatgagttcgcatagtctagcgaagttaagatgaaagctcatgttctgggtgcgagttggcattggagcatcacacaattatcgtggaatgctgccgtccccctactatgtcattggcttgcgcttcatcgtccccctactatgtccttggcttgtgcttcatttgaagtcagagtcaaaacatttaaaccactaaggcgtttcttggagaagcttgcgtttatgtttgcttattgtgagtccaactttgaataatcccatgccttcagaaacaatccatgtaattcatgctctacaccttttttctttagtttgtaatatcacttgttagtttaatcttcacctttaatgtgtttcagtattgtcactttcatcagattgtttacacctctgtatgtaagtggaattcttctgtctatgatgtcaggtatttaccccccacaagttaaagtctatgaattgaaggagttatcaatgaagtttgagaggcacatgatttcagaaattgtagatttccaggtgggactaggctctagtgaagctcattcctcttttactatggagaagacatttgaattttccacaaatcagaaacttgcattttcattagctgtgtaacaaattagattgttaacttagactgtagtacatctctgttgaatttattttgcttatgagagttttatactttccgctatgagttcatgctttgtcgtgggatgtaatttaaagtatttccacattgatacaaaccattggagattaactgctcaaaattgtctactatgcttgtaggtgccaacctctgtatctttccttttgtatattttctatctaataacacatattgcatctttctgtaggtccttggtgatgattactcaaaacttgcatttttgtgtgctgaccgttctgtatgcctgcatgcaaagtacggtagacactatagcttgagaattccaaggttagtctgtccttatcacctacatcctatttcttatatacttttcatgcactaactacttggccctttggtaaagtgaagcgacatcttcaagaacacataaactgtcagaattaatatttgaaccattaacattctaacttccctcctgcctctcatgctgattaaacccagctcattttaaacgctactcttctgtgctcctactgctgattaggtgcatgttaagtcatcgacttggttgcattgctttagcccacctcctgctgctcatgctgaaaaggccaactatttgggcatttttggccttggcactggctgcataatttccatttcgtcgctgccaaggatgagatatatctcaggtttttttttgagtctttggagtctgatcaggatgaagctttagcaaaactaaaacaacatgatcacatcattttctcttcttttccgtgatttccaaacaaagtagtctagagaagataacagtgagcatggtaataaaatcaataattttcatctggcattgacagtattctgtttaattttctccatcttgcacctccatgtctgcctcttgatttctacatgcaaattcctgcagcaatacatggagtatcacatgtagtatagtagtactaaacagccacctgttgccagatgcagacttagttatatgggctggtctggattagtaccaaattttgccctaccaaagttttggcaacttaaattgtgtcatcttgatgtttggtttggtgccaaattttgccacactagttctaagttctaattagcagtactataccctatcaaatttggtagtgcccaaacctgcctaggttttcgtactaccaattatttggtatggtacatttttggctccaccaatcttactgaaggatatttctcgcatttcattgttctgtcttaattcaatacattttgactgccctattatcaacattcttttagtgtcttatggccagtcagagctatgtaattattgttggttacatgtttagtatgctagaaagtagtaagagctccctgttgcctgtgcaaacatagttgtctatctgctgcataatgattttttcttttagtttctacattttgtatctcttcttatatcatgggtctaaactaagcttctttgagatgatgataactgataacactatagtaatggaatgtttcaatacataacttgccttaattttgcatgttgctgatttccattttgacagaatgggaagagatatggcatatgattgctggtcttgtgatttgctttgcgctgcttcatcaccagatgtgtatagaatcaatttagagcaggtctgttttctttcttcatcattgatatgtattttaaatatctggttaccttagtcttaggaaaaatcatactatactttgtttggcacctgttagtacagaaccaagatagagatgatacttaattaggttgtttgaatgtaagcctaactatagctttatcgcatatcctctgattaatttttctcatcatctatcctgaatctaactaaatattcttcatataccttgtattaagttgctaatagttgcaacattacaatggtgttttcttctcatcatttgctttcagtcttttcagagaatgaatttgatcatttcttaatgtacttaatgcagggacgattccttgcatctctttcatctcaatctccagcaataaatgtggtttctcggaggtagttctttgttattgacttgtatatttttgaaaatgccaagcttatcaagtagttcaattctctctttttatttgttgtactcccagtaacatacatgggctcattgcttgtggtggtgaggatggtgtggttgagtgctttgatatgaggagaaaatcttctgttggcagaattaacacagctgtctctcctgaagattttaatca

SEQ ID NO: 72274 - DNA, 9619 bp, Oryza sativa
gggaaagaattaagcccggctaggattgcctctttccgctgctgctgctttcgtttcggtgtgaggactaagtgcctcttctgtaagtatttacgcttttatttacgtttggaacaacacaagtcttttctgcacactttgtcctcactcgtgcgcaccgggaaagaattaagcccctatttacatttggaactgtatttacttgttattttgtgtaccctggctggtcctggacagggatggccgggcccgcttacatctggcagctttcataggtcatagattgcccggggaagaattaagcccctatttacgtttggaactgtatttacttgttattttatgtaccgtggctggtcctggacagggatggccaggcccgcttacatctggcagctttcataggtcatagattgcccttacagaccaacacaagtcttttctggtcattgcctctttccgctgctgctgctttcgtttcggtgtgaggactaagtgcctattctgtaggtatttacgcttttatttacgtttaggtatttatgcttttatttacgtttggaactgtatattacttgtcatttacttgtcattttgtgtaccctggctgtatattacttgtcattttgtatacccagggatggccgggcccgcttacataggtcatagattgtccttacagaccaacacaagtcttttctgcacactttgtcctcactcgtgcgcaccggggaagaatttcccggtcggtcacccatcccaaattgcttcaggccaagcacgcttaaccctggagttctttggagatcagcttccgaaaaataagttgcaacttgttaacatgagtattctattaatcttattaagccctagggcgggatgtcacatcctcaccccttaagagagatcgacgcccccgtcgatcaaccgtaggctaggaacgtcccctcttggccacgtccgtgtgtccagtgccagcgcatgtgccatgctgtgtgaccactccaggtccacaccagccatgcgcactatgactgtgcaactgcaacacacgcgcccccgaaaccgcgagagtcggctctgataccattttgtaacgtccgcctctcctaggcctgtctgcttacatctggcagctttcataggtcatagactgccctcacagataccattttttaacgtcccatctctcccaggccgggcccgcttacatctggcaactttcataggtcatagacagccctcacagaccaacacaagtcttttctgcacactttgtcctcacctgtgcgcaccggggaagaatttcctagtcggtcagccatcccaaattgctccaggccaagcacgcctaaccctggagttctggagatcggcttctgaaaaagaagttgcaacttattgatatgagtattctattaatcctattaagccctaggccggaatgtgccgccacgtgtgcgccacgtcggcgccacgtcagcgccacgtggtgcgccgcctccttccccggtccgtgcacccggtccaccgcggaccgccacccgagtcactgccatgtggggcccgcatgtcggcgccccctgatgacgtcagccctgggatatattgcgcaataaatcaattaatgattttttgtttatagtaaaaacacagtgaatcttctaaaattcatatctaattcatccgagctccgtttaagcccattcaagtctcagtaaatcatgaaaaatgcatagaatccattaaaaatgcttttgttctctgtttcagtagtctttagcctgtttgtattgtttgctttgtatgtcgcttagattccggctctcctgacgctccggtgtactttgaaatagtcaccgaggttcctccagcagtagagcaaggcaagtcatgcttgtcacttgaacatgttgatcctatattgtaaatgctttatcgttttcctttaaatactgcatcattttataatgttactatgggatgtttacctactgttacagccatgctattgttgtaccatgctcctttgctagcttggggatataacatgactagatattggactagggattgcttaactatgcttagttcaactagcacacaatgggggaaatacattaatgcatagatatcagattctagtaatgatgttggttaatgccactgctccggtgttggttaattaaaatatattaaatggtgggctgtgggtgcatggttttgatggtcgcacccatggcatttaaggaccggttcgcgggatgccctggaagaacttatcgtacttaccacaagccagcgtgggcaacggctgggcttgtagtgtagctttcctctagttgacgcatccaggcaagggtgggcgtgatggagcggggcttgccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgttgtggtggcatgtcgccacacggtaacgtgtcgtggggctgtgtcttgtgggtacagttgtacacctctggtcagagtaaaactattcgaatagccgtgcccgtggttacgggaggtcaaccagattcaccctgattagtctcaccctagcttagtctaatggaattgattagtccaggtggatgggtgggcctgttgcaacgtggtgtagcgttggacagtggatggttaatattaactaattattacaactgttttactgctttcaactaccgtctttaaatgctcgctttatgcaaatgaaccgttctagccatactttgattataccctgcatcataccccctattccggtatgacttgctgagtacggtggttgtactcagtcttgctctatttttacccaaaacccagagtttgagtacgtgtcagatggtggcttctccgaggagtaggcttcgtccgtgccgtcgaggatgcctgtggagtggcgttcccgctgcagttcaagtcaaggcttagctccatttatcttttaattttccgctgcatttatataagacttttctaatgtttgtaagacgtggatctgtatgtcaactttatcgtttgtgtaccccggccggtcctggacgggggttttaatgcacattctgcttggaattctattcgggaaccaatgcgggttcatacctgtcacaccctgaagttctcctcccaagcctaaaattgaatttataaatcaccctaagaaaatgctggtgcaaatcaagagaaaaccttaataaattaatgcaaataataatcggaattggcatgtggaatttttcttgagttctacatgtcgaaatacgctaacaagatttttagtggaattttcagagctctcgaaataattttaaccaattaaaattgagcacatgcaattttaatccgaggaaaaatcctttttccttctttttcctttttctttcttttcttttctttttttctttgaatgggccgccggcccattcctcctttttctccccctcctcccgctgggccggccataggccgaggcccagccaggccgccccgcctccctcctctcccggggtcgccgacaggtggggcccacctgtcgggtcctcccccaacctcccgccgcccgcgccggtcataccctgccgaaaccgccgccaccgcacccactcctccgctttccccgcgcccacgccgcgtcgcccttgcccacaccacgtcgccgccccccctccccgcgtcttccggccgcgcccgcgcacgagaggggcgagattagattttgaatcgcccccaccttctctctctcctctcccacgtcgccggcgaaatcgcggcgcctcccggccacgttcgcctccccctccgcctataaaatgctccccatgccctcctctctcgttttccactctcacagctccatcccgtgccccctaccgagctcgcgccgccgccgcttgcgccgccgcccgccgccgcactccggccgtgtgccaccgccgctagagccgtcgccgcgctaagccaccgccacccctagcttcgcagccacaagacctttctcggccgccgctttgcgtcgccggaatcccaccgaaaccccatctccctcgtgtcgccggtgagttttctctcccctccgactcaggccggcgtggatggtcgccgtgagggtttccctccatcctaattcctcctctctttttccctaggtgtcgccgtcgctcgtccgcacctcggcatcgccggtcttcgccgtctccctcgttttccaccgccggccattgccgcccctccggtgaggtctccctccccttcctttccttcttttttttccccgtgcgccgccgccctcttcgcgcgctcgccgtcacgttcggccgtcgccgctcgcgccgccgcccaccatctgcgccgccgtttgccgtcgccggcggtcgcatgcgcgcgccgccgctttgccatggtcagccggctggcttgatgccgggccaggccggtacaccggcccgtggagccggggccgtggggcccgcttgccagccgtgccctccccttgagccgctgccgagtggggcccacgtgccgccgccccttcccctctctcccgagccactgaccagtgggacctgcatgttggcgccgcccccttgatgacgtcagccctgggaattattgtgcaataaactatttaaggactttttgttatagtaataaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcaatgtttgccttgtatgtcgctagattccggttcttccgacgctccggtgtacttcgaaatagtcaccgaggttcctccagcagcagagcaagacaagtcatgcttgtcacttgatcatgttgatcctatattgcaaatgttctaatgttttctttcaaatactgcatttgttttgcaatatcactatgggatgtttacctattgttacagccatgctattttggtaccctgctcctttgttagctcgagttataacatgaatagacgttggactagcagttgcttagccatgcttagttcaactagcacataatggggaaatctcatttaaaatatagactgtaggttcatatgataatgttggtttagtaccaccgctttggtgttggttaattaaaatgaatcacatggcgggctgtgggtgcatggttttgcttgtcgcacccatagcaattaaggaccggttcgcgggaaaccctggaagaatttatcgtgcttaccacaagccagcgtgggcaacggctgggcttgtagtgtagctttgctctagctgacgcatccaggcaagggtgggcgtgatggagtttggatgggccctgcgacggcctatgcagcttccggattcacctaggcacgagtggggactgcccgtcacccgctggggacgggggtgaaacctgaggtgtggtgtgcttggctagagggggttatgcaaagggtcctgtcacagcctctttccagtatgtcgtggtggcatgtcggcgcacgaaaacgtgtcgtggggctgtgtcttgtgggtacagttgtacacctctgatcagagtaaaactattcgaatagccgtgcccgcgattatgggcgatcaaccagattcaccgtgattagactcaccctggtttagtctaatgaaattggatagtataggtggatggttgggccagtcgcaacgtggtatagcgttggacagtggatgaataatatgattaattataacaactgtttacttctttcaacttctgtttataaatgctcgctttatgcaaatgaaccactctagctctcctttgataattccctgcatcatacccccattccggtatgacttgctgagtacaatgggtagtactcagtcttgctctattttccccaaccccagagtttgagtatgtgtccgatggtggtttcttcgaggagtaggcttcgtccgtgtcgtcgaggatgcctgtggagtggtgttcccgctgcagttcaagtcaaggcttagctcctgttatcttttgttttccgctgcatttttgtaagacttttatgatgtttgtaagacgtggatctgaatgtcaacattgtcgtttgtgtaccccggccggtcctggacggggattttaatgcacattctgcttggaattctattcgggaatttctgggcgtgacaatacccccgggaatagttccacctcggtacaattcagcccttctgtaacaatagaaatccagagatcaccatttctagccaacctcatccttctcgaatccaaagacccagatgtcattcttgggatggattggctgactaagttcaagggtgtcattgattgtgcgaatcgcacggtcaccttgaccaatgagaaagaggaaacagtggtgtacaagtcaccagtcgcactgaagcagggaatctccttaaatcagattgaggtggagaattcggtggtcaccgaggagaagagttggaggaaattggaagatatccccatagtctgcgagtatccagaggtgttccctgaggacctcactactatgccacccaagagagagattgaattccggattgatttggcaccaggaaccgccccaatttacaagaggccgtacagaatggcagccaacgagctagcagaggtcaagaaataggttgatgagtacctgcagaaaaggtacattcgacagagtacttcaccttggggtgctccggtcatttttgtggagaagaagggcacagccgaagagaatgtgcgtcgattatcgcgcactcaatgaggtcaccatcaagaacaaataccctttgccgcggattgatgatctgtttgatcagctgaaaggaaccaaggtgtttttcaaaatagacctgcgatcaggctaccaccagttaaggattcgggaagaggatattcccaagacagccttcaccactcggtatgggttgtatgagtgcacggttatgtcttttggactcaccaatgcacctgcattcttcatgaacctgatgaacaaagtgttcatggaatttctggataagtttgttgtggtatttattgatgaaattctaatctattccaagtcggaagaagagcatcagcaacatcttcgtctggtactcgagaagttgcaggagcaccagctttatgccaagttcagcaaatgcgacttttggttatcagaggtcaaattcttgggtcacgtcattacagctcagggcgtggcagtcgatccatcgaatgtggagtcagttaccaagtggagcccacctaagacagtgtcacagattcggagtttccttggacttgcgggttattatcgtcggttcattgaaaatttctctaggattgccagacttatgactcagttgcttaagaaagatgagaaattcaagtggacagccgaatgtgacaagagttttggggagctcaagaagaaattagtgtctgctccaattctgattctgcctgacccgacgaaagacttccaagtctactgcgacgcgtcccgtcacgggcttggatgtgttctaatacaagagggcagagtggtcacctacgcctcgcggcagttgcgtccacatgaaggaaactatccaacacatgacctggaattggcagcggtggttcacgccttgaaaatctggaggcattacctgattggcaaccgctgtgaagtatatacggatcacaagagtttgaaatatatcttcacccaacctgacatgaatctccgacagcgaagatggttggagttaatcaaagattatgacatgagtattcactaccatccaagcaaagccaatgtggtggcagatgcattgagcaggaagagctactgcaatgctttgtgcaccgaaggcatgtgtaaggaattgcagcaggagcttgaacatctcaacttgggaatcgtagaacacgggtttgtggctgctctagaggcacggcctacgctcgtggatcaagtcagagcaactcaagtaaatgatcctgagatagctgaactgaaaaaagaatatgagggtcggaaaagcccgggatttccttgaggatgaacatggcacaatctggatgggagaaagattgtgcatacctgatgacaaagagctaaaagatctgatactcaccgaggctcaccagactcagtactccattcatccaggcagtaccaagatgtaccaagatatgaaagaaaaattttggtgggccagcatgagaagggaaatagctgaattcgtcgcgctctgcgatgtttgttagcaagttaaagcagaacaccagaggcccgcaggattgttacaacctctttagatcccgaaatggaaatgggaagaaattggaatggatttcataacaggtctgcccaggacatcatcgggccacgattcaatctgggtagtcgtggatcgacttaccaaagttgctcatttcattccagtgcatactacttatataggcaaaaggttggcagagctctatctctcaagaatcatgtgtttgcatggagtacccaaaaagatagtatctgatcgagggagccaattcacttcaaagttctggcagaaattgcaagaggaattgggaacccgtctgaacttcagcacagcctaccatccgcagaccgatggtcagaccgagcgggtcaatcaaatattggaggatatgttaagggcttgtgcgcttgattttggtggagcatgggacaaaagattgccgtatgtggagttctcctacaacaacagttaccaggctagtctgcaaatggcaccgttcgaagcgttgtatggccagaagtgccgcacacctctcttttgggatcaaaccagcgaacgtcaactgttcggaacagaagtgctaactgaagcagaggagaaagtcagaaccgtcagagagatgctgagaattgcacagtctcgatagaaaagctacgtagacaaccgccgaagagagctcacttttgaagcaggggattatgtgtacctctgcgtcactccgctccggggagtacaccgcttccagacgaaaggcaagttggcaccacgcttcgtgggaccatacaaaatcttggaacgaagaggagaagttgcatatcagctagaacttccatccaacatgatcggtatccatgacgtgttccacatgtcccagttaaagaagtgtttgagggtacccgaagaacaagccgattcagaacacattgacattcaagaagatctgacttatgtggaaaaaccagttcgcattcttgagaccagtgaaaggaggactagaaacaaggtcaccaggttctgcagggaccagtggagccaccactcagaagaagaagcaacctgggaaaggaaagatgagttgaaggccgcccatccatacctcttcgccagctcttccgaatctcggggtcgagattccgtttaaggggggtaggtttgtcacaccctaaag

SEQ ID NO: 72275 - DNA, 3831 bp, Oryza sativa
attaaattgttaaaaattgtaactaacatatgtaaatcccacatgcatgatttaaaacttttaaaaattctaataatcgtatataattagcatattcatgatattaaattgttaaaaattgtaactaacatatgtaatcccacatgcatgatttaaaacttttaaaaattctaataatcgtatgtaattagtatatgcatgatattaaattgttaaaaattgtaattaatcatatctaactagcatattcaatacattcaaaatagtttacaacaattacggcaatagatcggcggtgacggttgtccgcacgtactttctcctcactattgttccttccttgtaatcgctacgtgagtaaagggtgtcttcgtttgataggaggatgctagggtcaaccatcaccgtgaaagggggttgcctatcaaactgatcgtaatcctcgtcagtcttgtcctctactccgacagtttttcttttgcctgggagaaccacgtggcacttcggctcgtcaggccctttgcccttctttcctttgctagacatgtccttcacgtaaaaaacttgtgttacatcattggcaaggacaaaaggttcgtccgagtatccaaccttgttaaggtcaaccgttgtcatcccactgtcatcaatcgttacgcctccaccagtcaacctaatccattggcaccggaacagagggaccttgagaggtccatagtcaagttcccatatctcctcgatggcaccgtaatacgtgccagttgtaccatcgtgtcccatggcatcgatacgaacaacattgttctggttcgtgctcttcatgttttgggctcttgtgtagaatgtgtacccattgatctcatatccctggaatgtcgcggtcgagccagatggacccctcgccaggaaggccagttgctagttaatcgtctcgttacccatgagatgttgtcgcacccatgtggggaaaatataaatgtgatgccgtgtaatccatgcatcggacttaccgatgtttctggcgcgaactagagccaagtgctcctcgatgtaaggagccaccaatgaagattgttgtaaaaccgtgaaatgggctttacggaataaattgttatctaccatcattattgctttccttccgagagtcccctttccccgtagtctcccttcatggcgtgattcaagtaccccgattgggcgaaggtcttcaataaattctacgcagaattcaatgacctcctctgttccataccccttggcgatgcttgcctctggacgagcacggtttcgaacatacttcttcagaatgcccatgtacctctcgaaagaaaacatgttgtataggaacacaggcccgagaataccaatctctttcactaggtgacaaagtagatgcgtcattatattgaaaaatgaaggtggaaatatcaactcaaaactgacaagacattgcaccacatcattctgaagggcttctaacctatccggatcgatgaccttctgcgaaattgcgttcatgaaagaacatagctttgttattgttgcccggacattgtctgggaggataccccttattataactggtagcagctgtgtcatcaacacgtgacagtcatgagactttaggtttgtgaacttcttctccttcgtgcttattattcgctttatattcatggagtatccagacggtaccttgatgctctccaagcattgaaacatactttccttctctgccttgctaagagtgtagctggctggactcaagtaatggctgcctttctcctgtggttccgggtgaaggtcaccgcgttgttccatatgcttcagatcattacgtgcttccagtgtatctttcgactttccatatacacctaggaagccaagaaggtttacgcaaagattcttagtgaggtgcatcacgtcgattgcatcgcggacgtccaagaattcccaatagggtaacttccaaaatatggagtttttttccacatcgccgcgtgaccatcttcgctctctataggctagctgccaggcccctttccaaacactactttaagatctttaaccatagcaaacactatttttccgctgcgatgtttaggcttcgtacggttgtccgccgtatgttcaaagtgcttgcctttcttccgtaccgagtggtttgctgcaaggaatcgacgatgacccatgtacacaaccttcctacagtgcttaagatacgtactttctgtttcatccatacagtgagtgcaagccttgtaccccttgttggactgcctggataagttgctaagtgcaggccaatcgttgatggttacgaacagtagcgctcgtaggttaaactcctcctgtttgtcctcgtcccacacggggacaccttccttcttccacaacagtttaagatcttcgaccagtggtcttaagaacacatcgatgtcgttaccaggttgcttggggccttgaataataatcggcattattatgtacttcctcttcatgcatagtcaaaggggaggttgtagatacacatcgtaacgggccaagtgctatgaccgctgctcatctctccaaaaggattcatgccatccgtacttaaaccaaaccgtatgtttcgtgcgtcatttccaaagtctttaaattttctgtcgatgtttcgccactgcgaaccatctgcggggtgtctcagcatcccgtcctgttgacgttcttcagcgtgccaacgcatcattctagcattccccttgttcctgaacaaacgtcttagccgtggtattatagggaaataccacatcaccttagcaggaattctcttcttcgttagctgcccgtcaacctcacctggatcatctcgtctaatcttgtatcatagtgctttacaaacagggcatgcttctaggttctcgtactcctcaccgtgatataggatacaatcatttggacatgcgtgaatcttctgaacttccagtcctagagggcagactatcttcttagcctcgtacgttgtctcgggcaatttgtttccctccggaagaatgttcttgacgagtttcaataaatcgccaaatgccttgtcactaacaccattttttgccttcctttgcaagaactccagagtggtatccaactttttgtgcccctgctcgcaacctgggtacaacgacgttctgtggtcctctaacatcttgtccaatttatgggcccccttttcactttcgcagtcctccttggcatcctgcaacatctgaccaagatcatccgcaacgtcgttataatcagcatctatgtcctcctcgcccgtttgatttccttcaaatccagcgtactgagcaaagtctggaatattgtcgtcttccacttcatcttcttccatttcaaccccttgctctccgtgggatgtccaacaattatagcttggcatgaaccccgactcaaacaagtggaaatgaatagtcctggatgcagaatactccttctgattcttacacttattacatggacaacaaataaaacccttctgcttgttagcttcggccactctcaaaaaataatgcacaccatcaataaactctttggaccgccggtcagcgtacatccattgccgatccatctacatgaaatgaaaaaaaaatcgtacacaaataatcattcgtataataatgacagtcatacaataatgataaaataatcacaaactctttcaacagtcatacaataatgacatatcattattcatacaaaaattataaaatattccaccgaataattcttatttattattttttaaagtttaaattcttttaattctcaatttagtttgttttcttttattta

SEQ ID NO: 72276 - DNA, 2886 bp, Oryza sativa
gtcgggatcgaaagtgtgcttatgatcaatattgccagttcgtatttcagtttgccccctagccgaatttacaacatttgaactctgtgcgtgtttgaaaatatacatagtactatttgattgacattttgaagatggaactactagtggaacgactattaattcggctataatcgctactagtatatgaagccgaattatttccactagatattatgtagtgcgacccataagactgagatataacatgtgactgaccgatacttggcatggcatgcaatgatctaatagaatcaactgaattataaataccgccatagccatacatatctttcatcggcaaattttgttgtgtagtaataggttccgaaataatcgccgatgaattaaaaggtgcgcctacatattgtttattgctaccattattaaaatttaaagcatgtgaattattttgcataggctgtgacttgttattctcataatttaaagatcttgaacattgatttaaagcatatctagcaacattgacatgagtgttgatggcacttgaagaattattttgtggaacgagcaatgtgtctgtagagtgtacctcacaactggcatagcaaggtgaccacgtagcactccagtacgcatccatgtatttttctggtgcaatcaatgatgagggaatgttaggtcccgatctttcgataggtactgataaacagtcgatttgggcggagtcaccacacaactcgatccggcttctgaacgaacacgctactgagcctcccaatcgcagcaccacgtctcctctggttatcaaccgtgccgaaacccgattgacctcgccgagatggctaatccttgcatgcgaatcgaagaacacaagcaagaacaagatagattgcaaccaaattgcatatgaatgattaagcacacgaatttggggttacacaaaccgatctatcggcgaaactgttcctgacagattaatttaagcaaaacctgactctaaacgatgacggctactaaataaaaaagattagggacgtcctacggttgccctagggcgtagacccccttgggctaagcctacgacacaattacaaggccgaaaacccaaatcagattcggactggatgagatacgtggcttgttttgcagatttctggcagctcggtaggaattttgacatgggaccaaaaccatatgaaagtagactccataatctttctaacaagtactcatgggcccaaaaattacttctagatcagcggctaggtccattttaagttgatgctctcaggagggccgaatccgaatccaaaacatgtataattttatctcgtcttctatgggccaaaagtgacatgatgaggtagaagtagacttggagaaggttttggtttggtccccaatcaacttctttaatcatccatgcattagttacgctcggtctcttttcctttgcctaagcaagtacgtctgcaaacgaaaacacacaaaactcattgtgtagcaacgtttgttcaaataaatatataacaagtaaatctaatgtagaacatatgaacatttatttaattaatacataaggtagttatttatggttatatccgagctagttatgttcttatcatcctccctttcttgattggaaaccgtcctcggtttcaccttgtcatggagtgtattgtacttatctttgtctatcacaacatcctgtgcggaacatttcttgatggacatatgattggatcctaaaatctttgtagtcgaaaacctcaacactcctcttgcaaaccaacttgtaactcatttaaacaactagaggaactagatagagaattacttatatgcatgcggtcctctagacaatacatttcatcatgaaaaggaggtatagtcaaattcgaacaaatatatactcgatgcacattatattctcctttactttcataattgccaataatatgaaaaatcacatcagaagggcatggcaattcaaatctagcaaataatttcttctttaagcagttgagtggacaaatatcatcaaattgaatataaccccaagtatttaaagaagatagcaatttaatttcttcattctcgctagcaatgtgaataacatgtttaaactcaacacttggtggctctactatagaactagcatgttcattcactagttgtggcatggatataagtgaagcatcgcacaactcttctttgtcacgagaaacatcaagcaaattgttttgtgacaaaggtatttcagcaattgtttccaccatgggttgctctaatgtagcgtaagtagtagacatagttggcacctcataaatatgcataccttgagtagctgtagcaccgttatcattaccttttttctcatctgcagaaattataggcgcttgttcaattgaacattcttcaaacatgcatggagctatagataggactttttcctcttcgtctttcttctctttgtcattattaccttggttattctcagatgcctgtaaaatattagtatccaaaacaataggcacaacattacgttcgttttgtaataactcagacttagttgaaggcatcacaatagtatctttcctggtatctctgaaaatcacatcgattctatttttcgtcctttcaatactatctttgaaaatttccttgattccattcttcatcctttcaagattatcttcgaaaatttcagtaaaactcatgggtaccaatttcatttttcgaccattttgtctaaatgtgtatgtattagcaacaaaattatgcgaaccattattatcatatagccatggttgaccaaacaacaaagaacattcttgcatagggacaagatcaaaattggcagtatcatggtaatttccaatc

SEQ ID NO: 72277 - DNA, 782 bp, Oryza sativa
cacttagtcctcacaccgaaacgaaagcagcagcagcggaaagaggcaatcctagcggggcttaattcttccccggtgcgcacgagtgaggacaaagtgtgcagaaaagacttgtgttgttccaaacgtaaataaaagcgtaaatacttacagaagaggcacttagtcctcacaccgaaacgaaagcagcagcagcggaaagaggcaatcctagcggggcttaattcttccccggtgcgcacgagtgaccatgaaagctgccagatgtaagtgtaagggcagtctatgacctatgaaagctgccagatgtaagcgggcccggccatccctgtctaggaccagccagggtacataaaatgacaagtaatatacagttccaaacataaataaaagcgtaaatacttacagaagaggcacttagacctcacaccgaaacgaaagcagcagcagcggaaagaggcaatcctagcggggcttcagctccactccacaggcaaaacccaattggggtctgagccttggtcttctaacttggtcttctaacttcgtcttcagctcagaagcactatacttctgaaaagggggaaataacagcaaggctgagtacaaccaccgtactcagcaagccacaccaatgatgcagacgtgcaaggggaacacaaggacggtttgtggctatttgcataaaggcggttgtaaaacattttattgagccaaaaagcaaaattgttgagtaattaaagtaacattaaacctccactgatcaacgctacaccactttg

SEQ ID NO: 72278 - DNA, 2233 bp, Oryza sativa
aatcagaacagtgcagtgcagtcacaccactagtttcaagcaatcgttcgtataagtgattgattttggcaagtcgctagagatcgaagcctacacatcgatcagtccgggcatgataaccgcgtcaccgtagtccaccaccggtcgccggagcaggaagctccggtaatccccgacggcgatcgcgttgatcagccctcccttcacctccactgcacacacacacagacacacacaatccacaacaagaagaatccgtcagcgacatggactcgctcactctgaaaacccaaagcattcaactgctctatcatcatcagagtaataatcaatcagtccacttgtcgtcgatcgaggtcatcacctgcggcggggccgacccgtccgagcgtgacgacgcgctcgctggcgatccagaagtggtcgtgggggagaaggctgcacccctcaccgcccaggctctgcaaagacaaagggattctcctcagctttctcgtacgagagaagagatcgcagattcgaataccgggggaaagggaatctcccggagaccttggaaaagggcgcgcggtagaggagcgccgccgcgagcgccgccgccaccgccagcagcggcaggaccctgcccttcgccgccgccatcgccatcgtcgtcctcctcctcctcctcctcgcgctcgtgacgagacctcctgtccttttctgcgtctgcttccttccttcctcgcgtgcgcgtgggctgcgcctccactggctctgggctgacgtggattcgggtatctgagtcgggtgggagtggatctgtacacctggtccagtggactggtgggtacgaggattcctgtggggcccacctgtctgtggcgtggtctagtggaccgcgacctggatgatccgattctggttttgttgcgttgtgtgagggcatccaagtggctggaacctttggagggatctcttgccttttagtctttcttttcgtttttttataagaaaatcgagattcttttttatttttttattaataaattagagaatctcgtgtgttgttttaaggaattagagaatctcgttgtagcggtgagggggtgggtgtgacgcggccgcggagatggacggcgtggattgcctgctcggggtttgaaacgtcactggataggaactgaaattaagatttaaataaaacaaatcaaattattcaattattagagcaagtttataatagtatagctcactactggctccaattcatctatagccgatctaatagacaatttatacaatagttgcttactatactattaatatatggtctcacatgtcatacacacattacatcttggaatccgtgctgcagctggctatagatctgtagcccgttgctcatctctttcatcttttatcttattaaaatatgtttacagctggcttatagcctgctattgtacctgctcttatagcggcctgcgctataggtggaaaattctacgtggggtaggacataaaattctttccagctgtataagaggaaaccagcggctaatttgacaagtagtcaacatttggtactccctccttccctaaatgtttgacaccgttgactttttaaaacatgtttgaccgttcgttttattcaaaaacttttgtgatatgtgtaaaactatatgtatatataaaagtatatttaacaataaatcaaatgatagaaaaagatttaacaattacttaaattttttgaataagacgaacggtcaaacattttttaaaaagccaacagcgtcaaacattttgggatggaggtagtatttgttagtggcttatcatacattttctttttataatttggtgggataccgttttattttgtaatttactctcatctttatatagcgcatacagacgtgtgtacatagagctgaaaatcattttatatttccatgcctccagtaaactccagctttgaatattgtgatgggactgtagtattatggtgcttatccgagtctcgtatgtactatctccatcacaaaatatgttgattttttatataacgttcgattatttgttttattcaaaattttagtaataactcctcggttgattaaaaattacaacaaaataaatgatatgcatataacatttttcaactaagatatatgatcaaacattatgcgaagagtcaatgatgtcatatatttcaaaacggagagagtagcaatttattattagtatc

SEQ ID NO: 72279 - DNA, 1215 bp, Oryza sativa
tttttttttgctctataccgctcatatattcagcactttatttctttttctatttttaactcaaaatgttggtaggcacatatatatttttctactagtttttgaagggttgtttcatatctttcaacaacattgcagctcaggtcatctcatagttgtaatatccatattcgtttgatagactaatttgcagtcttatttgcatgggcccaaatgatctgttcattttttgtaatgtagatgtcaatgaatgtgagcaaaatcaaagcccatgcccaaaaggtgcaacttgtcgcaatacagaaggatggtaccattgttcttgccctgtgggaagaaagttggcaaaggaaacaaacacttgcaacccagacatcagcctgatcataggtaaagacctaaaagttaggagcctgatttacccttcttaaaactagataagctgcaaccctacacccaactctattctattacaggaagctataatgcataagtttagctgtcagaatttcagcattatgtaaagggccccttatttaacatgtacatattttccatttgcacagtatcatagaattgacaaataaatcggtgaatgaatagagctggaaagcatatagcagcatgggcatgtgactggtgtaaggatcatctacatcgaaagaatgacgtcttcctctacttgatccttagtcataaaatatccctcaatttttatgatcgtcttagcttttgtttatattcgtgtcctctcctttttaggaataatttagaaaaatatgagaaactatcaaaccaatataatcgacaaaagaaattaaattaaatccaaagaagacataagtgattataggtagaatcattatgttgtagtatactaacatcacctttcagtccaccacagtgagtcagtttgacatgcttttattgtattacatgcaaatacatgatgataatgtaacaagcctttttatactctttgaagcaggtgtcagcattggctccattgttctagtgattatcattttcttcgtgcgtataatttttgagagaagaaagcttacagatgtcaagaaaaaatacatccaggaacatggagggctgctattatttgagaagatgaaatcagaccagggacttgcatttaaggtgttcactcaagcagaactagagcaagcaacaaacaagtttgagaaaagccagattcttggagga

SEQ ID NO: 72280 - DNA, 2800 bp, Oryza sativa
gtagctcttgtttattgaggcataaggttttataatctgtaatgactgtctttctttacaatcagatgggggggacaaggacaatatgaaaaaaaaaagaagtcagcccttaaaaaaacttaatttattcctttttatttattgtttttatcacttgtaaagttcaatcaattaattcttgtgatattatttgcatccttagtgactttttttactttctgtttcctgttataaatgtgcctaatcaattaagttaatttgccaaccaccttaattatgacaattacttttggacagtagtgtcattttgtaccacctaccttaattcttgtactgaatccaaatggacttatatttgaaattgaagggattttgtttgggcatcgaagttttccacccgtttctttaaaatccttcatattatgtttacattctattctgtggataattgtttaccacttggtctttcttcaagcttgtcagcgagtttttccgtagcaacgaggaagctcaagctcaaattgttccccacagggtacagttcttaacccatgactattattatttaccacaattatgtattccgatataacatacctatgatgactttgctcctgaattgactcattgtattttaaggtgaatttttctgtatatatataatcaagagaaatattcttttacacagtcatgtttaattaatgtgataaaattttgatcaagtttgcgaaatttatgccaatccactagtatccatgctagctaaatccgcatgatcacctaatgatgttgtttttgtgcgatgatgttacatttttgcctaggtctaacaagtgtcctagtgtgttctgctctgctgtccatggaacatatggctaaacgcagggtccgggatcttttattataactatatcacattagagaacatgcacagacaggagaacaataacttgcttctactataattttcaactactctaccccaatgtgtccctaaaagattaaccaatgcagcatctataaatgcaccagataaaatcttcccaaaatgtgactagtttcatagagcctgaattcctggcactaagattgatttttcttgaataaataaacaatatatggaagtacttcaatgactcctctagtgtaggatctgaaaggaaaatagagtggtcaaccaaagataattttttagtgaagtgttctactgatcaggttgtgctattaggctgtgagatgcaacggccaggatgttatcccatttgactaaaaggcaccgaaattatccttttcacctgcataataactcttaccataaacaacagatcaggcaagtataatttaaaaaatttcgtgcacttgatatgagaattaccatacaagttgatcgaggtacacaaataaatagggtgtttggtttgtggatccggttgccgctagcaccatactacattagtaacataaattttaaaaatttatgtccgatgttcaattccttttcgactttcttttaactggatgtttccttttgacttcagttacaggatgaaattggggcagatatccagaagatccaattgcagaacgaggagatgtctggtcatgtaagtttacttagacatgtatttagacacctgcggcagaccagatttaactacgcagctaactaccggaatcgttttttttttttgcaagacatttattttctcattagttccttattttccagtgatgccacagctgaacgaggaagaaaaatacaatatatgtgttgccgatagaggagaaatctgggtttctttggacaaacttgtatatattgccgctagaggaggaaatgaataagataaacttgtttaaatgtttctgtaactgtaccaaacatacatcgatgtgacggaagttttcaaatatatgtaaattattattatttatatactagggtgaatttgtgagccgtgtataccatgtgcgcacgatcgagttggatttacatatatgcgcgtgcacgcagccagctaaccacgggccacggcattgtcgcatttaatttcctctcaggcagcagcggcaaaccggtagaccaaacaaacaagggggttaattaaatccgtaccactatgaatttataggttttaaaatataccattataatttataaaattaaaactatgtcattataacttaacattattttaatatgtcaccacttactcattcactacatttttctaatattttaaaccaaattggccttgtttttttcatccatcctcttctttcttcgcctctccttttcacctctcaccgatgagttcatgtagccgtccacggcacaggaaggttgtagtaggacaccccgatgagctcgtgcagcaggtggccatggtgtaggaagagctcgtgagtatagttatgtggagcaaaatatcttcatcgttttgagtgtgttataggttgtattcgtggatagcgctcgaagagtttgtgagtatagttatgtggactataatatcaacattggttttagagcatcggaagttcacattcttgtttctatagcaccgaaagatatcagttcactttagtagcaatgaaagttatctcagttccccattttagcactatcgttagtttttctgccatttgccgtcaaaattttcctctctaatcggttgcgccatggtagcatcgtcctgccatcctgccgctagcggaagaagggatggcacaacgcgtgtgctcctacgctgctggccctatcgccttggatcgtcgctcactcttgctggaccatttg

SEQ ID NO: 72281 - DNA, 1477 bp, Oryza sativa
actgccattatttttgatacactttgccaaatcaaacagatttcaaataaaacatttattgctaatcaatatgttatccaccaaaataatagctcgagatataattcttaatcatacatgatcctaaatcaaataaaattcaaagaaaatatccctctgatctgtgcaatcccacctccaacaccactaaagtactataagaatcaccccccagagcacaagcctgtaccacaatacctttgttcttcctaaaaattcttctacacacaataattccatcatcagcacaaatggatgaacaaggagaaaaaaggtaatctctcccctatgatatgaatagaagtgttacttcctacatctacatatttgccatacttaagtttcttgtttcacatgcttacagtagtctttccattctctacatatttgtacatattcaaatgttgttattcttctttaggaactgtaacccacaatctagtcacaccacctacctgcaagcaatttccgtcgttactgcatccaaatcgtcaactgtttatgtttctatccaagggaaatcagccgctgacgacctatcctatttcaagtcaactcaaactcacactgtttcctacatgaagaataaaattcctcacatagatgtcttcctcacagaacaagacttcaaaaataatgagatttagtgcttctgacattgcgtgttagttatttctaccatacattactattacctcactacaatttgctgcaatctaatgaagataatttacttatatatatgcatacgttcttctcaacttatgaaatccaatcctcaggttaatggttctaggctaagaattgcttgatctatcctgtaacgctaacaaataatactcactgcaagttttatgatatgcccgcagcaacgcgcggggtatcaactagttcactcaaatcctaccaccacaattaccatcaaactcgatccgacgggcgcaatgccaccaccatcaaagaatttccaatgcaacggcttcaagaagattatgacatcttgaatatcacaattgctattcgagacatatagactacaaggttttcattcggaagattccaccgcttagcacaaatgtaagaagagcgtcgtgtcatcaccttcaggaagttatgttgtgggcacaaacatcatcgagagagttgttattcttgaatatctgatttttctctagagattgggcagctgacaactcaacgtagtgtttcttattgttagctaagaaaaacttctttgttttcaattttctcaaatgtgtgctcgtggtgtgagctttggtcagatctagttaatcaatatttgtagagtaaatttcacatatgatacaagttgcagaaaagcacaaacattttaacaattggcactcaagtacatatattttggtagtgtaatttgacaaaaccacactatcaatgaatggattcacctgtgagatga

SEQ ID NO: 72282 - DNA, 1576 bp, Oryza sativa
cgccccgctccgacacgccagtcgcccgcttcggtcgccggccgcccgtcccactcaaccggccgaagagagaggatagagaggaggggagagtagtgaggccctgataggctgtcaatgtcatcgtccacgtggcatgctatgtaggtaagaccacagtcaaatgaggctttggaccgggatgatacattaaaccaagtttagagatctcgatgctcgttttgcaagtttgtggatttaagtaaaaccttgttacaagtttaagtactactagtgtaatttactcttgatttttcaaggtaaaattctctcctcgttgatcaatcaatccatccatcttcaggagtagattcagatcagattttgagtgagaacccagatcccagattatactacttagtatcattttatttgattgtatgatatgttattgttttaagccaatttcattgacacaagaactaaaacggctggcaatactggggcaaagcaaacctagcaagacagcaataacactggtatgccgtttgcccacccgactagccgaaccgagcaatagctcaggctaaccagcaaataaagcatttctaacatcacgcgtttattattccagttcatctacataaacagctgataaagtaactgaattacacttccacgtaaactagattacaggagtatctgaataatataaaaaatacaatcactatacgctgtccacatgaagtacaatgtagcacaatcgaatggagagtggtatataacaatggaagagccgggctaaattatacacacagggacattgccatttgcagttttgccgcaaatcaaaatgtgtagcgcatacgatcatatacactacaaatcaacaactgtaagcactggatccacctgaaagacaagaacaggagcaatatgtattaacataaatattttcgatacttgtgtgcagtgagctaaacagaagcatctcactactacacctgaattttatttggcgaggattggagcaccacatgcagcctttgcatgtttgtcttcagcgaacacaagattcccacccacaaaggtggacagtatcttccctgaaagctgctttcccaaatatgccgaaatattctgcaaaaatgtgaaataaactttacacatagaatccagacttcacatataaaatgtgatcttcaatttgtagcattttctagctgattgttgaggaagaggtcaaaagttccacatggtccgacattttatatggaaacaagtggaattctaacgggttcgagttagaaagcaaacccgatgcttatggtagacaggatggctgtcatcaagatggaattgagcctcaggtttccataccacaatatcagcacggtatcccggcagaacagcaccctacaaattgagtttaatttctttttagcaatatcagcatgtactgtatcgagtgagacaacagatgatgatataaacaaagatgaaaacattaatcataaccattagctggttttaagttacacaagtgtcatccagtaagaacagtagtatggcacaatgatgccatgcattttgctaa

SEQ ID NO: 72283 - DNA, 31408 bp, Oryza sativa
  unsure (1)..(31408): unsure at all n locations
aactacactaacaaaacatatgtacttaagcgtcaagtgtcaaagtgtgtggttttctgtaacttggaccacagaacgtgtaattttgtgaaatttactcatatctgtttacttttctcaacgaggagattggtagctccacggataatatgcttttttttttaattttgttgtaaaagtcacaaatgatataaatttagaagttttactcccaagttatttttgattgcttcattcctacctctcaaatcaaccgatcagcgcgtgagaccttgtgtactgagtttcaaaagttcacaagctggatgatcaaattttattcgtaaagttgactgcaatagttttgtatagatcttaactaaaattctttcagatcaatgtgattcacgcagtattattttggcccatacctaatccgtaaaattaacggcagggattgtccgtggtttacagtcggaagaactgatatgtggacgtaggctatgcacgtctcgaatttcaaccattcagtgggagctagcatatcattttggtagactttaaaatcccctccggtgaattaggcttgggaaaagtccaccacctcaatccctaaccaagatcgccagatcggccaccgccgcccgcgactcccccgcccatcgccatgtccgactccaaccccggcgcggcgaaccctgccctggggccggacgccgacgcggcggccggcgagggccttgagctggcgcagttcgcggcggggtgcttctggagcgtggagctgacgtaccagcgtctcccgggcgtggcgcgcacggaggtgggctactcgcagggccaccgccacgagccgacctaccgcgacgtctgcggcggcggcacggggcacgccgaggtggtgcgcgtgcactacgaccccaaggcctgcccctacgaggtcctcctcgacgtcttctgggccaagcacaaccccaccacgctcaacagacaggtgcgttcgcgtcgttcgctcgtagtagggggattagggagccattcctcctgcgccggcggcgccgccgcacgcgtgtgccggcgggcggtgccgatgcggcggcgacttcttcgctggcgtcgcaggaggttcagtgaacctggctcggtttttgtttagtgttgactttgctctgccgcggaagttgtggtctctcactgggagtattttggaccgttaaacagatcagaaaatatgcggttttaaacacacctacgtggccatcatccgtgattagttgcgttgagatttttcacgccattcttggtgcagtacggtactcccagaacccagcaacggttgatggaagagaaagataaactcaactcgctaagatttatttttgtgaagaaactagcgggctcctttcaaaaaaagaaagaaagaaagaaactagtgcgcaattgtgtgaaatagatgcgatcaaactactggcattgtgaaatgagaatcacatttgatatgattgtggaaagtaattttgacatgaagctagtattggccttactatccaaaaactgcaatccggtggtaattctacccaataccactataccagtaggaaagaacatttaacttcatgccagattatgtaactgagaagtgagtcagtgaagactgatatattgagccgatcgagttcatcagctagctgtgcagcctgtgctgctatcagttttccacgagactaataactaagcatatcgtcctggtttttacccctgctaattaaccccggcgaacttatgcacgcgcaatgtatggcagggcaacgacgtcgggacgcagtaccggtcgggcatctactactacacggcggagcaggagaaggcggcgcgggattcgctggcggagaagcagaaggagtggaaggagaggatcgtgacggagatcctcccggcgacgaggttctaccccgccgaggagtaccaccagcgctacctcgagaagggcggccagtccgccaagaagagctgcaacgaccccatccgttgctacggctgacgccgccgccgccgacgccgccccgagcggcactcgccggaccgtgcgctcgatttgccggcgttccattgcacatttgcaggtgtgcatgtttactgtagtaataactaccggtatcgtaaactcgtcaaaggaacctgcaaattctaagtcgcggtgtacgcgattgtgccattgaaagtttgaaactgtgggagtatatatatctgtgttacaataaacgcactgcttgtcaaggtgcagtatagttatgctgtatttgcttcattacctgatcatcgacgcacgcgttatttccttttgtgggattaactaatgatgtacattttcagctggttgttgagtcagttagcagccataaaatagggccatttgaatcacaggatttatttagaaatttcatagaattcaaattctatagaaaatttttctatttggccctttgattcaaaggattgaagctttccaaatcctatgaaattcctatggaatggcacattgcatgtggattttgaaggaaatttagtaagagctctaaactcttggaaaattttctttgaatctatctctctcatctgattcctgcgtttttccgtgttttgcgatcatctgttttacacttcaatttctgtcagaatcatgtgtttttcctattcctttattttttctaccatgcaattcaaaggggcccgtcagccgaattgaggtggcgatggaccagaggcagactgtagttggcaaacattttttcagccacgtgtgctggtgaaaaggtgaacgttcgtagaacgatttgtcgcgcgacgaccagtggccacgttcgtcgaggtatcaaactgtactgatctcgaatttaatagccaaacttgactggcaaatctccaaatctcgcgcggcgctcctctccagtccacggtccagtcgctctcgctccccggaaccaggcgagcgatggccggcggcgacctgcgcagcctcgtcgccgtgtgcgccgcggtgaccgcggccatgtggtgcgcccgcttcgccgcgcgccgcctccgccccggcctgccccgcctcgccgcgttcgtcccggtgctcgccgtcctcccgttcctcccgctcgccttccgcgcgctccacccgcgcgccatctcagggttcttcctcgcctggctcgcggagttcaagctgctgctcctcgcctcggggcagggcccgctcgacccgtccctcccgctccccgccttcgtcgccatcgccaccttccccgtcaggcagcgtgatcccaccaagaacgccccgggatcccgccttggccccgtgacctccggcgtgatggcccgcctgctagcggccatcgtgtcgctgtaccggtacaaggagcggatgaacccgtacgccctgctcgtcctctactcgctgcacgtgtacctcgcgctggagctcgtcctggcgtgcgcggcggcggcggtgcgcgcggtgatggggatggatctggagccgcagttcgacaggccctacctgtcagcgcacctgcgggacttctggggacggaggtggaacctctcggtgccggcggtgctccgcccgtgcgtcagccaccccgtgcgcgcgcgcgtcggcgagggagccgccggcttcgcggcgggggtcctcgccgcgttcttcgtctcgggcgtcatgcacgagctgatgttctactacatcacgctgcggccgccgacgggggaggcgaccgcgttcttcacgctgcacggggcgctcgccgtggcggaggggtggtgggcggcgcgcgaggggtggccccggccgccgcgccccgtcgcgaccgcgctgacgctggcgctcgtcatgtccacggggttctggctcttcttcccgccgatcacgagggccggcgccgacaaggtggtgatcgccgagagcgaggcggtcgtcgcgttcgtgcgggacaccggcatctgggcggccgcctccgtccactcggctttgagtcttctttgaccggccgctcgcgcgtactgtagtagtagtttgatatgatgggtccatctccccatcaaaatccaactctacgaatactccagcaagagagtggatcagacaactggtgtctgtcatggggtcccctattcatcctatgttgtcctgattctctgacatgtttgtattggatccattttaaggaagggatcccagtgcatgtttgtctgttcgcttgttaataagatcacgcgtgcaacccggaaaagctaacgcgggcgtgcccgttggcggcgagtgtttccaataatttagcctaattaactaagtggttagtagataataacggtaattaagatatgattttcttttttccggaagattttttctactaaccgattgaaaactttcaagttagatttgaaaacttttgaagtcaaattttaaaaactttcaaaactcaatttgaaaattttcaactcgaaatttaaatgtgtaagacaaattttgaaaactttcaactcatatttaaaaactttcaactcagatttgaaaactttcaactcgagatctgaaaactttcaagttcaaatttgaaaaattttaaaattaagatttgaaaaaaatgaaaactttcgactcagatttaaaaactttcaacttgagatttgaaaacttttgactccgattcgaaaattttcaactcaaatttgaaaattttcgactcagattcgaaaactttccactcaaattcgaaaactttcaactcgagattcgaaaactttcaaatcagatttaaaaattttcaagttaaaatttaaaaacttcccaactcaaaacatttttgaaaaaaataagtgtgctaaagattaaaaaaaagtaatcagaaaaaaacgaaaaaaacgcaaaagaaaaggaaaaaacaaatcgcgaaaaaaaaagaaaaaatggctgatgggccgggaggcccgggagcagctggcgcgcgcgccaactagcaatcccctgtgcaaccagggccatatgggagaattgtttggaggctctgtgccaaacgtaaaattttaggcccttagatttcagaattgtaattctaatttgagtcattatttaacttttacaagagtttgcctacatctaaggcttccgtatctacatccaaccattttcagaccaagacgtgggagtattgtttttctcccatatctccatacagagctaatgagttttacagttgtgctctcctcttggtctcggtgcatagaccaaatatgctgatcaaacttgaatggattgagtatatgttggtggttatggtgtataataacaaatagctacattttataggtatctctcgctaaagatcaacttttgcagtgttcaaaaaactaaaaccataaagtcccactatcctgtaataaaatttgtctaaataattttggtaccgagcatgtgaactgagaatgatggtagtgcgtttcatgagccggatagcgatttcggaccaaaccccattctgttgagggcgacttggatcgcgaataactctggttttctgttaccaacggactacagtgatatccaccggcggcacttggatttggcggtgacgccatggagaaagaatatatcactttcaagtgagagaacggagttaaacactgcagcacattttgttcgcttgataacatgggctgtagtgagcagtggattgtaccatcggcccatggtttgcatcaccgggatgctttaatttgttccacggcgactcggcgagcgcccaatttatcaaagaaaacttgacgagttgattggcaaattcagcaattccccgtctcgtgccaatctgttctttccgtcgcgccccatcgaccggaccccgatgatggccggcggcgacctgcgcagcctgttggccgtcgttgccgcggtggccgcggccatgtcgtacgttcgcttcgtggcgcgccgcctccggcctggcctgccccgcctcgccgcgttcgtgccgctgctcgccgtcctccccgtcatcccgctcgcgttccgcgcgctccatctccgcgtcacctccgggttcttcctcggatggctcgcggagttcaagctgctgctccttgcctcggggcatggcccgctcgacacgtccctcccgcttgccgccttcgtcgccatcgcctccttgcccgtcaggcgacgcgcgcagcgcgattccgagaacgccccgcgcccgggccttggcctcgtcaccttcgccgtgatggccgcgctgctcgccaccatcgtgtcggtctacccccacaaggagcggatgaacgagtacgtcctgctgatgctgtactcgctgcacgtctacctcgcgctggagctcgtcctggcgttcgccccggcggcggcgcgcgcggtgatggggatggacttagagccgcagttcgaccggccctacctgtcggcgagcctgcgggagttctggggcaggcggtggaacctgtcggtgcccgcgctgctccgccagtgcgtgagccgccccgtgcgcgcgcgcgtaggcggcggcgtcgccggcgtccccgcgggggtgctcgcggcgttcctcgtctcggggatcatgcacgaggcggtgatctactacgccacgctgcggccgccgacgggggagccgaccgcgttcttcgcgctgcacggggcgtgcgcggtggcgaaggggtggtttgctgcgcacaaggggtggccgcggccgccgcgcgccgttgcgaccgccctgacgctggcgttcatcctagcgacggggttttggctcatcgtcccgccgatcacgaggaccgggactgacagggtggtgatcgcggagagcgaggccatggtcgcgttcgttcgggacgccggaagctggcccgccgcatccgtccgatcggctttgaccggccactcctagtttgattacgacgggtcactggcgcatctctcgttcagttcacggtacaaatttgtatattgatttttcgttagatttggagctacagatttttcatgtagctttagatttatgtatatagaaagaaaaaaattatttgattagtgctgctaaatttaaaattagaaattcatgatgaattaatacaaagttatactcgttctatattctcagtcgtagttttgcatgattataaactggatcatcctagcatgaattttgcttatattgatccattcaaccgttccattgctcgaccatgtatgcaacgcaatgattcgtgtggtggactacgccatcacttcacatgggactaaggcacggcgatctgccgtgctggagcttgatcaggttgtagtacgtcccggcgcggccgacggcgaggagctcgtggtgcctccctctctccgccaccctcccgtccttcaccaccgcgatcgtgtcggacttctccaccgtcgagaggcggtgcgccaccacgacgcacgtcctcccccgcagcatccggtccacggcgtcctgcaccagcctctccgacgcggcgtccagcgcgcttgtcgcctcgtccagcagcaggatcctcgcgtccttcagcaccgcccgcgccagcgcgatccgctgcctctgcccccccgacagctgcgcgccgcgctccccgacgcgcgtgtcgtacccgcgctccatggcgctgatgaacccgtgggcgttggcgagcgccgcggcgcgggccacctcgtcctcggtggcgtgctcttcggcggcgccgtacgctatgttgtcgcgtatcgtcccggagaagagcgtcggctcctggctgacgagcgccacctgcgaccggaggcgtgcaaggctgtagctcctgatgtcctcgccgtcgaccaggaccgagcccctctgcgcgtcgtagaaccgctcgatcagcccgatcaccgtcgacttgccggacccgctcggcccgacgagcgccaccgtcttccccgcgccgatctcgaggctgaatccggcgagcacggccacctccggccgcgtcgggtagctgaagtgcacgttcttgaactcgatcgcgccttttatctccttccgtttcttcttcttcctctcgttgtcgttgtcgtcgtccttgatcgtcggttcacggtccagcgtgtcgaggacggagcgcaccgcgtcgccgccttgcgccaagtccgacgtcaagctcccggcgtcggcgatgacccttcccatggtcatgagcatgaagaacacctggaacaggtgcgtgggagtgatgagccccttggccatgagcttgcctccgtaccagagagcgaccgccatgctgccggtgttgctgaactggcacaggcacaggcagaagccggagaaccacgagtgcgccacgttgtccttcttggggccttgttgcgcggcctcgtacaggcggagcatccgccgctgcgacgagaacgcggtgatcgtccggtggttcaccacggcctcgctggcgagctggctcccctgcacctgcgccttcttggccttcttggacatggcagccatgagcaccttcttgaagtagaagctcgcgatgatcagcggctgcatggccatcatcaccgtggcgaggcgccacgacacggcgagcgcgagcgagaagcccagcgacgccgtggcgcccgcctggaccagcaggcacatgcggtcgccgacgagggagcggaccttgctcgactgtgtcgccagccgcgcgcacaccgcggcgctcgagttctcgtcctcgtcgaaccacccgacctcgaaggagaggatcttggcgagcatctggccccggacacgctccgtcaggcgctcgcccatcaccgcgaagttgtagtgctgcacgatgttcgccgtgatgcagacgacggcgatgccaaggaagaggaagtagtacaacctggtcttggaacggatctggccatcgtcggcgaggaaataaacctccggcaacgagcctaggctgtacgagtacagcggcagcaccgcgccgaagacgacggcgccaacgcacccaagcaacgcctgcttccactccggccggttcatcttcagcaggcgaagcttcgagggcttcctggagcgcgccacaccgtggtccacgagcttcctcccaatctccgtcgagtgttcgaccgagcagaacgacggcgcggggctaggacggtgctcggtggcgctgaccgccgacataatctccacgctgcggaacgacaccatctcgctctccaccacatccacggcgcggtggcgctcctccctcgccgccacgggtggcgccttctgcaggtgcaccatcctggcgtacacgccgccttcacccccgtcgtccatccccaagagctcgtcgtgcgtgccggcctccacgacgcggccagcgtcgagcaccgcaatcgtgtccgccttgcggagcgtcgagaggcggtgcgctacgatcacggtggtccggcccacggacgcccggtccagcgcgtcctgcaccgtccgctccgactcggcgtcgagcgcgctcgtcgcctcgtccagcagcaggatcctcgggtcccggacgagcgctcgagcaatggcgatgcgctgcttctgccctcccgacagctgcgtcccgaactgaccaacctgcaccggagaaaaaaaaaatacaccataagattcagcgtgctgtagcatgcactgtaaaaattgctgttgcttgtgtacatgagtttcgtatccatggggcaacttgacgatgaactcgtgggcattggccatcttcgccgcggcgacgacttgcttcaacgaggccgtctcgtcgccgaacagtatgttctccctaatggaggtcgcaaacagtacaggctcttggctcactagccctatctggctcctaagccactccacattgagcgtgtcaatgccatggtcgtccatcgatatctccccggagtccgggctgtagaacctctgcagcagcgagatcacggtggacttcccggacccgctgccgccgacgagaccgacggtggcgccctcagagatggtcaggttgaagccgttgagcaccagcgtgtccggcctcgacgggtacgagaagtgcacgtctttgaacacgatctcgcccctgatcctttccatggtggctcccttcttctccgccccttcgagcggtgggagcatttcgatcatttcttgcatccggctcgccgccgccgtcgcgtcaatgaagtaccggaggttcggcagcgccatcatgatcgacctgacattagcaacaacagcacgaacgtacattatcggtaaaaatgtcacttgttttgaaatggagggtgtgtttgtaatttgaatgcttacattcccgccaaaacgatgcagatggaggcgacgaacacgtggccgccctgggcgtgcaggtggatgacgaggaggctgccgatccacgacaagaaggaccagacggcgtagatgacgcccatgctcccgatcacggcgcccttgatgagcccctgcctgacgccgagcgccgcgctccgcgccaccgcgccgcggaaccgctccaccgtccgccgctcagcggtgtacgacgccaccgtccggatggacgacaccgcctgctgcgctatcccgcccgcctcctcgtacgccgcgcgggcctccccggccgccgcggccatgcgcccggcgaggagcacgctcggcgtgacgaagaggaggagcgtgaacgggaggcccgccagcgcgagccgccacgcgaacacgaacgacacggccagcgcgccgaagaagagcgtcgcgttggccaggaccatggggagcttctcgccgaggaagtcctggatggcgtcggcgtcgtcggagacggtggagatgacgcggaacgtggtggcctgggcctgggcctgcggcgacgacggcgaggagggcgcggcgtcgaagaacgccacctcctggctcaggacggcctccaggtacagcctcctcatctttgacgcctgccgttccgccgttctcgtccagcacagaccctctgaagatcaccaaccaacattcatgttctccatgatcgtccaaagaaaattctcaccgatcaaacactacttctgattttttatcactgatcactaatttgtttgattcaaagttgctcacctaggaaggagcaggcacccactgcaacggcgacgtacagtaaccgaagcgcaaactgcaatgcagcttacgcgcaagaataagattcaggaaaggagttgcatatggaaacgtaaatggatggcacgattgatcaccttgtcgacggcgccggagctgaaggcgctccgggcactgccggcgccgccggcgccgccgtagctgttgacgatgtcgccgagcaccagcattgacagcggctgcatcatgccatcgccgaagctgcccagaacgcccagcgccatcaggcaccggtcgtgcgcgtcggcgtagcgaaccagccgcaggaacgacggcttctccttgtcgcccatcgggcctagtttccaagcgaactaaccgattgcgttcgaagcttaaccaaaatttctctactattaatcagctaactgccacttagtcattggctgtctgtcgtccaattagacggattaatccgagcttgtcacgtagcctgctgtcagagaaggcctttcgagtgaggaatataccaatcatatcgaaatctggtgagtacttccgttttgtcccgaacgatgcagccaagccagttcaaataacagtagagaagaatatgttatactccctccgtcctaaaaaaaaaagcaaacattggatttctcttatatgaaaattttttataatttgtattttcattgttgttagatgataaaacatgattaatattttatgcgtgacttgtctttttaatttttttcataattttttcaaataagacagacggtcaaacgttggacacggaaaccagggtttgtctttttttttttggatggagggagtacgatcgtagagtagatacccatagccattagcgtgtgtttatagcccctgcttgcagttaatttggtttgtatattccgccggccttggcgctagcttttgctcgtagtctttttcttcgcaaatctgatatacgaagtgcagctgttcccttccaagttccaacaaaaggggatcgagaagaagcgctggcgtttcactctcatcatcctaacttgcagttggcacacgtaaaaagggtgcgtgccaaatgccacgctgatatataactttcactaccccgcccccatgtcaccaccattcacaatcctctcgtacgtaacattaccaaccaggacgctggtcgcccacacgtacctggccaaagctgctcccttccttgtttcatcgatagccaaagtccctttcggcagcgtggtccgccagaatctgcgttacctgacctcatactttcacaggttcacagcccccggtgcagcgtccatcacccactgcagccgagtgccatgtgcgcaggagagccatttttggggcagtaaaggtatcacgtccgaggcgcaccccggctgcaatggctgcatcttcctggctattcatcagtggcgtgtgctcgtacgagcgacctcgctctgtctgcagcctgccggtcgctcgttttccggcccgtttttcgccgcaccccgcaacgccccgcacagaaagcgccgcggcgcgggcctcgcgttacggggaaagcgagcggttggttggccttggcggcctactggctacacgcgctacgccggcgaatttgtgaccctagtgggtacggtgtgggttgggtttggccacacgaattatcgttgtttgccttgcctaccgccgtcgcgcccagcaccgcatgcccgcggtgtcgcagccgggatgcgggaaagtttcgtggagaacgcattgagacgttttgcatcgttcacgagtccctcgctctatccgatatatagccgtaggcatacgcgatgggcaaatgcatatgctactacttccatcccaaaatgtgtttacgattagatttgacactatctaaggacaccatgtaacgatttatcgggaatttgtttggaaatcgtcgggatggaacacatttgtccacatataatgatgcatcgatgaatgttgctcgttcttgcgagacccgttttcgccgaggtcaaatcctctttagaaaacaaggagacacgaaaggtaaccaccctacggcgcctttctttcatctcgagtccaatccaacgccacccacatctattcgacgcacgctatatatgtttgtatcaaactgtggacaatgcgattgactgaagtctgaaaatatgcatcatgattacattgtccgttttctacaaactttgttacgtgactccttcaattgaagaacccatcgttttcccacacaaccaatgtagtactagtgccacccaaaaagacccgccccaatcatgcacgccctggcagggtgacacaagtgaccagcggagccgtgtcacctgatcagaaaaaccaaccaatccatgccatctcgagctcacgaccacttcatctgacaaccaccagcagcaggcagcatgcacgaaacgcggcatattatcattggcagtactacgaatccatatgatgcaacaaaaaaaagcgagacgtgctcttttggatcgtcttgatcgcccaaccacggcaggccaggtgttctgctgttggcctacctaggctgcaccaaacgagcaaagcaaacaaacgcacatgtgcgcgtggttgcccactgcaattgaagcggacaccaccgaagatggcttcgtgcggtgctgcctgtggtggctgcacacaagttttcaggtccctactcgatgcggtccttgaccctgctcgcgagcgcgccacgtacacctggaggctgggacgccgtggagacacggatcattcgattccgtggtgccacaacccgacagggccacaatgccatattgccatccaaggaaatcacaacccaacacggtgataccgacggccattaggctgctgcgtgccttgagctttgcatgctttttagggtctatttaaaaaatatagcttattctacaatcttctgctcttaaaaactcttctcaagcagttcagattttcatacagattttaaaaatatgcagttgtaggattcagaaaataagctagaatatagaaatgagaaacctagcttttctatattttcaccagctaaattctcaccaagtgtttctcggaatattaagccttccaaacagtatcttagtgaccagttggcagttgcttgcgatttggcaataatttatgccccaagacgccgttaggagatacgtaaatgtcgttgcaggacaggttcctttgcttgagcgaacatgaaacgaacatttcgaatgattggttgcattttcgctcgatcctcttgcctctggtcgcttttatcacctttgcgctagtaaaagagtgaacagtgcaaagcatatcaacaacgcttggagacgaagcatgtagatggatccaggctttccagttcgatctgtgtctctgcccccagttcttgcgtatgtcacgctcacgcaagaactaactgatcctgatgatacgctcgtatagtgccctaatcctgctcaagaagacaaccggtctttgaatttagtggccgtgttatctgttatgttatctgctgttgctgcttatctcgtcgctgagcatgtgcctgtcgccgtcgtcactgctcacctcgtggcactccttgctgattgcactgtggattttgtctgcagattttcttagcgtgacgctgatgttactgtgcagattaaaaaaaaaacactgtgtagttgctcgacgttgcgatcagcttgatatcatccatttccaatttgctgcttcttgagtaaacaagcgcaataggctgctcaatatcttccaatggcatcgacttgacactgatccattgatcgcctgttcatttcattgagttaactcattggcaactcttcttttttttcttttcggtgttaatttcaaacctactagaaatctccaatttgtctgcgtgtatgtaatgattctgttcaaaaattgttcatgtcacgctctgaattttgaaacccacccctgcgaggtaaaggaaaggctgaggagcatgccaaaagtgaaaaatgacaacagattagtttatgttgcattctccagaagggaacatatattctttgctgcttctccactcaaatcacatccctgacgaccgtgaaatctttttggcaaatctccactaaacacacccattgtttgacaaatctgctctgcaaatacagaacattttgagatccgagctgaataagctatcaagatggtagtcgtagaatcatattctagggtggctatggagctggcaatgggaccagaaagcacactgcacacatacccgtaacacaggcctgcttaaatcctgcttaattttggcgtaaagtgaagcaatgagagagagagagagagagagagagagagagagagagagagagagagtagttagggagcagcgattaggatatgatcctcatttgacattctatatattgcattgctttacatgtagcccccatgctcttttttgcaccatatatattcggttgagatttgtccaacctcttataagtcataattagcttttcctttactgcattaagtgttgtaagataatgttgtctaagtagtccactcttggcatcacatgcatgttggatcaaatggaggtagcttttgcagtatctcgttactagcaacatatactagttactcaaaaactttatataacatgatctactctctactttgctaatagtacaatcttgtctctcttacatgatcagccagtaagagcatttgtcctcagattgtttttctcaaggacgcttgtccttacctcctgccgtttcctccacagcagatttgcaagattttgttctccaatttgcagcagccttcgttctctgatgagcttgcatgttggataaaaaaataatactttctgcaaaatgagtatagctcaactgattaagttttttttaatagaacaagttcacttcaagttttagattgacatggatactcatatttgcggctatttattctttcagtgacagacaacatacccatcaacagcgagacatttatttcgttaatctctagatgtatcggtccaatctttccgagatgttcataatgataggacgcacgtctatatgtttatagtgtatgcgtatttgtgagcgtctatatttatattatgttttttgaaaaatatatcactatctgaccactaagctcaaccagtaccacacgctggttcagttatcactgaaaatttcgaaacgcttctttcagagccaaattgacaatgcgtggcagtggaccaacccacattgaattgtactatactccttcaaagttcacactaacacacaacacaggagaagatggacgtgtcaatttacggatccataggtgaagccataaaacgcatgcggctcacgtttcaagtcccgatacagtttgccacgttgaaacaaaaaccggtggttccatccgacgtaaacataacatcttacccatgccgttactggagccgagatgtcagtcacgttacggtcgtactcgatcgtacatgttttgcacgcatatttcttcagcgtatggtcctgacgcgaaccacttgccgaaccgtcacttcggagtccctactgttcatcgagagagagcctctcgtgtgcacgcacaaatggaattgcacagggctaattggcacttgacactttggtacaggccgcgatgtccaaagcaaaaggtaccatacattttagtgttaaattcatagcctcgtttgatggaaaaaatcacatcggtcccgattaattcatcaggttagaatgtagtatgaaaattccggggaggcagtcgaggcactaatcctggaccaaacgtgatctgtacactttgtaagtgtacagcaagcatcacgatctgagattgagaagctggtgtagaagttgatcacatcacacttatttcttcatttttcttttttttttttttgcaaagatcacacgttgacgcagcggcgattccaaccgggtggatcggacgacgtcgaccgaccgtaaggcggggcgggctcgcgccatcgaccgcacaccggtgcccccgacacctccgccccgggctgtccactcgaaccgagcgcgtaccgacaggtcacatcggggccatcctgaccgtccagtctcccacccgtacatgtgccggacaatccccagtcgtcagatggaggaagccgacccaagcctgcgcgtacaaataccccctcctcgcactcgaaccaactcctccattccacggagtcgcggccgctgtcacagtgggtggtggtgtctcctgatgcggcttctcccgcggctttgcatggccaccggcgacagcgcggcagccgccggcgagggagacagcagcaatagcggcagtaagcagcaggcagcggcggtgtcgtcctcctcgtcgactgtctcgacgtcgtcttccgccgcggcggccgcggtgtcggaggcgtcgtcgtcgatgtccctcccttcgctgccgtcgctgtcggatgtgacgggtagcatgagcgcaagcctcgccgcatcgttcgcccatgttactactctgtgccctctgtccacggcggcggcggcggcatcggctgccgccgtcgcggcggcggactactcggttcacggcggtggtggtctcgtcgtcgtcgtcgccaggccggcggctgtggtcctccacgacgtgttcaccatggaggcgacctccacctccgacatggcggatgatacttcggcggccgggtcggtcaagtgcgtggcgcaccttcatggcggcaaggccgccgtgacggggcaccaggacgggaggctgcggctgtggcggatgtcctcccgcgcgcccgaccggctccgcctcgccgccgcgctccccaccgtctccgaccggctccgccggttccccgtcccgtccaaccacgtcaccgtccgccgccaccaccgtcggctctggatagagcacgccgacgccgtgtccggcgtcgcggcctccgccgacggccgcctcctcttctccgtctcctgggacaagacgctcaaggtgtgggccgtcccgtccctccgctgcctccagtcgctgccggcgcacgacgacgccgtcaacgccgtcgccgtcgcgcacgacggcacggtctacaccgcctccgccgacaggcgcgtccgcgtctgggcgccccgggcgccggcggccgggccagacagggcctcgcgccgcccgggcaagaagcccgcctaccacctggtggccaccctgtcccgccacgcggcggcggtcaacgccgtcgccgtcgggtgcggcggccaggtgctctactccggcggcaacgaccgctgcgtcgtagtgtgggagcgggaggacagcgcgagccacatggtcgcggtcggcgcgctgcgcgggcaccgcagggcggtgctctccgtcgcgtgcgcggccggggacgccgccgacggcgcgctggtggtcagcggggcggcggaccagacggtccgcgcctggcggcgcggcgcggacgggcgcgggtactattgcgtcgcggtgatcgacgggcacgggagcgcggtcaggtcggtcgcggcggcgctcgtgacggcgcagaagaagcgtcgcgccgacgacgacggcggcgacgaggagtggagggtttgcagcgccagttttgacggcgaggtgcggctctggtcgctgcgggttgcggcggcatcgtagcaaggtcccggtttggcacgatttttgacgtagaaaagtgtgcgtttttttcttctttttctgttcgtttttggactcacggaagtttgacttgtttgagaatggagatactcctgcctttgtgtatatacgggagaggggagtctctacggtccactatatttttggactttccaaaagctgcttattagtagtgatttcaaatttgcttacatttttcttcagggagtgtacatttcaggtgtctggatttttcaaaagatacagttacatttctcatccttggatggtactaataatcttatggttctcataaatccccaaatgattgaaaaataaattattctaacatataaaaatttacaaatgacacgaaacaaacttataattaataaaactttacaaaactacgtgcaaaagctcttaagtagtgatttcaaatttgcttacattttcctacagggagtggacatttcaggcgtctggatttttcaaaaatacagttacatttctcatccttggatgatactaataatcttatggttctcataaattcccaaatgattgaacaataaattattctaacatgtaaaaatttacaaatgacatgaaacaaacttataattaataaaattttacagaagtacatgaaaaaaaccaaatacataaaaataaagtaaaaccatatataacaagaaaatcacagtaaagtgaaataaaattgcagcaattttagggtttagcaatgtcgtgcaattttaattgaaagaaatttttataactttcataagtctaaaatcttgtaaatcaattgtctttatgtgtgtggagattatgggtaccccatacccacacgacatggttatcagactagttataggggatagtttagatctatggaatatgtaacggatcataacttgggtattacgttttcttgtatattacggaatggcgtaaagttttggtttgataatagatttaggaagccgatatcgtattagttaaggtttctgtcttgtaatcctgtcccccatcctatataaggcaggcaagaggccctctagggcatgagattcacaactagatcgtcaaatcaatactacacttggtggattcaaatccccaaacaggagtagagtattatgagagggttgatgagagggtctgaacctgtctagatcttgtctccacatctatccacttttagatctcgtgcgctatcccgtttatattgccgaaatcctgttttgacaatgtgttttttttttttgcctttctttgtgtgctacaacaatagctgtgttatctactttgacaaatataagaccagaagaatagcgagaaagacccacctaattggttcatcagcgttaggctggtgtcctgttctgatctgtaactttccaaaaggaaaagaagctcttcaattgtcgtctctcactctagcttggctatcaagtgtcaaaatcgacatgaatggctcagtaaaaagaagtcaagaaacaatctatccattcaatttctcttcaggctgggctactgtcaaagcagataggagaatgtctgacataactatcatccacagaatacaaccaaattaccaaaatgaagtaactgaccgttcattttgcaccacgataaactccaaatctgacgccaatcgccgatctgccaatggataataattgcacatatagtttgtagtttgtgggcaacgcagcattgcagctgcatgcctgtaaagcgggcgtgtatcgctggggatttggagttggagatgagatcgatcgatctggagcaagcaaagcagcagagaggaagtgcaggctcgatcgctttcatgctggcgtgatcggattgggatcgacgtgagcgtgacgaaccaaaccctaccgatctcgctggatacaatgataagattctgtgcgcctctgtcctgcagacgagttggccacgcactgcaatgatccatgcacttagcagatgattatgactaggttttagctaatctgatgcttaatcccttttttgggtctgcactgttgctgattcgcacgatccgatgctagaccgatttatcatggtacctgctacacccttttgatttttgactcatgctctgtcagtgttaaggcctaacatatgtaaacattgcctgccagctcttgcctgctgctgcttgtcgtgtgtaacctgaatagcactgctgtctggcttttagccatgtcaatagctttaagcaaccgacctcactagcaagggcccgctggttacctttggagagatgcgatgcgagtgaaggactgttgtaaactgtccttgaactgaacattttgctgttccttcggttctgtttctgtgcatgatgaagccgagcagcaagggggtatctgctgcagccttttccccggagatattttagcaaaaaggcaggccaggggttggtggtgcctccatgagctgaacggcaaaccgacacacgccgataaacacaatatctatccattcgattgtatacggcagcttatatccgataagcacttgtattatagtattctagagctaagcttaatcaacccatgttgtagcagtagtatatctgtacacatcacccttgaggatttaaaaatcagtgtaaagtaatcccacttggcgcgcggtcgcagataacacgagcctcgcagttgattcgcccggtggcgcgaggcgtgcgtggagcgagctacatccagggtttacaaaatcatacagtcactatggttatcatatgtgatgttttttttttcagtttttaaaccatcacacggtttgataaatcctagctacactgctagtacatgatgacaggcgtgagagtaaggtagaatgaattattccctgtattttataataagtaactttgacccgacgtgaatatgtgatatatctagtattataaacttaaacaataaatctgttacattgaatcaatattttttttatttgatgatgagtgtgaatatcgagtactatgttacatccaattaaaactttttatattttaagatgaaaggagcaacgagtcagcgcgagtcgcgctaatgatccggcagcgttggcgcgcggtggtggcggaggagcagcagctcgatctcgaccgattagttaatcgcgacactgactcacgtctgcctcagcgcgccgccatcttcttttaatcacgtagccacgtaggtaggcttcgctagctcgaggagtcaaatgcaatttatgtagctggtgggatactagcagcaggttaggaggagattcattcttttttttttttactttttttgtaagggaatggattgttaatgtgggattcaactggtggtgcgtgcattggcacgtcccctgattatgcaggtcgtgtatagaaatatttcaggagaggtcctcatcgtggagtatttgaccagcaaatgtgacaatgtgaaaagatgatgcagctgactgtatcgtccaagtgtaagtcagcgtggcaggctggaataacctggttagtacaaagaaatgccatggatcaggtagggtaggagtatgtcataaacaagtggcaaaaccattgttctgccacccatagtttcaaattttcaatcaacgggaggaagttttaggtgcatgaacgaggcaccacgtattacactagtatttactactcgtacactgagattgtgcattttgtttccatctactagtacatatatactagtgtatgaattgacgtgtagtgtacttgtatacagtgtggcacatggagcctattaagtcttggaatattctggcattgttagcttcgtcaacacagcaaatggatcaactagcaagtcggcacagtacctagctgctcacaagtcagcacagtgagctactccaacaatggacatcctattgagtattgtcacagctcacaacgaacacagagattaagcatgcgacgtgatgtgatggcaaataatactcagtccgtagtcctaaaatctaaaaaactacgggcggagctagaacaaaatgaatgattccattcatttgttactttgatttgaatcttgatacgagtatctaaatttaaactgacaggatatataaacatatggtgaaaatagataaattataactaatttttcttttcaaccgggttcccggacaccccctaactatacatagctccgcgcctataaaaaaactaatccttcgttagttttaaaatattgctatatatagtatatgtatgtgatgtgatattttctagtaaaatgaaagaaatattacatcatatattaggtacatagtagtaataatattttaggacaaaacaaggtataactaaatttgtatcaaattcgattcgagattgttatattttaaaattgaaggagttcatatttagttcctgaatataatttgcattttcataaggaactcgtgatacagtacatagtagcggtttcccttaggccccgtttagttcccacacaaaaattttacaccctgtcatatcaaacatttgaacacctgcatgaagtattaaatataggctaaaaaataactaattacatagattgcgactaatttgcgagacaaatctttaagcctaattactccatgatttgataatgtagtgctaaagtaaacatttgctaatgacggattaattatgcttaataaattcgtctcgttgtttactgacggattctgtaattagtttttttattagtgcccgaacactccatgcgacacctatataataatcgatgtgacacgctaaaactttacacccctagatctgaacacccccttactcgttttttgtttgtcccctacacacggttggtgcctcttggcctgatcgattgtcttgcactctttgctgcggctgcggcgctggaattgatcagctcatgctcatctggtatttttgcggagcaagactctgaattgattttatgataatatttcaagggtacaaaaagaaaataattaagcagcacaaagttgatattttaaatactatttctaagaaacttacatataaaaaaaaatgcggacaccattctgtgacaaataatctataccggcggggccaaagctgctgaattggcagtagagctcctgtccaatttctgattgtaccttgatggacggatctatattgtggcgatgaaccaaacaaatccgacccgtacgcgtggcggtggcggtcggtgcacgcctctcctcaccccctgcacgctgcatttttcagcaggtccacggcgtgacagtctaacagacattggcacagaagcttccacccgccaagccccatgattggatggagcgagccggccagatattccgcttccagaaccttcacccacagaaacagatcatgctcctgcagtagctaggcgacgggagaagaagaagaaaaagtcattaaagaattgaagcgatcgatcgcgtttggtcaactgtcaccagtgctagccctgccccaggaagcagacaaggggagaaggagaggaggccccatgacggcgacgaagaagacgatgatgatattgataggataagagaggggccctatgcttaagtcgaacgcatatggacgcatggcacgctgttgttcggatctcgcaaaacgatcaaggagcagatctgacctgcgaaatggatgcgtcttagctacctgttctgcttgtcaagttgtcatgttgtatctccaaagtccaaaccaaaatgcactcgaaatagtgatcgcaatttgcaagcatggagacgaatggcttttagaaatcacaagagagagagagaggtcgcacggtttgggggaagtggtttctgaacagtgaacaatgtatagtacataatttgtttggacttttgactccaggaaagtttcattctttaatgaaaccctccacaccaaagaaaaaaaaggaaaagaaaacgaggaaggacgcaaggtttcttaaacaatcttcagaagttggcgagagaaactgaaaagcggtgggaaacagggaaaggggaagcagatgatttagaacagttttgctccttcaaaggggaggagttcgttcacggcgatgatagtcccctgaaaaggtcgttctctgccttttctccgaccatcctgactcacctgccattaaggaagcaagcaggcagcttaatcacgaaattagtagtataccaaggatgttcaatcacgcaagattaaacaatcctgaagttaatcagggcaatgctggccatcttcaaacagattaaatacgagcccctttacgacatgcgagcatgatatgggatgaccagaggaaacttgcagccatcgtctaggcgagttggtgattgacttgccagttcaatcaacaatttgcttttccattcaaaaaagaaagaaatgaaccaaaaaagctttacctttcctgcaaggtaaaccatctcgcgtcagcttggcggctagcaagggagaaaatggagggaaaaggctcgaagaggcctattagtagaatttatagcccaaaataaaacccaattcagtaaagggatcacctgaaacgggcccaccaaggccccccttgaaaccccttcccgccatttacttgccctaatcccctccccctcccggcgttttcccgctcgcggcccgggcgaaacggaagccacccgcgatggagaacgaggcggcgcgcggcggcgagaccttcgatccggtgagctcccccctccttttgatcggaataaatccagttttggggttgatgcggtacgttgacggggcttgttttggggatctgggggcaggatctgatccgtgccatcttcaagctggtgtgaagccgccggggcaaaagggccgccgccggcggcaatgccggcgacgaggtcatcgaggtcgaggtgattccttgatctggtcccagatccttgcctccaaatgattgttttctgtggccgttcttctttcagctactcctaatctgtttcagattactcttctttctgttgtgtatgtactctggtctgaatgtttccttctctaattgacagcctgccccggagacatcaaggaggaatcgtagtgccactggtaaatcaccttctgctacagtaaaacatgcgatttatgcgttttgctttgttacatctgattagtctccttagccactggtaggaactaggaataagcttgaccatgcacatctgttggtagtattcggtgctgttaaatggcagcaggttatcaacactagtggcagcatcagaagtttttacatttcttgcaattgccttttggagctgaatctcatcagtatcaactttgctaaattctcttattactagtaactattactttggagtttgggtaactttacagtgatgtttacctccgtttcacgggccctgtgggtggcaccttattttactttacaagcgaatcctgacaacaatttaagttgtgcaatacagagggcaacaagaagtctatctgatttcagcatgacaatcaatcggtccaggcgtccagccacttatgatgtaacaggatcttgttggcatactagtttagacattcatcagttagtctgtcctcttttatagttgcatatgctgcagcagtggacatttgttgatcatcttggttgtacaattcagtttttgttattgttttatattgtagcagatgggctctagacctctagtcctttcagggtttggtatatccttacaacagcaactaatgccagcaccaagtgtgccaaccaggctataacaatttgaccctgttggcctgttggataagaaattgaaaatagacctaacaagtaacaataacttgtctcaaatgtttaaggcatcctagcgaaaaaaacaatattatcagattttgtctctagtatttgttaaaagaatagctgtgagttgtgaaaaaccaagtcttgttaaattcaattctgtgcgcccaatcacctaatactgaaaaaagaatctccacccttagatttctgttggggtagtttaaatcttgaacttgaaattaactccctatcatcctatgagagccttcttgtgtggtgttgacaatctgttcaccttcacagccaacgccagtgcgcttaaagtgagctgtgaacttctacggatatttgtcacaggtatgtacctcttaaattgttctattgcctcatggtgttaagtgacatgaagtcaatactccatagctacagtgtaactagagaaattttcttgcagaggctgttcaacgttctgcttttattgccgaagcagagggcacaacaactattgaacccacccatctggagcgtgtattgccacaacttcttttggacttttgaggtacttcagggatctcttatctctagcttccaaatctataaggttgcctctggcagaaagatataaaaacacctaagcatatagttttaaactatggcatcagcaaaacggtttattatctgaacaaagcaaaatcgtctggataaatcagtttactgacttgatgtatacacatacaggatacaacttgtaccagctagtgcttttattttgggggagaaaagcttgtggtcagatggatagctaagggacccgagcaaaattcatactcgagaagcctgttaatgctagtaccacttgctgtgaatgcgtaaaaatgacctggggcaacaacttctactaggatccgtggatttctggataatcactgtactgcatctttacactgatacctgtgctggcatgtcctaaataccaccttctttgacaggcacgatcttggtcatgtccacactgcagattgcttgataatgttctactagtatctaaatataaacaacagaggcgtttgaacgagatgctttctgtcactactactacgagttcgctgctgacagatgatgggcgaaccctgctgatgcaggcgcatctacggtgatttggtgaatcttcaaccttcacgatctctcggtctcttccgaattcaggagacggaacacccgtatcgtatcgcaccggggcagagcaaccagccaacccgcgaagtagtactgagtactgaatggaaggtctggataggcaggccacgcgcgcacacccgtcccttcctgggcggcagccggcaggcacccgtcccccacccacgctaccagagttcgccggagaggcggccacctgtcgagagggagcttctccacacggccaccgcagcggcaaccacccccaccacctgtcctgctcccctcctcgtgccgcctcgtcctctttttaacgggtttctgacgcacggggggccgccgtcatgtgcctcgccgccgccatcgcgtccgcgtccgcctcacccgcccgctgcctgtcgccctcctccgccgcgctcccccgccgcttcctccaccacctcctcctcgccgagactcctccccggccaacaccgcccccgccgccggtgcgctgcatcccgttccaccggatggcggtaagcgttggtgctcctcccctcccctatcgattttctcctgtggcaatcccgattccgtggaaatttgtgcccggcgatgcccaaccggaacctgctccggatggctcctcgtgtgacctgttagggtaaagttgcgtggctaattttggggaatcacttgaaagcgcagatgtccaaaccagtgaatttcggaggtgtgctggattgctcagctgtttgctttgcccttgtgactaaaaatgttcaccttttggcgacctaacttcatatatagggactaccttaaagtgaaatccatgcttgaaatgaatcccgtatcttaccatgtccatgtaaatgtgaatttacattgtacgtcttgtgaattcctggttgctttccaaatgatccatgtactatagaattatgatgagtgaacatttaacttttgagctctgtcgttccccccaaaaaaaaaagttcaagcattgtggatttggttgttttcangatgcatgcactcttttcaagaacacccaatgtattagtttcaagctatgatcatacctgcgatggatgctttcatctgaccattgcttgcttgccatccagcaattctggactcaaggatcactggacaagaacaaagctcttgtcgaatacctgaagcaatatggtgctgttagaactgataaagtggctgaagtaatggaaagcattgacagagcattgttcgtagcagagggccttactccttacactgacagccctatgcctattggttataacgcgacgatatctgctcctcacatgcatgcgacctgcttggagctactgaaggatcacttgcagccaggaatgcatgctctagatgttggatcaggtattcaggttcattactgaaacaccatactcctgtagtcctgtactatagcaaatgcggttgtttttagagtgccctgttgagttttctagaccatgcagttgtgtgaacgacttgctgttatccattagtattagatagttgagatacaaacaattttctaactattgacacatttcatctgcatgtgtaactcttgtaggcagcggttacttgacagcttgttttgcaatgatggttggaccagaaggccgtgcagtggggatagaacatattcctgagcttgtcgctgcttcgactgagaatgtccaaagaagtgccgcagcacaattactgaaggatggatctctttctttccatgttgcaggtatgctaagctgctaactggtctgatactggcactagaattagtgtattactgaacgcatgctttgcttccatcttggcgaaatctaaaatgcaaaatcactatgcgcataatatttcttgccgttctcaacgctgcagatggcaggcttggttggcctgacgatgcaccatacgacgccattcatgtgggcgccgcggcaccggagattcctcagcctctggtcgatcagctgaagaccggcggccggatggtcatacccgtcggcagctacttccaggagctgcaggtggtcgacaagaacgccgacggctcggtgaccgtccagaacgacgcgtccgtccgctacgtccctctgaccagccgctccgctcagctgcaggattcctaaggtcgacggctctaggaggtcatgaaaacacatgtaaatatctcgacgctcagtctacttgggtagttgggtagtttgattagtgctaattagtttcttctaacgaggttgagtagatggtttggtctgagacgttcagtcatggtcatctgtcagatgctgtagatcgagcgtgagctctgagcaatactcgataataaccaataaaagtacttcttagcctttcatatacgtgatttgtttcatgctaggaatgggcttgataatttctccattgagaatgttgttagtttggaatttggatggaagagaacaccacgcgctacgcagagatgtttctgtctcgaacacctctgttccaagttcagttccaacacccacaaaatagttcttttgcacaaatagtgagaatctgtaaattatatactctccctccattttaaaatgtttgttcgaccattcgtcttatttaaaaaaaatataattaactatttattcttttcatatcatttgatttattattaaatatactttcatgtacacatatagttttacatattttttaattttttttaaataagacgaacggttaaacatgtgctaaaatgtcaacagtgtcaaatattttaaaaaaatgtaagtaactatttattcttttcatatcatttgatttattattaaatatactttcatgtacacatatagttttacataattttcaatttttttaaataagacgaacggttaaacatgtgctaaaaagtcaacagtgtcaaatattttgaaacggaggaagtacatccctaattataatactagatgtacatctcaagatttccatgagttttagcagtaagttggctctggcacctacatgtaaaaacttcacatgggcttgaagtttctgtacgagatgaccgcgtaaaacgggtcggacgagcccgccatcccgaacagcctcatcacggcgtccagcggcgacgccggcttcccgccggcggcgtcggagggcagcttcctcaccacctccggctccgtgaacccgtcgacgcactggaagtactgcgtcacgagctgcacgcggctgtaggccgtgcccttccgccacgccccgatcgccttctcgtagaacatccggttgctgaagctcacgatgcacactccccccggcttcagcacccggaagatctccgcgaaaacctacacgacacaaaacaatcaagagatctggagaagaatgcagcaatggcagattggcgttcaaaatgttataattaaaaaaatcaagataaatcaatatatgatatatatttttacaaatatacaagttaaaatttgatttatacaactggaaaaaaacaataaatttgaccatgaaatacgtgttcttttcgtcaaatttattatttttgtttcaatcggtataagttgaatttgaatatgtatagttgtgaaatga

SEQ ID NO: 72284 - DNA, 3735 bp, Oryza sativa
gacacaatccagcagtggaattaaaattaaaccatgcacatgcatatgatgccagaacacgctctctagtatatatttcctctgatgcattcctgcagctagcagtacttgcatggattccattctctacagtacatattcccttctcatttctccatgctactctttgttttcattttctcttcccaaataaaaaaatatgtataccagaagacattcctatatttcttttttggttcttgtatttatcatctgatagaatatacagtttcagtcgggctctgcgctcagtttgttcccttccttgcgcagccttgaggacagacacaagccccatccctagccttaacttttccattgcttaacgagaccaggcaaagtttccctgtgatctgcagagcatttaacaacaagacagtgattgcatccaggaaagtcacacttgtgtaagaaactgagaagaaaatgatggggccctattgggtactattattggttggaggaactaattaatagtactacagacgatcagaatatgagtcagttgcatccataaagacaagcaaatcaagcctctttctaacttccccggctagcttgcagctcttcttccccccttctgctccggccctctcatagctagatcctcacatgtactgctgtcttcctcaatcctgggttcagatgtttcacctcttctctatctagccctctttccatcatctttggcacctgcaagagctagagctgtaaaagttagttagtgtcatttgatggatccagcaaggtactggatcttggccaggaggaagctgggagatcagaaggcgcctctcttccccacccctcacatcaccatcggcgccggcggcagctccacctcctactacgagtcatgggaggaacgtgccttcgcggaagactccgcagggcatctcgggggctgcatctggccgccgaggtcctactcctgcagcttctgcggccgtgagttccggtcggcgcaggcgctgggcgggcacatgaacgtccaccggagggaccgggcaaggctcaagctctctggggttgtggaggacggcaccggcggcgaaagccacggcatgccgccaaaccaaaagtacatgatacaaccatgccctccccaaattggcaccctgcagcacgcctacagcccaaaccctagaagtggcagtattctcgctgctgacactaaccctaattccatatgtgatgttgtcgcgtaccctgctagatccttgcttcaagttgcagctgctagaactgccttgggcaaacaagtcctgaacgcccctcttgtctcatcgaagtcgccgtcggctggtagagaacatggtaagagggagacgttgtttcttggtgctgttcgattggcacaggatcatgacacggtgagttctaatcttgacctgcgtgttgggaaaaatgaattgaagataactactgttttggggtgccgatcaagaagggactttatgtacgataacgaccgcgcggatgatgaaaagactgttgaagcaagtcacaagaaaagaagaatcgatttggaggtaaaccccctgattctaacttcttcaaccagtaatcatcaacagcaagatggtggtgatgaccaacatcatgaaaagatactaaaactttatcgtagctcctcggttgaagaactagatcttgagcttagactcggggaagccccaaaagaacagtagatttcatatccactgttgtatctcaacttgattacaaatgtttaatttgtatttattcaccactcgtgtttcattgaaatgttggtttgcactatctgaatttatccttgttttatcctatatgttaattctgcttatttccttggaatgatttgaagaaatcatttttctcttgaaagggaactgtaatgaaaaaaagaactaaagtgacttgttatatgctgtgtaagaaggtactgaattccaatttaaaaccttacttgcattgatgcacaaaaattatcacataatttagttgcaaaactttctctggttaaccttatatattacactaattgaatgaactgaatttgccagttaatcaaaacatcttgtggctaatctcgaacaatgtcaaattagattacgctaaacaaatatagttgtattcgtgtttatatcctttgttaattctcttaccccccatagatgatatgtgggaatagtgtatattttgtcaaagataaccacatgaaaaaaaatcaaaaatttgtcatactctgtcacaatgtgttgaattgtagttataaaattttatctagtagagcggttaattttatcgtgcaaatgatataaaactaaagttacagaaatatctcccagctgtactgctggacaaagggtttttaaccccggtttataaccccctatagtcccggttatgcaaccgggactacgaatacaggactacagatacccatctttagtcctagttaaaataaccatgattaaaaatatccatttttaggcccgattggtgttaccaaccggaactaaagatggagccaggccagctccagttggtagattttttttctttttttcattgttttaactttgaatattcatttcactacttccccaaatcatccccaaatcgatcatcgcagaaaaaagtatcatctctaaatctctaaattgatcatatccaaatacatcacaaattctaaaaaaaacatcacaaatacttcacatattcacatcacacacaaatcaaatacatcacagattatacatctcagatccatgcaatgaatcacaaattctcaaaaaaaagaacaaaaacaattttgcgatgtcgctgccgcctcctctctggcagaggcgccggccgcccgccgccgcccgcccgtcctactcgctcgccctctggcctgcttgcttgagaggataagaatagagagaggaaagggagaggataagaaaaaagaggaggataaagaagaggtgattgctagaggataagtgctagggattatatactatgcaccgatttttagtcccagttggtatttccaaccgggaataaaaagaatagggggcatacacttttttaaccaggactaaaaacgatctttagtaccaaccagactaaagatcataaaatagctatgggcttttcaaccggggctaaagatgatttttagtctgggttctttttggaaccggggctattaattgtggttttcggctaagccaacaaagattagttctccagtagggttgatagcataaactttagatggcacatgtgttatatcgtggtcaatattatattatctggttcttattatgcatgttggcaaagtattctcagccattatccatttctttttattgctggtgtcagtttaaattaattatattagtgctctttcaccgtgtcgtctattcaacgcgtgcaagtatatgaatatcaaacaattaataacaacggataatcagttcattaaaactcatatgtgctcagcttctataacaacggatatctatccaaagatcaatataattaatttacagtaactatgtcatatatatctgaacttttcatattggtagttaattttcaatatcatggaaaacatgtctatttttcccctgccagctgagatttaccagcataatatataagaagtttcttaccatccacggtaccacatatatttttatgataatatgtccttag

SEQ ID NO: 72285 - DNA, 36372 bp, Oryza sativa
gggcgaattcgagctcggtacccagtcgggattttctgcacacagttattaaaattcacaggaaatttgtggaattaaaatgagtttgatacgttccaaaaggtacttgggctcttagggttgtgaactaacggagcagcgattagcacgtgattaatttattatttgctattttttaaaaaaatggattaatatgatttttttaataactttcgtatagaatttttttaaaaaagtattatttagcagtttgaaaaggaggaaagttgtgaaccattggtggtatagaacgcagccttaggagacgatccaggatttcccttgcgcgtttactggtcttgccgctgcagaacggtaactacaagtgcccgaaaactatatcaagcattctaaaaaaataaaatatatttttataaaatttactcctggttatatccaattgttcacggatgtcgtggtaaggtaaagggtccatttgcatcttagcaatagaaaaacggaggaatagagaaaacataggattttgacaaaaatacaagtgtgcagggacctgcgtagtaccctaaggtcctgagttcaaatctcctatggagcgaatttcagattgggttgtttgcggggctaagttccctatttcaatggccgtatatatccggttggatgtagaggccgggtaaaaaatacccttctctaaaaaaaataagaaaaaacaagtgtaaaatactctctccgtcccaaaatataagaatttttggacctgacacggtcttcgagatgcttctttgaccaacaatatctataaaagtaagatgttttaaataaaaagagttgcatattatgatagtttatttaatgataaatatggttgatcttcttttttgctattaattgttaaagttaaaaatgtttgacttgtcactatgctaataatgtttatattttgggacggagggagtagatgattgaaaaatacagaaaaaacacaggaatgatcgtttgattgcaccacaggaaaaacacaggaatgagatgagaaacatagactcaaagaaatttttttaagaggttaaacatcttgctaactttcctccaaaatctctgaggattacccattacatacgaatttaaaaagataagataggattcaatcatttatttcaaatgcttccatagaaatatttttcatatgattcaaatcctccaacttttctacttttcatacaaatcaaagggccctaagacagatgcaatctggaccgttcatgcgtggtgcgtgcagaggagcgctgagtgcagcaccaccagggtcccgaaaagcggagattccccccttcctcctttggctttctcccccaacacgtcattccttcctttcctttccttctccactccgccatccgcaaccgccacgcaaacttcctctctctctctcttctcggcgcgaatccagaaccttctagaaggagagggagaggagaggagggcccccgcccccacgggtcgccatggccgacgcgtactggaggtacgccgccgccgccgacgccgcgcgccaccaccaccaccaccagctgcccctctccgccgcccccgccgccgggatgcccgccccgccgcctgctgcttctcaggtcgccgccgccgggcagccgctcaagcggccccgccccgccgacttctccggttcgcctcgccacacctcactccctctcctcgctggcagctgctcgtctcggctctgaagccggcgcgggtgttcactgtttatagggttttagggtctcgcagttgcaatgctcggctgttcttcttcggtcgtctctgggttgtctcacttgcgtgatatcgcgtgtgcatatcgtatcatgcatttcgtacttactgtttcttcgctagactgtagtggatctcccgacgatgcagtggcatttgttcgctatcactgaagctgtccatgaaaattgcacgctctctcggttttggtagcactgtcgctctgaggacactgttggattttgcgtgtgcttgatttcgatttaggatgacacctatcaacaatcctgcttgtcctataccatttttcacttataatttagtactagttgtggaatgatttagtcgatttaggatgacacctatcaacaattctgcttgtcctatgctgtttcagttatattttagtactagctagttgtgcaatgatttaggatgcagtagtgtctcgaggactgaggcccatatttactactaccacttttttcccttgcatagatgtacctggtgctcctgaaatggctggctattactctcgtgatgaagaaaggccagggtatcgtcctgcaagagacactgaggctcttaacgcttcctatgaacgttttctgcgcactggggtatcaaaacctgttcttaacacatactatattcaattccttaaacacattgtcagctgacacttttttcttctttttgtactacagcaaattcaatcctatggagctggagctggagctggacctggtgctgaatctattaggcctgcggcaggtggcaatgctggatacccagttgaggatcgtccaatgatggctggtgggggcatggaagccagaaatattggctttggtggtgggatgccagagcctccccttccaccagatgcatcaaatacattattcattgaaggaattcctactgattgtgcacgtcgagaagtttctcgtatccttaaatcccatgcctttttctgtctatctttaatctttcatttgcacaaattgtgggtgtaaattattcataatatgcctccatctcttagctgctggtccttcaccttcccccaagatatcttccgaccatttgttggttttcgtgaggtgagacttgtaagcaaagaagcaagacatgtaagtgagctttttggtgctgtcacgcctggtctcttgtttcgttcttgttcatccatctaagtgctttgctgttaacagcctggtggggatccaattctactctgttttgttgattttgaaactgctagtcaagctgctattgctatggatgctttgcaaggtgagtcagtgaactatagtttgttgacactgagccatttatcaccttttgatctcaaatttcttttggctgcgtaatgcccaattaaatctgacagctgtgggtacaccatgtgaagctgttgatccatctctcctatcagtgtcttatgagtcatgatattgaacttgtgtgttttcttctctatctttttccctgtttttagttatctcattgtcatgcatgcttataatttggatgctttgtttaccaagatctgatagatgcttgtgatggttggtaatttggggtattttgctaaaagccgacagtcagtttctttatggttgaatagaactcattcgactgaagtatttgtccttaaaattggtgtggagttattggccaagcagctaaaagtgggctgtgaaaatcttgtctgttcctaatttatcacctgaacattttgcttcacattgttaccatagctgtgactgcctttataatgcgcccccccccccccccccccacacacacacacacacaagatgttattgcgttgtctggggactaggcctgtggaaacactctggcagaaaatggcatagatatcaccatctatctatattactagtagctcgctggtgcttctcaaatggtaatttccccttcacttgacaacaactttagcaagctatattaattcccagtacggttatgatccacttatgatgcttgtcaatgtattctaattactgtgattcctaataggtagctgttagatcttgtttgtaaaaaggaatagctgttccatgatcatgtcaggcatctattgcctattttttgtagcatgatcaaagtaatcctgtcagtggccatctaaaacttttcaaggtcatgtacgaaaatagagtaattcgcacctgcaatgagttagttctctgtggtgtcttgggagtgagaaattacatggtagttgactggtcattgaaccgttcgtttgattgcttaatttccatgttttaaatcatgaaaattcatggttaattttgcaggctacaaattcgatgaacatgatcgcaattcaccccatttacggctccagtttgctcgttttactggccccaggggaggttcaggacctggtggtggtcgtgttaggcgttaagttgttcgtccttttatcaggtgatttgacaactctggctgctcaatgtttttttagaaacaacttgacctcaagttcttcggtggaccagataacatgagtcaatcgcttttcctaccttgtaggcatgatcacatcgaatgttcaagtgaaatgatgatagttcgttggtcgctctagatatattactccatagtgctaggattggtaaccttctgttgttccaagttccaactttggtgccttggctttgtgagatgctttctgacattaactagttattaaacatcaaagctgaaaacaattcgtggcatcgtgcagatgtgatgcttatggccggttatattgggatatatatatatacttctggagacaattttgccgattaatgcgtgttgggagaattttggtgcacatcacatatttgtgtacaacatattatctcccttccgcgtggtgttatatttagtagtctgttctggtttctgatttgcacgactcggcatgcttacattgttttgctacttgtaatcctctcggagattctaaaatgcctcctctggagcgaaaggtagaaattttacagctgcttccatgactcagaaatttcacatgttttttgctgaaactagtttaattcccacaaaacccctccaaaattatgtggtaaatttagatatgaatacctttgaactattttgcttgatgtgggctatgtggcctaggcctgtttagattcaggggtataaagttttggcgtgtcacatcggatgtacggacacacatttgaagtattaaacgcagtctaataacaaaacaaattacaaaatccgcatgtaaaccgcgagatggatttattaagcctaattaattcatcattagcaaatgtttactgtagcaccacattgtcaaatcacggcgcaattaagcttaaaagatttatctcgcaatttacacgcaatctgtgtaagtagtgatttttttcgtttatattaatacttcatgcataagtccaaacatttgacgtgacagaaggtaaaattttgccaatgtgacggaaggtaaaattttgccagaatctaaacagggcctaacagcatggagcaggacgatcgcatcaatcaaccgtgttatcctgtacataataaataaataaaagataccatcgagccataaaaaatgctgaaagagacggcccgcttgcctctattgtaaggcttgtagcattggatcgaacgaattgtcctcctcacagcgacgcaattctcccaaatctgccgtttcattcgtccattagctgaaaaagaaactctacaatctatctataaacagaaggttaggtacctgtgtctcaattttctcactgatgcctacaggtccggagtaaaatttgccgcaccttggacatggactgaaccaaaactttgcagatgcaggcagatttttgcacaaaaagtcaagagtccacataagctactccacggctactagctacaaaggcaggcactctggctctctggcacactggcacagctcccaactcctcccattatccatccatggcgtcctcccatcaccaagaagtacaagagcaaggccatggagatggagaggaagaggaacaagataatagccaaatcacctctccactgtgtaagcacggcaaagcctagtcgtctcagctgttttctttttcccgccatggaacaccactagaagaaagcaaactgttctgttgcctgatgagttcttctcgtgcagtgcgatcctcaatgcggctcggctcgccggaggagaactcgccggtggagcaggtggcgctgacggtgccggtgggggacgacccggcgacgccggtgctgacgttccggatatgggtgctgggcacggcgtcctgcgtcgtgctgtccttcctcaacaccttcttctggtaccgcaaggagccgctcaccgtcacggccatctcggcgcagatcgccgtcgtgccgctcggccgcctcatggccgccgcgctgccggagcgcgtcttcttccgtggccggccgtgggaattcaccctcaaccctggcccgttcaacgtcaaggagcacgtgctcatcaccatcttcgccaacgccggtgccggttccgtcttcgccattaacgtcatcaccgccgtccgagtcttctacgggaagcgcatctccttcttcgtctccctcctcgtcgtcctcaccagccaggtagaggtgacatcaacgtgctgcagtaataacagtacaaggtgtcatgtacactcatgttcatgaacttgagcttcattttgtaggtgctgggattcgggtgggcgggaatattccggcggtatctggtggagccggcggcgatgtggtggccgtccaacctcgtgcaggtctccctcttcaggtaataagcaaatagtaattcacaataatttactctccacatgtgctataaatctgattattcagatatagcttgcctatgattggttaaaaggagttgaattgccacttgtaaagtaatctttccaccagtagaatacattttttttgcgtcgcatgatgtgtgcagccagttgcttgcaattgatgtgttaataaggtacagctaagtgctagactacccaaagataaccaaccaaccaccttcccaaatctcaaaaccaacgtcaacaaaaaaaaagatactttgaactttgaaggacaaataagggtttttattaagctggtgttcaagtcgtatgttgtgtgaacagcactgaatacgatggcactgctattcagcaatatgctaattatataaaaaatattatctgtcctatatcatggttttgtcattttcattcataataagcagagatatattggcacatcatgaattgtctaaaaagtagatattgacataatgactcaagcgaacaggaatcatttaccagtcaattcaataataaaacccacccagcatcatcttcatctgaattctacgcaacaattaggagatttaggcgacttggacactcagctatgcaagtgcatgctgctgcagaaaaccagaattccgtgtatttggagatatcctgagtaataaaagaagcagtcaatcaattttgacagataaaattcaaagaaagaaaacaagatatataaaatatcatatcacttcaattatagacgaagagcagctattaaaactataacaagatttttcgtcccaaaccaaggcataacaattttccatttacgaccaaggaaacaagatcagttacaaccagcaacaagcatcaactaaaccttatacaatatcaagattcatttgagtaaacccgactagacattttaaaacaagatgtttacttccctagaggcttcaatgatttgtcagaaaaacatggatacaatttgtctgcaaataaaaaaaaaggttcagcattttgttgagatgacacttataaatcataataaggcataaatctgtgttgctctgccaatgagtgaattcatctaaaactttcagtggcaatctgaaaagtgagcttaatagccatactggacacacttgcaaatgcagaatcaaattagcagtaaaataataactttctccgtagtcaaaggatggctaaaaaaaaactaccatagaaaagtgaataacagatttgctgcacatgttcatcagggcacttcatgaaaaggaacggaggagcaaaggcggcatgacacgcacccagttcttcttggtagcatttgtgtgcagctttgcctactacattttcccaggctacctattccagatgctcacttccctctcctggatttgttggatctttcccaaatctgtgctcgcacaacagcttggatcaggtctccatggccttggcattggtgcaattggactcgactggtcatccatctcgtcatatctcggaagcccactggctagcccatggtttgccactgccaacattgctgccggcttcttcatctacatttatgtaatcacaccaatcgcctactggattaatctctacaaggcacaaaacttccctatcttttcagatggccttttcacagtgactggacagaagtacaacatctctaccattatagactcacagtttcattttgatacaaaagcctatgagaagaatggaccattatacatcagcaccttcttttctatcagctatggtcttggttttgcatgtcttactgcaacagttgtccacgttcttcttttccatggaaggtatcctccccttccttctccctctaggtctattatgtaaaattagatacacagataaatttgtgacacctgtgtccagtgaaatttggcagctaagcagatcagcttttcaagataaaaagatggacatacatacaaagcttatgaagaggtacaaacaggttcctgaatggtggttcatctccatccttatagccagtgttgcaatcaccatgttcacttgtgagtattacatagaacaattgcagttaccctggtggggggtactacttgcatgtgcccttgcaattttcttcacccttccaattggaatcgtcacagcaacgacaaaccaggtaagaagtaaaagcataaaggcaaatgctaatgcacacatccaagtgtagcacttcagcttattatactgtatgtgacagactccaggcttgaatatcatcacggaatacatcatggggtacttgtatcctggacgacctgtcgcaaacatgtgcttcaaggtatatggttacattggcccacagcaagccctagcattcctacaagattttaagctgggacactacatgaagattccaccaaggaccatgtttatggctcaggtcagcttcactagtcacatgaataaatgggtgtattgcttgtaaaaaaggaggataagcagattatcattttattcagtgttgattatgtccctaatagcaattcaaaaatagcaggtggtgggcactttgatagcagcatttgtgtaccttggaacagcatggtggctcatggatacaatccctaacatatgcaacaccgagctcctccccccaggcagcccttggacctgcccttatgatcatttattctatgatgcatcagtcatatggggccttattggcccacgcagaatatttggtgatttaggcacttattctgctgtcaactggttcttcttggggggtgccattgctcccctcctcgtctggtttgcacacaaggcattcccaggtcagaaatggatcctacttgtcaacatgcctgtgctgatcgccggaatcagccagatgcctcctgccacttcagtcaactacacggcatggatatttgtagcatttttgtcaggttatgtggtctataagtaccgtcgtgactggtgggagagacacaattatctactttcaggtgcccttgatgctggtttggcattcatggctgtcttgctatatttatgcctaggactagagaaaatcagtttgaactggtggggtaatgatttggatggttgtccattagcttcttgccccattgcggaaggtataactgtacaggggtgtccagtggcaagtgcatagccaagtttcttctcatccacagtaccgccggcaatggtatctcaatcatcttaaggaggatgcaaagatcaaagaaccatgcagagaggctttaaacaactcaaaatgaagaccaaaaagaaaatgtccatatgttacaaggaagatgatactacaaggtgtaccgaatacaaaaataagtaaagttatttggtgcatgctaaattgttgccggtgacagaaaacagattatgataatagatgaactgaatttctgaaaccaacactgaattgaaagacagtagccatcgtccatagaaatagttaaagtctgaacatgattccacttacctgtaaaggtaacatcaggatcaccttagcctttaatcatcacaagaaccttgcaggaaaaagtaagaaattcagatgttacttttgctttgagggaaaatgaaacaatacggtcagcatgtaatcctgtatgaaacatggataatataaactgcattatatattgtttcattggaagtataaacagttctgattcatcgtcatgagctagcatatgctactagaatatggtgggaagtgcggtgctgttcacctactatcggcattccatgatttctcaactctataatacacacacacacacacacaccacgattgcaccagcttcagtgcagtatgactactcttacggttctcgctaggaaaataacagagaatgtgaatggacgggtgaatctacaaacgtactctttccgatccaaaataaacttagtgctggatgtgacacatcctagtacaataagtctagatacaaagatattcagattcatcatgtgtgacatccggtacgaggttggtttattttggaacggagagaggaacaaatacagcaagggggaaatcatggagctgttgcccgaatatacttaccacttgccatctcccgcaacaataggtgtactctgaggccttgagcaacacctggtggaatactggagatttggagtgcgtgatggcatcatccagggcgtgctacgcgccagcaagccgggtaggcatttggacgagcaccgtgtgagcgaaaccgacgccgcgccaccagtgtaactttgggaattgggagcacctcgagcgagcgaggccgcacgccgccggggacgaacaggagccagagccggttagcggaggaaggtcttcgcctagggtttaggaaccagaggcggctgccggcggagggcaaggggtgcgcgcggcgcaggagctggagaggtgagaagcgcgtgggcgtttggagaagaagcggatggtgaccgcgccggccgggggcgtgtggagcgcggcggcgaccgacgaggtcgccggcgcctgacgcggcttgccgcgtgtccttgaagatgggcctgaccgggccggccttttagagatgtgggtgggctggatgggctgcatttcgtgaggcctaatagcaccgtggaatacaattcagattagcggacgccaaaactgaagctcttcagagagagccaaaaaaagaagaagaagaagaagcaaactataacatctcttttggacgacacatcaaccaatgcaattcagttttgaattggataccatcaaaacaagagcaaaataacagatgaaagatggaagtataactttcagatgacacaaacttcaccatccatggagaaatataacacatgtttcatttcattctgattctgaacagagattacatgtagaatgaatgatgaaagaatttgattgtaataataatgttgtataataacagccggagacactaatagtgactgtgagagatgctgcccctgctaatctatctactgcttctttgctttctttcttctacatgcagctacattttgcaggggactctctctcaacagccaaaagaatatttataaagaattacaatctaaaaattgaattgaatttgatttaattgaatctttccacctatcaatctataaaacaaaaaactacacctttctttcttctttcttttctctgaatgtataaaagaattgtcatactgtatgaactaatcatcattaacaaaagaagcactgtaaaaaaaggctttgttctttctttctcttcacctaatcaccattcatcgtcagcttagctttgctgagaatgtgatgctgttgtggacgccgacacggtgctgcctcccgcgccgtcgcccgccggcgtccacgccgtcacggtgtacagcggctggtccagccaccggagcgtgagcgcctcgccgccgccgctgccgccgccgccgtgcgcctgcacggtgtacttgtccggcccgaacatcctcgcgatcatgcgcccctgcatcgcctcgcgctcgccgatgccggcgttcttgaacccgccgccgtcctccatgcgccgccgccacccggcgaagctctcgtggcgctcgaaccgctcggggccctcgaacgccaccgcgttgcggatctcccgcgcgaacatctcctccgccttggccctcgcggggctcgcctccggcagccccgccgcgtccaccgcgtcgaacgccgcggcgtagtaccgcagcgcgcgcgcgaaccgcgcctcccacctccccgagttgaggccgccgccctcgtgctcgccgaggaggaggatggtggcgcccgtgctgcgcgctagccccaggaagtcggtcagcgcggcgtcgtcgcggagcaggcggtgcatggcgaggacgcagttcacggccacgcactcgccgcgcttgacgtggagcatccacaggcggacgtcctcgagccggtcgaccacggcgtggaactcgaacgccaggccgagcgcggcggcgacgcgcgccagccgcgctcccgtctcctgcagctcctgcctcgactcgccgactccggtgatccgcacgtgcgccggaggcaccgcccgcgcggccaggctctggagcaagcccggccattggagcccctgcttgatgtcgaagtcgatgacgtggacgcgctcgtgcccctcgaactcgcggaggaggcgctcgttgagcgtgaagtgcaggaacctcgggatgggcgtgatggcgttgagtatccgcagcgccatggcgtcgtcgtcgccgccgccgaaggcgtcgtcggtgagctcccgcggcgggccgatgtcgaacatgtgcggccacatgcgcacgacgcggagcgcgagcgcctcggtgaagtaggcggccacgcggtgcatcggcgtgggccccgccggcgaggccatctcgccgagccgggccaggtagtagttggcggcctcgtggttgccggcggagagggagtcggcgcacgcggtgagcgcgcgcaccagctccagcgcctcccgctccgcctgccccggcgccggcacgccgttcctcgcgtcgaactcgggcggctgcggcggcggcatcatcgccgacgagccgccgtccgtgcccgacgaggacgacgagtcggacggcgacttgctgtactcctccttcttggccgcggccagcgatggccccgcggcggccatgccgtgcgggaacgccgccgcgctcggcaccaagaagaccttctcctcctccgcctcctctccttctcccgccgccgtcgcttgcatcgtccctgcaatggattgatggaaccatacctcatcgccgtcgccgcccatccgcgtccgcttggcgcgaacaatggggccatactcctcgaccgcgtcctcgtcatgcgcccgcttaacggcgcggtgggcgccattgccattgccgccgggctccggcttggcgccccaggacacggactgggtgaccggcggcgcggggtgcgtccggaaggagcaggtggtggcgccgctcctggcgtcgccggcgacccgcggggcggcgccgtcgccgcggctgccgcgcttggagaagccgcaggggaggatgtcgaaacgctgcgcggtgctcatctgatgcctcgacgacgagaacgagcaacccgccaacatcccggagacacgtcactcgccggaacgcgacgtgccaagaagagacctcctcctcctcctgctcctcctcctcctcctcctcgtcttcttcttcttcttcctcctctgtttctcactctgatttctctcacactctctctgtggtatctggctaaggctttggtggaatggaaatgtatatgattcgatgtacaaaagaatgagcagataaaaaccagatgatcttgttgttcttccaaagaatttggtcagtaaatcaacaaagaaaaaactgagaaaaaaagagagagaaataatgtttgtgagatcagatgggggctatgtgtttgtaagtatatatgcaggaaagaatgggtggcttcgccttagaatgcttagtacaaaagaatcaaagaataggatcaagaacaaatgggccctaaaacatgtagaaaaaacaaatcacgaacgatcggacatgccggggcagagcccgcacggcctcctcatcggcgacgacgacgacgagcagcaggcggcgaatcccaacaatacctccattcgtcaaaacaacaaaccaaaagaaaaatcaagaaccctagtagaacatcctaaaatgatggatgcaatgcgaatcaatggcgatggagatggagatgcagcctacaaactacgctatcctagtgatgatatgaaatggaacctactcttgttgcctcaccattaccactcctctctcactaacctctccggtggtggtggtctctgctctcactctctcactctcactcacctctccggtgtggtggaagggaagggaagaagaggccgggaggggcaacccaaggggaggaaaagagtgcgggaggcgcgaatctcgaggcggctcccacgccgtcggatcgcgaccggacggtgcgagatggggtggtccgggatgtgaccgttgcctgattgcctccccccctctctggtcaatgtgaccgttgcggtcaggtgcgacgcacgtgaccaccccccctaacgctgtcacgcacgcgtggacgcggtcacgcagcacgcccccgttcttttgttaccgttgggctcccaccacctgacacgcgtgtctgacgcgtgggcccccgcgccgaaccgacggcccagatcgcgtgagccggacgccacgcggtgcggccacgtcagcgcggcaacggacgctgagctgtacgtacaggctagtgtacagggtggggtacggtgtgctgtacgacgtactacgtggctgtatcctgcgtgtctggtgatgatgatgtttgtgtgtttgccaccgtcggatcgggacacgtacgcacgcatgcgtgtcccgtgttttggcgtcaatgcggggctcagttaatgatgtgccattgctgtcagaaaaaaaagtgtcattttggtacgtgacaaaataccgggtgttttacttgcagacagctattgtcattagctgggttagctgctggtatatttgttttggctactaagtaagctcgagttttgggtttgttttgatcttgaaatgcatcattgtgttgtgccaccacttttgagtcttaatttgtttcttcctcttacttgaaattttgtgggaaattacaagaaatgcgacggtgatgagtagcatcggatcaagctgtacaataaccgttacaattgaaatgactgtttagtacaaccgttatgcgttgccctagcttctactcctaaatggcaacattagtattgcctatctatgaaccactcgtacatatacgcctgtaatggttgatttgcatgatattttgctgtctaaatgttaacattagacgtcggggacgtaaattcaattaccaggttaactacatgtaatatttcacactgtagttcgcgctataaacaaacgttggtttgcttattaacagagtagtttatttcaagtttttttttcaaacaatgtatgtgaaccggcaagaaaacatgagattaaatccacaactgcagttcatagggtccacgtctaactactggagttactcataaattcatatccaaagagccatttgtatttcatacacacagcacctctctaacaggacgtatagtagcagtaccatccaggaacattatggtaacaataaatgaagtttcaatcggatgttattcctggcgcgagcttgaaatcttcaaatcgaaatcttaaaggcacatttcctaaatgtgtgttttatactaataagaatttaacttctcctctctcgtttcatatgtacgcatttcctcaattattgaacgatatgtttttataaaggttttctatagaaaaatattaaaaaacaaaattaatttagttttaagttttttatataatacttaatttattatgcattaatgaatggttctgtttgacatgcgcagcgagaagtttccaaccattttaccgagcacaccctaatttgctttacctaggccgtgtttagttccaatttttttttcaaacttccaacttttctatcctatcaaaatttttctacacacacaaatttttaacattttcgtcacatcgttccaattttaaccagactttcaattttggcgtgaactaaacacacccctagctaaccggagaaagtgtgaggtccaaagcaatagccgttattccgttacaggctttattacaggtcttcttatcgccggtcgtacgttggcccacaatcccggcccgctcaaatcttagctctaaccacgcggcccaacctggaatttgggcccactacacaactggatgttgggcctgatctgcgacaggtgccggcccatatagagtggatcgcggcgcatttaacctccttttccccaattcacggggcggctggcttgacgcgtcatcttccccgcgaaaatttcaaagcagccgaggagaaatccaaaatttccccccaaatctttcccggcacggcgccctcctgctccttccctcgcaagccacccccgccgccgccgccaccaaggcgcgaaatccaaaattcgcgcgcgcccgccgctataaaggcgaggaggggatgcctcctcctccacacccactcgccgagccaactccaatccccaaaccaccagatcgaatcgcggttgccgcggcggaggcgaggaggaagacgaggatgccggcggcggcggcggcgaagacgctggtgccagcccgcggcggcggcgacatggaggagccgctgctggcggagtcgtcggatcgcttctcgatgttcccgatcaggtacccgcagatctgggagttctacaagaaggcggtggcgtcgttctggacggcggaggaggtggacctctccgccgacgcgcgccactgggacgccgcgctgtcgcccgacgagcgccacttcgtctcccacgtgctcgccttcttcgcggcctccgatggcatcgtgctcgagaacctcgcctccaggttcatgtccgacgtgcaggtcgccgaggctcgcgccttctacggcttccagatcgccatcgagaacatccactcggagatgtactcgcttctgctcgagacgtacatccgcgacgacgtcgagaaggaccgcctcttccgcgccatcgacaccgtccccgccgtgcgccgcaaggccgactgggccatgcgatggatcgacggcggcgagcgcttcgccgagcggctcgtcgccttcgcctgcgtcgaggggatcttcttctcgggttcattctgcgccatcttctggctcaagaagcgcggactcatgccgggcctcaccttctccaacgagctcatctcccgcgacgagggtctccactgcgacttcgcctgcctcctctacgacctcctccgcggcaagctcgacgagtcacgcgtccaggagatcgtcgccgacgccgtggacatcgagagggagttcgtctgcgacgcgctccccgtcgcgctcgtcgggatgaacggcgagctcatgagccagtacatcgagttcgtcgccgaccggctgctcatggcgctcgggtgcaagaagatgtacaacgtcgccaacccgttcgactggatggagctcatctccctgcagggcaagaccaacttcttcgagaagcgcgtcggcgactaccagaaggcgtccgtaatgtccagcctcaacggcggcgcttcttgcaaccatgtcttcagcatcgacgaggacttctgatcacatcgactgccatagtagtattaaagtagaaatacatgttctcccaaagtgttcgtatggtttcttgttttatttgttctggtttgacatgtactcctgtaatgaatcaagtaaaaagtttctcaatacatcaactggtcattgcctgtatgcggtgtgttcgacgaaatgcttattagaactcatgccattctgggggcgcaaccagggcgttcgatgaaatgtctctgagcataagatgttccaagcgaaggagattgtgttggggaaatggattatggatcgcttggctccagccgcacgcgcgtcgcctgttccgtttctgttcaccaatccccttcccttcaatccttcccgaaagacgaaacgagcgccgcgccggcgactccaaccaaccgtccaacagaaccaagagttggagacttgctgacagctgactttagcattcgttttcccctgttggcctctcctacacatgaacacatctgttttagagctaggagagagtttaagagaaagggttcagatcggcgattcttgcagacaaccatggtatgattttcttgattattacataggagtacaatacaactaagggtgtgtttatttcacgccaaaattgaaagtttgattgaaattggaatgatgtgatgaaaaagtttaaagtttgaacaaaaagtttggaactaaactcggcctaatatatttttttgctgccttgcaaggttctaaagactatataatatatttttaggtgtttttttaagagattagagcttgccttcttcatgtttcgttgacacgttttcagattccagccgatttgcaatttgcaaatcaaggtactactatattgtacatttgtactactgttcttggtattatgtcagtcaggaagtatttatctagaagtgaaaaaggaaaaaaaaaaggaaacgagtagatgagttaactgaatcttaatgggagcaatcgagaagttctttaggaataatactgattcctttagaaatcccgatgaattggctttagttgttttcaacgagcaaattaatgacagttctagagaataccaataaggcaatagcatcaatcagaatgaagatgtcaataacttgagtgagcatgaaacctaacatgattcggctgatacaaattctgtgggtgttgatgaacaaccaacttttgctattgaatttttgatccaagaaattggggtaatcttgataataaagcaggagatatctaaataccgatttcagggtgcaatctctaccgaatcattgggccacgtggccaaagctaaaagcaagctcacatctcgttaaaatgtgccatgtgtccagaagagcacgttccattccgcacgactgtgaagactctagataaaacaaaggaaaaatccagagcattccaaactcggttgaaaatcacaccaaaacacggaaagaactggtgaaaaagattgcataccgaggaaacaatggagaagaaaaaaaagtgtctaaaaaagtgccccaagttttttaaaggaattttttttaaatctaactataatataattgtaatataattccactataactatactataacaatattataacttgtatataaggtcctttttagttggtgaaatgaaaatttttgggtatcacatcggacgtttgaccggatgtcggaaagggttttcggacacgaatgagaaaactaatttcataactcgctggaaactacaactatactatactatatattgtagttacactgcaactatactatagtaatatttgaaagtttttttttccaaaaaatataaacagcgagccgatgttagctgtcgtaaaccggcgacgaggaagacatctacaacagtattttccggatccacggaagctatttccaacgagcaagatccactcactcaacggatcaagcgaagggcgtcgagccgtaccagctgtgatggtccgcgagtgtggacgcatcaaccagccggtgagcgtcgaggtcgaacacgtccacgccatccacggtagcaacgaccacgacctcgagctcgaccacatccaggagaaagagagagggatgaagaagggcccaatgaggatacccagatttggaggatcaagggacgagggcgatgttgcctctgctaccatcatcttcctctttttctccttattctcgcaagcgtcatcttcctcaattgctcatgcctttctcccagcaccgacgcggcaatccggccttgttctcgcaagcgacatcttccccaacggttgtcgcctttctcccagcaccgacgtgccaatccttgttctcgcaagtgtcgtcttccccaaaggttgtcgagctgagaggtaaaaagaaaagaaaatattaaaacatgaggttttatcaacacttatcataaaacaaacaaatgataaccgtaatattgataagtatatgttaaatattataaaaataataggtatatttgttaaaatattattaaaataatgtgagcgatgatgattagatatacttacatgttgatttgtagaattaaataaattatagatgatgttatacgctagcatgagtttaaatatataaatattgcttttatctgtagtgattgggccacgtgtcctctctcacatggtagataaatctggagaacaccaaaaggggaaaaaatgataccaagagttgggcagttgtgcgtcgagtgcgaaggaaaaaacagggttgtgggtccaatcaatggcgtgcccacatataacttaccggtgtcacaggacaccgggtaaaattgttaaattctaactaatttatgctattttgattagtatactagtgaataattagataactactatgtagtggacctcgagtaatgtagtggaccccgggtaatttttattctagattcgccgctggctccaatcctcccttgcagatgaaaggataatctaaaaggatcgattaggcaatcagcaaatgcctctgtcaatggagccaatggtggccacctgctcaaaatgtatacgttcgctgtgtgtctaggagtacgagggaagagcatggctgtggcagctccagtcctctcacgcagaggaaggataatctggaagtatctatatatcaggggaaggagcaaatgcctctgtcaatggagctcacttgctctacatgtacatgttcaaagatagagtattctatagtacatttgcaaaaaatgttagaatgcatatacaactactcatattcatatatatctctataagtattttcgaaatattgagctgcatatcttaaatgaaaaaaaaaactattttatctcttcgaaccaattcaatggacactactaaaaaaatctatcatgagttaataacttaattgtaatttaaaaaaaacaaaggaataactaatggcatggatggaaaaagggagaaaatttgatgattttctcaacaatatgatctattacgttaaactggaactcaaaaaattccattcaactaagatttttttaaacttttatgaacaatgtgctaattaataacacaaaaataatatatacgggctataaatcatgcgcgccaggtgcgcatgattttctagttttagtggaaatggggcctacaagagaagaaaatattgttttttttgttgtgttcaacttatgaaaagtattattaggcgattggaaattggaatgacagttagtatgacttacggatgtttttgttcaataatataatgaattattatattcactattgcaaaaaaaaaagttatgagggcctctatctttatttcacccaagggcttccaagaagttaggactggccctgaataaaaccttcattggaatgaatggatgaattttcagtgtttgttttgtgagaatcgaactaatttcgatgatgatcctgtgaaatcttaaactattttctcactaattacttcaggctgtgtttagttcacatcaaaattagaagtttggttgaaattggaacgatgtgacggaaaagttagaaatttgtgtgtgtagaaaagttttgatgtgataaaaaaattggaagtttgaagaaaaacctttggaactaaacacggcctcaatcttcgtaaaatttctccgaaattcgtcaagtccaaaggctgcatgccttgctgaattctgtccacacaacaaacgctggtctcgtgtcatctccacatcgccggagaagaagacgatgatgacgtcgacgacgatggcgaggcccacgacgttgctggcgtgctgcaagctctacatctccgagagccgcaacgacgccgccctgcgcgccatcgagcaggcggcgcgcggcggcggcggcggcgccgtcgtcgtcaaccgcttcaccgacgacgcctacaaccgggtgggctacacgctcgtcgcgccgctcaccccctcaccggcgccgccgccgctccggcacgccgtgctcggcatggtcagggcggcgctggaggccatcgacttcggcgcccacgccggcacgcacccgcgcctcggcgccgtcgaccacatctgcttccaccccctcgcccatgcctccctccgccacgtcgccgacctcgccggagccgtggccgccgacatcggagacgagctccaaggttggtgctgctctccactcctcttctcctcaattttcacttcaagaaacaatctaatggcgagctcgccgctgccgaggccgcagtgccgacgtttctgtacggcgcggcgcaccgggaggggaggacgctggcctccatcaggaggcagctcggctacttcaagcccaactcctccggcgaccaatggcggggagcgccggagacggacgccctgcccgtcgcccctgacgccgggccggagaggccgccgagatccaagggcgtggtggtcgtcggcgccaccagctgggtcgacaactacaacgtgcccgtccacaccggcgacgtggaggcggcgaggcggatcgcccgcgccgtcagcgagcgcggcggcgggctcccgtccgtgcaggcgatggggctcgcgcacggcggcggcgtcgtggaggtcgcctgcaacctgctcgacccggcgagggtcggggccgagcaggtgcagggcatggtggagcggctcgccgccggcgagggcctctccgtcggcaagggatatttcactgatttttcccaggataaaatcgtcgacttatacttcagatcagcagccaacactgagggttaactgcagcgcgagtgaaaagtaaatctttacagaaataaatttgatatgatttcacagaaacaagctctcaaccagtggatcactgatgagttctaagttccaactcaagaaatgcaatcacattatcatgcgtaaaatttaccaaaaaaaacagaacaaacgaattgattcaacttaaacttcggtctctgctatatatatatatagagattacatctcaactgctggccagttgattgaactaatcatttgcatatcttgggctacttaactcctgactgattaagctaaacctttagtttgtaccgtgatggccacttgattgaagcggctagctatctctctagctaggctcagtgaagattttgcgagggaagctgagattttagaagaaactgagagtatgtctaaattttcagtgaaattccacgtttctctccattagagttaagtgagttttttaaagaaaattgttactatttccactagcaaggtatatgagacaatatatcgttttccaagtgttgtcactagttaccaattgtttcttacacttgccatctcataaacccactaacctcgcgttattaggtacccatatataaagaaaaataagcgatttaagcatataaactccattgcttagctcttaacattatagcactccctctctctctctctctctctctctctctctctctctctctctctcttataatagttgtataataatatgaaagggaagaagtgttattcgagttctcactttttcttttttctttttacttcaattcagcagactgatttttttatgacacatgatgtatggtatctcgttggcgtatctcagtgaaaactatcatgatggagaggattagaaaagtcagaatatcattggtagtataaaaaaacacatggaggcaactggaaaaggcacaaacaaatctaaccagacttagtttggactaatcagctcaggtcacagggagctaaatgcttaggcttgaacaacaactacagtaatcctcctgtccacttgtgaaacacaggtagaggagatgtagatccagaaaaggcattcttctttaactaaggctgagtttagatccaaagtttgaatccaaatttcagtccttttccatcacatcaacctgtcatacatacacaacttttcagtcacatcatctccaatttcaatcaaaatccaaactttgcgctgaactaaacacagcctaacctcaaattaaacaatcacaatggactgatccccagaaacatttcgatatccagagtcttcttgtgcattcatagaagaaaatattcagactttttgcagatctgaaccagcctttgtcagattgggaaaatagctgtttttgttgttgcaaggatagattcttacatacataccatggttggtggtgtcatgtagaagtagttagtttcagaacttgttggccggttgttgcctaccctgtttgtcactgacctggttagatatctctgaaaagaatgaaaaaaaaaagtattagctttgacaaacgcacacacccatccaataaaaaacaccattcgtgcaagtacaatcctgtggtctgtcattctgtaaatcaacaagaacatgagcagcaatttttcaacgagaacacaaaagatttgcgtgaataagagcaacaaaaccaggccaataaaccattcttgacacttgacaggatacagtgacactgtgttgttgcacatggtaatggcaatcagctattgagctcaccaagcactagcatccatgacactatgacagtatgacatcttgcagtttgcaacaggtgtccaccttccatctcaagcaagcacctttcaaccacctcccctctcttcctcccttctccacacgatctgaattgcacaacagtgaacgaatctgaactatctgaccgaggagatagcaaatttcagttcttgatcggtgattgattcagtgattattcccaaatttccagtagctggcaaaggggaggagaagtcagcggccatgctgctgcgtaccatgaagctcccgctccccgccatggccgccgtcgtggcgctctgcgccgcctcctacctcctcgccgtgtggacgcaccctgccccgccgctccccgcctcctccctcgccgccgtcccgtgcaacacgcggcagccaccggcgcccgcggcctcgaagaacgacaccgccctcgacttctcgatccaccacggcgcgtccgaggaggacgcggccgaggcgggggcgccgccatcgcgccgcgtcccggcgtgcgacgcggggtactcggagcacaccccgtgcgaggggcagcggtggtcgctgcgccagccgcggcggcggttcgcgtacagggagaggcactgccccccgccggccgagcggcggcggtgcctcgtcccggcgccgcggggctaccgcgcgccgctccggtggccgcggagccgcgacgcggcgtggtacgcgaacgcgccgcacgaggagctggtgacggagaagggcgtgcagaactggatcaggcgggacggcgacgtgctccgcttccccggcggcgggaccatgttcccgcacggcgccgaccggtacatcgacgacatcgccgcggcggccggcatcacgctgggcggcggcggcgcggtcaggacggcgctggacaccggctgcggggttagttacttttaccgcgtttacttctcagattaacctggtgatgatagtcactgactggtgggcccagtcccgagtggagtttttccttgttggttgactggtggtcaacgtaatctcgaccgcacatctctgatctgacggctagtggtagagtttgactggttgaggttgatattttacaatcgagtccctattttattttccaaaatttgtttgcaattcaatccctatgaaattcgggctgctatcaatatttctccaccacagttgtgttgttttcatgtttttttttactgtttcttgatcatcagcgcgtagatcagtgtacactttttggagcttgtgttgtgtaccagcgagttaaacacccatgattgtgtttcctagtgctggtttgtttgtagtgaaaaatttcctgatgtagcgagttaaacacccttgtttttttctatcgtatttttgccaaaatgtaggggaaaaaacccttttttttagccctgcgaaaaaagtatggttttttttctactgggtaaatgcctgtggatctccatgtagtcatctgtgattaacaccttcaccagttatccttgccttatctgtttgttaattgttggattaaaaatgccactaggatagttgaatgttcacaactagtactagacatagagtacatggatgcttcgaggacagacagcaaaattagatatatttggatcagcttctggatgtggatcaaagctggttttatgttaactaagtaccctctccatgtgtagagtcggtgtgagaaattgaaaaaagaaacaatggattaattgatgttaggtctgagtcggtgattgatatctagtttggtaggagagttcgatagaagtgtgcacatggaattgtgtactgatgagagcttatttggataagaaaatactaatcatagtccaactaaccagacggcagatagctttatctgaactcaactgtgcatctttggatctggttgctcgtactccctccgttcttaaaaaaaataatcaaaaatcaagtttttaaattagaaattggttttctttcaggacgaagagcttaccttactaattgatcattcttgctacctttgtgttcactgtaaagatggtacaagatgtctgatgcgacatatatatccagctatcaacactattgaacaaaatgtccaagacatgattttcttcccccttgttgttggcttgtgtttcttggctaacttcaaccggagtacgacgagtttaacactagtatcgtttacccttcggcctgtaatttaatcatcataaataaaacgatggttgtataaaacgcgtcaaataagatttctcgtaaacaaagttttttcatcagacaaatcatccttactcgggaaacactcatgcatgagtcaagctgttggctatgacaattgatgagaaatgcccaggggttttccggctagctccacagggtggtgggctagacgacttgggttcagagcttcacctcttctaattatttgatattaggtcatttcctaatatccgtgtcttctttgctatgacaattgacaaatcaatctgatgctaatgtgcactgtctactactctgaactctgaagtgtgaacgaaccacatgtgcaggtcgcgagctggggagcgtacctgctgtcgcgcgacgtgctgacgatgtcgttcgcgcccaaggacacgcacgaggcgcaggtgctcttcgccctggagcgcggcgtcccggccatgctcggcatcatggccaccaagcgccttccttacccggctcgcgccttcgacatggcgcactgctcccgctgcctcatcccctggagcaagtacagtacgtgctttgtaactccaccacctcaaatttcacccctgcaaaatcaaacttgtgcttaatttgatttggaagccaccaagttgacaggctttttcgaagttaaggacgagattcggtcaaacttttgaaattccaaccatccatggataatacctcaaatgcttattttaaaaacgaaagaagaaaaagtactaaagtagtatcattgtatcatacttattataataaaaaactagcatggtggcccgcgcagattgcgcggctagtatcattatattttctctcatataatagcatatatgttttctcattatattattcaaatatattaaaatgacaacataattttaaattttgcaataactttacaaaactactaatgtgtaatattcatattatattttatatatgtttagttattaattatttttaatatcaaattttagttatttgtaaattatatatattcctatatggactctagacttgtcttttaatatttattttttctaattccgaattttctgtaaattatatttctatataggctctatgctcttcttccaatattatttatttttatttttgaatgttcatattatattttatatacgtgttagttattaattatttttaatatcaaattttagttatttgtaaattatatatatatatatatacatatatatatatatatatatatatatatataaaatttaaaaataactatatatatatatatatatatatatatatatatatatatatatatatatatatatatatatatatatatatatatatatatattcctatatggactctagactcgtcttttaatatttctttttttaattctgaattttccataaattgtatttctatatagactctacgctcttcttccaatattatttatttttatttctgaatttttattatttctaattgtatttctatgtggactctaaactcatctttcaatattctttaatttttagttttgaatttcagttacttctaaattgtatttctatattgaccttaaactcttcttcccatgtttttcttaatttcgaattttagttatttgcaaattatatttttatacgaactctaaactttacttttaattttcttatgtttattccaaattttatttagtttaaaatccctatatggactctatactctacttctaatattcctttttttaattccgaatttcttttttttcttaattgtatttctatatggactctatactctacttctaatattccttatttttaattccaaatttatattatttcctaattgtattcttatatggactctatactatacttttaatattccgaatttctgttatttcctaattgtatttctatatggactctatactctacttttaatattccttatttttaattccgaatttcagttatttcctaattgtatttctatatggactctagtctcctcttctaatattccttatttttaattccgaatttcaactatttcctaattgtatttctatatggactctagtctcctcttctaatattccttattttttaattccgaattttaggtatttctaaattgtatttctatatggactctgttttttctttttctccgattaatgtgagaatttctaggccatgagagcgaacgtagaaattctattcctttaataatataatagatttttggtcgggaatttcgaagtttgattaaatcttgttctaaacatcgaatatttatgatcggaggggtagctttgattgatcatggcaatatcaacaatggttgttgcatttcagacgggctctacatgattgaggtggaccgggttctccggcccggcgggtactgggtcctgtcagggccgccggtgaactgggagagacatttcaaggggtggaagaggacgccggaggacttgagctccgagcaatcggccattgaggccattgccaagagcctttgctggaccaaggtgcagcagatgggtgacattgctgtttggcagaaacaaatcaaccatgtcagctgcaaggctagcagaaatgagcttggtggtcttggtttctgcaattccaaccaagatcctgatgctggctggtatgcatgtttatcacctgaaaatgatccaaacatgattccattcgaatgaaaatttaagatttgatttgattaacaatatgtagttttacacattataccttaaatctgtagtttcgtggtaaactcggcattaaatctgtagtttttttatactccgtcgtaaatatgtagttttacaatagtttggtcaaaatatcagtagttttacgaaaaatactcaaaaacatttataaactcttaaaaaaatgttggcttcgtttctgaaagttcttgaaaaatgatttcaaggtatgtgaacatggaagagtgcatcactcccctaccggaggtgtccgggcccggagacgtcgccggaggggaggtcaagagatggccggagaggcttacatcgccgccgccgaggatcgccggcggcagccttggaagcagcgtcacggtggacacctttatcaaggattctgagatgtggaggagacgagtcgatcgctacaagggcgtcagcggcgggctggccgagaaaggccggtaccggaatctgctggacatgaacgccggcctcggcggcttcgcggcggcgctcgtcgacgatcctgtctgggtgatgaacgtcgtgccgacggccgccgttgccaacacgctcggcgtgatctacgagcgagggctcatcggaacgtaccaagattggtaagctgaaaattcttctgaccaaaatatgttcagtgtcgttgctaatgcaaaatcttcagaaaacaattgcagaccagcatatgtgcactgctttcttcttcagtgtattcattgctgcaaaatcttcaaaaaaaaaaataaaattgcagactatcatatatgcacaggcgtgtaagcggattgacccgtgaactcacttataagctaattaagtggatcgatcaactggttacccacttatttggcgaataagtgagttggtgggtcagcccacttacactccagcactgctttcttcgtcagtgtatttgttgctgcaaaatgttccaaaatttacaggtttattggtctttaattagtatgtgaaaattttgcaggtgtgaggcgatgtcaacttatcctaggacgtatgatctgatccatgcgtactccctgttcacaatgtacaaagacaggtactggattttgcttctgtttcttgtgctcaactttgcagttgctccagccatgaagctagctgaatctattgctgttctctgcatgtcatcagatgtgaaatggaggacattttgctggagatggaccgtgtgctgaggccagaaggcacggtaatattcagagacgatgttgatgtcctggtgaagatcaagaacatcgcagacgggatgagatgggagagcaggatcgttgatcatgaggatgggccgatgcagagggagaagatccttgtgtctgtcaagtcttactggacagcctaagggttcgcaaaaatggcattcatcatgctgatgatcattttgagctatagattggaacattggaggcagatttatagaaacagatagtttcagttgtcccccctcttctagtacagatagtttcagttttctcctgtcttctttccatatataggttctttattttcttaaaattctctcatattgttttagttttatcctttccatttcatgccatatggagtagcttttttttatttacattttcgttttctcctttctctttccttccatatatgtcttttcttattattttatctgtcaatttatctgacgtaaacggatattaaagaaataggcaccatttttgttaaggtgtgaacagtcactggatttcggattaacatgatacggagtatacatttattacgttcagcttctttacggtttagaatgcggttaaccagaattgactttcatctggtaaaattaaacatgccgctaaacaagggaccataacaaatagagtgaaatttggaacaggacagccaagtttgtccccaaaagctcgattggttgagcagtctgaagatgagaagcaaatgcagattgacagaggacagatgatcaagacatccttaatacaatctagaagttcgtatggtaatcacagtatggtacatatgaaagaaatcaactgacctaactcgatacaaacccaacaaaagaacaagggggtcccaaagtggcacccgatcacatcaaacatctctgcctcgaaggacccagtattgtcaagaataacatcagccaagtgtaaaataataatacacaaggaaaagaagagccgcgatgagaaatgtgtacattacaaaggcagctgggttctgcttttaacaaccatgtccgtgccctactgaaatctcagttttctccttatacttcatggttgctaatttacatggataaactctccagctctttgagaaagcggtttcaaagatcatatacattgctaaccaatctatcactcgtgaacaaatatgtttgtagttcaattcgtcaggcttccttacagaacaaaccacaaatcaatttgagagctggaatcttcctgtcggtttcctctttcgccatccctgaacaaacagttcaggacaaataagcaagccaacatttttccagattttcatacgaattgactgaatactttggaagaatgcacttacaaatattgcatagtaaaagagtgtgagtatcgcaagagccacaaagccatactggaaaacattgtacctgcatattcagatgttaaaatcagaacattttcaaaagtttgatgctccaatatccaccacatggatatatccagcttattcgagcaaacaactgtaaactgactatggatttgcatgctagatacatacttgtagagatacttaattccacggagagattgcagtgtgtggccaaagatctcctgagctgcagttgcttgcgcataataagcaaaagctgtggcacagaactgaatcacactgcaaaagattttagatggcctcttagtggagaaaattaacagataatcagcaggtatgcatatgttatggaggaagcaaggttgatgaaaccaacaaagtcgcatgtcaacatgttgaagcgatttttcagctgcactaggcacaagctaagctacgtcaactcaatgtttgctttacaaaagttcttcatttacactactgctaaccgttaaaggacacactgattttatatatagaaacaatttcagatatatgcaacaaattcacaattaatagacgctaccttgtcagcatggaaaaagttccaatatggaagatggcatcataatttacaaaaataatagcaataaacaattacatctaaaagaagcctcagtagcacacctgatggagcaaagtaggatgagtccaacattaaacaggaacgagttcatcaaagttcctccccatctgaaaaaaaatgcgttatcaatgattccaaaaaagatactacatagaaaaggaaatgccatgggatatgtcaaatacttcattgggtgaatggtgatgaaaactaatttcaaacccagcatcatttccccagcaatcactgctatgaggagatagaaacagaagaatgcaaaggcagcagtcccaagcagacctaatacagaaaacagaatattggtcaagctactgtcatcaataggacgagttcagaacaatgtaatgaacagaaatataccccaaacaccatccaattttacgaagatttcattcaggaaggaggacaaaggagggtcaatcaacaagtatatgacgatatgtgcaacccaagcaatcgatataattaacctgagatcataagtagctattagaagacaattgcagataggttggactagaatagaagcaaagtccgtacaactatttacacatacccgacagcaccaaataaaagttttccaatgtaaccaagaactgtcaaagcccaggtagcctcagcctgcaccatgatggatgttaagccagcaataaaccaaaagaaacaatgtaaataggatttcatgttcagttacctgttctccttgagggtacatctcttcaagagccttcatgtcatcttctaaaagtactaattcctgatgattaaaagggcaggcaaaacataataagagcattaatagagcattacagaaattattggcatgtggtacacaaatggacacgagtgttctgattagaaaggaaatggaacacaaatgcttcttactccacactaatctcaaaaaggtaagtttgttcactgagtgaggctaaaagtttgaatggcaatgctcaccttcccaagggccttgacatttttgcgccattttctgcccttcttcccacttttctcttcttggtgaagggcttcagctgctttcttcaattcccgagccttcttacctagttcagttgcttcctgcagaaaatatgttcagtctcaatccacattgaaaatttcaaagtgataattatatgtagtagaaaaatatggttctaatgaatgctcataattgaaaagaagtatgtgagaatataggcacctttatatattgtgagcgtgtaatgacagcttttgggcgccggacaaatgagaatataagtcccaatggaaggcaagcaattccaacaccaccaaatatctaccaaacaggaataggaaagttgtaaaaagaaaccagcatgattgcagcagaattggatgttggaaaggatccatatttcaaattgtttctagtacagcttacactcaataaaagacataaagctatcggtcacatgcagaccagtagagtgaatagatgtagctatacagaaacggtgataaagcaaaacatgaagattgaagtaaaactcactgtgaagagaacagatccaacgatggtagcaagagcaaccacatattcagggaaggtagcgcgcattgtccaagttgtttgagagttagcaggtgcagtgtaagctgcgcactgaataaaacaaaccgtaaagcagtttagtcgtagataaaatgccaaaagaaaggtgtcgatcaaatgttgctattggatggggagcacataacatcattactataggcataagaaagcataatttgattgattgactaacctgcttgggcgatgtactgatgcaaggttgaccagttgagaaactagtgaatgaatttggaaatgtctcaactgctgaagaaagatgcctgacagtgaagtccactttgccaacaagtcctgcagcagaacaatgaaagtgaggtcatgtaaagtgaaagcatcccaaacccttagaagccacggtgttcacaagaccactttttttttccttgaaaaaaaacccttttttttgcagagggcattcaagggacctagcaggagttcattttaatacatcgggtggaagaaagaaacaaggattatataagaaacagcgcaaaaacaaaactaccaattgtgaagctacagactactggtcgataagaaaacaatttgcgggtataatgtggaccggggagatatactacacaacaagtgcaaagctcaaacaggacaattcagatctggcagctgccttcctggtttgtacagcattgattgctcgaaaataagtactaattgaaaagctcaaagcttgagctagtcactccaagtgaagccagaagaattaacactagtaaccaaccaactcaagattcaggtagaacaggtcacatagcaaattcgaacagattcaaaaatcccactccaatattactactagtctagaaattttagcatgataggcaaaggagagcagtgatccgcaccgtataggatgccgaggatgaggccgcaaaccaccgcggagacggcgacccacaggagagcggaggtgagcctcttccccactgacctgcaggaagcaacaacacacggatccaatcaacaacattcagtgagagtttagcagcagatgcgcaatgggatagaggaaagagtggaaatgtatatgtatactacttacttgtcctggtcgccctcgtagtagaacatggcgaaggggatgacgaggaagacgaggacggcgtcggcgatgtagacggcgagccagagggtcttcatggggagggtgagggagcaggcgccgctgtagatggcgcggcggcaggcctggcggttggcgacgtcggcggggagcatgaggatggagaggagggcgacggtgatgccgaggacgacgacgagcttggggaagtaggcctggttggcgtcgtcggggtgctggtagttgatgagcaggtagacgctgacgagcaggacgaggacgctcaccaccgccgccacgatcaccagcgccacgttgaagtcccccatcgcggcacggtaccagatctccgctactgcgcccgcccgccggctagggtttgggcggcggcggcgctgcggccaccggcggcgtgcgggatctgggggatttgggggggaggaggagttggggttggggg

SEQ ID NO: 72286 - DNA, 652 bp, Oryza sativa
tcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactat

SEQ ID NO: 72287 - DNA, 9074 bp, Oryza sativa
  unsure (1)..(9074): unsure at all n locations
tcgctcccgtcgagttgacggtggctctcccttcccgccttgcatacgcgctccgtctgctccgcctcgggcccctgttcgcctctctccgagcagaacgcacaacgtccttgctccgtgcgcgtgaggggggcacccacaggacacccaccacctgttcgtggaaatgctcaacaccggatgcgtttctctggctgtatgtgcgggcggacttacaccatcatcgcatattcgcatgggcttcgccaagtgcggatgcagtgacaagcaatgcagagttgatgtctgttcgcggaagtgaaggaaggagaaaatcatggtgtggcgcgaagcggggtttgttcaagatgcaagaacagtagttggtgtttgctgttaccggcacgctaacaatagttgtgttctaagatgcgccggctttatttcctttagccccgccctcgacagcctactgtcaacatcaatttgtaatttgtaacttttctctctaaatcttgatgtactccctccgtttcacaatgtaaactattttagcattttccacattcatattaatcttaatgaatctaaacatatatatctatttagattcattaatatcaatatgaatatgggaaatgctagaatgacttacattgtgaaacggaggaagtaattggttggccatgtcttcggccaacccggctaaaaaatgttttcacccatgtcaacatatgacaccaactataaaaagatatcccttttattctctgtagtatcaaagaaaaagcagggtatttatctgtacattcttttattcttaatttttgtacacatatgataggacatatttcaacaggactctagaaaacaagaaatcaatggtactactactgtacacatacggtgttctgtgtattattttacaagctgcaatactatagtcatccaattgccttgaataaccatctggaacttgacacttgctctgtcatattcgtccttgatcaaattcaaacaggatattttcgaaatagtccaagattaactagatgatgttggagaccagggaccatgagatggcaactgcaaaatggaggtgccgcctggtatgtgtttactgcttaatataattttgaaccactgactctcaggattgcaattcggatctacggttaggcacttgcactgatttgtcgtgatatttccatcaggactggcctccaagcatactctggttccgttattggtgagttcagttgaaacatgcattcctgaatttgatagtagcttccactttgaactggatttgctgcaactggtgccaagctttgcattctcaccaacagacttcgcctggaggcattgtccagtttgtttgagtattaactcgtatcctttggtataattccaagcatttgatttatcacatggacccaactcaagtgcctctgaagatttcaccaagacacaaagcccagatagaggatggaatataacattgtaaggctgttgactgtttggaagcccgggacctggaggatggaatattcattaatatgtatagctcaaggaaatacagtgcatattgttgtgaccaaacttttagtggacttttacaagttacatagcccctttgcttactttcttgcacatcggcctgtgtatccatccaagtgatttcttttcaagggacacgttattctatgatgagggctaaaccaatgtgtgcatactagttaatgctccgatttcatatatgttccaataaatctgttccaacacaacccaaaaaggtgaaaaactgaaaagcggtccaattcaaccaatgaaatatgcacaggttttttctgttggttcagcaactgaggattcattataacttcaattttaccagagagctccatttttaatgtgattatcaaaacgtagaacaacagcacagttccagaaatcttgagagttgtattactaacaacgttgctatgtaagaataaaactgagataggttaagtacaaaccttggaatggtgattgcagagcattaatccttttaataaagctggggtttctagctgtacaccaatcccaggatagcaatccataagattcatcataagctagagtaccctccctgatataataactcccttgcagagcccaaatagcccagtccagatccatttcagctgccacggttaagaagcaggtaagatagcgattgtcagcgacatgtgtcccagacatgtcaaacccaaactcggagaaaaacagtggccagccttgctgaagtaggaacagtccttttttctttatggaatcaacaaccatcccacaagcatcgttttggttctgagatccccagtttccatcatctgagaaaccataccagtgctgctcaaagactaactttccagtaaatgttagctgaatttgatttgggaccaagaaatccagagtattgtcgaagttcaggcctgacaaaataacaagaacgccagggtttgccgcatgcacaacttcagcacccagttgcatgtacctaagtttggaatagattataaacgaaaattttccaatgatacgagtcacacataaaagccttttcaatacttctataagcaaaagtaagactcagtgtgtaagtaacaaacctgaaccacaaactaacatttttggagcctcggagctcgtttcttaaactcatgcccacaacattttttgtgttcctaaacattgttgccattgcactaaggcctttcaaccattcttctgggccaaagtacttgtcaccaaaaaagccattaccgtcgttttcgctgcagcaccatcctggagttgtcatttggttatcaagtataaccattatattgttcttggccaaagctgacaccacttcctatggttattaatttaacagaaggagtaaataatcagaattcaacacttgatagcaaaaatctcgtttactttatttcatttaatgtttagtacgggtaaactctcccagaatatactcctgagtatgtgaacacatgttttggtagattactaggtcaactaactagatacatcattgtaaaatgagagataactaatacatccctggtttggatttttttttttaaaaaaaggaagcagaccacctaatgaccccagttgccatctatcgtcagaacatattttacaaagaaagaatttatctagctagagactttcaaggcacccttatcttggaccatcaatttggtgactattaggaataatgtcatcttcacataaactggtttggaagagaaacaaaaggaaaaagggaaagctactcaaacaattaccattggtttttcctgaaatagaaaaggacgatcagattgttgattatgcttaaaccttcaacttgaaattgattgttcttattaaataagcaaaaaaaaaagaggataccctaggtttctttggcaagtcttgtgaaaagattgtgacgagatcatctgatttcaaaatcaataatctgcaaaattttgacttcttagcaagttgtttttgttaaattaaaccacatgacctgcagttggtttagctataagtcaattgattcattgcatactgttgcttccacaattaagccttatgcatcataatagctatttcttcagaaaaatgtaaaatttacatggactctgacttaaatgtttaaatgagcccatagctttcaacaacaaaaaatgtaaatgttcttctaggtacaacgttatctactccctccgtccacaaatataagcatttctagtgtttaaatttagtccacgaatattttctataaacatttctagagtatatttccacattccaagttttcaaccatccctcatagttatattccccatcccggtgaatcggatggtggcatggggattcaaccagggtacatgaaagtggtttcaccttaacctttacttaatttctcctacaactcttggacggagggagtattttcttgcactctatcagcgaaaatactgcttcctccgtttcatattataagactttctagcattgtccacattcatatatatgttaatgaatatagacatatacgtgtgcttagattcattaatatctatataaatgtgggtaatgctagaaagtcttataatctgaaacggaggtagtagcatctagcggtaagacacggtaaaatttggcgccatctcgaagactcgaactcgctaacaatagaaacagcttccatttcccatggtggttgttaaaaaaaaaacagccatttcttagaactgccattaataataagtttacttaacaacttggagaaaccaacgttgtcatttactccgtgtttgcttattcgaagagacgctcacctggaacacatcgatgaggggcaggtcgaggagtccggggttgttgacccggacgccggccacggactccggcataccaaggcgttccagcgacgctctcagcggcaggttcgccagcgtggcgttggtggcgaggtaggtcggccaggtgagcctgacgcagtttaaccccatcgccgccacgcgcgccgcgatgtccccaaggccgcggcgcgacaggccctccgccgccacgggctccaggtgcgacgcccagttcgcgcacgccagcttcacgcgccgcccgtccgcgcccaccacccaccgcgacgccgtcgagagcggcagcggcgggagcgacgcggtggcggtggcggcggcgagcgggagcagcagtagcagcaggagaagtggagaggaagaagccatggtaacaagtgtggccaacggtggcggatctgaggggggtttaaaaggaagagatgtgcctatgacagatggggccggggaaatggtgggtcccagctgcagtgtcacgtgcggtcttccgctctgataattagcgaaacgtgacagccgcggctcgtgcggttaagcggttggggcccaaagcccaactgcccaagcggactccaatggcgggcgccgccgacttcccagcggcggcggctctccccgcccccccaccgcgctggcgacggcgccggagttgtgcattcctcgcggcgtggttctctgcaacgtgcgagcgtcacgctggggtgccctcctcaagtcgggcgcgctcgccacctcgcccgaatccgtcgatgctctcctcgagctgacgccaccgcactcccggcccatggcaccttcaccgcccacgcgctccgcctgttcctcctctgcccctgctcgcctctctccgcacggttgtacagcatccctccctcgtcggcgctggtcactcggagccggaggacgccctccacctgttcgtggaaatgctcgacgccactggccccattctgcaccagcacagcacactgtcgcttgcacctctcgagcccacctcgaggatgtgcgctctggatttaggcgcggcgtccaggcttacaccaccatcaagcatgggctcatgtttgatcgtttgctggctgtggggatgtcacggcatcacttggtgcagttcgacgccatggaggacaacggtgcggtcacgtgaaatacaatggttgcggggacacttcaagaatgcaatggcggacgtatggtgatcttgagttttcttgacaaggcgccgaggttgttcgatggaatacaggtatgcagtggtgtgatgtggttgcatttgctctgtttggattgcaatgatctctggatacacagttacgcacatacgggcctatgtctggaggcacttactcttttcattgagatgcagactaccgtgctgttgctgaacccaaatgaggctactgtaagtcagtagtacataaggaggaagggtcttcctcttaccattgttcttggacttggcagtgcactggtggacttatatgcgaagtgtggatgcagtgacaatgcagataagcattcaaagttggtggctgcctgtgaggaactcagaggaacaccggggctcttctcatccatgtgtgaggccaatgttaaagcccacggacgtggcattcactggtgttctcctgtcttgcagttcacagctgcttagatgagtaggatcgcaggcattttgttagcaatgacccgggattatggcgccagccaaggatcgagcactatggctgtatggttgatctgttagtgcgggctggactgatcgatgaggcatatcagtttatcaaaaccatgcggtagagccaaatgcagtaatttggagtgcactagtttctgcctgcacagtgcacacaaatgttgatagtaacatgcaagatgcactgaggcatccactggacccaattagtcaatcacactggactgatccaggatgcattcccattgagttggagggtgcattctctttgagttcttcgctgaagacagtgaccatcccacccccacccccagctgatgacggagatatatgcgaaagctgaggagatgattgtaagtatcattatggccaggtacagatgatgtaaggctcgactttgatcaaaatgagaaggaagcctccgttacacatcacagcaagaagttgaccattgccttcagcctgatgaaactgcgtctcggtgcaacaattcagttatccaagaatctgagagtgtgcttggactgccactctaccacaaaggtgtacaacagggagattgttgtgcgtggcaagaatagatttcaatcacttcaaagatggttcttgctcctgcaatgagccaatgattactgatgagttgctatactaattctctctgctgagctttcttttatataggagtatataagaggcgcacctgatgtcctgatttattcattggagcagagagtaaatagtactccaaaatatcgaatatcgtttactgttggagtagtacatgtaacaacaattatcgtttactgttggaaggaaaacctgctaacctgctagtataaggggagaaaaagacttggaaggtactgtaacatcaagccatcaattggtgtgaatcgtgtgcagaccacatgctactgtgttacgcatgaattcaaatgagaaatcaacctctcaaattcgtgcttagcttttacggaaggaatacagtttgcattttgaatcttgaatactccagtcatcccattacctttcttaccaattacaacctccgattcttaatatatgattgagttgactttttaaatttgtttactatccatgttttttctaggaatatttgtgcaaatagattaaacatactagacatgtgtaaagtgttttgatgacgaatgtactggtatttttttcgctctaattaaataactaattgaataaatattgttggttttagttcaaggaaaaaaaaaactatcggtgtcatttattaaaaaacagacgtagagtactttacagcaacccttttttctgttttagtttatggagtataaatgaagtaacactatcaaaagtcaaagctgtcagcatttcgttttcttttcatttttgtattatcttttccatgtcatcgaaagattaaacctgctacgtttacatcgacaaagaaatgaagatttcatgttgctctgatcctaaacaaaagtagttagcacttggcagtcactagcgagtaggtgggtctgtgcctagacccacctgtcagtaactcaatgtcaccgagaatgtcacgtgggaatgtcaccgaatcccaatctagaagggtggttgaggggtactaaaaaagaaagaaatttgaatgtgtgtgattgatgggataaatagtacttgaatggtagaaagacaactaatttggaacggagggagtacatcattcgtgcattaactaattaaaacgataatgcttataaactcttatcggttgagccacagctaaagaggcagcggaaatatgaacaaaataatcaaagaaaatttatgaagaaaacttctattattggctgtttacaacttccctctcttaatacgaaacgtacgcaagtattttgggtattaaaaaaatatattggctgtttaaaagccaagttgaaaaattggttatgattaagaaaaaaaccccaaatgtaaattaaaactatatttcaaaaattaatatttaactgcagcaaataagcaaacaaagagacaatggccgtgtttagttcgtgtgacaaaatttttttaagtatacagacacacatttaaagtattaaatatagattaataacaaaacaaattacagattccgcctataaactacgagacaaatttattaagcctaattaatccgtcattagcaaatgtttactgtagcatcacattgtcaaatcatagcgtaattagtctcaaaagattcgtctcgcaatttacatgtaaactgtgcaattggttttttcctctacatttaatactctatacatgtatttaaatatttgatgtgacaaaaatttaggaggtttgaagggaactaaacaccgccaataattctgaatttatgatagaacagtacaagtcaaataagatatctcctcctgacatgacatatgtatagatagatgaacttagccgccctagagacaagctagagaacagcaaagacagcaatgtccatggcgtctctccaagctcctgagttccttgcgtcctgcctcctcctcgccaccattctcttcttcaagcagcttctcgcgccgtcgtccaagcagcgcgccgcctcgccgtcgctaccacgcccgagaggcctccctctcatcggcaacctccaccaggtcggcgcgctcccgcaccgctccctcgccgcgctcgccgccaggcatgcggcgccgctcatgctgctccgcctcggctccgtgccgacgctcgtcgtctccaccgccgacgcggcgcgggcgctgttccgggacaacgaccgcgcgctgtcggggcgcccggcgctgtacgcggccaccaggctctcctacggccagaagagcatcttcttcgcgcccgacggcgcgtactggcgcgccgcgcgccgcgcgtgcatgtcngaagctccttcggccgccgcgggtgcgcgggctccgcgacgccccggagcgcgaggcggccgcgctcgtcgcggc

SEQ ID NO: 72288 - DNA, 8191 bp, Oryza sativa
gtgaaacggagggagtagctagttgggacttgggagaacttcaaaacatatgctaaccattatcgtttcaaaagaaaatcctttatttttgaaaattacatggagggaacgggtacacagatacaactaaattgtatatagtggtcactactcattagattaaattgcaccagtaaatcgagcactgaaagaaatataagtgtgaatgcatttatattaattctactgatagatctgctcatcttgttgaaaataaattagtgtttttgttcatgcagcgtgcaccaaactgaccattttcctttttacttttgaaaatgcaaaaacaataaacatgttgcaggttctgctgccatggacaacggccattcagtaggtgggagtgataactgtcaagaaggaaagggtcagcttacggcgaaaaagatgcttttcaaggctgccgcaagccatgtactcgtaaacaagcagtctatgagagccttcacagcaatacccaatcagttcgactagatttggatggctaagttgcccaaggtagttgacttctgcctggaaacaaataataaaactataagtatctgatatatgctgtttaatcaaacactaatcagtataaaagtactctttcaatgtccttgcttaaaatcataaaatgtaaataagtcaggtaatatagaaactacaataacaaacaactattatgatcattaaattgaatcgtaaaatctaattagctgatgaaggctgatagacttgtgtatagttcatcatggtttcaaaaaaaatgaaataaagcaaggatacttaccaaccattccttgtcaccctgaaatccctctgggtttaattctttcacagcaacttgtgtggatggaaagcccgctctaacattttcatcaattacacctttgtaaacaacaccaaacccaccctctccaagaatttggtcaggccggaagttttttgtggctgctcttagttcattatatgtgaaaatattaacatttccgtatccttcgatttgcaggtcctccacatcttttggaggggcaaggacacttgctgtagctttagaatcagatttgcatttccttaacccatctggcccaccagcttctgcttatagaattaatagaaaagaaaaaacatcagggaataatcaattacatacgaacattaagagctacaatgtggcgtgattattttgccttagtactttagttttttaattcatataacaccccccatacagctcctgctgtgcagtctctgtaatgttgttgtgcattatgtcaaaatgataatctgataagcataacatcttagtttgtaaataccactaacctacccaaaatggtgttcatcttctaacttaagaaacatgtgttccattgtgtcaagctacaatgtcattttgcaatagctctacagcaacaaaagtattcattgatcatcctccacgttcaagtggcaggttaatgtgcagctaaaggccatgacatgacaaaggaaggtcccaatttaatttggtatctcaataaaattctagaatagctccaaacacgcatttgctgctcatggtcctatatgcaggacaacatttgtcatctcttccagtctctgaacaagaatcttctatgcagaacagaccatttgcatctaagttatagggttactcgatacttccatccaaccaacttaaaatcttctagcagctttgccaatgtagttcaaaccaagttatgagctaaatttgacttgctgcagtttgacttttcaggaaccgtgactgcaaatttcatagacaacataccagtacatcataatatcgtgtcctctaccagccatcaaagagcaaagtttgtaccatgcaagtttcgtctttgtcaaagaaaaaagagaaactaagctacagatagaggcctgaatgtaacgatgtccaataagataaaacttttagcacttagagaatggcattcctcacactcgacactcagtcacagaagaatcaaacatcaaccacgcgatgcctaaaaaacccgaatttgcaacacgagttactacatgatatagccccagagacaaaattgatcctgtcggaactctgacataaacgagacagcaattctcgctcaaaaaccaaatcttctgaagctgaatatacgctgaaaatccatagcccccaatacgcccaaaaacccaaccgcacgactaaattcacaaccaaattacaacaaaaacttcacttccatgcaacatgcacacagctactactactactacaagcaaaaacacacatcagagactaagtaagatatatatagctcgaggcaagaaagaacacggacgaacctgtcttgccctggagccggtgctcctccagcgagaagcatccgcccatgggagcccccaacaccgcgcctcccactccaatccgccgctccccctactcccgcctccccatcgccagcctcctgccagatccactcccaagaacacacaccaccaccagtccaccaccaccaacccaagccccgcgcaccaacccggaaatttcgcccgcaccgactccgccgcttggttgggcggaattgctccgccgccgccgccctccgaccgccggtggatggatggattcgcgcgcaaccgtcgccgaaatttctggtgcgttcttggatgcggcttttcttttttcctttgttttactttgggcgttggagaagacgaagaaagaaaaaaaaaacaagaaaaagaggaggatttggattagctgtgccagagggaagcgagagtaaaaggaagctgctttggattaataaatgcagcaggggaagcaactggggagctgagctgaggcttggttttttttttcctttctttttcttttctctcttgttgctttatggttggattggagaggcttggagtttatgggggtttgattaatgtgctgcatggttgaaaagaggatttggccgtgacagtggtttagtttgggttttagttaggatggtttttttttctttttttgactgatggcatcatggttaattggttattaagtgatatatggccatatgagtttatttggtaaaaatatagcatcatatttttcacttaattttactcatttttttctttatgtgattgattcaaatatgcgcatgtttatgtttttgacagattgtttcaaatgcttaaatttaattagccaaggaaatatcatatacgtgacacgtctggctaaaattagggtttgtttagatcccatgacaaaatttttcattatgtcatattgaatgtttggacacatatatagagtattaaatattaaaaaaatacatagattacgtgtaaattgcgagacgaatcttttaagcctaattgcttaatgatttgacaatgtagtgctacagtaaatatttgctgatgacagattaattagacttaataaattcgtctcacagtttacagacggaatcttaatttgttttcttattaatctatatttaatacttcaaatgtgtgtatgtatattcgatgtgacacgtcaaaactttacacccatagatttaaacacctcatttgacacgattaaaagacacaagaacaaaacaaagctaggtctttgtaataaatttatcaatgagtttccgagggacagaaatccctgtgctgtgcctgtgatgcccttttgagttttttgacaatggcacctgaaatggaagactagcaacaccaccagaccagaccgtcggttgcattttgcattgcgaattcgcaacacggccggagagaggtttgtctcctttagctgttgaacctactgcccaaagactccaagaaacggcagaaaaataccccaacacggcaacagcaaacagcaactccacacgaactctacaactacaagttcgcaaaacaaggggctgtttccttgtcccggttcagcgcatgtccccgattccaggtgctcctcggatttgtttttcttttcatcatcaaaccaatcgatcgatcgccaccaatccatccatccatccaccgtgcgtatcaatcattttcttggccaccatatgtttggtgttctgggagacgcaatttggcgtggaaaaacaatgtgattggcatggactcggtacgcctaaatccgaaccaaatccaagacaccacatgggggcgcgaggcgtacgtccacatgggagcagagccatctgtattgtagtactactagtactccccgaaccattttaaatgcagtgaccgtatatcttattttaaaaaattattaaaaaaataaagataataagttatgcataaaatattattcatgttttatcatcaaatagcaacaaaaatattaattataaaaaaaataaataagatggatggttaaacgttagacacggaaatttgtagatgcacttcaaatggaacggagggagtagcattgcatttgctatgctttgggaacgagttgttttgtggttgcccaaagttgcgagatccaggtttggaaggttccatggaatgatttaagaaatggcattagcgaggagaggggatgcttttgagtgggcggcagcatggcatgaatcaatcaaccaccgtgtcaaagtgctcgccaccacccccgtttctccactcggttttgtttgtgcttagcggaatccatttctgtacgccttccaatcacatcctctgcccactaactccagcaggagtacacaacttgttattacaagtgtgacagcttcatcatcatcattgcaataactcgaaatcttagaaaatactggtaattgcggtggtagagtagatagatacgaaaccaatctggagttgtactttggtgaggacgcgggaacggaggattttcggggcggaaaacgcccaaaaaagaggtcgccatccactccaccaccacgcgcgcgcgcacgcggtttgtctctcgcccttcttctcccggtcccccgcgtgccgacccctcctcctcgcctcgtctcgccacgcgcgctcgttctgcctcgcacgacgacgtacgccacctgccaaagcgccaacccagcgccgaaccggcgccgccgattttacatcggagaccttgatcgagcatttcacgtctgccttgtaaaaaaaaaacgtactactacatttaaatttaaagatttattagttgttttacttttaaactttggaactaacagtttatttatcgaggaactcttatacaattgctataaataaatgcaaactggatagttctgattgtttcgctgacgaagggcatgtagacctctcaaaaagcacctatgtagttctatctcttctctattttttaaaaacttacaaccaacaaattaatcaccttctcatgttctgtttatggaggatgtgaaccaacgcatgaacaaattaggatcaaagatgctagtggaagacaaaggggtggtaaagctaacaatcaggagtaatcgtatggcacagaggggcacactgtggcacacatagtatatgtggtagaggggccatcaacgactcgatgttaacgccaccgtggcagtgatggaggggctcacgtgatggcctgttgcggctatgtgacatgggacataggttagcgtctatagtgaaatggggttggtgctaattaatatggtagagcacacctagctgaatatcgagcggtgcgtcagtcgatgtaatacatttgacagagatacaagatgacgactcgatgaggcataggtggggaggagcacgtggacataatgagaataatcctacaatgatacaggttttagtgtagatgctacttaacaattcttattcacgggaaccgaaagattcaattcgtactttgtagggctggtgttgctgctgtctgcgtaggctactagtcttttatgtaccagtatctcaccgacgaaaaatgagagataacatactttttttctaacttttttttttctaaaacaagactatagtttaaattcaattgatttttaattagcaagtgcatatattgttatgtccatgcagcgtgagagctacacatgaaagaaggtccacgggaagaactagaattcggcattataaagggggtagcgcacgagacctaaaagtggatggatgcggagacaagaatttaaaaaggttcaggccctctcaatgagaggtaataccctactcctatttagggatttgaattcgtcgggttgtagtattgatctgacgatcggattgtgaatctctgcccatgccccttggagggggctccttgcccgccttatataggttggggggcagggttacaaaggaaaaacctagccggacacgttatcagtatcctaatctattactccctccatcccaaaatataagcatttttggaccctgacacggtcttcgagatgctactttgactaacaatatctatagaagtaagatgttttaaataaaaagagttgtatattatgatagtttgtttaatgataaatctaataacatcaactttacatgattgatcgtttttattgttttgttattaatggtcaaagttaaaaatgtttgacttgtcactatgctaaaaatgcttatattttgggatagagggagtacatggtagtacccgattggggctttataccctgccttggaatacaaggcaacatagcgaccgagtcctactttattacatattctatatacatgatctatcccctgtaaccagtcggatagcccagccgtgtgggtatgcggtactcataatctccgcagaaagcgtcggtgaaggatggtggattgattttgatcgggtggtgggggtcaggggtgtgcttccattcgcgcagggaaggggacatcatgcgtgcgagaatcgctcgagagggcatgggagtcaggttgagcttaagatggacgagggactgtaaaccaccgctatacttctaggccttaaggatttattatttcttacatttatagtttggaactaatggtatattttctagatcctttgtaacacactgacagtgtaagcttcttttttctatttaaagtttggaactaattgcgtatttattttatatcctttgcaataggttggtattctcgtagtattatataaactttgttgatgactatagcttggggccttggccaactatatgaaatgaagcttaacttagcacctctcaaagctggcttcgcttccattctatccattaccacttattcatgttggagatatgtaacaccctgaaaattcgaccaacgaaatcaaaacaccaaaaatacagattttcaaaaactttttaagtaataaattgcatcatgccgattttattcgcctatttcattggattttgatctcggaatttattaatcgcggataatgaataactaactaggaataaaccctaaaaatcaagttggctaaataaataattaaaatataaattaaaataaatattaggtgggattggaaatatataaaatattatcgcgaccatattagcaataattaaattttagtacgatggaatgagaattaaccctaattaaaaattcaaataaattatataaaataaatatgagtgatattaaattagggtgaatttttagttagtataacacaaatatggagtaaacttcatttatgcaaaagttagaatttataggactatatttaaatagaaaatgggctaaaatcgggataaataggaaaagttactgttcattgcggcataggtgttcgatcgtggtccccctggccccgcccccttccctgccgcgtgtgccgcgtcgcccgcccgtcgcgcgcgccgccgccgctgccgcgccgtcaccgtcgcgtcgccgtcggcctcgcgccttgtgccgccgcgcgcccgtcccctcgcgcctgcgccccgccgcgcggccgtcccctcgccgtcaccctgcgtcgctgccgcgccgcccattccatcgcgctgagccccgtgccgccgcgcgcgtcgcgtcgccctgcctgtcacgccgctcgctcgccacccgccgagtcgcagtcccatcgccgcgcgccgtcaccatcgccgcatcgagccccacgccacccgtcgcgtcgcccgtctcgagccccgcaccgtcgccggtcgcatcgccgctccgagccccgcgccgccatcgcgtcgccgcccgcgcg

SEQ ID NO: 72289 - DNA, 3467 bp, Oryza sativa
attcctgcagcccagaaacgcgctgtactgcgttgcatgcagcgtgacacgcttgaccagactgcaataaatgctgttaggtgagcacagctgtgatcacttatcccatgtatgtggcgcagacttccttaaggggtcggggtgcctcggccctcggggccggggcaagcgcaacccgacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagatggaaaagttgaaagtttgaagaaaaagttggaaactaaaccagcccattgaagtgaaagtctgggttcttatacaacttcaaattatttttttcttaggtcttaacctacagtgtatttagtagtactcgtaaaactaagaggcttgaatcagtgtttgttcagttttcttttttactttaattacgtgtggttgcagttagaagctaacaatgaaggtttcgtgactgcagctgcgccgcagcaacattaccctaccaaatagtctcagtaaaaatttaaggaatttaagttgcattggagttatacaattcttagcttctattttcatattttgtgtaataaaattttattctatgtgataatttataggccgtcaatgtagtgatttttttttttaactatccttattataatataataaatagatgtaaagtgagctacctcaactggttatattcgttagattctttttttagtggaattaactcactaggggatgctcgcatttacatttacttattgtttcagtggtagatgatatatcctcgatagtgatgtgtcattcaagcatactcttgtatctcacattcctaataatttccagatgggcagtgaaaacaaaaccatactccaaaaacaaactgtcaacaaacggacactgattcatcttatatttttccatcttcttgttgatttcctgtagaactgtaccaagtttgcaaggacatcatcatctatacagaaaagtcaaaaacactcgagcaacaacaacactgacacatcgattatgatgtggatcttcctcttcccagagaatggtttcaagtttacaacacgaacttttcgtcgcggcaggcatctcacattacaaatgctttccacaacgctcctctctacatacaattgctagtcggaacagcaagaaacctaacgaggtagagttcttccgccatcagaaaaaattttaacaccaactttgactctgatcgatcttgacaacaagatggatggatggcaatgcgaaatcgccggtagcgaaaacttgaatcgtcataaaaaacttctgtgtgacttttatatcttgtacaaatcctcgtccggtggatcctttatgcttccatctctggaaggggatgacaatgcctccaggcctggctgctggccatcagagtctggagatgggatgtacagcttgcattccaaagacggctcgctcttgctccggccattccctggccgtgttctcctgctctgaggcacgggttttccatttaccggtgccggtgccacggtgaccgtttttgctgctggttgttcttgttttatcttctccggctcgacgctctccgtagggtcctttgcaacctcgtagagtgtcactgcacccgtcatgcagttctgcaagagtatgtcttggcattcaggcatgttttgcacagcctcaaaggtctcaacaacctggctcatggtgggtcgtcctttgggattctggctcaagcatcggtacgcaaggcctgccacctcaatggcagccttggtggagtactgcccttccattcttggatcgataatcctgaacagcttccgattgtgcacgaggaggggacgtgcccactcaactaggttgtgctcacggctaggccggctcttgtccacagccctcctgcctatgatcatctcgagaaggacgacaccaaagccatagacatcacttcgtgctgtcagatggcctgtaacagatcaaactggttagagtaacaatttaacatacatgatgtcagctacaatgatatgcatattcatacttaagaacattaaatgcactcaagaatgaacgggttggcattctaaaaatacagggagattccattgctcacctgtcatgacatattcaggagctgcatagccataagtacccatgacccgagttgatacatgggtttggtctccactaggtccagttcgtgctaggccaaagtctgacagcttggcattataatcctgcagaggtgacacagagtgagactgcggcagtatcataagataatcgtcaacatataacatcccaagatctgaaataagatatttagatcagtattccttgtgcagagttgcatggtttaattggatggatgagggcacacataatatctactatttaaagtggaaccatggaggaggaccagggacaaataaatgattgatcaagtgtttcatttgtaatcgtccttacatactttttgctgtgtcacactaataaattgagaatattaaaaagatttcagtcgaaatatcagtggtaaacaggactgtgttgaagagcaagcgggaccagatccaaactggtacgttattgagatcgctgatgtttagaatcttactgctgaaagaattgaatcattcattcatcagaagatttagtagctttgaccatgctggcagcaactgaaaccaccatgacggtttggagggcaagcacactattctatcactacttcagaatcttggattctgtaaagacagttatgggccttatggctagcatgtaggctaagttatccggttaactgttagttctgtcattccaagagttcagaacaatgtaggaaatggaatcttgtctgggttggaaagaacaaagttgctagagcctgatgagatggaattcctataacaagtgattgaaaaagggtaatgatatcaaagtattcagatagtagatgaagtacaaaccgcatctaacaagatgtttgatgttttgaaatctcgatatataattgatctctcagctccgtgaagatattccagcccccttgcagcacctagagcaatcttcattcgagtagaccatggcatattaaggcaaacccctgttatcaattatcatacgagcaagaagataaatcaacaaaagtgtcctttagcatggaaaaatacatgttctctcaatagatcaatcaaaggtgagcaagccatgcagcaagaaaatcgtttcttcttttttcactagtagcgtagttagcatgtgcatgcagattgtagaatcaactaaacagttcaactcagacaaaatcaactggccaacttgatgatacggccggtaaattaaatacttcctccgtttcacaatgtaagtcattct

SEQ ID NO: 72290 - DNA, 71693 bp, Oryza sativa
  unsure (1)..(71693): unsure at all n locations
caaaatccacacgctttacctttggagtttggagaagagatgaacgaaaattccaaacatggacacttccaagaactgagcagatgatattacagctttttttcttgaagggaattttttttctgtttgaagggagatattacaagttttcatgtccaaaagcctttcctttgtaagcaaattgactgacctacttcaatagatgaatccatgtatttgctgacctaatatttcgagatacggagctatcctgcaacagataattagaccagcattattatgctgatcattatcgttggaagactgcaggtcgttgccaatggctgaaaaaaaatgatttattttttttctgatgatgcaaccgtggagacgctaagctgaggtcaggtcttcggtcgcatatggtagccctttgatcaaatcttaatgtttagatgtcatcatcaaagaagaccttgacttagtaataaaaagggaataatggtaattgcaaaataaacagatactaaattaaaatcaaagtaatggttcacacttcacaaggtgatccagtcttttattgcttctcttcctagttgggatgcagtgcagtcataaacaagaaaatgactacacgacctggtttcaggaaaataaaaagaaaaagaaaaagaaaagaaaaggactagatgtgatgcgctggaagtatagagataaacatgggtaaaaatattacagcttgtaagtaagaaaaggcactctgcacaagtaggtagcgtttgaaatagatttacttgttggattattgttgctgattatctacttcattattggaataaattaaatattttgataagtaaatttaacaaaatagtttagaacaagtagtctaagcaatgtttgacacttagcaatacaatagaagattttttttttaggaaaatgtatttctaaaagcatggagcaaagaatgcacatggtgaataagtttgtaacacctgtgatacagttagagaccaggatttacatttaacatatcatttttcagaaatcaagagacaagatgccctctccatgacaagaagttatccggagtgattcatgtagaagaaataaaatttaccatagcattacattaattgcatatgttttacaaaacaaacaatattacagtatatgtaacagttggacccctacctagcctagtccctttcagtcaagacaactactggacagtaaaacacttgcacacagagagagagagagagagagagaacgacttgccgatatataaatactcattgagccacccaccctcttaacaaagaattcgtccagccttgggaagccgagaagaggagagaaacaagagacagaccgccgagatagagtaactgagtaagcatctcgatcttggcatgttctttcttcttcccctttccatcaatgatttctcctcttgttttcctcatcacnaactcntgcagagacctgttcttcaacccaattctgctcttgttatattgcctggattcctttttttttttggttcttggaagcttctattgccgctgcttgttcttgagtgccctctgcaatttatagataattttcttcagtttttttatccaaaaagagttcttggattagttgtaaagaagaggttaaatcaaggaaggttgcatcttgttcttgactgattaattggtgtgccatgatctgcaggtaaacgggttcttgcctgacatttgtcttgtccgggtggccattcatggccaccgtggggcagcctgatgccatgagaaggatcaccgttcactacgtgaatccgccgccgatcgccggcgccggagaagcacacgtcgatggcctcgacgacgaggttcttgattatgtgattggtgatgttcttcaggatcaggtatgcatttgatccaacctttccatcattattagcatactgctcttacaggcttgcagaatgatgagctttagcatcaaacatatgtttctaagcctttgatatggcctctttactttagttcaacattgtttagtaaactttccactgtttctctgaaacttttttgagaataaacttatttgtttttctgaacttttttctaggagggtctgtatcaatcgatattgtatggcaaatacggggatgacatgagaggggcaagaaacactgctcttgcccaatctgatggtttacattactactatcacggagagaacagcagtggtgaagcaacaacctcgagaaattcagaaatcgaccaacagattgagtatgacttggtgttcgctaggcagctgcaggcaatggataatctgacaattgagacacctgcagatgaagatgatggtatgcattcattctcgttcagtttttgtaagcacttgatgtgcataatgattttcagtcgtggcaatcttaatcttttcacctctgaaattttgttgcccatgttggtttgattcagatataagctgcgtaccctctccatctgactctgaaaccgatgaaccggcagaaggcaacaacgaagaggtgattatatgagctgtttcagaattgcaattattcagcattgttcgtttcagacttcttgatgcaaagatacacaattgcgtattcactaaaaagatgagctgtttcagaataaagcctttccaaatggataatgtataaacatgtactacgaaaagttgagattcctatcatttgtttgcaggctgccacacaggatgataacgatgatccagacaacatgacatacgaggttagtgttatattcacttgtatcacatttcttctgtaaaagaggtttacaccatctatgaaaaagttgctgattcttattctttctgtaatccagcaaaggcaggcacttgtggaatctgtaggaaatgagaacagaggtttatctgatctgcttatctcctacttggagacatggaagtacaaatcaggctttttcccaaggaaggcaaaccatgataagtatgtctaccatttcagttttcaatcaatcacatactgatttcttgcagaagataatccaagcatgtaactgatgacactctgattaaaatcttcatcatggcatgcaactgatgatttcctcctcttttttctcccaaaattgcagctgtcctatatgtctatccgctttcagacgccgagaaacactcattacattggcttgcaagcatagttaccatgaaggttgtattgctagatggctcaagattgacaaggtaaacaccttcttgggacactagatttgctatctgaattgtgtacctatcttagattataccatttgtcaaagtttacatgagcactgatatgcactgtccatttcatataacaagatggtctttgtctttcagtttccttgagcttcttccaaattaaaagaacttcatgggcttgtgcagtggaattcctgacatttttgtttatgaaacaggcctgcccagtttgcaaatatgaagtgtttggaccttcctagcgtgtgaggaggcgatcaacaaggctgaccaactatgactcgatgagacggcatatagtggttgcagcatctgctctgcagtattaattaaaaagggaaaccttaactcccaaaaaaaacagagaagggaagaaaaagaaagcaaaaaggaaaaaggaaaaagaaaaagaaaagacaaggagaaaagaaatttgaaaacagagatgcttcgtcaagattgtgcatttttttcatgtttttttttggctgtgtacaagcgtaattttgacctgatcgactcaaggcagtcgctcgaggcctttaatttcgtaaagcttcatatgcatgagtgtgcaattgtgtgcctatagtagtatagtacatgttttctgtttgaaacggagtcaaagatctctctcctgccgaccacccatctaaaagaaggccatgtgtacatcaatacatgtactgatatatactccctctgtccaaaataaatcaacttttgtacatgtcaaaatcttcttgttcaacttgtacaaaccagaacatattactccaaaatcacaaaaaagaacatattactctaggagtactcgtcctaaataatttgtgctttgcttggcttggtaccagcaaggcagcaacaagtatgctatgccacttcacttactacctgacaggcagtccagctatgatatctctcgtttatagtgggcccatctggtagtggcaggctggcagctgccttacgtgtgacgccagcgaggcagcgggcatgggtggcgtgcccgagaagagacacgtggagtcgaacgagacaaagcaaaaacatgggctcacatccccaacgtccagaagaagccgccgctgcctcctctcatttcggaactctaaagcctcctcttatttcccacttctctcttgccgtcgacccagcgaaccctagccaacgagatcggtagctagaggcagccgctatagccatggatgtggtaaatgcagcaaccttggatgtgttaaccaaggtttcccatccgatcagttactgcacggttatcgtggtctgtgcttaccgcaagggagcggtaataggaactgcccagtatatcgacttagttaaaaagaataaaaaaatatatatttttggttaaatttgtctggctttcttctgttttgcaccgtaaccgctgttacagcggtgaaggatacccctcccctgacggtaagggaaaccctggtgttcactaggcactaggtggtaagggaaactctggtgttcaataggcaccaggctaagcagaccaatgcgtaggcaccacagatcagctagacagacaaggtggtggaataaagcctaataccagaagacgtctttcagaacaatgttaagttattaggtttgcatagttacataaacagtaacaaacttttttctgaagaagaatcaatgctatcacaattttaatatactgcctaagtaatcacctcacccagatcaacatgctattaccaaaaattacctacttcatggttagtgtggcatatgcaattgcatgaacgctggcttgctctaacgcatcccattaatataagttaaaattggataataaagaaactatatttttcatgtactccaagttcgaaacaaaccaggccaacatcacaagcaaaggctttatggaaacactagttattgaaagtttcgtttggtggaacaaaaggaatagacgaaattgaacggatgaacattgcagttaggaataggatgtgatcagaaaaacaatttttgcgctcacagataatccaacatgaagtcaattatgctcagagaacaaacgaatcatgagattcagtcacaaactttgcatgcccttggcagttggccccctaaagagaaaatttggaaagacaggagatatcaaaatacctgagaaattataatacattccaatagcagcatgtgctcttcttccccctttctgtttggaaaggaaaattttcaatcagctggtgatttggatttcaaacatatcacatctcgttatcactgaatcaggaaagatcggagtgattaccaaagcaagcaaatcccataaattgataaatacgacaacccccttgctgtcccctccacatcggaatctctcacccaactcaagagcaaccgcagccatggccgacaacaacttcggagagctttcggtggacggtgagcccggccaaccgggagggcgcggtcgcggtggccgcggcggccgtggtggccgaggaggcgctagcggcggcggccggggcgggggcggtggtggtggcggtggcggtggcggcggagccggcgggaaaggagggaaaggcggagccggtgggcacggcggcgccggtggcggtggtggtggtggcggcgggaaaggcaggaaaggcggggccggtgggcacggcggcgccggtggcggtggtggtggtggcggcgggaaaggcaggaaaggcgggcgcggcggggacggtggcagcggcggggccggtgggcgcggaggcgacggtggcagcggcgggcaaggtgggcgcggcggggacggcggcggcgttaggagctgcacaaacagcagagggacccagatgctaatgcgaattagagagcgggttgttaatgcgaatattaatttatatagtgagaagttaaattttttgtataactaaatttaacaaacagtttgaaataagtcgtataagcaatacagtagaaaattttcttctagaaaatgttttttaaaatgtgtagcaaataatccgtttgaataatttgatggataatctgatgtattaagctaacagcctaacaatatattgtttggatcattaatccgtgccctactatcactatctcgaatcttaagtgagagaaagaaagagacgaaaaaaattggaggcaatccaatagctagtctattttagattgatcaacatattgcgtcgggcgtccacaaactgtgattgtgtatgcatcccgattttattagtggactaaaatcacgcattgaatcctacatgtggaaaaagcggtctcccagcgttatattttgatcaatccagcgttatattttgattaatttcaaatgtttgggttttacttacgccgattaataatctacaatggaggaagtacatgttagctctaatactattaaaattggtagtgcttcaatttctaaatttaaatttaataagctctgttttttctaagctaaaaccatttgattccaactctacaacatgtggaataaaacccttccaacctgacctgaattaaacatagtcgaaaatcaaaaactctgtatacagcagattacaggcgggttttttctttcaggaactatttcaaatcccagaaaactcgtgcaaaatccttccattccaggattttggagtaaatcctactataaaaatttcttcgctgaatcgacaatcatatggcattataaagatacaaaaattaaaataatagtactaccactaaagtaaataatagtaatcgccagacgttgtcattcagcagtatgatgggcctcgatgtgtgctagcagaagcagctctggttcgatctcagcattccaagccaactcacttaccagcgcacataacgcttaaattacatcagtgtatcatcatcatcagaaactgtttcagacaccccaaacaaaaactccacatacccaaaacaaaaaagaacaagacgagaagctagaatctacggcagtttccatcatcaccaagaagccaagcaggcaagcatttgtcacatgttccatgagtagccaccacctgcctggtcacccaggaacagcccactctcctccagttcagtactgatcagattcccaagattgtcaagatcatccaactcatgcagagcatcagccttgggggtagccgcatggccgccgctgccaatgccgccgcccgcagcagctgcaacttgggggttgctgctcactgacttgaagctgttacttctgctggggaggatgctggctgtattgttgatcacactgctaggacctgttgtaaccattggagtcccacccttcaccgcgccgttgttattcatatgatccccgctagcggcgctgccggtgatagccgttcctcctgatgcaagaccactgttagcaggagcatgttgaagttgttgttgctgctgctgctgcgccaagacacggttgttagtgttcttggcctcttgcagcaactgatggagcacatgctgctgatattgtgggctcacacccaagccctggaggctgctctgctgaggcataggctgctgaaatgaggccggatgttggaactgcgcgagatgcacctggtttggtccacggaaggatctagatgcttccagctgaatgccattgtgcattgctgtgggacctttaaacatgcttgatgcctcctgctgaagcaaactctggtttgcgactgaacttctaaggatattctggtaattgttaagtgcagcagcattctgcagaccatttccaatgggattctggtaattgttaagtgcagcagcattctgcggaccatttccaattggtccaataccgtgcgtctcattcgcatgggtgttcatttctgttttgacacccatggctttgaggttagtctggtcattaggaaggccagcagctgccattagttgctttggctcgtgcatgttttgtactggaagttttgctgcagtttgcttgggatagctcttcagaccctctgcagatgaacagggaaaacattaaacatttcaaagcataaaaaaattgctgaattttacagggaaaaagggggaaaaacagctgcttcgctgttatcactgtattatctaaattggtatgctgttataatctagtatccagcaacaataataataatttaccaggtaatccttccatacggcaaccacacaccaccatagctagttcaaaaaccatgtttaccaagtgatatcataacaacaagtatatgatgttggatttggtttgccatggatatgcttttactatctagccctgtaagcattttccccaaacaatagaatatctctcaacacttcagaccaaaagaacttctaggcttatgcttattaccattttcatgcaaaacattgnnnnnnnnnnnnnnnnnnnnnnnnnncattatataatattgagcgcctagtcaaacaatagagaactgagtggtgaatttgcataaaccatacctataggaccaagcttgttcttgtggctgaattcaatcaggtctttcatgtgattcaccacctctgatatctgaagaggacacaaattcaatgaagatgctgtgtgcagaagtatattacaggaaattctggataatattatagcaaatgttaaataacacaaggagaactcgtgaaaatatggatactgttagcagcgagatattaataactaaagaaaattcaggagcttctttatggataatatcacaaaaataattaaataacctacaaatgctatgcttacctgcaagcagcgaacatatcttttagatagaccatgctcatttaaggtgtggtggtctatatttttcgctagctgtcgtgacgccgtcacaaacctaaagagcgtaatggggtgctgagatcaattagatcataaataaaaaaaactctagatggaatttttaaaaaatcatgatttgtcatgccagaagaggaattaaaattgcatgtcaaggaactagtggcatagttggctcactaacatgttgcaaatgttctgtgcatcactgtttgagaccccagctggaccactttcagtggcaacagtttgatatttctgggcaacttgcagcagatgagcaacctggaaaaagcacatatgaacaatgagataccaagtcaccaaaattggagtacaccaaagaatggcagagaacaaaatgtgcagaaaaaacagggatgtttaccatcaggacagcactaccaaaataaaaactagacaaggacggtcaagatggcttaaaattcgaaattatcttgtgtttttgcatgtgcagccctcaggaagccagtacataaattggaaaattaaacaagaatctaaatagatgttggagcagtctagcaggaaaaagaaggggctttttacaacccagcctaccaagattcgcaatattcatccaactaaaccactttattaaaattgcttacatacgtgttgacaactatcacataagaggtgtattgggtatattacagcagctaatctactatctgctctctattgatcaaagtttaatcaaataaaacagaacagcataaatctacctggggtgaaagaaacctgcgagtgatatactcatcatgtcgccgtgaacagaactcccaggacattatctgcatattttcacatgaaaacagcagataagaatgatcctaaactgtccaatcatttgcaacatctagatattcacaaatgcaagctattacaaataagcctttaccttcagttctggtgtgaatatgattctcaactgcccctcgtgtatcacatgcatatgttcataaatgcttttctgaacaactttagtatgttccagcagcattagtccattgggcaaccggaattcattggccatgtcaaggaataagtattcatctataacaccatggtcaaatctaatttgacagagtctaggaagtatttcataggtagcctctgccagataagattgaaacaataataacaaagtgagatcaacatcatacaatggaactgaactaatgaaaaaagcaaaaaagatcatgacttcttatgagaagaacacactagtactttaaaaaaggagcaaaatacaaagtagtccagggaaaaatatgttgtgaggtacattttgaagaaatggcaggtgcaaactgcacaatatatggtaacatatactatgcagaaatgcagaaccagaactacataacaatactaggatatcaccatgtagtttcaagaaaaatattttctgccagtctgaccaatcattccaagtatattcaagacagacaaagcctcttgagatataaacttcataggatactttcttttttgctcgtgatggctaatttctcatatgaaagatacactcaagataatacagttttatatatttgcattttctgtcttgagatgaggaggcaatctctatagcacaagacatgtaggaatattgagtttatctaccaaaagtactataggcacaaaacagtgcagtaattgatcttccataaaaaaagacaggagtgggaacagagcaaattgcaaggttcattgttatgataatgaagctggataaggttccaaaaaagtagtcaactaaccatatcctttgcccccatgtgtattacaaatgtcacagcgccatgaatcctgaaacatggagaaaatagtaatttaaaaggtgcaactacgaatttatgcttcacagtttactaaaatctcaacagcatcagctatctcagctctcagtagaacgatcattaaaaaatgaaaatgcaatgctaactatttcaaaatattcatctatagaacacgctcatatggattttgtttctcactacaatcacaagatacttgactgtcaaaatatagtgttcaatatccaagcaaagtttaaaagagatgctaatcaatattgttgtgaacatcacactgagaagtattctgttgaaacaggaaagtaaagggcgtcaatgtacaatgcagatataaagatttaagtgtgaaccgtgaactgaccggagctgtgtgtggaacagcacctgaaggatttcctcttttctcatacgaggatacacaccatctttctcttgctcgtggtgcaaaatattcatcaataagcttcctccagtatgttattggattattctacaagcaggtactccagtaaatagtaaatcttatagccaagaacatgtgtcttgcaataaatgtttacaacgcagaacctcacctctggtcggtgacgcttatggtataagtattgctttaaccttcgagaacaaagcccattctcgacaggagtcctaacaggtccagctagctgcattccaggctgcgctagtggaggcctcaactgtggctgccgaggtatgccaacttgagattgttggatctgtgaaaatggttgcaacatctgatgctgctgttgctgctgaatctgtgccagtttatgctgatggatcaaggcttgaatctgagggttctgttgaccctgcagatgaagagaactctggccttggagcagttgctggattaaattgtgttgcaggatatcatcttgcctaatatcaacccttgacttcttctgagcatgcaatgcaccagcagcatcaataacaggttgtgatgttacactagaagaccttcgcttctgcatctgctcttggggaggactttgttgcacaatgggaccatcaataactgaagatccagagatgttattggatgaaaacgacattggggaagcaggaaggcgcatgaatgaatcagcattcatgctcgtacttggctgcaactgggcacctccggagagcgatgagttagcatccgtcaccaaagagctaacaccaatgcttggcccagaggaatttgtagtgctaatagggatactaccatgcatatccctgggaacaagtccaaggttggagcatggcgccccagacatggaggttaccagggttcgatcccaatcatcactttgaagaacctgcaaaaggtgaacatgaattattaggaaataaatcatcaaatatcttactggataagaactgttaacagcctaatgcgtgagaactgagaaatggtcagcagtaactgaagccaaacagatgcaagtagtaatgagattttagcatcatgaaatttctcgattcaatggttgaaaaaacagaaaacagaagaaggccatttttcaattctctaaccatactacgctactgcaatagcataaccagaaaatgaaactagaatccaacaaatggtaaataaataaaaaaatcgtctttgaaaagaaaataagggacagaaaatatagcatgaaacacaaattgcaaaacagttgatgctggttatgcagggtgtgagctgaaatttactcttttggttgaaattagccgagctttagcattctttccaccacacaaaaaaaaatatttttcccaggttcctctcatacaagtacaagaatggagcatataccaaaatgtcttccaggtcagatcaaacaacgaaagaaatgaaatagaaatcaagttcacatcagacaaaatagaatactgaactaacttcacaacaaaaggctccagggcaacgaatcgagagaggaggggaggggaaactgccacgtccggggaggatggagagagaggacaacgaaggccggagatgtgcccgcagccggatcgccaaccctagcaaagtagaggagcaggagacgaaacaaggagaaaaattcccccctaatctttgctccgtagcagatggataaaaaccctagcccaaactcgccccccaaaaaccaatcgaaaaaccgagctacaaagattaagctaacactcgaccaagaacagaaattccacctctacacccccaaaattaccacgctacattgcaggaatcggcacccatcaacccaaaaaaaaaatcacccaacccctcctctcacaacccaaccacaaatcgccccccaaaaaggggagcaaaaacaagaaatacttaggtcacttcccgcggtccgagccatcaacccccccccccccactaccaaaccatctctctcaccttgagttcgtcggctcaatcgctggccctcccaaaccccaacttctcctcctctaccttgcagctgcgatttttttttcttttttgctgcgaattttttttttctctcctcttccgcttcttctcctcctcttcctgcgcctgtaggcggcgtcctcgccgacgagcaaaccggttaaatagattcgcggcgcccgggacggtggcgaccggctgcagccggtgggccgggcccacattgaccgccattgaccggtctccgtggggcccacgggaggcctccgggccgtcggatcggccgcggagccgcatcgcgaggcgggtgtgtacacgcggccgcgcgtgattggctcccggtgggggcgggggaaaccgggagacgggcaggtcggctcctcgctacgcgcaccccgctcgcgcgcgcgcgcgtacacacgcggtggtggggccatcttgtcagcgaccgtgtggcttggcgggtgtggaaacctcggtgctttgcggtggaaggctcgggtgatctttttggccgagcacgcgggtagctcttcgtggggcccacacctacggttcgtggggcccacatgtaagtgagggtttatgcagggcgggtggctgcgttggtcgcttgaagaaataggaggggtcttttccaggacaggaatgacttggtaacactgactttatcgtcactgaacggtgggtccattgatgtatggcccacctgtaagtcagatctaacatgtgtgtgggtatggctatgcgtgttcggattaacggtgaagtttctgccctttaattttcaaggaccgactgctcactgctttgcctaggaagtggaattgctccatgcacacaaaaggctacacacaagggtggggggagcttccttttgtggctgtacaaagggtgggggccagcagaggctgtgctgagtttgactggttttgcattgtctatgcaaggctggaagactatcataataggctttcctttagcttgattattgcagcttacatagcctaaatcattgtaatgggggcataagggattttttttatgtgggaaatacaaaaggatgaagattgaagatgatcaatggttgttgtggttatagaacatgtattttgtgataaatggaatacaattatggagtgtaggttgtcctaaaaacgtgattcagcatagacagaaaagtgatatcttgtctagagcacaacttcggatagtgagaaatatacggcggaataactggatagaaacctatccaaaatacatgaaacggttattatatgcttttatatctataagatattagtagacttgtctagcacgtcggatctagtaaaatatttagtatactatttttgaaagaaatcagataatcatgcttggagtggcattccaataattttatattattatttctaccaataataatataaaattattatattattatcttgtactccctccgtcccaaaataactcaacttaagatgggccatcttaggacaacgaatcttgacaaatgctttgtccagatattttgggacatagggagtacatgactatgctatgcagataattcttttcaaatcgaactgggatgaattttgaacctgtttagcctgtttttgaccagctttaaaagttaatgtacatattccaaaccagcatattaatcgcttcagctgatggtttctagcgttgtgatggagtgcattccaggttaaccgcgttgctaaaccagccaagccaagccaagccatccctggttacttgattagtctgtgtgacgtgtagcggttgcatccttcgcatggaagaatacatgacgaggatacaagtcagcggccactatataattttccatcatgtgcatatacgaggttcttatcgtgatctaccgcgatatcttgattatatttcttgtaatttgactggttttttcaaagaaagagaactcaatgtcaactcatctttttttttcccgacagcagccccgatgaactaaggcttccttcgaaatagagtatggagtgagcttaattatcaaccgtacgcaaaattaaaaaaaatcattagcatgattaaattaattaagtattaatactagctattacaaacttaaaaaatattaatctaattttaaaagaatttttatgtatatttttttagaaaggaaaacacgattaattgtttagtaagcgtgctgacgttaaacgagaaagttgcccgaaatatgtttgatcaagtttactcaaacatttaaaagaaaactcacatgatgatttgctttaatttagtaagtacgcagtacatgtgaaactaattaactatcttcatatacaagccctgaacgatgcattcacacggatcaattaacacgagccgcgtcgagtagcatgtatgatttctgatattgtacaatcaaccttgaccacccaaaaaaaagtcaaaaagaatccaatttgaagcgacacgtctcctagctaacaaaacgcagcagagagaagagtaacagtaacacaccatgaacacgtaggtacatttgcgttctgtatatatttacggaattttcaatttggtttctcgccatcgccaatccaagacactgcgaccggccatcttaaatcgggcaggaaatcgacaagtaattcgattttgatagctttcagtttacgttccaccgcgacgatcgatggattgatgatgaaataatctcgatcgatcactgcatcatgcatgctgctgagtccaatcaataatcggagatcacctccccttcatgtcggcgagctgcgcgaacatctcgccggcggcggtggtggacacgtcgggcacggtggagacgccggagccggaggaggtcgccggggccgcgccggcgccgtcgtggtcggctggcttgtcggccccctcgggcgggttggcgtcctgcagctggagcgcgtactcgaggttccagagcacgtcgcccatggagatcctgtcgctgccgaactcggcgaggcacttctcggcggcctcggcgaacttgttgagcgactcctggttcaccgtcccggcgagcttggggtccatgatcttctcgatgaggcccttccgcttccactgcatcccccactcggcgaggctgacctgctcgcgcggcagctgcgggtcgatgggcggccgcgcgcacagcgtctcgaggagcacgacgccgaaggagtagacgtcggacttgtccgtcagctgctggcaccggaagtactccgggtcgaggtagccgaagctgcccttgacggcggtgctgacgtgcagctggttcatcccggggccgtccttggacagcccaaagtcggatacctttgcgacgaagttgtcgtcgaggaggatgttggtggtcttgacgtcgcggtggatgatcccctgcgccgtgccggtgtgcaggtagtggaggccgcgggcggcgccgatgcagatctccagccgctgcttccacgtcaacgccggcaggtccttgccgtagatgtggtcgcggaaggggccattgtgcatgtactcgtagacgaggatcatctcggcgttctcgtcgcagtagccgatgagggagacgaggtggcggtggcggagcttggacagcatctggatctcggtgttgaactcgttgatcccttgctccgactgcgggttcccgcgcttcacggcgaccttggtgccgtcgtcgatctcgccgatgtagacgttgccgaagccgccgacgccgatgatggcgctctcctcgaagttcttggtcgcggcctggatctcggcgaaggagaagaagcggccgaggccgagggtggaggagaaggtgtagccgctcttgctggacccgcccttgctggtggtgaaagattggccggtgtggatggggagcagccacgacgagaagctgttccggcgctcccagtcctggggccgcttgtaccacttgacggccatggctcccaggccggcgaacgcgccgaacatcatcgcgaaccccaccgccgccacggccttgcggctgccgctgccgtcgtcggccttcttcccgtccacgccgaactcgccgtcgaggctccccaccgagttgctcatcttgagcacctccacgccgctgagcagcgcgtccacgcgccccgtgtcctcccccatcggccccacctggatgctcagcttgtccgtcgcgatcgacgagttgacgacgatgtccttgtagtacgccgccgacagctcgccggtcaccgtcgacaggtccagcccggagatggccttgcgcccgttgacgaacacgttgaagtagaggtcgttcatgctcttgctcacgatgtccgcgaagaagagccggaccaggtagccgaacgccgggtccacctccatcttccacgacatgttgaagctcgggctccccacgccggcgtccgccatcttcgcgcagctcgcgtacacctgcgccggcgccaccagcttcgacgtcccgtcggggaacttgatgttccccaccggcaccgacacgtccttcaccgcctccttcgactgcacgtacggcgcgtccacgtcccactgccgccccagcgtatccttgtcgggcgcgatggccgggccgccgacgttgatccggtacaccacctggtacgccgcctcggcgagcccggtcatctctccgacgggagcgatccccatggccatgtctgtgatgagctcgtcgggggcgttcacgacctcgatggcgttgatgaacgcggcggagcccttgagcgggtagaacttgacggcgaggtggttctcggtggcgttcacgaggaactccttcatgaccggcttgttctcggcggtgaagctgtggaggaggacgttggtgtcggtggagacggtgaaggtggcggtggtgaggtcgaagtcggagttcttgagcgggaagaggtagaggcggacgaagtgccagcccgggacggtgagcgggaagctgtagacggcctcgtcgcggaagatccgggcggtgaggtagagcggcgagggcacgtcggcgtcggtggtggcgaccttgatggcgtccttggcggagagaaggctgttcgactgcgcgtccgtcttgtacaccttgccgccggtggtgacggggctcgtgctgccgcagtcgatgaggaagttgtccttgggcgtgaacgtcgacggcgtcggcgccgtctgcgcgccgctctcggtgaccggccgcccctgccccgacacggccgtcgcgagcgccgccgccaccgcggcggccagcagcagcgccggcgggatcatcctcccgcggcggcgcatggtggtggggtggcctacgtggcacgcaagacgtggcagtgtattattggaggaggcgcgcggcgccctctcgccctctctctctggttggtggggccaatcggaggagagggaggagggggcgtggggccagggagtctagaagagggtggcggagaggtgggcgggttatgtgggccaatgagcgcgccaagtttagtttaagcaggccgcccctacggttgggcccgcctcgcgcgctccaccgctcgcaaattctcgcatacgcgcgccgcgtcggccgcctattcttagcacgcgacggcttcgttcgattgcaggtggaggagcaagatttgtaccgcacacgaaatctaatttgcaggtggaggcaactccggctcggacgtccgacgtttggggaaaaatcgggcgctgatgtcagcgcccgatttacgtgcaaaaactactttaaattaatttttctcttaaattacttatctaaatcatgattcgatttcaccattaaattcgttgcaattaaatcttcaaaataagaccacacatggatatattccgacgattttttttagcttactgttgaattatttttaaatgttgcacgatgttccaccaggtatatcagaattgtttcactaaatagatcgaaaatgtttcactcgtttaaatcgggtgttgtttcaccttatataaaaataagggccatttgcttatttgaccctgttttgaaggctaactaccaatttgaccctctttttttgagtttgcttatttgaccctgcttttcgaaaacgaacgatcggtctgaccctgttctgttaaggtgagttgacggtgttaagttaggggtaaatagtctattttgcccttgcaacgaagctgacgaccggcgatggcaacgaagctgacggaggcggagacggcgacgacgatgctcttcccggccacggcgggcgcgagtgcgggcgtgagctcgctgcacggggccatcccggcgcttgtgtcggcggggctcggcgccgcggccgacgagtcagcgggcgacgaggccagggacatcggcggggccggcggcgaggccatcgtcatcggcggcggtgggggccttggcgagcaggcactggcgcatgtcccctccgcgcgcataccgccgccgccgccgccccctacatccacaagctgacgccggcgcggatccgcctcccctccgcgcgaatcccgccgccgccgccgccgcccctacctccacaagctgacgccggcgcggatccgcctcccctccgcgcgcatcccgccgctaggcccggctcctctcctcccttcgccggcgcaggcctccgcctccctccccgcgcgccgatgcagatgccgccagcgccgcctctgccgcaggcccggctcccctcccttcgccggcgccggcctccgcctccctccccgcgcgccgatgcagacaccgccgccgccgccaggcccggctcctctccctccccgcgccgcatgccagcctccgcctccatccccactgcgcgcgttgacgccgccgccgctaggcccggctcccctccctcccttcgccgcgtgctgtcaccgccgccgcaaatcgctagcagaagagagagacatggagactcagagacatgtggatagggctagagatggatatggtttcctcaagggtattttgggcattatgaattttaattatatttttttctttttttaaaatcaaatcttaacggtgtagtggaaatagggtcagacggaagattcatttttgaaaagcagggtcaaataagcaaactaaaaaaagtagggtcaaattggtagttagacttcaaaacggggtcaaataagcaattgtccctaaaaataatgtttcagcaaatagcgaaagaatgtttcagttcactgcaatatttgatccatacataatgaaacattataagtacactaggtgaaatattttttggtggaataagaaatgaaatgaattcccttaatagggggtttccaaaatatatgggttttttgttgcaatgaaatatttcagttcactgcaacattggatctatacatagtgaaatattgtgagtacactagatgaaatattttttgtgaaataaaaataaaccaaattcccttaatagggggtttccaaaatatgtgggtgatttgttgtaacggcgcgttccataatgtcaaaatacactacaatatttgatccgtacatagtgaaacatcgcaagtactagctgaaacatcgtaaaactactagctgaaacatcaaaagagatcatatgcaatattcaaaaaaatatcaatagaaaagctaaaatattttttatcgaaatataatcatgtgtggtcttgttataaagatttaattgcaacgaatacaacggtgtgatcggatcgtagattggataactagttttagagaaaaatcgttttaaaaggagcgataggaggcgcgggcgcccgaggcgtccaatttttcctctgccgtcgggcgccggcgtgcagcactctaagcccatcgcagtggcggtcgaggagacacgccggtttagcccgttgtttttcgttgggccgtggactagtggtgagcggtgaggtcataacatattgacatagccaatccaaggtttatttttcttctttaaattttgtttttttaagaaaagacaagctgccaatttttattaaatagagaaggagtaaacggagagagctacaaatcgaacgtccgacgttgtaaaaaaaatcggacagtcaaatgtttcggttgactgttggtgcaacattaagttatacatagtgaaacaaaaaagtcagcctatgaaacatatagaacttttgtgaaacataacaataagaatacatggtgtaacatatttctatcacatatgaaacattgagtttttattgtctgaaacatatgttttttttcatcagaatataatcatgcgatatcttgttgtaaagatttaattataacgatttcaacggtgtgatcgaatcgttcaacggataagtagtttagaagaaaatttttttttaagatcactaaatacttgcatcatgcatggtgtgggggagaaagctaatagaatagcataagagagactaggggcaatagcgtctcatattttttcagtgattggtgaaacattgagttgcacatagtgaaacaaaaaaaaattcagttattgaaacatttaattttttttatgaaacataacaaaaacacacattgaaacatattgctactgcgtctgaaacattaaatttaatggattgaaacatatatttttctttcatcggaatgcaattatatgatatcttgttataaagatttaattgtaacaaatataatgatgtgatcatatcataaattggataaatagttcaaaagataaaacattttgaagaccatcgtatgaatgtgtggagacatagggtactattagtagtttgttcatccgatcttttcttttcgtcggacttatgatctcaagtattttcgaggttatgtgggccagcgagagcgccaagtttagtttaagcaggccgcccctacggttgggcccgcctcgtgcgctccaccgctcgcaaattctcgcatacgcgcgccgcgtcggccgcctattcttagcacgcgacggcttcgttcgattgcaggtggaggagcaagatttgtaccgcgcacgaaatctaattagcatataattaataaaatattaataattataaaaattaaaaaatagatttatttgtattttaaaaaattctatttagaaaattttaaaaaacacatcatttaatagtttgaatagtgtgaatagtgtgctaacggaaaatgaagaagttgaaaattttggagttgaagaatggaattgggcaaatgggaggtagaaatggcgctgcaaatttggatcggttgtattcagagatttcatcagttatttcttcttcttctaataatgcatgaacttggacagcagacaacactggttgatggagcaagcaccgaacacatcacatggatgcataataagttcgattaattaggaacccgtgtttatgttttgtgtttgcagtggtccaaaatcctatgtttgcagtaacgttactattgttcagtaggggtgactgactattatcttgtttgcctccaataattacacagctgaattgcaatgacggagtcgatcgatcacctgctgcaaattctgcggttgtttggcccaaacaggctcgaatcaatggtcattagtgatcagggaaactggagatattaatttcttgtgcattaacgatcaaaacaccgaagtagctaaaaattcccgtttatattttatacgtcttgcacgttacaaccaataacacaacagacactaacatcgaacagaagaattaaaacaatacgtatagaacaaaaacgcttacttcctccgtttcacaatataagtcattctagcattttctatattcatattaatattaatgaatctagataaatatatatgtctagattcattaatatcactatgaatgtggggaatattagaatgatttacattgtgaaacggagagagtacataatagtactgtgtatacgtacggtatatagtagctagctcctaataggagtaataagcacttagagaataaggatagataagttaatccacgcatgatatcttgtttgattattagcatccgacattgaaccacctcctccttgctggcttccaccgctcctccgccttcctcttctccttctcgcacgcacatttcgcttccttcagattcttcatcttcagataaaaaaaatatccatcaaattaattcagatttatatatttttcgaacaagagattcagatttatatcagatcgataaaatgtgtattgataatgcacagtttccagacttttctttctttgtacatttctgcaattattattagtactaatctagcgagcttaatgtgtgtgttgctaatgaatgcgattaattaatctgtaataatcatgtcaccgtggatgtgttcggtttggtgcgatgaagctgccgcgcgcccttgtacaggaaatgcgcgccgctccagctcccgccgccggccgcggcggcggcgcaaaccggcgcctggtgtttgcacggctccggcagcggcggctccgaccacgcgcggtcctcggccggccgcgccaccgccggcacgctcgagccgccggccgccgccgcgacgtccagctcgcagctgagctgcctgatgcgtgactcgagcaggttgaggcggtccatcaggctgcccttcgcctgcacatgctgcagcgccgccgccggcagcgacttgctgtgctggtggtgcgccgccggcccgccgtcgccgtcgccggcattcgcccgccgctgctcctccagctgccgcaactgaaacaaagatcaaacaacgacatggtgatcactgatcaatcgacgaatggatcgatcgacacgcgacggcgacgctctctcgcgctcacccggaggtcgagctggtcgaggcggccgaggagggtctccggcggagggagggcggaggcgctgatgaggacgcggcgctccgagccgaggagcacgtcggccatggcggttgcacgccggagcacgcagcggcaggtacggtttatatagaaggccgcgcgcggcggcgagggcggagccaagatcgggtcgtggactcggctccgcaatctggcccgcgctcctcgcgcgcgcacctttgacttggacactgtcatactgggcctggatttgttggggttgggctttgtatggccctcgtggcaggcctacatgccaggcccaatttgaggcccaccgagtagtcgtaattaacaggagaccaacaaaacatgatactccgtatctctttgaagaaagagagcagagttgatgaatgtcatgtcctgagatttggtctattttttttcacgaacgcgtaaaataattgcacgttaatatattagaggaaaaatagtttttgatacacaacgcaatcagccagatcggcttatgctaggggaatgaagaaaagcaaaacaaaaattgtagctaggaaggaaaaaaaactactacggcggctatgaaactccgattggtgggaaggggtagagccacgttacattttcaataaatctccaaaagtagcaatgcacgctaaagaccacagatgatcttccaagcagatatactctagaaccactgagaccgaagagagcgtagaatcgaaaactctggagttccgttccttccatagtgccaagagaccagaagtatcagagagtcgaaaccggcacggagatgctcagataaagcaggccctagaggttggccaccaatcctgaagccgactgccacaagaggaagagagagcggtctagccaggaggcgacaacacacggaacctgacctgccgagcgaacacacagtcgaggatttggtttagagaatgtctctattgggtattgtaattggaagataaattgcgtagcacgtaaattagctagacatgtttttaatttaatcaattttttttaactaggttcaacccctggcttcttattaaacgttccaaatgtcatccctcaaaaagaaaaagagagagagagagcagagcagagaagagttgatgatggttggatggtgtggtctggaacataagaaaaagtcagaatcagatgattggtccggaggcatctctctctctgttgccaaaagcaatttctgtggtagcaaaccatgatcatcatgcttcttgttctgggagatccactgcaaatttccacaaccccacttcacaatgtacacccattgcttgcccttctctctttaccgtttttctgcatccatacatgttttctaagtggtagcaactcatattcagctgtgtctggaattgcctaaacattttgaaaatgcttcaagcactgaactgctctctaccaaactcctgcactactgcatcgcctcttgctttgaccatcagaatgttacgaagaaattgcaccccttaagctccacatttcacgccagttgcttgtacaccttttttttcaaagcgaaaattgcagaagcaactgtcgtgaaatgtagagcttgacaattgttaaaattacatgagtacaacaatgtccactgtattaagctctacatcccaccggaatatataatcaaaactcgggagagaaattagcctgcaggactgcagtacaggactccactccacatgatcagttgttgtaaccagactaattaagcaaggcgagctaatgagcagcagatcgagcacatggtaatgcctcgctaaaccgatcctgatcgatccatctgcttttatattaaagagatggcacaagccaccagacgatcgaactacctggcaattgctccttctctctctattattatttttttggccattaattgctaactgaatactcaaggcaaactgtgccaaatgatttaattatttgatcacttatgtttaacactccaacgatcgcataccaactgctagtactggtattataaaccagtattaaactagtactatcatgcatgatgatggaagtatgggccattcaggtttcaggtttacgtgcagtgtggctatactgtaggacgaacactcgcaatgatttaaaccgacacttgtggtcaattcaaacctgcccaggatcacgcaagatctctctaattttaattagttcgtgctaagaaagtattatatatgaaatgatttttggttgctctgaaccttttgtgtcgtattcaggcacccaggctgtcttggaagccatttggattccatgggccacaaatataggcatggacagcatgtgaaacttctgccttttaacaaatccctgcaatccaaaggcgattaaaacactttctgaaaagtattttctaacataaatacaataactgtctttttcacacaaacattttctctaggcccatgattcaaactctcataaactatggactccatctcgaacaaaataatttctttttcaaaaaaacgaaaagaaaagaaaccggtatgaccgcataacaatagtcagttacatttcaataaacaaaagtaaaaacctagacgggttacaagaaaagggaaaagaaaaccctcgccgaacaaaagaactccatatagatttcatgagattttttctatttttctatattattctcgtgggaatcatacatttaaaaaggaaaattatacgaagtgagtgagcgagttggtccgtgtttggacggaagtagaggctatgggcagcatgaccaatgacagggaagcggcaccttccgatcactcaggtcatccattcatccattcatccatccatccatccattcatccatccatccatctcaatatatagctaatctgtattttctgtgtgcttggaagcagctttggagggctctattattgtctttagcctctctgattgatatgactccctaaccatatgctattatgatttatgtcatactggcaatgtacatacgcctctatatatattcccatatgtttagcttaatttaaatctacatgatttagcatcggtgtcggtatagctacaagatatcgtaagcttagcttttgatcatgagccttgttgcgactaataggaaggttcatcagtgatgaaatgaatagtgaggcttcgttctggcatccctagggggcgatctcgtctgtgtctctttgttggtctagcggcggtcggtcacgcttaacggcggtcgatccggtgctagccttctcctgggattatgtgttggcgatgtcggtgtgtgggtggttgtatattttttcctttttcctggttacgaccctccagggttgtaatcttgtaatttttttcctgctctatcaatagaacttcgcaccgtctcgtgcgagtcgttcaaaaagaatagtgaggtttcgtgaagaacagttgttgggaagaggaagaataagagagcaatgctttacatatttcaaaaagtgtttcgaaaaacatgcttcaaaattggatattttttccttgtgtagttctgaggccttttttatctgggaaaaatttttaggattgattgtcacatcggatatacggacgcacgtttaaagtattaaacatagtctaataacaaaacaaattatagattccgccagaaaactacgagacaaatttactaagcataattaatccgtcattagtaaatatttactgtagcaccacattgtcaaatcatggcgtaataggcttaaaaagttcgtctcgcaatttacacgcaatatgtgtaattttttttgcctacatttaatattctatgcatgtgtccaaatattcgatatgacagcgtgaatttttttgttttggaaactaaaccgggcctggatttctggtaatcaaaattggctcagtcttgatcctatccatattgcctggttaaatatagcattgcctagatggaaatagaagtgccataaaaatgcacggtgctgacaattcaaaacaacaactactgcatatttgaaaaaccaactaactaaaacgtgtcaaatgatctgaatggaaaattcagagcagaacaattaagcgatctcaaaccaagattaagtacagaataatcaggcgtgcgtttttgtttctgtaaaatacggcaatgcaagcgtccgaacacaacacacataaaaccacatttagtagttaagaactcatagaccgacattaactaatctctgcaacgaataaaaacaacaaaacgaaaaggaaaggaatcggacaaagaaaggaataagaggagaaccacagaaagcaatcgccaaagaaaaggaaataaaaaacattgtgcaaatcaaaacgtggttggctgcatttcgaatcagatacctgtctttttttcatcagaaagcaaagctgattaaggagaagaagaacttgagaaggaggagaagagaggaggaagaaaggaagcagagacgaggaggtgggttacagcgtctctttcctcggtcaacgcaggcgagaggagagcgttgacagtgccagcgtggcatccccaggtgggccccacacgcgcgacactcctgactgtcggtggagctcagactgtctgtcaccttgtgccgccggcctgcgtgtttcagactgttgatgaagagttgttagacaaaaagaaaaaaaaggaaaagttgatctcttgttattagcaacttgttgatcttttttgtagtagtattttgaggagaattcagtggctttggtttactaatccaatctctcaagctgacttgattgctgtgcacatgagcatatagtagttactacttcagtttcagttaaactaagctcaccctccaacgactaatgcacagcaccacgcacatgtagcagtgtcatttaaaaattcagtaacagtttctgaaaactaaaaaacaattcagtatcagttgtgattacaagaacacaatgcaactgatcctgtatgttttattcattggattatatttttgacagtgcacaaaaacacactaataaggcacaacaaagtagcactgttagggtggcggccattcattaaagattgactcgtatcgctgaatgccttgtgttcctgattggattcaactgtttactttccgtgctccactgtttgggaatcaatggttaattatggggatcattagcatgatgctttgctttcttttgtcatcagacttgtatgattcaatgatgatatttttttcttaataaatggaatacaaactagtaattgtcaggctgatcagctcacatccagacagagactgcatactggctgatactgtcagctgtgtttgtgtatgaatctcatacagacagcagcagtttactcagctggttggtaacaaatgtacaccaggttacaataactcttctgtagtttttgaactataaaccaaaaacgacatttagagggagtgacgtccctccaaatatttttttaagaaaaaattatgagtgtatcgggaattgaacacgagaccttggggttaaaactacataccccttgtcattgtactatgaagtgcatctcaatttggaactatagttttatagtttcttttgtttttgaactattaaccaaaagagatagtactctctacatttgaaattactgaacattttagctttcttttaagtcaaacacgtctatctttaaccattaatttttaataggttcgtatagtctaataacatatgaattatatatatgttatgaaagtctcatgctgaatctaaaaatatacttgaaatttattatgttaaaccatacaaatttattaagaaaaaaaattgacttactagaatgacgagtagtttaaaactgagggagtagcttgtttctaaaaccataattcaagagccacttcaattcatgcatcgaaaagctgattgccagcactactgtagctgtcctgcaaacctgcaacagcaaatctagctgtgataaattctgatatctgaaccattgcacttcacttttgaatcatagaagatgaattccacaagcatgattcatgtcccttaacttgtgccttttcttttttctaggatcatgtgatctctttatttattattcctctccctcctggcacacaaagccttcctatgaccactactattgtattactagattttaaacacctctaaataaattaaaaaaacaaactcttacatttttcaacattattatttggcattgtcatgctgcctgctgacctagaatttcacaagattttcataggaaacaattcatttccttcaagatttccacaaaattcctctgttccaaataagaccatgccaatgccaacctcaatggccttgccaaaaggttttgatcatataggcaagtttatttttagttgttttttaaataaaaacttggaaaaaaatatcctgttatgttggacagttcaaattaatcaagagcaatttttttccggtagttggatctagctaactaatcacaaacaaattattttcgcaccttggcgcgaataatgctcccgcgattatttcatctgcatgtgctgcgtattctccactgatgatcagctgctgaactgtaccagcactgctaatctactacgctagctactttgtaactgtttttaaagcgggtagttacatcgttaatttttttttgttttgattacaagtactcggtgctaaaatatatagtatttaaaaaatctattaggcgatggttgggacgttatatcgacaagcaaatcaaacaggaaggaaaaggtttgcagcagcatcagccgacacaatacgaatcaccatctaaccaaacgaaaacgaatcaaaacttggactagcttgctgcaaatttcctggttttaaaagccaagaaaataataatttctcaggcatgtggaatactagtagagacgacaaggaggaaacaccaaaaaattcagcaaataaacaaataaatgaagtgtattcatttctgatggcgccatgatcaagcatctagcacaatgtggagcatccacccttcctttctctcacattccacagtagaatcaaatcaattttgtcatgaaccaacgcaactctgaccctgatcttttcagtttatttaccagattattgaaacatattatttatcgtacactttaaaaactatattttctttataaataatttacactcctctattgcatttcttatcgctagtgttattttctcattaatataaagattttacttcgattttcgtaagcacgcttttaaaactactaaactgtatgcgaaaactctaaatatgaaagttgatttaaaatatcaaatatattcatttgttaagtttataaatattaaaatttaactaataatgtgctaatagctttatcgtttaaccgtgcgtcaacttaatcttaatcttatgagtttcaaacactattattaagtttattcatcaaaacatgtactcctactttatatttatatctgagtgcatagtccgccaataatctaaatcgaacaggaatatatatattatcatgttaattaaatatagttttccagaaacatttatttatataaatctctttggaatttgataatggaaaatgtcatgtggccagtggcaagtaatctaattggcgtatatattccccttgtccatggcgttgcggtttgttccctcatcaacctcaccaccattattttcttctctcctcttctcttcttcctcctctcctctcctctcctcgctctccatccatctcgtcttcttcttcctcctcctcagcttcgagatttcagcttctccaaacccccattcttcccgccacaagctctgctctgtgctttgctcgctcgcctttcccgccattggtgtgcttcgctttcttggcttcaaagatccgacgagctctgtgatagctggggagaagaagaggaggagaggaggatgctgggagcgagccctaaggccaagaaaggcgcgacggtgaagttcgggtcgatgaagaatcctcctcctcccccggtggttggcgccgccgccggagcagcggcggcggcggcgggtgggaaggtgccggcggaggaggtgtgggaggtgcggccaggcgggatgctggtgcagaagaggggcggcggcgccgacgaggagcccgtcaacgtgaagccggtgcccaccatccgcgtcaaggtcaagcacgccggcatcacccacgagatctacatcaactcgcaggcgtccttcggtcagtgcccgccgccgccgtcgtcgtcgtcgtcgacggcgaactcgatggatgggggccatgtctgatttcgttgtgggtggtgcaggggagctgaagaagatggtggcggcgcgaacggggctgcatccggacgaccagaaggtgatgtacaaggacaaggagagggactccaaggcgttcctggacatggccggcgtcaaggacaggtccaagctggtggtcgtcgaggaccccgaggcacgcgcccgccgcctcatcgaggagcgccgcaatggccacctcgagaaggccgccaaggccgtcgccgccgtcaccgccgaggtcgacaagctcgcccccaaggtaggcacccacccacattgcccgccatccatggcgacgccgacgccgaggtagtaggctcacctccgattggttggttggttggttggttggttcggcaggtggcggcgctggacgcgtcggtgaggaagggggagaaggtggcggagaacgacgtggtgcaggtgaccgagctgctcatgaacgagctgctcaagctcgacgcggtggtcgccgacggcgacgtcaaggcgcagaggcggctacaggtgagctgacgagctacctcgccgcctcctccaatctccaccgactagcttgaccgccatggttaatgagctcaacctgttcgtcccatgactctgcaggtgaagcgcgtgcagaagtacgtggagacgctcgacgccgtcatggccaagaacgccgccatcgtgcgcaagtccggcgagaagctcacctccaaacaacaccatcacccgccggcgaggcagcagcagcagcaagctcaccaacaccatcagcagccggcggcggggcagacgcggtgggagatgttcgacctgctgtcctcgctgccgtcgacgtcgtcggcctcctcaacgaccaccgtcagctcaacggcctcctccggcgcgccgccgccgctgccgccgccggcgaaccggctcgactggatgctattctgagcacacacatcacagaatcggcagatgcaatggtggtgcttggttggcaagaattgcacccatgtccggaaaatccgaggtgtcctgtccctgatgagatgatgatgaagatgatgattgaattgccctggattatttgctgctgctctagcaatttggttggccacattacatggtactactaccacttctagatgagttcagttcatcatgtgagagtaatttttttttaattttgttttttctttctttctttctttcttcttcttcttcaccatcaaatgtttgatattcttttgtgtgcatatattctgagaaagagagagagagagagagagagagaggaaattaggggggaagagagaaattgaagtgtattcagattgggaataagtcaaaaagggttattattgttctccaattggcgtttgaagaaaaggcaaagaaaatgttgtacccatatggatacagataccaatacataccgttcttgataaggggagaggccatggacttggactgtggatgatgaattcttaaatctttttattattatttcctgttagttgttatgattaaaaaaattgtttctttcttctccttgttgttgttggtgttggtgttgtctgtgttcttgagttagttggcgcctatctgtcaggcttgattcctttcagaaatgaatagtgcaggggttggtgtgcatctaaatactttattgctgtgccacatttaggtgttgcatcaagccatcagagtccgagctgttttgttttaggtaaaaagaagaagaaaacttgcgagttgctttggcctatttggcgattattacaacaaactaatcagctctaatgaatgaattttctttcttttcctccttgttgattcagcttggatgtctgatgaaatgagagatcaagcgttgattgattgattgattgattcaattaattactagctggttgccgttgcagtgtcagtattgagagagtgaagcatcatgtgtgtattagtgatgtattagtagtggactagtcattgcctggtggttgagctgagcttctcctcttgtgcctgtcacatttgcaattgcattgctggctagagagagatgttgccttccttcctctcctctcctccaagctaatgacaccaaattacatgatagtatccttccttccttcttttgttgtttcttttaaagttgggctatttatttctgaaggtaatgacatggtaccatctgccaattagcaacattgcatggttggtgctgaatagagagagagttttgagtcacatgtttctcgagtgatgatggccaatctttccttttctttaatttggtgagagatcatactccacgagatggcgtggaaccagcttgttaaacactgatttattcatgtttaaataactaagaaaaacaacaagagaagaaacaaaaagggcaggtaacgagtctaacggcagaaggatctttatcatgtatgtctcgtcagagttgttcatcagccaatcgtcatcatcgatttacagtcctcaactaactaatcataagctcgtcaggcagaataaaaatcctgaaaattccatagataaactagtcatacttggccaaatacatagcttaaaaataaagtgtttttgaaggtgataatagtaaagtttgaactgaaattaaggtggcaactggtgctgtaggtgagtctagaaatggggggatgttggttacgtggtcgccgtcgaggggtgagaacaaaggagatggtcggcgttcttgaaagcgaccactcccggcgaacttcgacgacggacacatggatgaacacgcttcctcttcgcctacaccgacgccgccggcaatgcagggcaacgcgcgtttcttttcggctgatcggtttggctgattagctacctgcacgctaaaacatgagaaacataagggtgtagttatatttatggcgtcatattttttattaaaaaatagtcggcatgtatttacattgtaagtccttaaattacatatgtaattttagtgtatttacaatgtaagtctcaaaattacatatgtaagtaataaaattacatatgtaaattcgaaaattacatactaattacatatgtaagtggggtgtaaatgaggtgtaactactgtgtaagtggctgaaaaaaaatcgactgtagcatatgacgccatatttctagcaactccgaaacataattattaactagctgggtggtggcccacgcaattgcgcggctagcacccaaacaaaatcttatatttttttatgattttacttaaaatttattaaatagctatctcattgtcttaagactttgaaagaccaaaccttatcatcctcgtgtttctaatatatagtttgtaaaagtcacaccagttgctaccccttatgtcatctcttcatttttataatttctagatgtcccgtcaaacgttgccactatactcctctgcggcccgtccactgtctcctctctttattatcattgagattttaaaaatcgaacataattatcgtttgggttcatttttactttctagaagtcccgccaaccgtcagcggttttgccattgtactcctctacggctcgtccgctgcctatctttttttattgtcattgagattttaaaatcaaacatgattatcattggttttttttttactttttagaagtttcaaacctttaaaaactggacttgtagttttattttttataatttttagaagtcccatcaaacgatgccactatgcccctctacagcctgtccgccgccaaactctttattgtcattgtgattctaataatcgaacataactatcatcggaattcattttttattttctagaagtcccgtcaaccgtcggcgactatgcaattatactcttatacaccccgcccgctgcttcttctttttattgtcattaagattttaaaaattcaatatgattatcaatgggatttgttttttttactttctagaagccccggcaaccgccttactcgtttgcttcacggcctgcctgacgtccctccttttaatcgtcattaggattcaatttggtgttttattaacaattttatatctcgtatcaaccgccaccactctacttctttataggcttgttacttaatttatctcgtcatgtgtttagatggtcttttcttttaataatctatatttttatcacaaattttagttatttttaaattgtattcctaattgaaatcttatttttctttttctaatttcagattttcttaaaaaaaagttaatatcgtattgtgttatttttaatgtttttattttttattttcaatttcagttgttttaaaattttattcctacttgaactctcttttaatttttctaattttagatattattttatttttattctaaattttaattaatctcgtattgggttcttatatggattcttctttcaatgttgcttatttttaattccaaattttagctaattttaaattgtattcctacatgaactcttattttattttattttcctaatttcaaatttatttatttttatttcgaatttcaattaatcttgtattagattcttatatggactcttcttttattattcctaatttttaattccgaattttagctattttctaattgtattcctacttggactctcgttttcttttctaattttgaattttatttcattttatttttattttgaattttgattaatctcgtattgggttcttatatggaaacttatttcaatattccttatttttaattccgaattcagctatttttaaattgtatttctacttggactctcctttcctttttctaattttggattttattttatttttattttgaattttgattaatctcgtattgggttcttatgtggaaacttctttcaatattgcttatttttaattccgaatttcagctatttttaaattgtacttctacttggactctccttttctttttttcctttttctccgattaatgtgggaatttctagctcccacagcgaatgtggtgcctcctttcaaagctgttttaataatataatagattagcatataattaattaaaaaaaatactttatatgccctaaaatatatgagattttgattggatgaaatacattgtccataattcatagtattagaatgtattctatgcaaccaaaataccctatattttggaacgaagggaataattattagaaacatgaaaaataaatttagtttggctttttagtattaactaaaaaaatttcatacaaaacataccatttagcggtttgaaaaacatgttaacggaaacgagaagtagctatgctcaattagatcttggggtcttaattctcgtcttctcggctaattaatatgtctccacgtttaatttaactctcggatttcaaaccttaattcagcccatgatggaaaaattaaccaaccaagcaaacattaaaacgatgaaaataaagtttgatttcttcacacagatccattaccccatcgattcatctatctgtccatgctgaaccaaagtaccaaatttatgccttacattatcaccgactaataatgatacagcaacagtgacaagtcccggtactgattgcacaagctaatcatgtctatctaataatccggagtatgaagcaaagattcccggccgctcggattgatgaacaaaggcgaagcatcacaaatccaatgacagatcgatcaagcatatgtactgtacattacataccacgatatgatagctagcgcgatcaagaaggccatgcccaattgccaaatgatccagtgacaagcaagctgcagcctgcagggatcggagcagggggacagagcacaagctgaacagtgctcacatagctacagacacaggagcagctgctctctttgcatcgaccaaagatgctgaattgctgagaccacgagtttcagatgctggtgcttgatatttgctgtattctttcttcttctgaattttgccggtgtgcgagttcggctgtgcgtatcttagttatgtagagatcgaaagtgttctcggggaccagaagatgctgatcgatcgatctgcagacaatgcgatgcataagtgcgtgtctcgttctgatcatcaggtgaagatcgagaatggctgaaactgtatatgtgcttgtttgatgctgaatccacagatctgacagtgccatagaattattggcgtacgacgggtacctcctcaggtttcagacagcacttgccctgaccatgatactgttatatatgctgcctgccttttagtatggctagattagattcttcaatctcattccagttgtaccgtgtggtgaaaaagttaaaactgtcatcactggtgaggatgacacaagagtaagtactgataatgccttgaaactgtaggaagaacataccaggatcttctcttgctttgtttgtttctcaaatctcttcttattgatcatcagaattcagatggtgagaggcgagcaagagggagagatcatgcctaaagtgaaaatagccgtactcactactacagaacttgagctgttgggcatattgatgagtcacttagaacatcttcaacacagagcgaccatttttgactctcaaaataactatttggccagcctaacaaaaatttagagagtcaaacttatcttctattccaacagcctctacacatttcactctctattaaccaatgtaccccacctgtcattcttctcctcctctttcttcttcctccactctccaatcccctgctcgtgctagcggggtcagcggcggcgacgctgcggaggcggtggcaaaggcatcgagccgccccgctgccgctccctccctcccttgccgcacatggagggcgacgacgacggcgtgggcaggcagatcaaggaggagaaggagccattgcgggaaaagggaggtgggggggggggggggcaaagcagccgccattggtgggtggaccatcctcgccgaccgactcctcatctcctctaggtgcgctgacctcggcaccccgcaccagtcgcgtggaggcggcggaagtcgctcggtgacggcgcagatggtggcgatggtcgcggctagcgacgacggcggcgctggggcaatgcaagagagaatagtcggcaaggagatgggaggataatgtgtgtggggccacagttggccagtgatttttggttggccaagtttggccagtggaaggagggttttggccagccgggttggagaggctattgaaggacgttttttgactggaacggctaaaatttagcttagagaatacttggagaggctgttggagatgctctacgggtcagtgtgtcctgtacctcgttgaacttgttgcatgactaaatagtaaataccattaaggggccttttgtattgtaggattggcaaataatttttctagaggattcaattcctttgggattttctcctatagaactctttattcatataaaggtatatattttttaaacaaaattgcatttctatggtcaaatttgtaagaaaataagtaagaggttacacctcttggaaactttccatttttttactgtggtgtaatcaaaggtcatacctttctgtttttctgtattttcaatttctgtaggattgaagcaacacgttatttcaattccaacagtttctctatttctccttttttttttttccctatcccacgtttaaaaggggcctaagtagctgtagcacatatagcaaaattgctttgacaaaaatagaaaagagaagtaacgggtaggagatttgggtcgggttagggcccatctgctgcgaaacagggtgaggcccataatagcagtaatgccttggcccatgaaacaaggcttgaaccgtaacatgcttccaacgacgccgtctgccgtctcaactactctctacttctctagtctcaactcaggcacgagttcgttctcgtcttggtcagctgggacccacaaagagcttccttccgggactgtaacgattatttattaaacatatcccaatttgccccgttttgatccgggcacatccacaacttacacggattttcggcacttatcctccacgtttggctatttacaacttacaagacactgataactactataaatttctctcaatattgtaacactaaaacttgagatatgagtcaaactgtctcacgatattttgaacccatctcatacaccacattaataacattctaatccgtgaaagcacctgcaactctcggtgacgaagagccaacatcgggtgccaaaccttgatccaatgtgaaccacctgtagctcatgaagatacacgttcttattttttttttgacaattttttgccaaatccaagcaactgactattataatcaaacaaatggataatcttatttttaatttttcttataggcgcacgtaaaaatgttgatatatgtgcatggagatggttgatagatgcatgtggtgctttgtgttcttaattagtatcatggttttacttctaaaagaaattctaactatgtacacttttgagtagtgttttattccattaagaaacaaaatttgatgatacttaatgtttcataacacgaggatttgcgcttgtggatttgtgcatgtccttagaaaaaaacatctaaatttgatcataatatgatttgaagttaaaattttagttacttttttttagaaaatttaccgggagggagagctttcccacctgaattcattgatataaggagttgaaagttcagtttatccaattatacatcaaaagagcgaatagtggaagaaaatagagacttccacgccgagattacatgacgatcatataattttaaccgctcagcccatagagaggcttccgaaacacacataatgcatacccgacacagggaagcttcctcatgccggaagaccacaccatgacgatgattccaaagacaccagaaacaaagtaggtagaacaccctggaatgtttgttgggaatttgatgtggcagaagaagagaagccagctcacacattgacgcaatgttgacctgaatattaaggttgtcctaaaaagcagcagcaaaggggcagtgtaggcacagatacgaagccgtttctttagccgagttgcaaagatcacaggcgggggtggacacaatgttcttcttacaaaggtttttcttcattgggagccgatctttagcaaggagccaggcgaagaactggaccttgagcggtgctttgttgttccagataaacttccaattgaggcaaggaggcagttcactgcgttggacaagatagaggtggctcgtcttcagaatgtcactagaatatttcgagtttctcacatcaggtctgtcatttgccgtggtatgctcagtcaagagaacacgaaggtagttaaattgttcagccataatcgacgacaggcggagagcaaagtgatctctcaaatccatagaaaggacctcggtaaccgagtcttgcttgccaagcgagtgcgtgtagagtggttttattgattaaacataatggtctcacaatattttagttaccttttaaagaaagggttaggctttattgattaaacataatggttacaatcccgcaaaataagataatgtacctttactattgtgagacgtgacattactaacaaaaataattatttggatagggagactcggggttttcaaaatcgtgcagttgtcatataagataaaccttctcagtttttgaaaccacaatatacctcatggtaaccgtacggttttcacggtaatcgtacgattatcacagtaaccgctaaagcgtggggtgacggtaacccacctaggttcggtgaacttgcatggagtacacaaatcatacggacttgcaaaacaggtgcgggtacgttcccaagtgcgcgtagcaaattattagacgtgcagagggtggagtcgctgtcccgatctcctctcctaataaatcacaacttcgcttctcggttggcagcagcgatttcatccaagcaccacgccgccgccgccgtcgaagccgatctcctgcgcgcggagcggatcgcctctgtcaggtacgacccgccctcttcctcctcccctgctaatttctcttcgcttcgtcggccacgccacgccacgcgcgttcttgccaaccttggtctcgcgagcagcgaggatggggaggaggagaggaattcctctcgaattgatcgccggttgatgcgcccggcttgttcctcttctgcggcctaattttgtacgagttcgggggttgtttaggtggagaaatttggtacagattcgattttacccttttggtcttcttcttgtgcgtccatgccgccgttcatcagctacggtgaccttttccagtctagcttttggaaggggccgagctcccagccatggattagctatcatcaacttagtcaagtgacttgtcgagttgtcggggtgtagttcactgtctaggtgttctcaaaatcaccaccttttatagtggcacgcctcttaaactgtatccatgcaatcaaatttaaatcacatgtcattgagttaacctttatgctactttacaggccactgtaaattttaccgagtttatgaaattgtgaatatgtgctaaaggttatatgagctcctttttttttagcagagcctgctgtttaaattatagtcttataggtagcctgatgagtgatgacaaaccttattctgctactgccaatttttccgagattctttaaacctttagctgttagccctgttacattgctttcggttttggcaatttcttcgttatcactatgcaacagagatcacgactgagcctatattatttttggaattaatttgtttcttttcctgcttcaattgtgtccctgattctgtcacggtaatgctcatctattcactgctataattgtgacccaacatcttatcaccgatgcagtcaccagctatacagtatgagttcactggagagtgcaagagcagatcttgctctgcttattttatacctaaacaaggctgaagcaagagataagatctgtagagctatacaatatggctcgaaatttgtgagtaatggacaaccagggcctgcacagaatgttgacaagtcgactagtctagctcgtaaagttttccgactttttaaggtaaagttttaatccttgtccgcagtagatattgcaaatgagaagctattttttcataccttgacatgatctgtggcaccacattattttgcagtttgttaatgatctgcatgctttgattagtcctcctgccaaaggaactccactacccctgatcttacttggaaaggtatgttgaagcttgtattgccttgtaggaactctgagaacctaaagatacgttttttcacttctcattgtatctttttgctttgtgccatccacagtcgaagaatgcactgctatcaactttcctctttctggaccaaattgtatgggctggaaggacaggaatatacaaggtttgattttctcttcacatcattactgatatacataagcaccatacagcatatggttttatcatacctagatgttgacagtagaaattaatggtaggtaatctaattgtttgtacagaacaaggagcgagcagaattcctcagcaagatagcattttattgcttcctgggttctaacacatgtactagtattattgaggtatgagacttcagactgtagaatctatttaatcctgcccctgatattattacaatcaagagaataccatctgactagtatttcattataggtagccgagcttcagcggctatccaagtcgatgaagaaactagagaaggagcttaaacaccaggagctgttaaaggtaccgtcttatatgatcatagctcaatgtaaccacaattttcacatcttgcttttgatgacataatggcgtgtgatggtattggcagaacgagcaataccagatgaaactgcagaagtgcaacgagaggcgtctcgctctcatcaaatcgagcctcgacatagttgttgctatagggctgcttcaactggctcccaagaaagtgactccgcgtgtgacaggggcgtttggatttgctagctcactcattgcttgctatcaggtaccttaactctcacatattgtcatgtggactatcgtctgtttagagttagcaactgcaaaacctgaaactttcattttgatctgcttatttcctctgcagttgctcccagccccagccaaatccaagtgatccacctgaaggggtgtcagtgggcagttccaatgttgcaaccagtaagaaataaaagtggagctgcttgattgactcatgtggacttgaaaatcctttgtgggttatggttaatatgatgatctagtggattgctgcagctgtaattttaaggtgcagtacttgtgacaaaaaataagaaacttagcatgggaaaaatgttgcattgtttgccaatggtttagtgttgggactagctaataagaacattgccattatatcaacatctgtttgtgtgccttgttcgagactgatgagtggttaaatatgctgtgcttgcttcctgcgtgtgtagcgtgaaagcaatggatgtccggtttcggtgcatcgtggaggaaggctttttctgtgggccgtagtttgtgtgggccggcatagctagctcgtgggcctccgtttgcgttccttgtccactgtcgtcgccgacaagctatttattgagtgaaaaaaagatctaaccataaaaaaaaaaagcatcgcaatacatgtctctactattataaaaattgaagatgtttttgccggcacatttagtacgtcatccgtgtatgagtcggtttctaagctcgtttgcttttagaaatacagatccgtatttgaatcgggttttaagttcatttatttttggaaatacataacatataagaaatctatttaaaaaaactcacacgtaaacttaacatgattttctagacatatatatccaagcgaattctcacagtgaactataataagattaaaatagcattcacccgttgcaacacacgggcatttttttaagtaaaattaaagtatttgacatggatagcaaatataatatattttgaccatacaaaataatatttctgtgcctcccttcgcccctccctgtcttcgcccttaagtgtatcgactcacgaatccatccatagatcaaatagatcgataacctttatgtgggggaggagtgcgcgtcagctggtcgggctagcgagagttaagccatggccgatcgaagcaagcaaacagccactttgatatgtaatgtaagcactgtacagtattttaccatgaatcaaatgattagaaaaaaattaataattacttaaattttttaaataagatgaacaattaaacatgttaaaaagaatcaacgcgcgttaaattttagagacggagagagtattatattatcattattgtatgtccacatgttcttttttaggggatatgtccacatgttatgaagcgatactgtcacaccctaaaaattcaaaatatataaattgttgtttaattggaatttttagaaataattttaaaagcctagaagagaagatctaattttttaattaataaattccaatataaaatggggccagataaaatttcattaaatactttgcttaatcctttaattcctagatttttctgggatttatttgagctaaggaagtatttttaataaatggaattgcatttaaggaataatttaaattgaaaaaggttttaaaagtcttcttttggctttgggccgaaagtcggcccaaaacccttctctctctcctcggcccagttcggcccagtccgcagccgccgcgcccacgcgtccgcccgctgacaggtggggcccacctgtcagggtcgtcgtctacctccggccgccgccgcccgaaaccctagtttcgcgccgccgccgttcctttccaaattcggtcgatcctttccttctccggccgaattgatagaggggaaacaatctccgggatcttctctaccttttctcttttggaatcatcggctaattctttttggaaatcgttggattcgagttcgaatcggattcgtctctttcctccgaaccctaaaccttccttctcgtcgccagccgccgtgggccttcgccgtcgcctccgagcccctttaaaaggttccccgagctctcctctacccgtcgccaccctcgccttcgcctctcgtcgtcggaaacgctctagcatcatgggacctagcgccgccgtcgctccagccgtgcgccgccgccgttccagtcgtcgccgtcgctcgggaaggtcgtcatcgtggtcgccgtcgcgtctccgtcctcgtccgccccttcgccgtcgccgaagatcgccggagcaccgtcgccgccgtcaacccgaagagcgtcgccgcttcttcctcgtcgtcgtcgccgtccgttgatcttccgccgctcttttggtcaccggtgagttcgccgcgtcgcgctctacccgttggtgccttccgttcgcgccgccgtgccgtcgttcgccggcgagcatgcaagcccgagccgccgagccgccgccgccggtggtgacgtcaccgctgacgccatcatcgccctctcccgtgaaccggtcgtggaccgttcgatctcggccatccgttttggatcaagtcgatctcggccgtccgttcgcgtgaaccgtcgccgtgcgcccggtccaccgaaaccctagcccgctgacgcaataaatccctttttccttttcaaaaataatttattattgcgtcataattcaattaaaatcaatttaagtgttttaatccgatttaatcttcaaaaattcataactaattcatcttagctcggatttagttggttcaagtctctaaatttttctaaaattgagatctacatgttaaaaatatccacatgtactgttcatgcttgtttatgtgctgttttggtgattttgctcttttctgtttagattccgtcgtttccggagagtccgttttcaccggagaagagtttgaagagttccaaggccagcaaggcaagtcacacagatcccaaacaaccctttgagcatgttgatcccatttaaagctatggtttctattcaactattgcatttattttcgaatgtcattgggtggaattaacctattgtttgttatagcccttttgttcttgattactttattccttgataccttgggttattataattggactagttgagctttatatatattggttcaactagatattaggtatgattgcttagccatgcttagaaacattagcacactttcgggataacttatgactcactattacttaatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgcattgtttataagggggtgattatgattcaggaaggtgcgctgcggtggattgtgttatgtaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttctcaccatagtaaatgatgctataattggtaataatttgattaactcctggtttggaatggtacattcctggtttggagatagaactgtgcagccgggatggttgttcagaatggttgggcctatacaacaaggtatgttgtatagcgttggattaatattgtttaatacttaactgttttattaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacaataaggctgatggtgtggaggattaggtgtaaccttggtcaagctgcctgtggagtggagccgtctgcgccgtttatcttatttttccgctgcttagatctttattgtttgagaggaactatctacctctgtaatgacattttattcgcttattaattaaagtaataattgtactctattatcaatttgttattgtgtgcctcggctgattcctagacgagggttcacacacatgtaagcgtttggaattttggatagaaattccgggcgtgacagatacggcgaccgcttggctggtgctctcgcaaaaccaatcacaaggacaacaagagtcgtcagagaccgacggccgtagcatacgccacgtggccaccggcaggcgacggcgtctcacctggaccacggacacgtgtcagtggcgttgtacacctgtgagctgccgctgccgccgtcagcagaaacaaacacaaaaggaaatggagaggccgtccggaggagcgacgagcggcggcgcgtgggcacaccggccaccgccccacgtactactactactttcagcactccatgtgtttaagtactccctctgccccgtaatattgattttgattttttcttatgttgtttgaccattcgtcttaatcaagaaactttgaaattattatttattttatttatatcttactttattatccaaagtactttaagcataattttttattttttatatttgcacaaattttttgaataagaagagtggtcaaacagtgtaaaaaaagtcaaaatcacttatattatgggatggagggagtatgtgtttacctaaagtagtactctattcatattatttactaggaacaaaaaaatgccgtcgactttttattaacatttgatcaatcgtcttattcaaaatttatgtgtaaatataaaagtatttatgtcatgctttaaaaacatttgaagataaatcaagtcataataaaataaatgataaaataagacgaatggtcaagcgttgtaaagttaacggcgttatatattaaaatacgaagagagtactgcatcagtatcatactagaagaagtaataccagtactaaacagctttgatattttcgctagtagcccgcatatatcctcagttaatttgttgctttagttaaattgtgttaagagtgaattgcaccttgatctgagtatctttttttttgttatcgtagttttactttagatcacctcttaattcatggtttttactttaaaactagggaatgttacattttctagaatagatggtccaaaatgaagctctggaataaaatatagcccaatgtataattcattaataagaatagtagtataaaaatctccatgtaaaattattttcagttgattagtactcaacaaggtatattgtgtcacgtagaccataagatattgtcttgtagggatgtaagtggacaatctcactacccatataaagcctcacttgccaattactttctcaaaactttaaaagaaaaaaaattaactagaacaggtaaaagggaaaaaaaatcccgcttgtccgcttcccttggcatctggatggtcacgtggcaggaaagaacttgtacagtagtagtacgtgctagggtttgaagtaggagcgcgtgtcaatcaccaaaaaaaaaaaacaaaaaaaggcacagcagcgagtggaaaggagtcgatgggattttatgcccaaaaccgcgagagatccaccgctgtttgatgggttcgttgggacttgggaaggaatccatcggcgaatcgccgcgcggctccgatccggggcgcaagcgcaaggccaccggcccacgtactccactactcctactccgtagagaggcgacgcgtttgcgcgggcggcgccgcggccgcccaacccaaccgtcgctgcctccgtctccgtagtccgtactgcctgtgtctgcctctgctactgctgctgcctgagagcaggtaccatagcatagcaggctacaaaccagctacaaacatattttaaaaaaataaataaggagagagaatggtagcaggctacagatttatagccagctgtagcacggacttcaagacacagtgtgtatgacagatgggaccatatattaatagtgtaatatgtaactattatatgaatgagctattatattggctatagatgaatggtagttattagttggctatactattgaacttgccagagaccaaccagctactccctcacgtgcggctggattaaataaacattaatcaattaattaattatagagacaatcagttgccacttgccaattaaggaagaaggcataagtactgtagcactgcagccgcacactccacgtctccattgggaggaaatggaaaatagtttttcttttttttaaaaaaaaatagaaaatagtgctccttccgttttatattataaatcgtttgatatttttcttagtcaaaatttattaggtttgatcaaatatatagaaaaaaagaaacatgtacaacatcaaatttcattaaatttaacattgtatatattttaatataatgtttattttatattaaaaaacattactatattttgcttaaagtttgacttaaaaaaatctctactattataaaattgaagatgtttttgccggtattctagtacatcatctgtgtatgagtcggtttttaagtttgtttgcttttgaaaatatatatccgtatttgagttggtttgtaagatcgttcacttttgtatgatacaaaaggaatcatataagaaatctgtttaaaataactcacatgctaaattgagacgatcggattccaaactttagctcatgattttctaaaaatatatatatccaagtgaactcccacagtgaattttatcttaactaaactatataattaaaatagatttcacccgttgcaacgcacgatattttttctagtactccctccgtttcataatgtaagacttcaaacattggttatattcatatatgtgttaatgaatctagacacacatatatatctagattcattaacatctatatgaatatggacaatactagaaagacttacattataaaacagaggaagtaactcataaatacggaacgaaggggtagaaatatccgcatctcatacacacacagaagtggtcagccgccgcccaaaagcttgcctttgtcgccatctccacgtggccacccccatatactattgcttaacgctgtcacctcaccctctcgcggtttgagttttccacttccacggttccaccccgacacctagcgaagtactcgtagtaatccgaatcccaccgttccatccgtcgcggacgccacgctctcggctctcagctcacgtgacgtcaaccccgccaaaacgcgttattgccgtagtactacgcctcttcttccacctccatctccccctccgacatctccagccaattccagctcagctctcgccgccctcccctctcccgccacgtgcgcgccgcccctcctccaaatctccttttcttttccttttctataaataaatcaaaattcacacaccaaatcctatataaacttcttcctctccatccccttcccgctcaaactcaaacaccaacaccttcttcctcttcttcttcttccagcagcagcaacacacactactgacatggagtactacgagcaggaggagtacgcgacggtgacgtcggcgccgccgaagcggccggcggggaggaccaagttcagggagacgaggcacccggtgtaccgcggcgtgcggcggcgggggcccgcggggcggtgggtgtgcgaggtcagggagcccaacaagaagtcccgcatctggctcggcaccttcgccaccgccgaggccgccgcgcgcgcccacgacgtcgccgcgctcgccctccgcggccgcggcgcgtgcctcaacttcgccgactcggcccgcctcctccgcgtcgacccggccaccctcgccacccccgacgacatccgccgcgccgccatcgagctcgccgagtcatgcccgcacgacgccgccgccgccgccgcctccagctccgccgccgccgtcgaggcctccgccgccgccgcgcccgccatgatgatgcagtaccaggacgacatggcggcgacgccgtccagctacgactacgcgtactacggcaacatggacttcgaccagccgtcctactactacgacgggatgggcggcggcggcgagtaccagagctggcagatggacggcgacgacgatggtggcgccggcggctacggcggcggcgacgtcacactctggagctactgatgatcgcgagttggagctagcagttttgagctcaaccagctttgctcctcctatacagctaaatactgtaggagaaattaatggagattttttccttctttattttttttatattttttccaagataaaatggctgagctggtagggagttctagaaggaggaaataaagattacgagatttgtaatactactacgagggacagcatgcaaaaaagaagtataattgctatgctctctctctctctctctctcttttgtgtggagtggaataaaatgccagctctgcttatggtcagattttcacttttttttggagtgttaagacaaatgaaagctccagataaattagtgagtgctactgcttatctgaataaatgagatcattcatcatcctataaaagaataattaagaaaatgggtgtaccatatatgctattggcagacaaaatttagcagtacttgtaagtactagaatttggtttcactttattttaagtgagattgagcacttgtttatcatgctatcatcggtctacaattagttagaaactgtagttcgcagctcagttattactggatcaaaacttcgtcctttttttttattttttgagataagggtgtttttactcggcctcatatatgcaacctttttaaattagcaaattagcctatcaatcagaaaacttatttcttaaataacccaatctaaaattcgcttctatatatatttaaattcaggacgttgggaaggtcacttcgtccttttttttaagcttcggatcagttcgcactagctggagaagcagagatagttgcaccagattgatggtggttcgatgcctacgcctacgagaataagtactatatactgtatatgatattttcctcgtactagtatcatacgagtactttgcaaaaacacctcgtatctatacgtccgtgcttatatatatggctgtatatatacgtccgtgcatacgatcgagtactcggcaatggcacgtgctgagtactaatgtaaccctaatagtaaagggcacatgttgccgagagcttaagatactcattacggggagccgtgcgagtgattacatcatgtgacgacggatgattgcacggtctaattaattatcaattatagtaggtaatccatcgattagattagtggtcacacacgcacacacacaccggccctaatcgatcgctgaattaagacgcgtttccgcgggcggcgcagcggacgacgacgacaagatgtcacgaagcaggaagcaactctgcacgattgacaccagaattgttgtttaggtggtaatcctaattgtaatagattagacagtagagtaaaggttaaggtcttaggggggtcggcgctggcgctagctagttaggaggagtaggattctgtgaatcttgtgcacgtcgctggacggctggatacggatatggtccagccagccagctagcgctcatgttgagtcaccgtcacggccaaatggcagcgaccatgtcaactttgccacgtcactccggagaatactcttaacagtggtattttcaatccgtctcaaacaacccagtattagcactatgaatttaaacaaggcatacaagggacaaatgatgtgtctgtaagggcagtcccaaccctccacctaggatgatgtctatgacattaactacattgacatgtgggacttttagcttatgtggcactatattaattaagagagagagtgaagagaggaagaaactgggtctcatgcaagacacagcttcaacacgagaacctatgtaccagacactatcaagttttttgtattggaagagaatattgtcttcataatagatgaagaattaatatggttggtagagaagagagatgatgtatttattaatggcccactttaagaaaccataggttgtagagtgtagtttctattgtgatgtcttattgacataacaccatagataccgcttatggacactatgggttgggactgccctaataggttagtatattttaaaacagagattattatagtttagaatagagttagtagcgaaattttagtcttcagcagcatagttattaagagaaaaggacttacgctgtgtttggaggtgggtgctgggaacccattcccatacacggaaaacggagcggcccattaacgcgtgattattaaccattagcctttttttaaaaaatagatcaatatgattttttaagtaacttttgtatataaactttttgcaaaaaaaaaacgcaccgtttagcagtttgaaaagcgtgcacgcggaaaacgagaggggagtgttgagaacttgctcttgcaaacacacccttagttgttttggcaaaaaaacgttggcgtatacagacacacatttgaagtattaaatgtaaactaataacaaaacaaattacagattccgcatgtaaactacgagacgaatctactaaacctaattaatccgtcattagcaaatgtttaatgtagcaccacattattaaatcatggcgtaattaggctcaaaagatttgtctcgcaatttacatgcaaactgtgcaattgtttttttcgtccatatttaatgctccatgcatgtgtccaaacatttgatgtgaccgaaaagttgaaagtttgaagggaactaaacacaaccttagtactccctccgttttttaatatatgacgccgttgactttttctcacatatttgaccattcatcttattcaaaaaaatttatgtaattataatttattttgttatgagttgttttatcacttatagtactttaagtgtgatttatatcttatacatttgcataaaatttttaaataagacgaatggtcaaacatgtgaaaaaaagtcaacggcgtcatctattgaaaaacggaggtagtagtattttatagtgaggttcacctctgaaagtctatgctttgtacttcaatgtacagccatacattctgaattagttcatcagaagacatgaagcattttattagtagtagcaattttctgtttcttaattgaattagcttctgaaaaccaagaaataatggctacagtaacacacgccttttcttttcagtaaaatcactgaaaagggttacgctactactacagaagaaaacagctgaattggtagcataactattggctatggctaacggctgtaatttagagagcatgaaagggaaatgcgcacccgatgagatccttcattccttgctttctttagttctcttcttttgacgacagctccagaagatgttctgcctccctcaagaacaactttgtcagctgcttttggcctctgcggtacactatgcacgtcctaatatttacttttgacttggtctcgttgctctcgtcacttctgtgaaaaagacaatgagagtaatggtgaaacacaaaaacaagaggtgtacagatggaaatgtcaagcatgatagtgctaatatgcagaaaaaagtatccattaagcaacgtcaaaaggccctacgtccctacctcgttgcgtcttctgaatcactgagatcgaatttctcaagtagttggctgtcagatgcttcagttccagtgccctcttcaagttcagtcattcttgcaaaagagaagggcttgatcaataaattattgacaacgccatagaaaaaatacaggtacactgacatcgaatttctcaagttgtgggtgtgttacttgactctaagaagatccacaagcaaactcagtgctccattatcaccactgacctcccatatagcactccggagctcatcatctctatcttcattagatccaatctacacgaacagattcaaaggatttctacaatcaatttaccatgaaataaatatgctcatacagaataatgctgaaaactagggaaaataaataatatgtgaatattaaggtcatatcagaaaatgtgaaactagatagcctaaatgcttcttgagaagctttcttaatccttttagatgagtaaaacaaccttttttatatcaccaagaaattatgattgatgatgctgccaaaattagtaccatgtgtgataaaattttggactcatggataatattttagtttgaaagcaaatgcgctaattttcataaatactgtttgccagcttacagtacaagtacaggaggatactggttaataagacaactctatggtctgttgagaagtggttaatatcttattaaccagtatccccaggcattagtcccctttatgaaaaagatattaaccacttctcaacagattagatggttacgaacaatgtcatgtaaaatttggggtactaaaatgtcccaaaggaaaaaggaaaaaaaaaaaggacagggcaaggcaatgtcacatatgcaactgatgcctttgaacacatggtacagagtgtgaaaaacactaacctctccaagcaatgaagcggtatgctcaagctcatgttcttgcagagcaattgtacgcagggtacttataaattcctgagagaaaacaattttctcgatatatgatggaaccttgcgttgaccactccagctataactagaaaaaggacttgtattatttttgttctccttgttttcaccagaacagctaccaaaaaatccattttcaagcaaactacgaggtaaaagacatcgcaattcggcattctgtaaacacagaagatatggaaagtgagacccgtgatgtccaaggatacttgttgggcctaaatttttcacaacattcttcatatcgtaaataaaaactagagctaagaaatgttgctacctgtatctccagtagcttcatcttaatatcagcagattgaacctgtcgaagagcttctactggataatgaatctgcatttggaacgtttgttagctctagtttttatttcaaacaagtagctactttcttaaggaagtacgccaaacggaggaaatatcaagtataagccatcttatcactatgaacatgtggagcacttcaaacaatcagcaactttgataatgaaaaagggtgggtacatacgatttcataatttgaactaaaagaaaggagatattctcagtgaataatggttttcttatcttttaaaatgttaactaaaagtttggtcctttatgtatcccagaacaccgatagagttacacttacaatatttagctggagaacaattaagtaatggctacctacaatgtttcaagacagacaagtgctttgccactataatgtttgacagaaagagaatatctggcagggaatatgctaaacaaagaaaactgagttgacaaacacctgttgctaaaagtaatctcttactgagtgttaccatgagataatcgtcaggattgttgtcaattacaaatccatagaggtatagtagttcctgcaagtaaacaaaactatgtcatttcatcagcaactatatttcagtaatcataaacggtatgaatatttgatgacatttaatcattttgtagtttctcggaacaaaagactgcagcgctgcagcttcttttcgttgactattgagtctcaaagtcatctatcagttagaagccccaaagtaagattattttatacttcagaacattagcaagtgtgtttaatgcaaatccataaggaactaaaggatatgtgaatccatgaagaaatcaaatcaaaccaggcccagtgatgaaacaaagggggccatagagctccaagaagttcatcaccgtcatatgtccttcctcttcttttcttttttttttaaaaaaaaagaatggccagggtgacggcactaatgaagctttcctggattgtttgtctgaagtgcaaccaatatctaaatgcacaaatcaaaagaatcttcttgtgggtagttctattttggctatatatcaataatgcccgtatcagtatatagagaaatcgtgacagagaagtcagaatgagtatacacgaaaatatgaaacagtgacatcaatccaagtcacacaataacaagtacgataaaactaagagcaacaacttgagaaaaataacacacttgcttataaactagtcagactagatctgcacatatgtaactatgtgagtaatacctcatttcctttgttgccataatttatgcagatctctgtttcagccttcacaaagcttttatcagctagagggagatacaaaaataaacagtcataaattggaactataatcttatatcaaaatatttgattaaaggaaagatcatgaggttctcttatcaaaaggaaactggagctacttatgtacctagtacaaggtacattgaagaaggacatccagtaacatgtcccatggaatcaacttcccatgttgccagcgcctttacatctgaaaaatatgatatacctatgtaagactgaaaataacatgttttttcaatgagtatttattttcagtacaacaattttttttatgtaaatccttgcaaattcgcctacagttttttttttgtcaaaagttgaatatagaatgatctgccaactagatatttcgtctatactacataattcataaacttttattagaactcttactatgattacaaaagtcgattccagggacaaggccctcaacccaaattgactctgtattacttgatttaggattatcattgccactgatattcttagctgtaatggcagtcccagttccctggaaacaaacagttagcatgttaaaatttggaacaagaagatatgggtgaacaaattaattgaagtattgagatgttaaaaacaaatacaatttggcataattataaacaatgatttgtcagataagttggatctatattcacgagattggcaaagtatatgatgagtcctcaaaagtatatggcgtttccttgaggacaaattgtagcatgtcacaagtatattttgtttaagataattgtagattactgctgtaattaacaaaaccacaacttataatataaaagtcatttccctgtttccgtgttataatatccagttatgcaactagtttgttcaacagaaacatattcttgcccccattcagtttctttttttttttttgtggcacataccttgagaccactatatgccttcagtaacagaatttctctgttggtatgaaaaattttcagggccaagaaaggtcctatgcgatgttcctctctcttgacaacaaaattccattcaaggtcctatgctactctttcatgacaagaaaaagtcatgtaaccaatgtttaacctctttttcacttttcagataggttgtacatgagcaaaaaagaaacctaaatgaccacatataatcgaggggaaaaaattaagccacacacaataagtaaataaaacaattgagaagaacctctgaagctaggatctgcggtcagaaaaaatgcaattaacctgaggggcactgagactagaatcaccacaatcatcaccaatgttggcccgcttttcgtctagtgattccggaaaaacataaaaacgaggcaatggtatattcaatgctcgagtccagaatattgagtttgccctgccatagagtcgtgctgctgagttacataaaacaaagaaagcagggaactgaaccagcaactatgtgaaggaccctgcatcatatgtgtatattgcatttttcatttgttgacataaaactgttgttccaagatatttattgaaggagctgcaaatcaaagccatcacccaattaagtacaattttcttatgaatgagctaatttccaccttgatggcttgaaaattgtaatagtagcaaaggttagttgatgctaggtacaaaaacatccccaccattttgtaaactaatgcctaatttgtccaaaaaaaaattagcacactgaatcttttgcacacgaaattaacatgatatgccatgtcaatactatgaaactacagtatcagtaaggcttatattattccccccaaaaaaatgtaagccttataatatgacattatcactgcaaatgcaaagcataattatacataccaaaggaagtcttcgaaccgcacttcaattgagctgcaaacaatattttgatagtattactgttaaataaaacgaatttctttgtcagtaaacatatgatagggagtcatgagaattagccatattggtatatcattgccatactagacagtaaaaatcacaaactcggtaggtgggcatacagatgtataacagaacaatatttgagtgatattgcttgtggattcatgggttttaagtacgcacagaatcaataaacaaaaatcatgctggatacactctacttagcactagaagccttcacaagaaaatattcatttaatagggttggctgaaaagaatattcagatcaaaatatttcaaaggtacacaaagcccagtatacagtgcattaaaatgatttctaacgtatttataagttaaacctatgccatgtcaacaaaattcataaatgttctgtaaaataaaagtagcaatttatctcatagtgcagcattgccatcttggtgattctcatttctataaaattaaataaaaacataggcgctatcccagatgacaacaaatggtgcactcatacacatgaagatatggaacatgcgttaccccaaatcactttatatgagaagctattcttcatatcatactttggggtgcaatccccatgtatcgcagaaccccagtacagaagtgtatactaaaatgtaaaagaaactatgcatgtgtgcttgatacagaaatatagtgataaagttgcagcagcgctggaaaatgatgcgaaatcagtacaaaccttcctgattcatcgacgtttaagagctccccaaccagacctttaaccttattatcgaataaggtttgcaatgacttcctctgaaacaaaattgcagcatgttcgtttaaacgaatttgctcttggctccccaaaatatccccaaggaactgaaagaaaaggtttgcactactgatgaacctgcatcacggttgcccggtgaagtgtggtcccttccaactcagcaagctcatcttcggtgaaccaaatggagcttccgaaggtgcttggaagcatatccaaatacctagagaaattaccaaaattcaatcactgatcaagttgtttaacatggagagatgtggattgcgaccatacggcttccagagggagctagggcggagtcgctcgaccatgaggaagagcatgacgaggaggcggtcgtcgacgccaccttcctcgaagagcgcgcggcaccgcggcccgacgagcgggtcctgcagcacccgcatcggagtgatggcgagatcgagcggcaccaccatcaccacctctgcaacgagacacagccaacgcgcgagtcagcgcggaggacgagctcctaaaacctccgagagaagaggtggaatagcaaatgttaccgtcggtggcgccggcctcggcggcggtggagaagacgccgtagccctcgcggccgcagcggcggatcgtgcagccgcggaggtcggcgccgttggcctgcggagaggagccaggggtttagggatttggcgtgcacgcgagtagaaggggatgtgcaggagggacgaggagcaacctggagccattggaggaaggagtctagcttggcgtcgccgggtactgctgctgcggcggcggcggcagccatggtgttcgacgggcggcgccggcgcgggcgaagtggaagaagcggtggagcggcatcgaggaagacgacgacttggctgggccgtgggctgggtcagcgaccaggcccaaaggcccataggatcacaaatttgtagatactggaagactggaagaggggacttgatcataaattggtaatcacttgatccaaatatatcatctcttgagccatattttttctttgctttatagtagcaaatacgtcatctctatccaataatcactatattattcgatcatcttttcataatgaggtatttgaaatgtttcttgagctaattacatgggggtcaacttcggtttaagtttgtctgcaagcattcaagagagagcatggcaccaagctgatgttgatggatggtattagtgataagtagtgacaagtgcacaaaggagaccaaaaataaggaacacattcaacaaacagaaagcaagcacactactcggtaatctactatagcattatatatcatcaggtccacgttacattctaccactcacactctcatctcatctcatcactcatctcactcttatctttcagcttgcatcgcaggtgcaaggaggaaggcaagagactagcgaagcactctcacagccacaggacacatggtgaattgcacagataaacaaaatgctagcacaccagcgaagcccggagcgagtgcgtcgtcgacaggttggtgcaggacgcccaccgtatcaccgactcggcgaccgccacatccaggtgctcgcgctcgccggcgccgatggtgtggttcctcctgctgttcatgccgatggcgcgcgacgggttcgcccttacggcggccctcaggacctccgctgtcctcggagccgaggacgagacgagggccaccaccgtcgcgtcgcagtgagctttctcgcccaaggcgtcaccatcaggcgacgactcaggctcgccgggttcttggccgcagaagaaggagaagctcggcatggaagcgaccggggacgggaacacggcgttgcagggttcgcagacgccaccgaaggagaaccccgagagcgcgcacgacggagcattctcagcgacaaatgcagagaacgatgatctgcaggcgaatgtgggggagcacgcttcttcagacatgctttggcaggcgaccgggccaccggtgttgaagctcacatcgcggctgcatgacgccagcggcgtcgagaacgaacatgagccggcgtcctctcctctgagattgatctcatggcaatgtccacaagaatcttgggattggtcggcatgatcttgtatccaggaatgctctgtgtaacaacagttgtttagattactccacatggcaagcattacaaaaaaatggggaaaggaatcattagcagctgatctgtacagtaaggtccgggaatgatgcaatgacaaccaaacaaaagattccacgaaggatgacagaatgaaccagcacaactaaaggaatggctacaatagacaaaaggtgatgaagtgccaagaaattttaaagttcatctgtaccacagtggatctaccagaacatgaccctacaacaaactgtgatgcaacccagctttttcccccagccgtgcaagtttaaattagaccaccaacttaagctggcactaactcagtacttagcagccaagttttgttaatttattcaatatgtaaagtaaacaaggctaacctcatcaggaaaattttgatcaatttcgatttacaattccagttacatgcatgtattaatagtcagtgagcattttccatcttaaaaaaaaaaaggcagttccaagttctcaatatgatgctagtgatgtagaacaaggacaggaaattgaaagtgtgtggtttctgaaaagattgaggccgtgtctcacctaggacctgcttggctgtgagcctctgtcgaggatcgcgccgcagcatctcggttattagctccttcgctgaatcggaaaccttgtcccagggatcagaaggaaaccgcagctcagtcgacctgatacattcgaaaatctttgatttggttttcccccaaaatggggggatgccactcaggaggatgtaaagtatcacacccgcgctccatacatcggcagcctcattgtacccaccggcgagcacctcgggcgcaatgtaaaatggactacccaccatgccactcaagctccgacctgacaaaaccgaaacccaattcagcttcgaaacaccagccttgacagagagcagccacgaaattgctcaagaattcccaattataccaggctggatgtaggttgcgaggccgaaatcggcgagcttgatcggcgaagaaggcgatttgctgacaaggaggatgttctcgggcttgaggtcccggtgcacgatccccttgctatggcaatgcgccacgacctccatgaggtagcggaagagcgcggcggcctcgtgctcggagaagcagccgcgctcctcgaggcggtggaagagctccccgccggcgcagagctccatgaccaggtgcacggacgcctcgtcctcgtacacggccttgaggtcaacgacgttggggtggcccgagaggcgcgccatgacctcgatctcgagcttgacccccctcacgtcgtcgggggacacgaggcggtccttggcgatggacttgcaggcgagcgcctcgccggtgaccatgtcggagcacgaccggatcacgccgaactggccccacccgagctggggccccagcgcgtagcgatcctcgaggcacgacacgtgcgccgcctccagtatggcgccgcgtagccccgccgccttgtacgagttgtacttggcgtcgccgccgccgccagcggcggccatcgcccggaggtcccacacgctggaatcagacgagattctccgctgaaatctctcaccgactccccccccccccccccccacctcagtgcatcatccttgcttcttcggccactgaatctgggcacgaacacaaaccgagcagagaaaatccaaagctttttagcgctctcgaaaccccaaaatcgcgggcttttccatacaaatccccaccgagatcattccccggaaaaaaaaacaaaacgaataaaaccgcgtggattcaggagatggggggagcgccgcgaaattcaaaattcccaccagggagagaacccgcagaccacgcggccgccgcaccggaggaggaacccctcctcctcctcctcctcctccggtgagagagcgctccccacgagcaagtctccccgcgactcgagcccgcgcagatcgagcacccacccacccttgctgctcgacgcagaagccaaaaccaaaaccgcccgacaaaacgtccgacagcacgtagcggaggggggagagtcgacttacccgcgcgcgctggctgctccggcggccgagcggagtcgccggcggcgaggtcagcctccggcagcgcgaggcatccgggtggggcgagagagagagagagaggggtgagggtattcgttggtggggggagggggaagcctttgctttttgataggtggtaggagaaagaaatgagcatccaataacaaggccattaattaattaattaaatcattgttcatcttaaccctaggttttattttaaattgctctaggtttggctttggagtttaccttagagacttgttgctcttgtttgcttttgttactaactggagcagtagcagggtttcccaacggttaccgcggtaaccgtgaaaaaccgtacaaaaccatgcaaaatttatcaaaattttaatttattttttaaatttatttgaatttaaggaggttaccgcagtatttatattaccgtaccctcgcggtaagcccggtaaccgcgcggttaccggcggtaagtcgaaccctgagcagtagtactctactcatccctccgcataaaaattgtagactacgaatctggacataataatcttaggatggagtaagacgatttattaggataagattttgataaacaattgttctactaatatgttggttgtttatatagtaacaaattacgatcataagcaaatacttttaaatgtagatataataacatcaattttatgttggttggttaaatgattgttctaacagagtgaatagtatttgttgttgactctagaagaaaaaaatgattttcgccagactggttagttaggaagaggtatgaacgatgatgtatgagactttgaattgttctaatgtgtttggttggtttgaattaggtgcagcagttgtggtaaggtcttgtctttttttcgaagtacaaattatgcgtttcgggatttgttttttttttttttgggggggggggggtacagaccgttagacaccaatacagatgcagtctgtacttcgagtattttttttccctgcgaccgtattagcacataggagtagtataaggtactagtatgtcaatgcatgtaaagttgttaaagactgaagaaaatgagatgtgcaatttgacccggtagtttgagatacactcaagtgtagtgacactctttctacaactcacgcaaaaacataggtgaaccttcacaaatcagtaaggatatgcaagcagctagcgcatcctggtacaaatcactcaaagttattcattctataaaaaaaataatcttatgtttataaaaaattccttctgttttttccaatgtcgacccaattatatgtcgcaaaaggagtcccaaaaaactgcaaatgcaaagtaggacagaagcaaaagaaaaaccagaaagaaagtaaacacaaaaagggcccaatctcctaaaaatttgttgtttagttaatgtggtgatcatgccgatgtgtgatggttgccctctttgctggattggtttaaggagcactacaagttgtgcctctagtggggctacaaataattgttcttaagcaatgccatttgcatgcctttatttttttttttgcttattattttttgtccttgttctttctgttttgcaagtgattgatcaggggaaagaaagatctaatgcaatgttgtgtggttggctggcctaccagagtgggaaagcgacaggagggcgaaagagagatgcactgcatttaatttgcttccttctggtttcaacgggttcgtttgcttgcgtccatttcggaggtggaaaaatgaattagcacattccctagtcagaccagctagccgtagccaaaaattaaaatttgaaacttaaatttgagttgattcttaaaagttgctaagtacacatatcttaaagatttacgcataaattatttttgttgctaatcatgcttaaccaattaagattttttttaacggtcagacccgttgctgatattttatataaagaagaaggtgccccattttaagaggtaagtgggactaacctagtgctcagttaattagagaaagtgagcaaaaaccacaactgcaacaccacaccaatatatagctaacttaagctaccgcgacaaaacccaacacaaggcaattaagatcaaggatagagtaacctaacaaggataatgttgaagtgcatctacatatgcgtgagtatatacgacagttcaaaggaagaaccatgaaaagttgaatttgatgaatgtgtcgtttatggatgggatatgagccgttagccaaattaactccacaacatggctactaatacaagcaagaagagaacatatatggaacaaacaaatgatagcgacaacactaggtcttattcatgaaagaaacggcatatatagcatactcaaaaaggagaggaatcatgcaaagtttcaacgtagcactagtgttttcaagccggagaacaattctggtggtgggctgcaggatgatggtgtctctaagatcctggacgttggtgagtgttggtcggggtccaaagtggagcaacaccatcattatctcctaaaccgttttttgattaagaaattaaagatagagaggctcaatgcaatgcaaggaatctggaccctggaattatatggccagtgtggttgcaatttgcattgcattttgcactaggtgaaccactagccgaagcttcccacacgagctggtagctagctttgcccaaaaggttagcccggattctttgttgctccaaatcaaggaggctttccgtgtgcacggaaaaaaaaaaaagctagtaatgggtacgcgtgtgtgtgagagagagttattgtttatgcccgtttgttaaagctactccatcggataatgtgtgtatctttcttcgtgctctcatggatggattcgtatcctctggcttgacgtagcaatgtcactacgtgacattatttctatctaaaccatccgtttgaaatcaacggataatatatttgagcggtaacatgtgttttgttgataacattccgttaaagccgtatcgatttggcgtattcaatgggattatgctctttttagaaacttgttgcataaaaaaaaactcataactcaacttagggcttcttcggaatacgggaattttataggattttcagagaaaacagtttaattcctccaaaatttctatgaaaatcctacaaaccgaatagatccttagtattgaagtgtgaaaaaaaagagaatttcaccacaaaatttaccacacattgtttcatcaatggaaaatgaaatataccgtttgggatacctaggacgacattcatgctaacttatcatatgctttactttgcaaatactatgtcgatctcgtgcaggatatatttcagcaggtaacatgttttcttttttaatacactttgttggtgtgtggatcgagcgtatttgataagggcattgtttagttttccccatattctcaactttccatcacatcatatcacaacaaaaactttcctacacacataaaattccaactttttttccaaactcctaactttcttcaaacttccaacttttttcagaaactaaacacacccaagattattctccttctataaattctctgtccaaaacctcatgacactagtttgtcctaggtttaactttggcaaatgatatgtgaatgcaatgctctaactaaagagtttgtaccttgtactctaaacaaaccatttctcgtttggtagagtagacgacaacagctcagaggtatccgtacaatcatcagctccgctagccacgaaaccacaccgtacgttgaccactcatctgtcgccacctggcgcttagctggtctagctgtctgtgaacacgcagtgggccccacctgtcagatcctcggagtaagtgtgtaatgaatgatcttcgctggaatgtcaacggtggggagtaagtagatgatcacggtcggttgtggctgccacgtgatgtgattagatggagctgagatgctgatgtgtgtgattagtgggtaggattagtttgttcatcactttttgaaaaaaaaaaaacacaccgtaagttgtggaatggatccgttggccttggcctttgggccgttgacctactgcatctgactttcctatcactcattttttttattttttttcacatgtttacttttgtttttggaaggttttatactcccgttctaaacaaatcaatctatccagatttgctgtattaagttttatcccattaccatcatgattgatttattttgaaggacaattttactatcattgagaatgtgtcaggaagtatcatactttctaatgtaaaatttgatgcatccaggtactacagctactatgtactttgaggtaaaaaaaatataaaatataggtatctcgagataatttttaaaggattatacaatttctctattttgaaacagagggagtacgtgccttgtgcttagtaggtcatgcttatgtcatcaacatgcatgcatacagctcggcccaggcggcaaggcctatctggagttgagatgtgaagcccaaagtcatatcaccccttctttgctgtttgaaattaggcctgcttatcatgggctgaaattcttcggccacttcatttttcttcactttgcaggcccaacgattggaagcttctaactagagattttggcccgtttgtgaaacgagaaccaccgtcacatcttacgaaaacgctaatccgcgacaagtcgcgcggagcggcggacggcgcgtgtacggtactcttttttttttgtttttttctgttttcttccagcgcgtgtacggtttcttggttttcgttttttctgttttcttccgtatttttggtttctttttctttgttttcgttttttgttttcttccgtatttttggtttcttttggtttctttttcttttttatcgttttcagtttttttcggtttttataaagtttatatacgtgtatataaagtttgtatacgtgtacataaagtttatatgcatgtatataaactttatatacgtgtatttttttatttttatatgtacgtatacaaagtttgtatacacatatataaagtttatacacaggtatacaaagtttgtatacgtgtacataaagtttgtatatgtgtatacgaatatacgtgatgttttttttagtttttttgatttttttaatatgtacgtatacaaagtttgtacacgttatataaagtctgtatatatcatatataaagtttatacacgttgtatacaaagtttgtacacatcatatataaagtttgtatgtgtgtatttttttatacataaaaaatatacatataaaattatatatttttttatagtagtatactagtagtagtactagtaatagtagtataagtagtagttatagtactatagtagtagactactagctaatatagtagtactgtagtactagtggtggtggtcgcgcgccgggggg

SEQ ID NO: 72291 - DNA, 4660 bp, Oryza sativa
ctgttttttaaaaaaatcatgtgacttgaaaatcctgtgtttggattttgttgctaggtctgtttggatgcttggtggtgcgctgcaaccaatacaaacaatgtcgcaatttataggtagtcgcagcctcacctgccaaaatgattttttgagttagaactgcttattagagtgaggcattttttttcatgttttagaatttacataaaaagtactaaactgtggtactttagtttaatctacaaactattttctctagaactcacagcttagagccgtgccaaaaaagggcgtaattttggattagttaatactgctcccttcgtttctttttttttttagagttacatagtacaacgcagacactcacagcgcacgtgcacttatctctatgaacgtacgcacacaaactctacccatataagcatcgtcgaagactgctcccttcgtttcttaataactagcactaggtaatattcgctttagaaatttgatcacttgttttatttgttgataagtggatagccctttgaaggtgaggtttttgcttgtgttgtaaaggctttggcctgttttggattaggttggtggacacttttcctttcgtgttctcttcttttaatgaaatgatacacaatgaaatctattaacatttatctaacaatgtaaaaataattaatgagaaagtcaaaattatcaattattaacaaacggagggattattattttgtgttttcctccaaaaacctgaaaatttgagtgtcaaatttcggcctgttaaccttcaaacaaaatttcggcctgctaagtatttgtggggcttcgaagtgccagctcattaagctgcccattgacatgaccttttcgtgcgacaagtcaacgtggaaaaatccggcctgttaatctgcgggccgttttaacttacggcccgttatacgtacggcctattatgtttcggccctaagatttgggcttattaatcatgcggcccatgtaggcccatttaacaggccagaattccggcccattagtctttagataggtgggatttgatgatctctcgcagtctcatcatcagcctgtattcctttgtttcttttgggctataatcatttgattttctttttgaactcaaatcgtttcaaataattgcataaaatcacgcagattattcgccgatgcgaatcagaatcgtcccacgctcactttaattaaagtcacactaaaaaaatactccctctatttcacaatataagttattttagtatttcccatattcatattgatgttaatgaatctagatagatatagatgttaatgaatctagatagatatagatgttaatgaatctaagacatatatatctatctagattcattaacatcaatatgaatgtgggaaatgttagaatgacttatattgtgaaacggaaagagtactaaacaagaacaaagattccaatttgcatctgaagttgtatatactttattaatcggcgtcatggagaaagagatttgcgattaggacctgacgaaacggaagccgccagccgatcgcttttgttgacttcaaacccgggggaaaatcgctggccggcaaacgatcgacgacgtgcgcgtccggatccaaacacgcgtaaacaattatggatgatgatacggtacgacgacgacggtggtggcagaagaaattcggcgaaatttgcttgatttccctagttaatctactcatcaattgggatgaattggaccacatggtttgatgaatctaatgtgtgtgctctggtcagtaggttcgagactttgggttgactgataaagtgctaatgcagccatgatgcgagatgatggaatattttactatcttcatcacaaaatatataaaagattttctacaatagtaaaaaaatacttggatcgtcttctatttaagagtttggtaggataacattagcattggttatttttcagttacgttagatagggtggtatgactaaaagttcatattaaaaaatagtctactttaaaattagatatttaaaagttcaaaaacaatacaaattctcagattaagtcgattccaagcggaattttaatacaaattctcatatgaatgttgttgtgttagtatacgtatccgtgatgtatttgaacaaataccaagttaggcatctagaataaattattatgttttactaaatacaaatatgtagtacatattgtggacactcgagtttgctaaccgtgtttaacacgtaaggttaaacaatatcatcgtcgaaaatagagaaaaatgagaacaaaacaaaataaaatagcgaaagaatactgagatatttacccccagtatagagaagaacaaatttatattaaaattatgaaattttaatgattcattaatctcaagatatatcagctcaatcttccgaaggtactcgtagacatggatgtacgtgtgtacgaagcgtacacacgttaaaataacttatattgtgggagtgagtttgcaggtgccatgagcttctacgttttaattgcattccccgtaaaagatagtagtaccaatgtttcataatcagcatccttcctagcgtagttgtgaaaaaaaaagggaaaacaaaaaggagatcgttgtgcggtgcctcgacgagacgacgatatttccccttcccctcgtcgtcgcctccgactccgactccgactcctcgtgagctcgccccgccgcctgcgccgccgatcccgcgaggcgcgccgccgccgttcgtcctgctgcttccgccgcatcccggtgagcatccattcatcctcttcctcatcgctgtgtacccactcactttttttttccctccaattttgcgttgaaccctttggttgttcctcttctagacctcggaggaagcttttctcttaatttgccttgaaaacttgacacgaatagtagtttgcttgttccccaaattttgcgttgaacccttgttgtttctcttctagacctcggaggaagcttttctcttaatttgccttgaaacttgatacgaatagtagtttggttgttccccaaatagtttgggggttcagtttattagatccgcccctgttttagcataattttgatggtatactttactatatgcgtatttaggcgctaatcagttttttgttttgattctagataccgtgggagcactgaagaaaactgagaaatggatgtttttcagcgattctactgtttcgtaaagcaaccctactgttagtgttggttgtttgaagatgattgaggggtcaaggtttcagaatatgttgggcggtgctggaattggaggtggtataggttgcagaggaaggcaagaaaacgagatgaatggcttccacaatatgccctactaccacaaggtcggggagagctcccacatgtccgtggataacgccgacaacctgaacatgatgaactttgttggtggttcggttgccatgtcggtggataacagcagcgtgggatcaaacgagtcccgcacggtcatgctcaaacaccctggcctccgtgatatgccggcgccgagttattcggttcacaatagcgtcatccatccgaaccgggctatggcgcctactctgaatgaggatgcattggctcgggtattgatggatccaagccatccgacggagatacttagtaattacgaggagtggaccattgatctgggtaagctcgacatgggagctccttttgctcaaggggcatttgggaagctttatcggggaacatacaatggagaagacgttgctattaagctgctggaaaagcctgagaatgacccagagagagctcaattgatggaacagcagtttgtgcaggaagttatgatgttgtctacgttgaggcacccaaatattgtaaggttcattggggcgtgccggaaatcaattgtttggtgtatcattactgaatatgcaaaaggtggatctgttcggcaattccttgcacgaaggcagaacaagtctgtgcctctggggctggctgtgaagcaggcacttgatgttgctcgggggatggcttatgtgcatgccttgcgatttatccatagggatctaaaatcagataaccttctaatttcagcagacaaatccatcaagatagctgactttggagttgctcgaattgaggtacaaactgagggaatgaccccagagacaggaacctaccgttggatggcaccgtaagtcataatcacgcattcacgctcattgcctactgtttacctttttaaatctctgtcaaatatgcttatcttgccatcatgcagggagatgatccagcacaggccttatgatcataaagtagatgtttacagctttgggattgtcttgtgggagcttataaccggcatgctccccttcacaaacatgacagccgttcaggctgcatttgctgtcgtaaacaggggctctcgtcctgcaatcccgcaggattgtgtggattctctgagcaagatcatgacttgctgttgggacgcaaaccctgaagttgcccatcatttgccgagatcgttgtcatgcttgagaatgccgagatagaggttatgagaaatgtccgcagggcacgtttccgctgttgtattgcggggccaatgaccacagactgaaactaatgcaggataga

SEQ ID NO: 72292 - DNA, 7074 bp, Oryza sativa
ctctccactgcgccgccactctcgtgccgccgcgccgccgctctcgtgccgccgcgccgccgctctcgtgccgtcgcgccgccgttcccgtgtgctgccacgccgccgttcccgtgccgccgcggcgccgttcccgtgccgccgtgccgccgctcccgcgccgccgtgcgccaccgtcgctgccgccgtcgtcaccgctgctgccgccggtgagccgccctccttccccctcgtgtccaccgccgccgccgctctggtgggagagagccaagagagagagggagaggaaaagagaggccggcagagagaaaaagagagaaagagagaaaagaaagaaaaagagagagagagaaaagaaagaaaaagaaagaaaaagagaagagagaatggagaaaaagaaaaggaaaaataaatagaaaattaggaagaaattaaggaggttaatagtttaagaaaatctaaaataattagaatttaattatagattaattatggtcatagaattgcaaaatttaatataaattatagattattcttggtaatttctacaagaaatcaattcgcggtagtagtttaactgtaattaggaactaaacgattagatgaattcttatagactattatagattattttgggtaatctctataagtaatcgattcacggtagaaattcggatttatttactagggattttagccgtatattatatttaatcatttagtcatagactaaattaaatcatataatatttctaggatttcgtccgatatttagctcgcgatagaaatctctaacctattatatggatataatgctcgggtagattaaattaaaaacttatgacaacaaaacatttatacccgcaaaatagtttgaatcgaaattgggtttgccttagttcgcgaataataaagttaaaataaaggaatcgactttcgcgttcgacttccatttggatttatttggattttttatttgaattctaatcgaatccaaatcagttttcgcacgtaactatagagcccgagggagttgcggatccaagtgaaggccaagacccccaagaccttgagcaaggcaagtcatcactattccttgaacatgttgatcccaattgcgaaattattttgtttataaataaaattgcatgcaatgatgaacatcctacttgtgattatgccatgccttgattattgtttatcccttattccttcgtaaccatgtttacgtatgagtccctagtcaattatgacaattgcttagaaatgctattctaggatcatgcatactcatatttatcaaatgctaaatgcttgggcaattacctttgggaaggtaattgagatgcggtatgtggagacatgagcgccacattgccatgaaattgataacatgatttgtgaaaggaaaataaagcgaaaacaactgttttcgactggggcggacggatgatttgggtggtatctggaaaaggctagtaccgtccccagtcaattaaggaccgagccatgaagttaagcatgaaacgacccccgtacaactgtacttctcgaatgggtatagacctagcggattagatagccgagcggaggcagtatccctgcatagatggttcacccctgagtgaggcaggtgcgctacgatgggacagccgttgaggtagggccgagaagcgtgccctacatcggtgtcgccattggtaggactgccatgagtatgtgagagagagaacttaacttgaaccataatttaatatgtgtgtgagacttctctttcctgggagcgccagaactcctctcactactagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacctgtgtgggatgggatattgcatgatgattttttatgctgatggagccacttcctgagaggagggaaggtggacgtcctcagaaaaccatgacgactcaatggcgggaagctatccttgggatcacaatggatggtggacagaaccgtcgttgtttaatgtgaacactggtattaaaacttgatcagtctatgctaggtcttaggtttgtgaaaagaattacaaaactggcttagcgcaaaagagccatagccatcctttgaaataccccttttcatatgcattgttgttgtggtggcttgctgagtacggttggtactcacccttgcaaatataaaattaatcagaagcaggagataaagctttggaggatccctatgcctactaccaggagggagatgaagacgatggcgctcagtaggtcttagtacggtcgttgcctgtggcaatggcatgccgctgcgcctgaattccgctgccttatctatttctgcattttggatgtattccgaactgctcggtccgatgatttaagacaatgcctgcgggcttatgatgtaataattagcactagactctcgtgtatgtgcttttggtatttcagctatgaactcgtgtgtaccagactacttgatccagggaaatggtactgtttacacgaatgattcctgttataaaaacgggggtccagaagatatgattagttaatgtgacttacattttgttttagcatctgaataagctaaacgatgtactgattctttatacttatagtttcatgtcacggtgtgatcgattcaacaatttgttccacaaaatttttaaaaaaacaactgtaaacaatatttatgacaagctaaaagggagaaatgggctacattgatttggacatatatatgtactaaaattttgagaaatcaaatacacacaatcgtcttaatgaaagctaaccaaatataacatttttccatacatccactataaacagcatatatttgaaatcgtgttcacatatagctccacaacaatgttttggaaggacacatgtatgccttattttgccactggcttattacaacaaaataaccacaagaaattaattgtttgcttgctcacgcatagcatgatctctttcaagacaaaattatttagaggttaataattatcatgcaacccaatgcaagaatactcatgtctattaattagacgttgataccactcttgtattcagagccggccgtaaagctttcggggatgacgtcgtcgacgacacggtagccgccgttcttgacaaggaagcgaacggagaaggggcccttgagcgccgcctcactcttgagcgaccaggtgttagtcgatgactccttgagtgccacccagtccttgccgcccttctccttgatctccacctcagagatggcgacgttggtgacgagctctagactttttccgctagaaccctcaccgaccttgaaggtgacctcagtggcgcacgagccgacgaccaacaatgccgccactgccacagagagccggaaggaggacaacgaggccattggcgagctagctagtttgttggtgttatctttcttgtttcttgaagggtagagggatggatcgaggtgtttggtgatccatgttgtagttgggtgcgtatttatggtggcagggggcaaagaaaaccaggcatggacgcatgatgcagcatagagatcgttggccggctttttcgtcgagcaagtctaatacaattcctataaatagatgcaaacttggtagttccgattgtttcgctggtgcaggacatgcagacctctcaaaaagtagttatgcatttccatgttttctgtactttttttttaaattacaaataataaaaatttgtgatgttccgtttatggaggatatggaccaagacatgaaaatattaggggcgaagatgctagtggaaaacagaggggtggtagagctaacggtcgggagtgatggccaggcacacaaagggccaccgtgtagcatccatagtagatgttgcagaggggccatcagcagctagatgttgatggaaccgtggcagtgacggatgggctcatgtgttggcccgttgcgggtctgctcgataggggacataggttagcatttatggtgagatggggctggtgctaagtaaattggtagagcacacctagtcagctagctggatatcgagcggtggtggcagttgatacaatacatttgataggaatacaagatgacaactcgatgaggcgtatgtggggaggagcacgtgaccttatgaaaataatccaacaattctaggtctgggtgtagattgtacattaaaaaggagtacactataaattcagttgaattttttattggcaagtgcacatgtcgttacatcctgcaggttgagagctagacgtgaaaggaggtccatggccaagcaccggggaatgatggttgattgattttgatcggtggtgggggtcgggggcattccattcatgcagtggaagggacatcatgcgtgcaggactcgctcgagagggcatgggagtgaggatgggcttacgatggacgagggatcataaaccaccactacattttttaggccttaaggatttattagttctttacatacatagtttggaactaatgatatattttctagttccttttaacacgttggtagtgtaaagattttttttctatttaaagtttggaaccaattgtgtatttactttagatactttgcaatagattgatattctcgtagtactatataaactttagatggatcgatgtgttttgtgatccatgttgcagctgggtgtgtatttatggtggttgggggtgggtgggggggtaagaaaaccatgcatggatgcacggtgctgcatggatatcgttggccggctttttcgttcggagctcttgtacaattgctataaatagatgcaagatggtgattatattgttattttatattgttaggtgccaaattccgctggttgataagtaaaaacctcgggaaagagggtgatgatgcaccgagagtagtattgatctagagattcattacaatggcctcgggtgtacatatttacacccatggatagatactagtccttgtaggacaagaaagaaacttttctaaagttaaaacggaaacataaagtccttattggacactaaacacactttcctaaagataaaagaaaactaacaaactattcctaattaatagataacttgccatgttgtatccttcttgaactcggtcacttcggataagcttcctttaattcgattaatttccttaaccgaatatagcaggaatccgactattggcgatgtgataattttgattggccgattataggattctgaagccaattctgactctagtccgatgatgtcttcggggcttatcaaatttcgctgctaacagatgtggcaatattaccaaattcctaaaattttggcattgccaaaatttgttaaggtttatttcgaaaattgcgtgcatgcatcaggcacccgcacctcccacgcttgcgcgccgcctccaccaagtgcaccatcacagacgttgttgcaacaaatcaactgcatattacggaaacgctatagtaaaggaatccgtttcattttttgttccaccaaaaatgtttcagctagtgtactcgtgatgtttcactatgtacggatcaaatgttgcagtgaattgaaatagtattttgctatttgttgaaatattgtttttatatagagtgaaacaacgtctgattttttggaaaccgtttgtatcatacgttgtagcaaaatgttccacgaggtgatttggttgtatttcagctttttaaaagactaaaacattttcgaactacttagtgaaacattctcgatctacttggtgaaacaacgctcgatttttgaaaaaaaaaaggtttattttgaatacaatctgaacatgcctttagtcaatggctcactgctaaataacaactatacccctattttttcccctctaaatttctactaccgctaactaggatgacagtagaaagcaacatgaacccttcgatcaaatgagatcaacggttcagattattttctacaactaaatagcaccaaagtgaggctcgcttttttattggacagattactagaggcgtctgttggttggtgtatggaactgtacgggtagagctcgtcgtggactgtccgggtggatgacattgtaaacgcgtgacctgtgtacaccgaactacgcgtactggagtgtgtgtggaggaccatgtttagcctgccatggacgatgcaagtcaacaatttcacacaaatacggagtatatagtacacagtgctagccagctagagagtggactagtccactgttttgttcctgctcatcggttttgtggtcggttggcaacttgtcgtgcttgctggtacagtacgtaattagtttaccggcgactttaggaggctattcatgtcaacgccggctgcagcctgcaaatgccagtaccgtgtaattctcgtgtagttccaacgtcgtgtttgtcaaaacgtagcactggatagcagacatgccccaactgccatagtacttcagagagaatccaaatggttcaaccatacgggctcctttttcttattatatatgccttgttcggttcggttatacgatttaaatgatttttttttctataggaatcatgtgctagatcttcaaaatgtattggttccataggaataaaaacatctactccatcttctttgttcagctcactaaaagaaaaaaaatatgtcttgatccttagtattgcatatacattcctacgcaattccactgttttttaaaaaaatcatgtgacttgaaaatcctgtgtttggattttgttgctaggtctgtttggatgcttggtggtgcgctgcaaccaatacaaacaatgtcgcaatttataggtagtcgcagcctcacctgccaaaatgattttttgagt

SEQ ID NO: 72293 - DNA, 9928 bp, Oryza sativa
  unsure (1)..(9928): unsure at all n locations
gatcctgccatgatatatgacttctacaatgatcagcacagctacctttctagtgtgggtgtggatggtgtgaaggtagatgtgcaaaatgtgatggagactcttgggaagggttttggtggtcgtgttgcattaactcagaagtatcaacaagcacttgaggaatctatcgctcggaacttcaaaggaaacaacctaatttgctgcatgagtcacaatacagacagcatttttaggtacatattcttgtcgctgaacaatatgtgtgacatacatgaaatttgacgtaaatcttggttctttgtagttcattgaagagcgcagttgctagagcatcagaagatttcatgcctcgggagccaacgatgcaaaccctgcacattgctactgtggcattcaatagccttttattgggagaaattttcatacctgactgggatatgtttcatgtgagattatggcatccccagtacctctttctttcttttttttcatgccaggctggcagctaattttccattcttgccaatgtaaagagtaagcatgaatcagcagaatttcatggagctgcgagggctctgagtggtggtggtgtttatgtcaggtaattcttgcagtatatttatgcagatgttgtatttgcatttaagaaatttgcatgatctcattatggattttatattactgaactgatatgcagcgacaaaccagggatgcatgatttcagtgttcttaaaaaacttgttctgccagatggcttgattctaagaacaaagcatgctggtcgtccaactcgcgattgcctgttcaatgaccctgtcatggatggcaaaaggtacacacacacacacacacacaccaatttttctaaaaagtttcctgctacttgttctaaaaataatactaactcagttaacttttgtgcagtctgttgaaaatatggaacttgaacaagttttctggagtcatcggagtgtttaactgtcagggtgctggaaattggacttatccagtgaaagaaaatgctcatgttcccactaccgtctgcatcactggtgatctctccccatcagatgtggagttacttgaggagatagctggggatgattggaacggagagactgcagtatttgcttttaattcatgtaaattccattggacacatatttcttgcaactgttacccatctccttcatcgatctttttcacgattattaactgcagctacgccttcaggttctctctcaaggcttcagaagcatcagactatggaggtttccttgtctactatgacatgtaagatatataccatagcgctgataaaggtcagatttttctccattcacctacttacttgagcaatcaattttttatcgcgaatatgcaagccttttgtatctttgtattaagaactcaatctattcttgagcaatcaatttttttttttgggtgaatacttgagcaatgaatcattcgatatatgtttacttcttagagaaatgctcttgtttttgcaccaggtttttggtggctttgttcagtttgctcctcttggactggttaacatgtacaactcaggtggtgcgctcgaaaacgtcacgagcacaggtgattgttcagagatcacaattcagatccaatgccgagggccaggtcggtttggggcgtattcagcaaccaggccggaaatttgcagtgttgatgagcatgaagtagagttcaaacacacagatgatggcttcctggcctttgatctctctcacggttcgtcccaggacaacctcaggaacattgagattctgtacagagcttcctgaacctccattttcagtgtgatttttatgctctttcgagcagattatgctgctctcaggctcttagctgtggataattattgcttnccgcaagcgtgtgttagctctgaattactgcatctcgcgtgtgttgtttgtgccaattaatttgggcttgttctaagtttcgaatctgccggagacagttataatacgaatatgtattttggcagatcaattccaattttgtgccaatattacctaaaacaaaaatattatccctctcgcggtaaacctgtacgtaactttataagagacgggaaggaattgcatggatgaatcatgaattgaattgttacatcacaagaacaccgctcttgttcaagggcagtgtcttctccttcctgcgccagatggcgtcatggcgattgcaatttgcaagatcattctacaacaacaatggatacgtggattactccaccatgtatatggtgagcttgtgctcacgcgcacgtgcaagatggatttggctaatcatcagagggacctaatcttccatgacctgagctttggcggcagctgcgcgagcatggtgttcgtcgccgccacgctcctcgtgctggtcaccagcttgaaccactggctctccgggtcgcagctgttgtccgcgctcaggcaccggcacgggttggtcaccaagctccggccatcgtcgccgacgtccaggcagagcatgccgccgttgctggtctcgggggacgacgacgacgacgaggcgttgacggcgaggtgcagcttggagtccgaggtgaggctccaccgcgccagctcgtcgccgcacgacaggccgaggcgcgccggccggccggcgccctcggcgcggaggcacagcagcgggctgtcccgcggcgacagcctctgctggctcgccgtgtacgcccacgcctccgcctcgccgcaggaccccagctccagcgtcgtctgcaccaccgacgacgaccgccgcaccacgcaccgccccgtcgtcgggtggaacatcaccgtgtacggcgccgcctccgccagaccaggccctgcacacgccaaaccaaagtcatcgccggagaagatagataccggcggcggcggcggcgaacctacctctgaaggggcgctgcagggcgtggagcctggtcagggcggtgtcgttgcggggcttgcaccacgcccagtcgagcacgccgtagacctcgtcgaggcccaggacgccctcccggaggtagtaactcccctgcagcgtccagagcgcccagtcgaggtcgaggtcggcggcgacggcggcgacgcagccgtagtaccggttgtcgttgacgttgccgccgcggttgtcgacgccgaactcgctgaggaacaccggccacccttggtcgagcaggtacagcgcgcggcgcgacacgctcgccgccacccgcgcgcacacctggttggcgttccccgcccgccacgcctgcccgtcggagaagccgtaccagtgcacctcgaacgccaccttcccggcgaagctgacgttcacctgccgcgagttgaggaacgccaggtcgttgtcgaagctcatgccggacaggatcaccaccacgcgcgggttcgccgcgtgcaccgcctccgccccgcgctgcatgtacctgcatgcacgcacgccatttttttcccgcgcagtcgtcagctatcagctcagccgctacatcgttggcgccattttttatttttattttttgcagatggcgctagtacacagtacactgaaatgaatgatgcgaactgcaactgcatcagattattgccattactgttcttcacatgcttgtgcagggacgagcaatggcggacgcggtcagtcagctcagctgccaaccaccactagcttcaggttcatttactgatcgatccaggacatggccgacgatgaacaatgcgtggttcttggatgcagatgctaatcatggcggtcggtgtgcaaattgatgaggaggatcgatcgagcaaatgggtggtgaactggtgtgacttacttgtaccagtcggcggagttctggcgggggccccggagctcgttgcggaggctcatggcgacgacgctggggacggcggcgaacatggtggccatcttggtgaggccgtcgacccacacgtccgggtcgaagtacgcgtcgccgaagaagccgttgccgtcgttgttgccgcagcaccaccccggcttgctcacgtggttgtccagtatcaccatcacgccgttctcccccaggctactcaccaccgcctgcacgccacgccacgccacgccacgccgcgccgcgccgcgcgtcgtcggtcaatctctctctctctctcgcattgtcaaaaataagtagtagataacaatgatcttgccttgaaggcgtcgatgagcttgaggtcgacgagggaggggttgttgacgcggatggcggcgagggactcggtgaggttgaggcgctggaaggactgggcgacggtgagggaggagtaggaggcgttggtcaccatgaacgtggcccaggtgaggcggacgcagttgaaacccatggcgaccacgtccttggcgatggcgcccacaggctgcttgcccagcccttccgccagcatcggctccaggtgcgacggccagttcacgcacgccagcttcaccctgttcccgccctcgtcgacgatccacctcgacgccgtcgacagcgtcgtcgctgccgccgccgccgcggggcgcccatggctggccagaccaagaaccgccaccgcggcgagccacaccaccacgagcctcatgtcgacgccggccgtccggcaatgcgagacaccgagaagaagcagcggcgaggtggatttatagcgagtactacggcggcggggttgcttcggcatggggaatggcgaggcttcacgggattgccatgggcggaagacgacgatctctcctaagctatgctgctggtccttgacatgtgtgaagtggagaggccatgaatgagggtgagtgagcaaatcgcattgctgatgtttcaagaatgcaaccaaatactgttttatccttcaaggcaggacaagctaagcgacatcactgtacgtctgtgacaatgcagtgcatagcgcgtttatttgcacattattatcgtgaactatcaatttaattataaagataaattaaatatttaaagaaataaacttaatgaataatataaaataaatagcctaggcaacattgcttatagtaaagaaaataaatatttttgaaatatggagtaaataatccgttttaataagaagcggatgatagcttattatgggcaatgtatggcgtacttatgaattaaagaagcaatgctgataaagaaatttttcgaagacgtacttttggaatcgtggtactaataatccggttgataatccgactgatgagccaaaccaacctggcctatttcagaaatcagaaccagagaaaacaaagaatctctgcacgtcggtcggtgggtggttggagtaaaaatggccaccaaacccttgcagttacagcttcggtttggacttcttatagtgatactggagtattgatgttggttacttgcatcgattattagtagtacctcatttgcaattaataccagatctaatcgtggttggttagtataattttttcgtgaagcaatcaatattcagtagtgtagcattggtgcacacacaactgggatttatttgcatcctgtttatgaggagctcgtccaaagcctcacgccgttgtcaacaattcagctacaaagacaggttaagaggttttgcttttactctaagaatgttgctagttgtattccagatcatgcatgtaaactgcttgcgattccgtatctgtctcacatcagatcagttaagaaatgccgtgctgaatatgaactaggatgaatgaggattttgcccttcaactaaaaggaaaggagaaaggcgacattgaaatgaacaaagagggaaagaagttgagtgtactgaaaatatagggaaaggcctttctctggcgccacgattgctgtttgcatatttcagattcagaatacaattttattttctcgaacacgtaggagagttgtgtaccaatgtattaagaagggaagtgcagatttcctagctgcattattcagtaaattgctgaggaactgaaataatattgatctcagactgatgctcctgttgtagttttttgcttcatccctcgaatcaaagcagtgacttatgaggttgttgagccagtacctgtgaagtcttcagaagaaaaaaaagtatccaactatgcacaagttgagatgtgcatgagaaatttcaataagtggacaacccatgcacgcgacctcaataactggacaccatccctttgagtgaactttgcaatgttttaagccatgtcaacatataccaaccgtaaaatactaacactttttattctatatagtatatcagagaacaagcatggtatttttctgtacattccttttattctctctagtttttgtacacataggacatgtttcaacagaactctatagaacaaggcacaagtgaattcaatggcatcactatatacatgtggagttctgtgtattattttacaaattacaataatatagtcatccaattgccttgattaactaggtggaacttggcccttactctgtcatattcatccaccacacgcaatcaggatattttcgaaatagtgccatggttaactagatgatgttggagaccagggaccatcagatggcaactgcaaaatggaggtgcctgtgtgtctactgcttaatataattttgaaccactggctctcaggattgcaatttggatctccggttaggcacttgcacggatttgttgtgatgataccatcaggagtggcatccaggcatactctggttccatttttagtgagttcagtcgaaacatgcattcctgaatttgatattagctgccactttgaactggatttgctgcaatcggtcccaagctgtgcattctcaccgacagacttgacctggaggcattgaccagtgtgttgcagtaccaactcgtgtgttgatgtgtagttccaagcgtttgattcatcacatggacccaactcaagtgcctctgatgatttcaccacgacacaaagcccggatagaggatggaatattacgttgtaaggttcttggctgttcggtagtccagggcctggagtgtaaataagtttgcactattatctaactcaaggaaatatagtgcatattgcaatgattaaaatttaccagatttttacatggcacattacttattttgtctaatgtcttacataccatattttgtttaaatgtcttacatcggcactatccatatatcgaagtgttctcttaagagggtacatgtcatattgtcatttcatgaaagggctaaaacaatgcatgcatactggtggataatctgaaatttatatcagtgcaaaataaatttcagccaacaattaagtactgagaaggggcccaatcctatgacgaaacatgcagaagtttatgtgttgattcactaaaagaggtcaaatgctttttttttattagaacagtccagtataaagtatataatcttaccacataaaattcgaaatgtagaacattccaaaaatctatgttcccatattcctgataatgttgctagacaagaataaaactgagataggcgaagcacaaaccttgaaatggtgattgcagagaattgatccttttaataaaactgggatttctagctgtacaccaatcccatgatagcaatccatatgattcatcataagctagagtgccctctctgatatagtaactcccttgcagagcccaaatagcccagtccagatccatttcagctgccacacttaagaagcaagtgagatagcggttgtccccggtgtgtgtgccagacatatcaaacccaaactcggagaaaaacaatggccagccttgctgaagtaggaaaagtcctttattctttatgaaaccaacaaccatcccacaaacatcattttggttctgagattcccagttgccaccatctgagaaaccataccaatgctgctcaaagactaactttccagtaaatgataggtgaatttgatttgggaccacgaagttgagagtgttgtcgaattccaggcccgacaagataacaaggacgtcaggatttgctgtatgcacagattcagcaccctccttcatgtacctaaatgagaatagattgtaaatgaaattttccaataccatgggtcacacaaaaaaatccctatcaattgagataaaaacaaggcctttaggtttcagtgacaacctgtaccacaaactaacattttcataggggccccggagttcgttcctcaagctcatgcccacaacattttttgttttcctaaacattgttgccattgtcttgaggccattcaaccattcttctgggtcaaagtacttgtcaccaaagaagccattaccatcagttgtgctgcagcaccatcctggagtggtcatttggttatcaagtatgaccataatattgttcctggccaaagctgacactacttcctacagttgttcaatgttaaccatgtcagatggaataaaaaaccagagtttttatcatgtattaaaactgtttactttagtttcctttcatatttagtacatataaactctctatatactcgtgactctatgagcatctgttttcacagattactgggtcaactaactggataactcattgcaaaaagagagataactatagatacttgatttggattagataaaaagtagtacacctaatgcaaccagttgccgtctatcttaatcattagaatagatccgtagaaagaaagatctgttctagctagagtattgtggcttgcaagataccctcttggaccattaatttggtaactagtaggtaatctgtacacgttcaaattaaacttgtttggaagaaaataaaaggggaaaatgaaatctattcaagcaacaactactgttggcctttcctgaaatagaaaatatgatcagatctttcttatacacttaagccctcaacatgaaattgattgttcttattaattatgcaaaaatggatatcctaaagtttctttgggaagctttatgacaaggttgagatgatatcatctgatttcaaaatccatcatctccaaagttttgacttctaagcaactagtttttttgttaaataaaaccgcatggcctgcagttggtttagctataagtcaattggttcaatgcatactgttgcttgccacaatgtaagtctacaatcttatgcatcattgcatcgtaatgactatttcgtcagacaatataaaatttgcatggactccgacttaaatgtttaaacggacacatagctttcatcaagattgtaaatcagtctgttcatctcacacaaagttactcctacttacttttcttgcattccatcatcaaaagactagtttctagcggcaagacagtaaaaaattgaccatctttgacttgctaacagtagaaacagctagctgccaatttaatggtggtggtaagaaaaactaaggaactatttcttcagactatcattaataagatttggttaacattgccaaaatctaacgaggttagatttaaaaatgccaaaatctaagaagggtagaacactggccggatagctccaaaatctttttgccaaaccaatgcttggatattgttttggctactcgaagagaaacccttacctggaacacatcgatgaggggcaggtcaaggagtccggggttgttgacccggacgccggcgacggactcccgcatgccaaagcgctccagcgaccaccgcagcggcaggctcgccagcgtggcgttggtggcgaggtagggtcggccaggtgagcctgacgcagttgaaccccatcggcgccacgcgcgccgcgatgtcccccacgccgcggggcgacaggccctccgccgncacgggctccaggtgcgacgcccagttcgcgcacgccagctttacgcgccgcccgtncgtgcccaccacccaccgngacgccgt

SEQ ID NO: 72294 - DNA, 3797 bp, Oryza sativa
catattaaattattatactaatttttttaaaaataatttgcgatgactttttaagtgacatgtttatcctcttaatgaatagagttttcccaatgtcagcaatggcgggcatactttctcaggggactgaaggtactggacgctgaccgtgcagaggacggcgtcgaggctggaggtctggagctcgagccgctgctccttgttgaggtccttgacgaagaagtagtcgaggcgtgggttcttggcgagctcctgggcgttgaggccgtggccgacgacgcggcggagcgggagctcgcgctccggcggcaggtggctgacccaggagctcatgaggtccagcacgtcccacccggggcggaggcgctcgcggtagaggtcggcgagcgccgcgaggaagccgtcgtccacgtgcttgacgagccgcgggaacgcgtagaagtcgcggtccggccgcgcgtccagcttcgcccggccctccggcgtcagcaccagccgccggatgccgccggccgacggcggcggcgacgcgcctgcggcaggggagcaccgcggcggaggcggccgtcgcgaggcccgcggcgcctgaggcggagcgcggagcatggctgcgatttgctgccgtcgccctggagaacggaggctcactggctcgtcgctggacgtggcgctttatctcgtcggggagttcgagtggttggcgtcgcagtgtgcactgtgtagtgaccgtggcacagtccagtgcagatcaaaactccctcttttcaggccatcgttttatgtggcttcaaatatcatcctcattcctcaataaacaggttaaactttaaaataatttaaactgaaattcaaattttagcccgtgtgctatttttagcccgcgaggcgtcatgtcgccatatctgagggaaaaatgatagtcttgccctcataaatgatgacgtggcatttcgctggctaaaaattgacacgagagaaaaaaaatcgtctctttctagtaaaaaaacgaagtcatccaagaggggatagtggtatttgagaatggaaaagtttattagtattaaattttcttttcctaaagttttactaagactagactatgtatcatgctgtgagtatacgtagatatctatgatttttatcttcttaaattaaacgcatgatattattgtttatgagagttttgtaaaaatagaaagaagttactccctccgtcccatattatagcaatctagtatcggatgagacacttcatagtatagtgaatttggacatgctccctgtccatattagttgtgctataaagatgtgacattttcgccgtgtttagttttaaagtttttcttcaaactttcaatttttccatcacatcaaaacttttctacacacataaactttcaacttttccatcacatcgttcatatttcaaccaaacttctaattttagtgagaactaaacatatcctttataatacaactaatctggacaggaagtatgtccaaattcattgtactatgaaatgtctcgttcgattttatattgctatattatgatacggaaggactaagtacatttagcagtgctcttcgagaaggaagggggccaaatagtccataaaaaccccgatttcgtagctgtcgccctcgtcccccccgcgtagtcgcgcacgcgagccgagcgtcgccgtctctctcgcgtcgcggcgagcgcccccatccacacgcgggggtcccgatcatggcagcggaagtactaccggatatcttagtctatcccagctcgaagctgacatggcgatgacggggacggcgccctggaggtcgccgcttcgggcccctcctcctactccctcgcgcgggaataattcgcgcccccgcggcctcgtcccggcgcaatgccggccgtggccgcgtcccagcctcagttccgccgccgtcgcgtgcccgcggagcgaggagatggcgcggctggagcgcgggtcgctggtggtcggcgggcgggagctcctggagcgggcccctcccagcgtggccctccgccgccccgcggtcgtcgcctccccggggggcgccgcgttccttggcgccacggcgcccgccccgtccagccgccacgtgttctccctcggcaccctcgccaggtagagcccccgcccccagagcagagattgcggtgtgcgccgcggccggcagcggtggtactgattcgttgttgggttttggtgtgcagtgggtggaagtggctgtccctgttcaggttcaagatctggtggatgatcccgacggtgggcgaggacgccgccggcgtgccagcggagacgcagatgctgctcttggagtcgaggagcgaggcgggtgccgcgctgtacgcgctcatgctgccggttcttgacggcggcttccgagccagcctccaggggagtcctgagaatgagctccaattttgcttcgagagcggtaggtttattctggatttgctggattctgaggtgttcgaattgaaacgaactgcaaattttggaatttcggttggaatttctgaagagtacagtggtggactgtttttaggtgatcctgaggttcagacactggaagcagttgatgctgtattcatcaactcaggggacaaccctttcaagcttatgaaggaatcaatcaagtaatgtcatcctctaacataaccacaatgacacatatttttgttctatttgcaactggctcacttcagttgtatctccatttaggatgttatctaagatcaaaggaactttcagtcatatagaggacaaagaggtatagtgtagctaaggatgttcatctttgtacttctatcttctacttagaataagactgttaatcatgtaaaccttttctagtcatttatagttctatgttattttgtttttcacaagtcctgttgaaattcatcacaaatgccagatccctgcaaacctggactggtttgggtggtgcacttgggatgctttttataaatctgtcaacccagtgggaattgaagagggccttaaaaggtacaaatgaatcgatcttacttatgtgatattcgaaaacaattgaaaggtcttttttattacccgcatcctccatttgtcaattcctgataaagcatttcttgttgtatagtttgtgtgaaggaggtgcaccaccaaggtttctaattatagacgatggctggcaagaaaccgttaacggattcaaggaagtggatgaggcctttattgaacagactgtgttagcgtctaaccatttttcaacttgctgatcggtccatgaagtatattaaattcctgtttaacaaagaaaatttactccaggaaatggacgtttgagtatttgatttcatattaaataaacaccaatacattttgaaatctctccttatctgtttgtgaaagagaatctagatccaccaacatagactgtatactttttctttattgtgagatttcctatccaatttccttttttttttcccctgaaactgtaaatcactgtcataacctcatattatatctatacacataaaagtgcactcatctgttccttacccatgttgcaatattattaggtttgcggagagacttatcgatctgacagagaacgataagtttaggggagaaacctgcaagaatcttggagaccatgtcaagaaaatcaaagagcactatggagtcaagtacttgattcttattgaaatactagttctataatatgcttttcataatatatgctgagaaaaaggctttgtatgaaactacaggtatgtctacatatgg

SEQ ID NO: 72295 - DNA, 9670 bp, Oryza sativa
tcatttgaagaatatatggtgaaaggtatcggcattggcgtccctcaagacaatgaaagaaagatgaaaaaaggcattcctaatgtataattcttttcttatttacatttgagtttaggaatgccgtactattaagagggatgcaacgtcgaggtgtttgtgcatgtctcagtgctaaaagtgacctatcatagtgctaccttgagagaaacccaagctttaacctatcctttcagtggttttagaccttgtttttggttgagttgggtagtcctctgagtgagtttttcatagagtccaagttcatcaaaaatggactcccgagcgaaaagttatagtcgttttactctgtgcttttcggaaagtccgaaaaattatcagaaattccgaaaaattttcggagttatccgaaaaattttcggacattccgaaaatggctgcgaatctgagatttgcttctgtagattttcggacttgtctgaaaatgattttccgcttccgtagatttttggacttgtccgaaaatgcttttcggaaaatccgaaaattacagtcttggcctccaacggctagtttttgagaggctctggtatataaactcctccacccctccaccacccctcctttgagtggctgttgctcttagggagtattagacacatccagagccaaatagccatccctatttccctacctttgtggtgcctctttgtgagggcgatttgagaaggggagagagttggattgagagagtgaggagttgagagctagtgagcttcactccatcctttgtggtgcctctttgtgagagggatttgagaagaggaaagagttggattgagtgatggagaagttgagagctagtgagcttcactccatactttgagcactcgagttcatagcaagcaaatcttcgattgtgtttgttactcttggggactaaggtctcctagacggctaggcatcgccggtgagcacccaaggttgtggtgtgccacggaaagtttgtgaaggcttccatttcgcctccgcaagggaagaaattaagagtgaaaccgaggagtgcatttgtgcaacctcgtgaggaaagggttgaaataggcccggcccttgtggctcctcaacggagacgtaggatccatggatccgaacttcgggaaacaaatcacgcgtctcctctcttggtttgcccatttgtgcattctctcatattgtgcttgagcttgtttttacccgatctacttgcatgcttaattgatttagttggtgaccttatatcttgtttagataccttatttgtcaccttttgattcatacacattttctttatttgaactacaagttcatagctagtgttttattccattatccgccgaacctttcggttgagatcggaacttccaatctcatatcggaagttcctatttgaaccgaaagttctcatcattctagtatgctatgaagttgtgataatttttaggaacgcctattcacccccccccctctctaggcgacattaaggtcctttcagtttctataacccatctaaggctcttcaaatgtcaaactccatagaatttatttttgggcatgatttgagcatttgattgaattttgccgcttggaaagagatacaaagcaaatttcaggtcttctcttgatagaaaatcgcttctgcaaaaattctttttgggaaagtttctttgatttacaaagatcatttctgcaagatttcaactcgcttggacttgatttggaagagttttgagtttttataactttgatcaacttgctaaaaaattcagaaatgacatggttataggctgaattgtgaattttgtatctcaaaatgcaatccaaattggaaggagcttccattatgacttttgataccctaaggctgaaccttacttttaaatttttgtttgaattttttcagctcttttgtactttgtttgaatgctttttaaagcccttcttgagttgtgaaaaatctggaatttcagcttactgaaatcttgtgatttttgttttgcctatatggttgagatatgagcaagactaccaaaatgaaacttgtgcatgattacatgatatatctccatgatttattgcatattttttggagctcatttccacaagtttatgttgcttcaagagcttgcttagttgtatcttttttgttaaacttcaaattttaaaagtgtgtttcatttagttgaaaatctgagttggtggcttaaaaaaagttgtgtcaagaagtgagctctatgttatgtgaatgttaaatcaattttgagctcgtttggatttattccttgcatgaactcctcttgctctcaaacacccattatttgagccaacctaaactcaaatggaattttcactgtcaacctacatattccatctattttgcttctaaaattgaagttgatccttgtttctattgctaactaccatttcttgattccaaattcgcacttgcatacacaagcggtgtccatataaaatggtagtatcatttgaccatcttgaactcggtaattgcctatcattgtcattcctttgtcgagattacacacttgaccaagaagctctcaagtatcattgaccgaaatcctctcattgataaaatacttgttgagtgtatttcgagaggaagttcaagtgctcacaaccactccctccgagagcaagggggagcgtttcttaaatggacattttctcaaatttttgctttgaaatttcatctaaaaattttatttggtcttgtgaatgtttgttcttgttttgctcgagcaaaattgtttctctttcggttccatgcaaattgtttctctttccattgagtcaaaaatcataaaaaacggactcccgagcgaaaagttatggtcgttttactctgtgctttccggaaattccaaaaatggctacgaatctgagattggcttctgtaaatttttggacttatccgaaaatgcatttcggaacttccgaaaatcgcagtcttggcctccaacggctagtttttgaggggctcgggtatataaactcctccatccctcctttgagtgtcttctgttcttggggagtattagacacatccaaagccaaatagccatccccatttccctacctttgtggtgcctctttgtgagagggatttgaaaaggggatagagttggattgagagattgagaagttgagagctagtgagcttcactccatactttgagcactcgagttcatagcaagcaaatcttcaattgtgtttgttactcttggggaccatggtctcctagacggctaggcatcgccggtgagcacccaaggttgtggtgtgccacggaaagtttgtgaaggtttcgatttcgcctccgcaagggaagaaatcaagagtaaaaaccaaggagtgcatttgtgcaaccttgtgaggaaatggttgaaataggcccggcccttgtgtctcctcaacggagacatatccgtgaatccgaacttcgggaaacaaataacgcgtctcctctcttggtttgcacattcttgcattatctcatattgtgcttgagattgtttttacccgatctacttcgcatgcttatttaatgtagttggtgagcttatatcttgcatagataccttatttgtcaccttttctttcatatacattttgtttgttcgagctacaagttcatagctagtgttttattccgttatccaccgaacttttcggttgagaccgaaacttcctatcccataccggaagtttcgatttgaactgaaagttctcatcattctaatatgctatgaagttgtgataatttttagaaacgcctattcaccgcccctctaggcgacatcaaggtcctttcacttacaactactgcggttgttagcacgctactatcaaaacaagattcagatagtaaagttagaaggttttagatctgcagtttggtacacatactgtgataatctggatgctagagtgtcagttggtttaattacagttcttctagaatctagagtcttatagcaagtatctgaaggagagaactctgtggctttgatcaactaacaagacaaagcaaaggggaagtatctagtgatgtatccgcagcaccgtatcggttgatatatttcaatattggactaaaaaacattgcggatagactggcactacttgaacaaggtagagtgaaaagcaagctaacttggtgtctgctccactctgttgaaaatcagatacatgaggattcgattgatacttatgaacgataagaaatgtattatttgttttatagtactattgctattgcttggattcattcttcatattgaatggtgagctggttgttagttatgtcttagctattttgccataaaaccttgccttttctttaatgactggaaacattgaatataagataaggccttcaattaattagcatgacaatgtagtagttcacacatcaatattagctataagacatctggaaaatcatgttaattggggcagacattgccatgcatgttgttgtcgaagagacaactgcttcacgtcaaaggacgtggttcactcaatggaatggttgaatagtaaagtaatgtattaatgggctttttatagtcttagtacaagctcatgcactctagggtttaatgtttgcaggggaatttacatggatacccttctgatagggacatttacgagggcaaacaatgtccatttggttaaggggtcttttcatgggcttttgggcccgacccatattggtgaacggccttctcgggccgttctgatccttaggcttcttggcgaaggcctcacatcttctggcgaacccttcctgcttcgcctgaagtgaagacttgccagtgggtcctttggacatgatggcgaaccctttcagatgcgtcctcagggtttcgccataggcaaaccatcttgatcattggtggatcatcacaggtaaaacggtttcggcagttaatccatgacttagtgaatttgatatatgtgaaataactccgctggggattgaagtcactcctaacttatgtttatgctaatgcttgcatattctgtgttaaaatttttggtgacacactagtaggaaatagtcttgagataatcaaggaggcactaaatcccaaaaatttgtttatagtgactttgtcgttttggacttagtgcatttgatatgtgtggaaatcactaccctggggattgtaatcattgctaactttgtgctggagtcatgccacgaaggccttcgaccgaggctaccaaaaccactacgaccagggcgaaggatcagtcgaagaccaagatgcttacctaaggcgaacctgctgggcaaaactagagggattcaccaccaatctggacgccttcgccatggagtcaaaaggcaataaagcctagccgttcgccatgtctggcctaggctaaggcccattaaggggcccagggcaaaatagacactagttaccctcataaatctctctatcataagggtattcatgtaaattaccctgtacttattaaccctagggtgtatgagcttgtactaaggctataaatagccccataagggcatttagtaggggatcccaaaaaattccattattaatacacactgctttacttttctactgtgtgtatacctcgttcttcgacgaacgtagttgtcatttgacaacattatgtttatgctaatgcttgtgtattctttgttggaatttttttgtgacttgtactagtaggaaatagtatgagatagtcaagctccaagatctgtttatattgacttttgacaacctggcttctctctcaaaaatgaccatttctctatattcttgaaagggatatttgttcagtgtcatgtataccaagtaatacacaatagtttagtattttgaatgacgtatttataacagtggatctatgttttctatgagacaatggagtattgtcggctgaaaatggtgctttgccctgataaggtttcttcttacatgttttatcaggtgggatggcatttggtaaaaatattttcgactagttgtagatggttttttttttactttcttgcaaatgttggaacttccgtaccctcgttcctgatctatggaaatgcggggagcatggctctcattgataaactacttagctaaatgttggttttggttggaaggatgatggtttatgaataattgtaaatgtatgttcttttgacatgatatctagattaggagttagtctatttaaaaatttgttttactgcttttttttcaaatttgtcaccaaggtagtacaaaatggtttagagttactctttgcattttaggaggtctttcggccttaggaaatcgtggctttgtcttatttggttacattgtgaatgatagttatctctaacaatgttgaaaaggtacatatacagcgttccctcttttagatctgctgagaagtagtctcataatgtgtatcaacatgcaaaacatttacaatcgttcatacccgatgaagatcaaatacttcatttgtggctttgagagataaaatttagtcgaatcagtaattcaataagaaaggcagaaaggctgcgagagtgctaacacctgcaggcagaaaggctgcgagagtgctaacacctgcattttgtgtggagaactgaaacctccaatgctatattgtttatttttctgacacctgcatttttctgatgtagagatatagggatggacaacaatccctataaggttcgaagatataaactttttttagctttttcaatggtgttgatgtagagatatagggatggataacaaccctaaaagcttcgaagagttgttctctttctcactaagaataataaggtttttctttcgttgagcattgtaactatcttttgtatcttatgtcgaccgggatatgtcgttccttttgctgctagcctctttcgcttcgttccctttgctgctagcctctttcgctttcagtaaaagccatgtctcacgacttttgtaaaaaaaaaaggctcctaccttatgaaaattttcttttgggtacaataatataagagaattcaatccactattcagttacatgaaatagctcgggtttgatatgaattttgtgttctttatgcccaacctgaaaaagctgcacatgtcttttttattgtcttttgcacaattagttggtttcacttgtagggatgctaatgcctggaatgctatttcagtgtgatttaaacattattttacaaaggttgtgggtaaaacaagcgtttgtatgctattagttgctacagttcttaaaaaaaatacattccactcctttgaccttaatcttccgcatgctttcttatttgcttcagtgaacctaacggccctcttgaaatgtgaagtctggttgtgttggcaactctgactaactagcttattaatcagcaactattcttttttaatgttcataaatatatttgttccatctccccaactattcttttctgatgtatctctctacttctgcagtgctgtcatgcttagaaattcaacaacccgaatctctgtccaggaccagccagagtacacaaacgacaaattgatacagatccatgtcttacaaaaatattaaaataaacttacaaatgcagcagaaaataaaagacaatctaaacttaatcttcacggcaaaagtgtagcatcctccaaatcacaggcaatcctcaacatccggaacaagcttaatcctcaacgaactcaccatctgaaatattctctgcttttggggttgggaaaaataatttaagactgagtacaaccaccgtactcaacaagtcataccaacggaaatgtatgatgcaaggatatcacaaaggattggcaataggatatttgcataaaagcagcatttgcaaatcataatttgaatacagtaaaacaatagatattattaagcaatattaaataacatcactgctcaacgctaaaaccacgttgcaacaggcccaaccaaaccacctgaactactccagtcatattatttaagtgagactaatcacggtgagctggttgaccgcccaataaccacgggcacgactattcgaatagttttactctgattagaggtgtacaaatttacccacaagatgcgattcgacacatgttatcatgcctcgaagtaacaccgcgatactgcaaaggtgcaaatcgtgacaaaacccttcatataaccctccctaaccaacatcccacctcaggtttcacccccacccctaaacaggcattgggcagccccctcttgtgcctaggttaatccggaagcagcatagaccggctcccgctccatccatactccatgacggccacccttgccacggtatgttagctagaaaagattatacttcaggtcaagcctggagcccatgctagcttgtggtttgtacgtgtatatcttccaaggattcccgagaaccggtccttaattgttatggacacgacttgcaaaatcatgcacccacaacccaccattaaaatatattttagtttaattacttgtatacatgttgacggtcgttagcgatcagtttcgcccatcaatattactaaaataaaggagaactagttatgtttgcaatgcatattatgttagaataagatatattccactagcactgtgctttctaaccttttgtagagaataaatacaaaatggaggagaatcaacagtgaaataaacgatcaatcaatcagacactgtcgagaatcagacttatgaatggatgggccaagaactcagaaatgacacgaccaaaatgggccaaaattcacaagtctgcgaaaagaagaacataaggaggcaaccagccaaaacctgggctggttgggccggcccctggttcggtcgaacctcgggtgcagccgaacccccctcgtcgccgtttgatccaaggctttgcctggacggtgtagattagccccaatgacggttggagggtatttccaacaattccaaccgtcgcaactgtcattgggaggttataaaaggagctctcatcctccactccaggacatactcaagcaagagctcaatcatctttctcaaagtttagtttagtgtctagagtatagtggaatagaaatagaatagagtcttcagtcctcggagacttcgggaaaagttcgggtattgctctagtagcttttccttcttttgtaagacttgtactatttttagaatattcttctaaatatatatacagtactttgcttcattctgatcatctgagtactagctttccaatatgttatttgatatataattgtctagctagcttactcgggaaatgcaatggtgtgggtataatgttcatgtatatgattgctctgtgtcatgacgatgatattagagtagtatttggtagcataagcgaggtgcttaggccgctggatatcattatttgggattatatgctacgggacagcagaggtgggccgctgatggtgacagctcagtacggttattcctccacattagcatatagtcctaagtacaatttcctgggaagggtactcctccgtatttagccccggttggatggccatgacgggttgtcgtaaggaactcggcaaccagggatggtatctcgaaacacta

SEQ ID NO: 72296 - DNA, 972 bp, Oryza sativa
agtttagggaccgttgatgaactttactcaataccacccattcaaagggtatggctatttgaatttcatccaaaagtatataatgaccataatgacctaaagttgtattttgtgggttaaactaatggagctaaagttctttgtgaatattggctaaaattagtttctgaaagttcaagtgccattaatttggttttgatggttaatgacaaatccaattacatgagactaacattgttataagcatttctttgtctactagtctcatatggatatgaaagtggaatatgtgagaggtgatttctggacttcatatgtgttgagagagaaacgttcattgatggtgtacctaaatcacaaggatgaaatgcatggagatcaagctatatgtatcattctttctatccgtgcacatattgatatattcatttataatattttcatgtgattacataagcatgtcagactaatgttttgtttgagccatatcttgtttagtctctttacattgagaacatggagatgatgaaggtatgtttttattttattgtctatatttgataaatgccttctattcttgtatgggataagctctcaatgtttaatatcttgttatgcatactcttgcttcacacaaatattttgtatgcatacatttagggggagcaaatcctatactttagttatgcatgtaatcgatccaagttattcaccttcatttaattgggatcatttattcaagttatgcatgtatatgacacttgtggtgttgattaatgctcatcatttattcatatccttttatacatgcgatcggttggtcaacatgtggaggttgacaaccggatcattgggactaataattttattgagttgaatgaaagaaataggtcccaaggattacaaaggtgttgatgctcaagtgatatcattacacctaacaataccaagaatgacaaagtgaagatattg

SEQ ID NO: 72297 - DNA, 23484 bp, Oryza sativa
catgtcacgccgtaccacagcgacacgccggtgccggcgccggcgcaggggccgggggtggtggtggcccactggctgagcggctccggcggcgcgccgtgcggcccccgcagcgccccccggaacgccagcagcgtggcggcctccggccccccggcggccgccgccgcggcgagggcgagcgccgccgcggcctgcaggaggaggaggcgcacggcggcgacgccggccatgaggcgggcgggcggcggggcggcggctaccagtggcggtggcggtggcggcgacgtgcgggaggcgtgcggcgcatgcgcgggagggtggctaaagaacgggaggcgcggagggggaggagggacggggagggagatcgcgaggtgggggagagagcagctaagaatagcgcgggaagcgtgtgtgtgtgtgtgttggtatttggcgggaggcttaggcttaggcttagacaccgagggagaagaagaggaggaaaaagctggcgtttggtgtgggagtcgccgctggagactgcaacgttttcttgttcatcacttctgttttttctttgtttcggttggcaatggcttatttggctgcttgctcgcacattgacaaagggtttgtttgggagctggatttctcagctccttacttctaatttattttctaaattctacaaccacagctttttataatccgaacagaaaaatgactatttggaaaagatgtatcagctagaagcttctccaaacaaactcaaagactatttggaaacaacgcttctccaaacaaattcaaagactatttggaaaccgttgtttctgcttatatgtaacatttatggctaaataggatgtaaatcttagtgacttaagttatacatcaacttaaatcaccacactactattgtttttccctacttgagtgatattctctttattttttaatatatgatgtcgttaacttttagagatatgtttaactaaattttgtacaaacatgacaataataagtaatgtttaaagaacttttaatggtaatcaaatcacaataaaataaatgataattatatattgtgcaaacatatataattaaaagaaatggtgcaaacatataaaaaatcaacggcattatatattaaaaatgaagatagcatttatttggatttaaaattgtctggagcgaaaaataactatttttacttagggtgaagacaatagacctccagcaaagctcaatgacgaaaaaaaatatatatgactttttattaaaaagaaagtacctttaaaaacgtgataatctcttgggttatacaataattttcataaccaaaccatgcaggctgccaagaatgttgagaaagttgtctgatttttcttttaccagccaagttgtcttcctttttttagataatggattatattaacccggcctctacaccttagaaggtgtacacaacccaaaccacaatcaagagtacataagactcaacccattacatggggataccaaatacatggggataccaaataatagtttaacaaaacggttaaagaagaacaatagtctaagcctcaattctggtgtgtttagttcacgccaaagttaaaagtttggttgaaattagaacgatgtaacgaaaaagttaaaagtttttgtgtgtaggaaagttttgatgtgatagaaaaattggaagtttgaaaaaaaaagtttggaactaaacaagggcctagtgtagttgtatgctatatgtagatcctttgcagtactgtacgtgcagtattgctaactgacatgtcagtctaagaatctgtgagacccatgtgtcagcgagcggtactgtatgtacgtatacgtacggtactgacatgtcagtctaagaatctgtgagacccatgtgtcagcgagcggtactgtatgtacgtatacgtacggtacttcagaggaccctctctctcagttcagagctgtatgatgtttactctttgtccatctagcagcacatcggcaagttgttcttttttttttctaaagcacatcggcaagtttggctctccattttcactatttttgccagtgacacatcgatctgcacacctttaatgccgaattaatcacaacattttcacttctggaagcgaaatgcgcgacaaaagctttggttaatcacaagagatgcgcccaccgacaaacgcgctgtcttaaagaatttcgtgccgccaactcgcgcccacgattcaagagaaaaatcacgagtacgtggcccatgaattatagtatatacacacatagaacatagtcacatacatcatgcaaaaaaaagttatcgcacgacaagaacaaggcctagggataattatatatgtgattagcaatagttgtagatgatgttgttgctgctgggatatgccttaagttgatatgcttttgttctctgaaaatcatctgaacttgacagctatatatgcccatttctatgtcacattcatataaaatggtggaatgtaccttgattttggtcgtgatattgttgttttgacagcaaatattggtccaggaagatgcattggtctattcgacatctgcagtagaacttccaccgattgttctaccttcggatcataaattattcgataatgtaaatatgttgaagaaaacttacagtgtgaaaacctgaaaaagcatgcacggcggcctcttctttcttcagagtttagttcagagagactttgaccgtagttgaacgaatggtgtaagcaacactctttcagtctcagataatacaaaaaattccagttgatggatacatggaaactaggaagcaggtcagatttcctacaggagagtgctgcttataggttcactgttcaaccagaatgatctaagtttcatctcgggaatccaaaaattcagattttcgattgttgaatcagtatatcttgttctgctccaacaggaatatgactgttctgtttaatcaacaatgaaacacctttgtctattgaaatcctcgtatccaacatcaacaagacagagcccatctggaggcgctgggggagcagtagctcgcctgcaagtggcttccatcaggttcagcaaagcatcttcttcagcaccagcagctgcctcccttatggcagtcgcaacaagaaccctaaccatctgttcaatgaaatttactaatattaactagaattcgggggacgactggataaattacaatgccatgaaacaacttgatgtataataccttgcgcagaaacctgtttgcgactagctcaatgcatatggccctggtggtgccttcttcacaattctgcaaaaattgggaaaacggaatggaacatggtattaccagttgaaatgatatatgtgcatgcagaatgctaattgaaaaaaaaaacagataagggagttatcgattgcatagccatgatgctaaattttatgagtccacataatatatttagttttgatatcagcaactcaaaactatataatccacaattgcatacacgtcataatgccatactcaagctatgccaatgtccagcaactaaagttaaggttacaaacgcgataccacaaaataatactgttacttttatgtagagattagcagtactagaatggaagcactgggaagtaacctgattcctgacatagtatattaccagcaaaagttacattgttattttctggtttaaaagttcaatgtattagactagcatcacctcatcagcagtgtgtagtttggccactgcagctcgagaatggaacatgaaacactctgtaggtggaccactgcaaaacaacaaaacatcaacagaagtttttttttttttggttgaacttgatggcgagcataaaaatagtgacatggtcatttacaaggaaaacaataatgttatattccaacaaagatgaacaaatatgtcaggcctaggtgattaattatcataaaacagcaagagaaccacttttgtacttgaaaaatacacaaatacacaatagttataaacttacacacttcgtgaagcttgtgtatcacgtgcaaacatcttgtaagatagtgattttccttccagttgtctaatgattttgtcaaccttacccacatcaaagctttgaggttttatgttgcactcaggaccctctactgttttagcggactgttcttcccctgagattagttttacatcctcgtcaagaggaaatatatacaggtatctcctccatttggctgcaaaattagggtgaaattcacgtgagacctgcaaattatgccatcagttaataacaagcgtagcatcacccatggtggatgtcttgacattctaagaactttacatgaaaaatggacaattctaccactagcagcaatgcagcatacatatcaagtgcagtcatatattctgaaaaagcaaaagaaaaatacctgtgacacatgcaaaggtcttagtttatcaggtgcagccttgtttattgcatcctttatatcactagactttacatccttcctccatgtatctaaggaaattagaagtaaatacacatgtcagctatcaggagaagtaatgtatctagtcccatggtgtatctcagcattccattagagttaatttctcacataagtacacaaggattgtctatttatttgtgcaaatgagttcttcatgtcatatcaaatgaaatgaatggcatgcattggtggagttagtcaaataagaaggttagcagttcattgcacgtaggccagagttctgcactgctatatctccaggctattacttctttgataggaaaacagtggtgtatttggtattgacaaattgttgtgttaatgattttataatcagaagcaaattacttgttcaaatgcttctgtaaacaaagcaaaattttcaaccaaaaaaaaaaaaactctacaaaataactgcacataagctcttcttgagaagtagaccctccatcccaaaatataaggtattttagagttggccacagatattaaagaaaaaggtaaacatgatggatgttgtgattggttgagatgaggaagtaggtggagaaactaaatggggattggtgcgattggttgagaggtggaaaggtagctaaattttggaacaaagggaatagtttgtaatatgacatgttcataaaagtggataattagttgaaggaccactggaaaacaatagtgtgttctcaggtgcaactaacaaaatgagcaaacttgctgaagggcagtcacccctttgtctgtgcgcccagcaacaacagcacagccttctaatggcaatgatcttgcttcaagctgtttagctttcttctcgtcaacaaactggccaagatgtttttctactaacctgcaagaaatacagagtgcaacaaatggttttatcctgtcatctgtcttgagatgcaaaggaagtgaagaataaaagtgccagatatgtctatagaaatgacataactccattcttatttatccttacccttgaacagtgttgaggccaggctgcttctgccaaccatcaaatgaccccccatgatatgaaaggacaatcttgaaggttactctttcccatcgtcctcctcgatctttggatgatttagttgatgtttgattttctgatggtgctgtgtaatcttctccattcgtatcaaggctgtaaccattctgttgaagaaaaatccgataaatcttactgaaacaaactaaaagtactagaaacggacctgcaccgacaaattccaaaatctactctatcctccaagaaaaaatgtgttcacccaaaagatttcaatttctctaaaacgatgtgtactacttagatggggaaaataccaacatttggctcactaagagaaattgcaactaatactaacacattttccccttcccatttactgaatgcgaagaaccactacctcagggtttcacatggataattctagaaacaggcctgcaccgacaaattccaaaatcttaatctatcctccaagaaaaaaatgtcttcacccaaaagatttcaatttctctaaaacaatgtgtactacttagatggggaaagtaccaacatttggcacactaagaggaattgcaactaacactaacacattttccccttccaatttaccgaatgcgaagaaccactacctcagggtttcacatggataattatttaaaaaataataatatcattccttctcacctcatccttcccaaacaaatcggcgagccccgctgccccggcgccggtgcgcacgagctcggcgtagaagtcgaccaccctgctccacggccgcgcgtacatgtactcgtagctctccctgccgcagccgcagtgcccaaccaaaaccaaaacagttactaccaatcaagccccaagccgcagataagccctagacgatggaggaagtgatgggggggagccgttacttggctgtccaccggaggtggtggcacgcgtcggtgtggttgtagtgcgcgtgttcgtctccctccgccgccgccgtggaaaacgacaaagccggagctggcttcgccgccgccgccgccgccgccgccgccgtcgccatgaggggccggagcttcgcgagcatgttcttccctttttctttttgaccgtaatttgaccgtaatttttttcaagaaaagaaaagaaagatggttgttgtacaatttgaatccatggattagcacaatttgaccgtaatttttttcaagaaaagaaaagaaagatggttgttgtacattaccttggagagaaatttagagatccttatcctctcactctcactctctcgttctctctctctcccactctctctctctcgttactcttcaagccggctgacgggggcaaggagggggggcgtccaggtgtagatcggggtcggagacggcaattctggtggcggctaactggcctggcaacgcagatcggtaagatgggtgtatgggcggcgcggatgctaggggacggcgacggcgaattcgatgcggcgtctttccggtcccctctcgcacagatccgtcatcagctgcgacgggaggggttggatccggcgacctgttcctctcccgctcagatcccgttgtctctccgtgccccgctcacgcagatccgccgccggtgttaacgggagggtcaagatccggcggttctaccgtggtcgtggcctccctaccgccgccgcctctgcacgcgcggcccctacgccgcccccgcccctgctgcctccttctcccccacgccgtcttcgatggctgcgataaggggcggcggcggcggcggtgggaggcgctagaggaagggatatgaaggggaggcgcatggtccggtgggtgaagaatgaagaagtgggcggtcgatgagatggaggcgaaggtggcgagaggtggtcgccaagacctccgtcgagcatctggatccggcatcccttatcctagcgactgatggcgctggcgcgttcctcatccatctcgatctgacagcgccgccgtaggaggaggtcaccatctaccagtccaacgacgccaatgtgagtcctcaacccaatcatccagacactttcctctgcatcctcttttgattttctcttctatccaggatacttggtgctatcttttggtttgtgctttcaccgataagtcaggggacccggtgttggttgctaagcacatcgcatttgaggatgcaacttctttttaagtccttatggggttcaccacattccattagctcatcagatttgtctctgcttcttctggtggagaaccgtgtttgacaacactccttatgtagtcatagtgtccaagctacatacactgcagataatctagttgtgtattaatctacatttcttcagatcttcagaaacatcatccggctcactggagctatgctgataggcaagccttacgggagaaacaatgtccgcattatactgaatttctttcgaggccaggctgcggccggctgagttcgaggagagttggcccgcgccgtgcttgccaacgaccgacgtccttgactcgccgtcagttccagccactgcctcccaggtgctttattttttaagacaatatatcatgttgttgatgtgaaattttgggatcatcttgtatagtagtaatccggttgcttagaaattagaatacggttcttatctgagcttgtgttttgaaatgtggaattgctggacaacagttttgtgatcatgcttttatgttgtttataatatcatttacatcccatgttacatattttcctttgcttaaactaaattgagagttgaatccactgtcatttatttgtttcaagtattattttttgtgattctcagcattacattttcactctgatactcccaccgttccaaaatgtaatgtgttttagttttatcctaactcaaagttatcttccttttagaaaataatctgggtatttgatgcaagtacagtatgatctaacctggtcagcattcttatataatgagttattctttgtaatgagctagaagttatagatataatttattcgttaaatccatagtatattttcatcacaaaattaaaaattagaagtgattttttgcttctctctgaagtcatgagtacattgtgactacatatgatggtgaaactggtctggtagaggggtcaaattatctgttagtaaaaaaacttgaagcatatattgtttaactttattagatttagcatgcgatgagctttgctgatcaccttcataattaatgcaatgtgcgtccttaacatttggaaggacatttgaatccttttttcgcttataggcgtcatgacgtttcttaagtattccttcttttcgtcaggcattttgcgcatacagctttgtgtctctgtcttcgtgtattgggatctaagaatggggacgatgatccagatggcgcatctagcttggaagatgaagctgtacataaacattatcaacaacaaaagcatgatgtatcttctcgaaaacaacggtgagaagcaaaaataatttaatcattcacttatgttttttcagctgattttgttcatttaaatgagccgcaggatgtgtttatatatgtgttggacttcgatggaatcaattaatacaccaattcttttggtggggattattctatctcaatgttgagatagcttgcctgagcaaggtcagttatcaattttgtgcaaactacagccatactactgcaaccaatttttttttctcttccaatgtaatatctgatcacatggttgtttcctgctctgttttggttgcgatgtgcatgcttcattggtcatctgtttggaaacactcaattctgacatgtaccaatgtagtaccaaaaatttcatgtcttagtttgctatgccatgatgcttgatctaaagaaacttttgttctgatatgcgatagaggttccacttgattttctaggcaagttattcgttattgttttgttttactaatgttccataatattcttttatgtgttctctatatgcaaatactgttaagtttttttttatgctttacttatgctatttgaaatacctttcacgttatggccctaggaagtaataggggaactcaagcaacagttatgtacacaaaacaccaagctataggccaaacatttaaactttatacgtaggtcttcttttgtgtgcgcgcgtagttaagggaaattgtttggcagactatacatccgaaatcagaaataagtgtagcaaataaaaatataatgaagtaatagtggtattattttggttaatagtttggtgtgataatttttttttggatttgctaaatttctggcaccataaaattccattgattacagtcggtttgcatgcctatgcgctatgccacacaaccgcacaggcctgaggcctcccaactgtgcttccgtgaggttgaagattatttccacacatacatcatgatgagagatgattatatattaattacatatatgcaatttcgagacttacatatgtaattttgagacttacatatgtaagtttgtgacttacattgtaaatacaataaaattgcatatgtaatttataaacttacgatgtaaatacacaccgactattttttggtgaaaaatatggcgccataaatatagctactccccttttttttagctaatagaagatggatggttttttcttcagaattactaataaaagatggttgcctcttaaataaggtatgagatccgatcaatctggtgttaccttgctgagcttggtagttttatttccatgtattttttccctcttaagattgactgatttatgttaattgttcgttatatgtcataaataatgtatacatcattaaggtctaaagaattaccttttatcgttataaatgcagtaaaagcagattgagtctcacaccgaacatgaattgctcagtttcaaaaaaatatctgggtatatgagtagcgccgagcagagattgcttagttccacaccaaattctgggtgcatatattagtcttgtttgtgctttcagttttattctatatataggttgagaagttgtttgtatcctaatcggtcatgtaattcttatgtttgggttctatgtaatttatgtgctggactgaatttgtaattcctgggcaatgggcccaaaaataccgcatgcgggaactggagacggacagctaaaaaaacgcgtgcattgaaaaaaaggcggactcactaaaaagagcgtgtgcgcaaaaaaaaggtggatgggcccacagaaaaccgcgtgcgaaaaaaaccctgacggacaaaaaaaaccgcgcgaaaaaaaaacggacagaaaaaaaccgccgtgcgcgtgtgggaaatcggcgacggaccaaaaataatgacggaagccttaagaatttttttattaggtatagatttgacaaatttcctttcctacatgtgtcggtcagtgtatttccctgcatggtttcctatcaaaaaaagaccaagaaaacaggtgtttggttgtgattagttcacgctaaaattagaagtttgattgaaattggaatgatgtgacggaaaagttaaaagtttatgtgtgtaggaaaattttgatgtgatggtgacggagctcgtggctcctcaccgggagaccgcgcaggcccccctttgccggttcggccgggggcttagggtgaaatctcaagctctcgctctccctctgtatctggaaagatcgtctgcccgcaagacacacgagacacgacgatgtatacaggttcgggccgctgcgaagcgtaataccctactcctgtgtttttgtggatttgtgtatggacaagttacaaaggatcgacttcctttcctctcagccttccgaaaggaccaaaaatcccccgttctaagctctaaatctcgaaaagaatcccccccctctctatgggcaaggtcctccttttatacttcaaggggataccacatgcacccttccctttccaaactggacttttcttctctttatggacggagattggtatggttgctgtccgaatgacactccgatgggacagcccacacctacctccactcccggcggagacaggcgcaacgtgggatcgtggctgcccgttgctgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccagcttgagacgagtgcctagaggctttcgtcttgacgggatggggcaaggcgtgcgtcagaccgccagtcgccacctaacccgtgatctgaccggtctgtgactggtcacagaccggataaagaaacgcgctgtactgcgttgcatgcagcgtgacacgcttgaccagactgcaataaatgctgttaggtgagcacagctgtgatcacttatcccatgtatgtggcgcagacttccttaaggggtcggggtgcctcggccctcggggccggggcaagcgcaaccagacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacgccacttgagcagcgcgcgaatctgggtgagcagatttgtctcgcccggagatatggtaacgccgcttcggtcggcgagcgtaattaacgcgcgcacgatacaatccatttcgattgccacaaccgcatatccactcaatgcgccgcaagcgggcgaatgggattagtggaagcgtgggcacgggaaacgagggagcgagatagcgagatacgagggagcgaggtagtgggcgcgagaaacgaggagtcaggcccagcgatggcaagggtataaaagcatcgagaaaaggatttgcttccttcctttcgccattgttcctcttgccttcgccacctgagctctaactctttctctgctacgccctactttcgccacacgcgctcgttctcaatcatctcttcctccgccgccatggcacggggctctgctctgctcgacggcagtgtactaccgccttcccgcatcgtgaatgagaggcacgccggactgccgcgccgcttcatgccggagtccgccaccggtcgggagatagtgatgctgggcgaggggcgcccggcaccagactacccggggcggtccatcttcttcctcccctttgcgatggctgggctggtcccgccattttctcatttcttcatggatgtcctggagttctatgacctccagatggcgcacctcacccctaatgcggtgatgacattggccatcttcgcgcatctgtgcgagatgttcatcggggtgcgcccctctcttcagctgttccggtggttcttcaccgtgcagtcggtgtcaccgccgtcggtggttggcggctgctacttccagccgcgggggccggtgttgaaccgctacatcccctgcgtccttcgcaagaagtgggacgactggaagagcgactggttctacacccccctcgccaacgaagcgcgcctccgacttccaagccagcccccggcgcaggtctccagctggcgggcaccggtagatctgggggaggactacgacgccgtcctcgaccgcctggcgggcctgcgatcccaggggctcaccggggccatggtgtacggcgattacctccgtcgccggattgcgccgctccaacggcgcgcccggaacgcctgggagtacactgggcctgaagactacatgcggacccaccagggagccagatgggattgggctcccgaggacttcaagatcgtggtccaaagggtgctgaatcttagctccgcggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccgaggggaacaatctgccccaggagggggtcgtgcttctgggccccgcgccgggggctcggggagcagccgccctgccgacgcccaggggaagaggaagctgggaggaacacctcccccatctcctccccgagggggcggggcggcgcgtgccagcagtcggcgcccggagggggccgcgccgacgtcgcagcccgagggggagcgcaagaagaaacggctccgcaagacgggggagacggaaccatgccgggggaacctgatttctcctccaaggtggtcattcaaccgaccccctcgcaggttcgtctcactctcattgcaaccacctttctcccaaagagaagttttttcttactcattttgttcgtcttttggttttttcttctgcttcagcgatgtcccgtcgcattcctcccgccaccccaaatccggccagtccgaggccgaagatccagcggccgcagaggagcggaggcgagagtctgaccggcgtgaagccgcagcccgccttcgggaagctgaagaggccgcccgggttcgccaagcggaggaagctgctcgggaggaggccgcccgggctcgccaagccgaagaagctgcccgggaggaggccgcccgggctcgccaggctgaggcgacagctgctgctggcgcgtcacttgggcctactcccttgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgccttttctccaaggcggctcttctcctcatcttctgtcgccccgctgagcgccgagccccttctgcaggccctggccgccgcaaacaccgcagtgctggatgggttcaacacccaagtggaggccctgcgtgcagaacgagcggagctcgaggccgcatgggcgcgtgttgaggaggggcggcgctcggtggacgccatggtggaggtgggccgtaaggctcaccgccgtcatgtctcggagcttgaagcccggaaagcggcgctggcggagatcgcccgtgaggtggaggaggagcgggcggccgccctcatctccaccaccgcgatgatcgaggcgcaagacactctccgccttcagcacgcaagctgggaggcggagctgaagaaaaagctcgacgccgcccaaggggtccttgactccgccgctgcccgagagcggcgggtaacggagactgaagcggcgtttcagcggcgcgaggaggcccttgaggcccgtgccatggcgctggaagaacacgccggcgccgtggagaggggcttgacggaccgcgaggccgccgctggtctccgagaggcgacgctggcggcgcatgaggccgcctgcgccgaggaggagtgcgcgctccgcctccgcgaggacgcactcgctgagtgggagcgagctctcgaggaggctgaggccacgaccaaacggctggcggacagcctgtcccttcgcgaggcggcgcaggaggagcaggcgcgccgcaatctcgaatgcgtccgcgccgagagagccacactggagcagcgggctgctgacctcgaggcgcgggaaaaggagctggacgcaagggcgcctatcggcggggcggccgcgggcgaaagcgacttagccgcccgcctcgcagctgccgaacacaccgtcgcggaaatgcagcgagcgctggactcctccaccggggaggccgaggcccttcgcttggcgggcgagattgggcccgacatgctttgggatgcggtctcccgcatgaagcgcgccggtcgtcaagcaggcctctggagaggccagacgacggtgccccccaccaatctggaaggcctcgctccgcacctcaacaggatggcctgggtcctcgaacgactccccgaggagctcgagaagaccatcaagtcatcctcgagggacctcgcccggggggcggttgaactcgtgctagcgagttaccaggcccgggaccccaatttctctccctggatggcgctggaggagttccctcccgggaccgaggacgacgcgcgcgcgcgcgtcggggatgctgctgaccacatcgtcaacggcttcgagggctcggcccctcggctcgcgttcgcccccagctccgacgaggagggcgacgccagcggcgaggacgacggtggcgacgaggccggcgacccgggcgcatttgaatgagcccccaggcccccgccaatcttaacttttttcttgttctttcttctaaggccttcatgcctcttttttgtacaatttaacttaatctgcaatgagaaatgatgaaaaaatttttgtgttagttttattttgctatatgtgagatgaggatgatctgtgccgtggtctttttgcgtcttagcttgaaataagggcccatgcccaagtcccagtcctcgaaaagcgcgggtcggggctagtgcctggggagatccgcatgtcgagactggccaggccgggaacgtggtgaccgagggttatgggtgacccaattgtgggtttttgccgattcccccccggagttcaccacgccccggggcacggctcggttctgggccccgtttggcgattttagctgaccgaaccgagcccccgagggcaaggttgagcacgagtgacattatttcaagtcaagattcttcaaaaggaaaaaacggcacagacacaacctttagaaaattgaaactgcttttattgaaatgctgaaataaaggaaaaagggatatatgtgcatgtgtggtagcccccggccaatcctgcacacccgaggggggtgcggggttggcccgagccaaaacctgacacccgaccccccccctttcaggggtagaagcgacgaaggtgttcgatgttccacgggtttggcagctccgtgccgtcgcccgtggccagccgtaccgagcccggccgggggacaccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaagctctgctggtagcgcgcggctcggagggccgcgcgccgccttcgctcttctaagtagtagaggtcatctctgcgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggtactccaaaacgggccgtgatgcccttaatgaatttgagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcgtcattgagagctgtcggccaataaaatccttgacgaaaggccttgccaaccagggtacgcgaggcggaatgggctccgcactcgccctcatggatgtcagcaagaagctcaacgccttgttcctgaggaatgcatttcaggaggattccgttagccgcgcgccgatagagggtcccttctaccagcacgtagcgtttggaaatgcgttgtacacgttcactcccttcgcggtcctcaggtagagtcttatctgtgaggtatgtttggatctcagagatccaggcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccttgagagttcatcggcaactatgttatcccttctgggtacatgccgaagttctatcccatcgaaatggcgctccatacgccgcacttggcgtacgtaggcgtccatctgtgggtcagagcaccggtactccttacagacctggttaacgactagctgggagtcgcctaataccaagaggcggcggatccccagtccagctgccactctgagtccggcaaggagtccctcgtactctgtcatattgttagtcgctcgaaagtcgagacggaccaagtatctgaggacgtctccgttcggagaggtcaacgtgacccccgcaccggcaccctggagggacagagaaccatcgaactgcatcacccagtaggtggtgtgaggcagctgcgaggggttcgtgctggcctcggggattgagacggtctctggagccggggtccactctaccacaaaatcggcgagggcctggctcttgatagcgtggcgtggttcaaagtgcagatcgaattcagaaagctcgattgcccattttaccacccgtcctgtaccctctcgattatgcaagatttgcccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacgggccgctgcacctttcggcggggccgatccccttcgctaggggccgtatccccggggcgttcttcatccaagtggcctctcggggtgcactcgtcttctgtgccgatgacctcggggtcggaggacgacaggagcggccttcccacagtggcctcggggccgtcctgggggtcgggggctcctggcgtcatcggacaagcgggcaaggggccagctccggtcgtcaggggcctcaggcctcctttcggctcgggggcctcttctccctgctctctcccgggtcgagtcagcacagggttagcctcggggccaaagggcgataagtgcggccttccctcagtggcctcggggccttcctgagggtcgggggcacccagcaccgtctgacaagcgggcagagggccgactccggtcgtcgggggccttaggccaccgttcgactcgggggcctctcctccctgcctgctcccgggccaagtcggcacagagtgggggtgcgcagaatgaggattgtcctcatcgcgctccacaaccaacgctgcactaactacttggggggtcgctgctaagtaaagtaacagggactcatttggctccggggcgactagaaccgggggagagctaagatacgcctttaactgagtaagggcatgttcagcttcctccgtccaagtgaacggcccggagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcagggttcagctttatgcgggcggagcggaggttctcaaaagtttccgctagatctgaaagtaaagtttcttggttgcgcgtttttacaaccaagtcatcaacataagcctcaacattacgtcctatttggctacccaaagaaattcgagtagtacgttgaaaagtaggacctgcattctttaacccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccaatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggcccccggggcccggcatcttcatctggaggtaggcgtagtggaccgccgccatgaacttcaccaacgcgggtctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgtgggggaaaggatgttgagagccgctcctccatctatgaggacacgccccaacttcacgttgcagatagtgggggaaaccaccatcgcaatctgccctccccgggcaacgcacggtgggtggtcggtctgatcaaaggtgagggccacctccgaccaccgcgcccgacgcgtcgcctcatgagtaggggccgcggctagaagctctcgcttcatagccttgaagctccggcgagaaacgtgagcacacgctcccccgtcgacagtggcaatggtggccccaggttcttggaaacctaggtcatcatcaccgtcatcggggtcaacggcgggggccttctgtctggcctcacttcgccgtctaccggagggaactgccgcggacttgccctcacggcgttcctgcctcctgtcctcctcccacttcctcgttcgctcagccaaatttttgactgcacgacagtccgcgagatcgtggagggaggtgttgtggacggagcaccacttgctggctgggcgctcccggttgggagtaccagcctctttctttttgtcgctcgcaggcctcccctttcgggtggcccgcggagcgccctcgacggcgaggacgtgcccctcgtcgccggaatgggccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccgtgtcgaggtgacattctggacgaggaggcgccctccgttgcacggggagtacgccggctattacgcctgcgctcgatgttgaggcgggcatccggctccccatgctgatcctcccgagtcgacggtgtcgacgagggagtggcagccgaatgacgtgcagccgccgccgctcgccgcgccctccgccttgatgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgtggattcggctccccgtcgtcgccgctcacactcggagagaggtcgtgcgcttttccctgctcggccattaggctgaacaagaaaaacttggcgcacacggaagagtctgagagctcagaaaacacacgctgagccccctacctggcgcgccagatgacggagctcgtggctcctcaccgggagaccgcgcaggcccccctttgccggttcggccgggggcttagggtgaaatctcaagctctcgctctccctctgtatctggaaagatcgtctgcccgcaagacacacgagacacgacgatgtatacaggttcgggccgctgcgaagcgtaataccctactcctgtgtttttgtggatttgtgtatggacaagttacaaaggatcgacttcctttcctctcagccttccgaaaggaccaaaaatcccccgttctaagctctaaatctcgaaaagaatcccccccctctctatgggcaaggtcctccttttatacttcaaggggataccacatgcacccttccctttccaaactggacttttcttctctttatggacggagattggtatggttgctgtccgaatgacactccgatgggacagcccacacctacctccactcccggcggagacaggcgcaacgtgggatcgtggctgcccgttgctgacgcgaccagtgccagaccggtcattctt

SEQ ID NO: 72298 - DNA, 15490 bp, Oryza sativa
tggtaggattttttattctttttttcctttttgaaaagaagattgacttggtagttgctgatcgtatgcctctcaatgttgcatgagctactagtagttaggccgatagtcatacaatactttgaccatcattgagacgcatatgaaaatccgctagcttttattaagagcaaattccctgactagattatcatgaaactacagatttcaaagggtatattataaaactatagatttagctctaaatttatcacaaagctatagatttagatcgtttcagaaaattaaatatttagtgatgaagttatcatataactatagatattttcaaatttagatctatagcactattattttttcaagttacagaagctaaaattttgtggtaatattgatgttaattatttagtttagtgataatgataaatttgatgctaaatctgtaattttaagatacatttttatatataatctatagttttatgatattttgataaaaaaaactgtaattgcgtaaaatttactcttttattaataacgagtctttttgtttttttctctttcttggttttcatggaaatataatctcgatggtcaaacacaacactgttaattcgaacatcaaatttctgcacgagttttgtatcatgttttgtactaggaaagagggctttcaccactttttttttcatgcatcctatagagacatgaaaatgatcatgccgatcgacttctcttattttcttaaacgtgtagaatttgctcatgtgattgttgagaaataattgcctatgtcagcagtagagtataaaatcattgtcatcataaaaggaggcattggtggtcgttttccgtttctttcggttgtcttttcgtcgtgaaaaataagaacaattctttgataggagggtttatgtgtgataatgacgatgataagatgatcaacccattgtcacaagtttttcccttgcttctcaattaccctacagttttctaatacctattcaagtttttaaatattttttgtgcccttagtattgcacacttaccattttgttgtttgcaccagaaaagtacaattctagatattaaaagggaaaaataagaaatcagtactaggtttcttctgccacttacccaataaactaactttaattatttcctaaagaagcataaagagaaacatatataaatagaccctgaaatgggaatgatgaattgatgagtcactgtccagcgtccacttgtccagtgtagatgatttgaacattttgaattcattattgtttgaattttgattggcctggttgagaaaacaatgaaacgtgagtctactttgattcggcaaaatcaaaatctgccaatagaggcaacacatgtgtacatgacgcagctaccgcttttaggtcagatccgaggtgtaagcggatccaaattttggttataaaatattgcgattttcggtaattgaatcttcggagagatctgttgacatgaacggcaaccacgtcatccacgtgaattttgctcgtgggcatttttaaatggtgagacaaggttgctcattttttaagagtaaattagtcatgaatcagaagcaaatcagaaccaaaaactagtatatcaacgtgacagaatccggatttccagtgacgcaaatgagctgctgattctcatcttccgtatagactccttcggtttatgccgtagcttaaatttaacttcaaaaccatagtcatacagttgattttgatgtttttcattttgcagtactagcttttaaatgctaagaatacatatgaaaaaggtttttccttatagatttttttcttttgccgctaaaaaacggtacgttttataagccactataggtttaacgataaaactgtgttcaaatcgataaaactgtgttcaaatcgaaccttttcaactctactttttcattttttacatgcatattttccaaactattaaattgttattttttttgcaaaaaaagttctacttaattaatcatgtgataatgagctaccacgttttccaaaaggttccaaatctttatcctcgaatgcagctagggtcggaacaaaacttcgtatggaaaacatgaataattctcgcgattctctgaaattgattcccgttttgtaattaatctcaatcatggcctacttacttaatttccatttcattttttgcagattttggtgtcaaatcaagctcttaatttagccaacattgtaggccaagacgatggagatccatactgctactcgatgcagcagcagaattggtagaggggcggcacacactgccctccctgtgggtagcctccggccgtcttgcaccagttgtcgcagtcacgtatatcctcgcacttgcctcggcacacgaacttgccctctcctgcatccatcagaaaagaaaaatgccaatgtttagttcacaaatcagccacatccaaacagagtaaatcataatttgaaactccgatgttctctttcgatactgagtaattatgaaccgtaaaaatcagaatcgtaatagtgatttgagaggaacaatattatctatatctatactaatataaaagatagtagtggtggtgatgagtctgccaccaccaccacccaactaccatacgggacccatgaacggtgagtgcttatctcttagcccccacatgctatagatcttatagaaagaaaaatataacaatagaatattatgaaaattttcatctttacaaaatgatagaaaaataaacaaaatgataatatattagacaattagaagaaaaaagcatgttgcaacacacgggcattatgctaatcttagaaaatcttgcaatgtgtacctgaagggataaggagagcagcaatggctacagcaatgacaaggatcttccacataacagaagagaaggtggcagccatctcgctgttaattgcaacccactgctgaatgctcttctgattggatttgttggaagcaagatggtttgagactttgagtgatgctgcatcgcagtcatctctgatcatgtgtatatatagcagcacgatagtaaataaagagggtaattttggtgaatagtagcattcagctaatctaagcctctagaaggatatgcatttatgactcttctaagtttaacatgccataatgtctctattagttagattagatacgacaaggataaggcacttaattatgtgccaaagataaccatgctagggctcttttaccatgtgactatttgtgaccgtttttagactcattgacaatttgacacatggcagagtaaatcaaccacctatttttatatttaatttaacaaattaggttcacatttattttagaacaactaggttcatattacctttatggaattaagatgcctgcactacatcagcacgataatatttggttttactattgcgtttcacagaattaaaatgacttccaagtttatacacacccccagctggtttatgagccactgtttagtattgtaacagagcaatatttctgcagtcgtaaattgaaatctttgattaaattagctaacaagtgtgcggacatcaacagctgaacagatttcagattgttcaaaggtgacctgcagtctattttacaaacaacactgacctgacaagtgacaatcaccctcatgtacaaaaaaaggaaaagaaaaagaaaacgacggcgcaatgtgcaatctattacgattagaaagagctgcggaaaagttacttcatgctgtggaaaatttgactcaggtagaagataaaactcccatttcaatcttgttattactcttcaagtttttggtgcttttgaaggaacacctttgatcttatatcagcctagcgaaggatgaaacgaaacgtcaaattagtacccaagatacaacgtgctgacaagatgaaacttgaggtatactatttacaaaattctacctggcgaatgggctcgggaatgcgataattactacagaacttcactatcccaatggctgagtcaagtgaaatgcgatgcccaactgagatgtagatcggcttcgacaaactagggcaggagcacattgcctgggataagttaatagtttagttccaacaatagaaaccttttcattatcaggaaatatatgacagaaatgaagtgaaggatgcattcagaggtccaatatagaatctcctacagctccccatgttgtcccagactgtccagtcaataaaattaactccttgttgcagttttcttttgcttctaattgtcttctcaattcagattggttaaggccatccacatggtgcagctggggcattcaaaacactgaggacttagtcttctctcagaggatcagaacatcagaaaaccatcaagtacttgaaatggtcggaaaacaactagatgagagaacttccataggagtagttgcaatggcagtaatattaatacattttttccaactccaatggtcggcaggtctgcaaggacaccaagatgacaagctaaaccaaaacctgttgaacatatgtaagttagagggtcatgcattcaagtagtttattgatgcagcttgcagtgtatatgcataactagacatgctgtacgctatcaccaagtcaattgactagggactacaaggactgtcaaggtagttcgttctaaaagaatataatataatcatgttatgtgtgtgattctgcagtttttttctaatcacatgaatcatcttagtcttacaaactaagattgccatgatactaatcactaatgaggtatacctcgtggatgaagtaatccatttccatcaaccatgagtacctgtcagttcatcaagttaaaccatagagaaggcactggcataactagtgttaaatgtaaaactagaagacgctaacatatctaaaatttaatgccaatgcttatgccattaagcattccagatcaaaattctagaataaatgatatttatgatgacaaatgattatacatcagcgcagacaattcacactgttttcacagtcaaaatggaaacaacatatgacaacatggaatgctacaaagcataaagccacagtaaacctatttacagaagggtaaattgcaacgacaaagcaacctgagggtagaaatgctggttgtttgtcttcattttttccaagagtcctagaagaattggagcctgtaacaagtagtgcatgttgacacttttagctgtataacaatatacttgatgtatattttaaaccatctaacaaagtagaataattaaaagaatagttagcatataacaacagtttatccacgtccaatcataacttgattttgcattgaacatgctagacccatatatggttatacagataagaagaaagaatagttagcaaaaacacaataaatatgaatgtacccatcttgattttgtttcattgtttgcttgtctgcctgttcatcactacagaaaatgaaaatgtctaggcccctgaataataatacagaaggcatggataaactgttgctcatgatctagcaaacatatgttttgatcaaaccaaacacgccaaaataagaggacacacaatacctctctgaaagcaagaaatcctggaatatatggcacttgcagccgaacaacatcgaactcttcgtggacaacttctaaggtaccagcatctaaaactaccagtgcagcacacgccgtggaagggtcttctttcgagaagctaatgtcaacacctcctatatacttcaggttgcccttattattagcattgctctgatctgaatttgagcccattgaaggtaaattccacccaaaatcatcctcaagaatgagcttgctctttagcatgtcttgtgttctacagcacaggaaaaaaccagcatgagatgtgaactgactcctcttgattggtgaatggttctgagggtatacttggcccattcttgtttctgctgcatcaactcacaatcatctcctcctcctgaaaatcgtggggtattatccattcctcttgtgttcctcacaagcctgcagaatcttgcacagcggtccggaaatccaaaaaaaaaaaaaaacggctgcaaacctgaaaaattctagctgcgttctgcatcagcataatgatttgtcttgaaccgtaaaatttgagcactgtggaattgcggggcgtactgacagggaagagaatcgaagaatcggatggcgagagaactcgccgagattctctcacctgatacgtcgccgtcgcccgatgccgccgccggcaagcctaccctctcctcttccccttcaccggcctcctcttctccccgcaaccgctactcccgtcctccacctcgccggcgcccgcctgctcgtgaccgtggcagccctcgtgatgacggcggcggcggagccggagaggcgaccttcgccggcgaggcggcgcgagagatgcagaggaagtcagcgagacacggagactgacaggtggggcccacaaaagagagttgacagatcgcaatctcggcccatctcgctttgcccgggaaacttgcgacggatgggccacaattgcggcccggatatgtcatacaatgggcctttacttcgaagaacttttcctgatgggactgtctaggcatgtggcgtgttatttttgagaaaaaaatcacccaatttttttctcccctcgtatctgcatccaacggtaaaaaaaaaaataacaatacagagaaaccgtccaagtagcatgtgattgtacttattagtagagtagtattcaataaagattaacacaaatgttgcatttataactaaaattaccgacaaatgttgcatttataactaaaattacagtgttttataactaaaattacatttataaaaacaatagatatggcatgtaagtgcactataatttatttgtcgttttagtataaatacattgcttgagaaaccatgcagatatctgaagtgttaaatgttatatttataactaaaattacagtgctttataactaaaattacatttgtaaaaacagtagatatgtcatgtaagtgtactgtaattttagtacaagtgcgctgtaaattttggtaactagaatatttgtcgttttagtataaatacatgggtgtagctatatttatggcgccatatttttcatcaaaaaatagtcggtatgtatttacattgtaagtccctaaattacatatgtaattttagtgtatttacaatgtaagtctcaaaattacatatgtaagtactaaaattacatatgtaaattggggtgtaaatgaggtgtaactactgtgtaagtggctgaaaaaaaatcgactgtagcatatggcgccatatttctagcaactccgtaaatacattgcttgagaaaaccgtgcagatatctaaagtgttaaatattgcatttataactaaatacagtgctttataactaaaattacatttgtaaaaacagttgatatggcatgtaagtgcactataattttagtacaagtgcgttgtaaatttgggtaactagaatatttgtcgttttagtataaatacattgcttgagaaaccgtgcagatatctgaagtgttaaatattgcatttataactaaatacagtgctttataactaaaattatatttgtaaaaacagtagatatggtatgtaagtgtactgtaatttattttagtacaagtgcactgtaaattttggtacctagaaaaaagaaagaaagaaatagatagaagaagtaaatggctactgacaatctgacatgcgtgatgtacatgaatccatcgatataaagtcaggttgacttggtcatggactcaactgaccctgcttttgcacaaatcttggaaaacatcgtgcggctagaaaaacgtcaaatactatgaaaaaaaatcacccggcaaaaatttagcaaaatcgtttcatttccggattcgttcatactacaattttcagataaaattcttcgaaaatcatctgaatgagaactcgtacgtataaccaatcattgagagaatatgaaagcttgatggtgtggacgatcttgccgaaatcagtcaccaaagttttttttgggcattttggcaatgttgttcaaactcgctcagcatggtcgtgttcctaaattctctccctaaatgtttttaggcccgtttgaaactccttattagattatagcatattagcacataaaatgagacggcccatgaataattactaaacattataaatttcaaaaatagatttctttgattttgggtaatctgcatttcagtaaatgaaatgggagagcgctgctctccttcttaaaaaaaaatatttctttgatttatttttaaaaaacttatatacagaaatatttttttttacaaaaacacattatttagcagctcgagaaatggtgctaatgaaaaaggataatgttgtagtttggaattgaagttttgggcatgatgtgcttgatcatgcccaaactcaccaaagcttttggaattttcacaatctataacctatttcaaacccgtagaccacgatcgtgctgcttaaatctctctgcaaatgttctcagtctgaaactctcaactcggtatcgatatatactctgaacattctgcatacatcaatcaacacaagaaaccaaatctgcagggagagatcatccgactgctctgccgacgtactcgacgtcgaagaggagagtggagttgggcgggatgacgcaggaggtgggctcccagcctctgcacccggctcctctcgcgccgtaggccagctccggcggcagcctcagcgacctctttccacctgaacattcaaccacatttccattcagcttcaccatttctctaaattgatacaaaatcgaggtgaatctgatcgagtatggtgagttcatttcagatttttgtcatttttcagggttcagttcaggcagggagacgcaccggcgagcatcggcgggatcccttcgccgcccactatgccctggtcccatcctttgatcacctgaagaattatcagtgaatatgcaatgtgagtgatcttggtatcagagatgagtctaattcatcgtgtagctgcgtaatctgttgccgattagtacaatgtttgaatatcttgcagaatctgttagtgtgcttgattgattgatcgtgtttacctcgccgacgccgacgcggaaggtgagcggcttcccgcgcttgtagctgctgtcgaacaccgtgccgtcctccagcctcccggtgtaatgcgcctgcgtgggacgaacgaaacacacggcgaggttagcaagaaccccgagacctcgcctcgccggcggcggccggtgggcgggcaggtgcgtgctgtcgtgctgaccttgatgagctgcccttgctcggcggcggcgccggtgccgacaacgcggtcgcagaaggcgagaccgttgggcgccacctcgagcgggcactcgccgccggacgcttccgccgccgcggggagcacgcgggagaggatggatgcggacagcacggcggccacggcctcgcgccggcggagggcgacgacgggggtgctgttcttggcggccacggcggcgccggcgttccggctcggagaagacacgggaagtttcacgctggggtttgggaggctgagcaggagacgggacagcggcgaggcggtggcggcggcggcggcggcggcggcggcggcggcggcggagggagccatggcttgccggctccgtcctctgctgctgcctcagttcattccaaagctccccaaaccagagaaacacagcgtagcgttgcagaaacggataaggttcaacgtcttctgaatcgtggacgaatccttggacgacgtgggtcaatctcgaccatctgtattggatccaacgcgcccaaagtaatgttctttttcatccttttggagagcgtctggtagtttttccccatgagggcctcctgaaccgtaccaaaaacatatacttccttctaaaaaaaaacatatagttcctccgtttcagtttataagactttctagcattgttcatattcatataaatgttaatgaatctagatacacattcatatagatgtctagatttattaacatatatgtgaatgtgggtaatgctagaaagtcttataacctgaaacggagataaatttggagaatttctatattataggaaaatcgtaggaaagtcttcgaaacaaagatttaatcctatacttttgttttaaaatcatataaaatggacaattctacaaaaaaaatttagaggaaaattacaagaactctaaacccttgaaaaatttcatgcgagtctatttatctaattcgattcatgtgttttttccgcggtctacacaaaccactatttctatatttttcttatgttttgttgtactctattttgcatttatgttcacgtttaaatcctttgctctttttccattattccattttttttcaatactacgtttcaaagaaccatgtaatttggattaaagatgatggatttgtttatgtgaattagtcaaatattatatattacaaaccttaaaaataaatttaaacacaaagcagtctaaacaatgaacagttctaacgtttaaagtttacggagaaatcgtgaagtaagcgttgctcaattgtttagattcttcgtggtggaaccagcctacctgggtacaagttctagatttgacacatgtactcacattcacggctaattattctttcagtggtaggtgctgtacctgccgacagcgagacaacatggtgacttcgtcaatctcgagatatgtcgacatagtcttccgaaaggtcatagcggtagggtgtgcgtgtgtgcattcataggagtgagagtacacgtattgtgagcaaatgcgtatgtatgtttcgaaaagattttgtagaaatcgaatttttttggagcatggcacgagtaatccacaaccaataatctgaggtctgagattttgttgacatggcaattggcaagttgatctgttccactcgtgctaactaggaatttatgtggcaaaaccaaaagtggcccccgcatgtcatcatcactgtcctcccctcttctctctagcttctctctctctctctcctaagggggcgcgcggtcaaattggagcaagggctgccgaatcgaaggagaagtcgcggccgtcatctatgttgggacctcccctttgaacttatctagcaaacagtgtgagtgtcttaccggaagacggcggaccatgccgatgctacctttaccttcgacctcatcagctctatcgcttctgtcgaccagtcgaggagcgacaaagaggtgcctggccggaccgccaccgttgactcgctgtggagcgcgtcccactggtggagacgaaccaagattcggtgaataagccaaagaacgagcggctcgggacgggaactaggacatggtgacgcaaccaccactcaaagctcaagttccacctccacggctcctcctcctattctcaacatgattgggtggaggcggcgagcccacccctagtggtggggaggaacgtcccacgaggatgagcatgagtggtggggaagagcccactccagcatcacaggaccgcaggagtacctaaggcggagttgctggggcattggatcctctccttcactgatgccttctcgcggatggctggctccctcgcctcccttctcttttcctccactatggctgaccaccagagccacctcatcaccgacctcccaccgttgcctcgtgcggacggtctagccagctgtcaccgctctccttgccgacgagctcctatgaaagagaggggagagatggaataggtggggagatgtggaagtccacttatatgtgggcccacttgttttttaatttcctttttgctgaaacacgtcagcaaaaacaagtatccatattgtcacgggatctgacttgaatggttttactatgatggggttgaagatgtctgatattgcagtttagagttatcaattaaactcgacggaaagttgaggaatgaaaatggacttattcctccctagatctctgaaaatttctgggccaaagccttcctggcctgctcaacattatccggcccatctacccaacacacctcatcttatagcccatacaactacccaaacctgacatccttcatcaaatttctgcaggcaaccaacgtgattctgaacaaatgcgatataataaaacccatcgatatcctcgtatacagtacactcatggcgatccaacaccgtcgctgtcttcagttacacgaacgcacgatctcgccggaaagaccgccgcttcggccggcgagccaccggagttcggcgtgtgagccttcaaatccgcacgcacaaatggcgtagcaaaacttcgttaggtttcggtcattttcacaggcaattctgatctctcaatctcttccacacacgccgccgccgcagtaatggctcgatctgcagcatgtgcctgaccaaactctcgatccacatccatcgatacatcggttaataagtcaggttttgtactttcgtttgaactggtctgcgaggaaaaacaaaataaaaatctttgttattggagagacagtttgatcacaaatcactcctgtgatcgtggtccaaaatccagtacttgtcggtgtcagtactaccgttctgttgacaagtaactcatggtgattgatgctcatcttctcttctgatcttctccttgacaattgtaggaaatgattaattcccaattttagactttgtttagataaaaagaaaagaaaggagagacaatcttgcgaagttaggtttcatgcgttgcaaacagcggcaccattaacaggagcatatcgtcatctctgacatctagtgagtcaagtgacacagcccaggacttgggccagattaccagaatggataattggagtcgctcacctgctcgtgatccatcatctctcttcttctgttgctttaggttgcttgcttcactgcatcttaagcttgtactaatgcaaaacttgcactcaaaaagattagtgttgttgttttgctaaccacacacacagacatgaagtcagaagctcagatcatctgctcttctcctgcatatgccaaagccctccaactccatgtttcagaaaccatgacaggagcatccacacaaccaatttttagcttagtgatcagcaaagcagcattgtgtatgtcatgtcaaaatccagtgattaattagcggaaggtgacttaatccagatgcaccaaagctatactatccttatccactgaagcacccaaaaaaagtctttcagggacaaaagtgcagtgcagtgcagacggcaggcctgctcaactgtattttgaccggctgctgttgcgacactaccaagtacaccaaaccacttcaatctcaagctttctttttatggtcctggatctcactggcgtcatctcttgacatcttaattttattttggagcttgctaggctgctagtttcccttgatttgctcttttcgacttattcaccgaattattaaaacatattatttattacatgcttagaaacataagttttctaaaaaaagacattcttccaccacacattatttaaggtgcgttcgtttaagcgaatgactggaactcttcagtcaaacacaaaacagatactccctccattgcaaaatgtttgacaccgttgactttttagcatgtgtttgaccgttcatcttattcaaaaaaaatttgtgaaatatataaaattatatgtgtacatgaaagtatatttaccaataaataaaatgatataaaaagaataaatgattacttaaattttttgaataagacgaatggtcaaacacgtactaaaaagtcaacgatgtcaaatattttgaaacggagggagtatatcgttaatatatgattaattaattattaattactttaaattttaaaaatagatatgctgaatttttttgcaaaacttctatatagaaattgttgcacaaaacacactgtttagcagctcaggaaacttgctagcaatatattttcctaaaaaaaaactcaagcttctttttttttgtcctcgatttctttggcgtcatctcttgacatcttaatttttctttaaatttggtgccagctaatttccctcgatttaattttttttctgaattttcttttgatgccatcaggagagctaattttttctttggtgttgacgtgtgaagggggtatcagtacagtacgaaggcaatttaaggagccgtttggtttgggtgatgccttaaaaatgaggcctatttatttaattttcctatcactaggaagccatgtgctaatggtaccaagacagtattagtgctgggcgtgttgtaattgtggtttttctaggaccatattgtgtcctctcctaaaaaattgattatccataatggtctttgggacagaggaagctgtatcctggtatatatgtcgtgcattgcattaatgctttgccatcaactgaataagctagcgctcaaatgcgttggtcaccatgtaggtaatggagtgaaaacagtggtttgcaccgagcacactgcttcttgagttacgagcagttactaaaatttaagttttaaaacttaattttggaggcttttcatcaaaaattatttttcagtatcagcttttaagaacaaaagaaaataaattctatagattaatttttgttgtttcgtttatttcgtacagcttatcattcatcgcgtaaacaattaaaaacgcaaatatagaaaatgacataatatcaaataaatagaaaaggtgagactttgaactcaggcaatgtcttagtagagctagctggaaaacctctcgacgtttttcaatgcataaacaatctgagactaggatttgttggaatggctaattttctactgtaaaaaacgagctaattctcctttgccgctgcaacttacctctcacttcatgacaaaccagcgacctaatatggaaatttttttaacactctgttttaaaaggatgatgtcctaaatgcatgcagtcaaatcttaaactcttagaacattcagagattaaaaaacattagtatttgatatggaaaaaatggtattaatatatttttcataaaaaacactatatgggaatatttttaacaagttttataaacatataactagaaaacgtaatgatgaatgaaacatatacattagagaaccatgtccatgtccatgtccaaaactaaaggtaaaaaagaatagaggggtatcattgcattctagtgacagttataatctttttttttctcatggataatttattgagcaatgaaaaacattagcagtttagcatccagttagtaatactttttttttcttattgttgtttgtcttttcctagcatgtttcttcagaacaaaaagatgctacttttcgcttaaaagaaggggacaaaagacca

SEQ ID NO: 72299 - DNA, 3920 bp, Oryza sativa
tggaaatagacttgagtagttaggtttgtacttgattcgtcctgattatatgattttgtaagagactactaagtacttccaaacatatggttacacaatctttaaatgcatcaaacaagatataaaggttcccaagacttctagcgggttctttattgggccccttttccctgatagggacaaatgggctttgagttaagcatgggttaatgttctacttcgtaagcaacataaccttgtcacaaatggttttattatgcttcatgtggtattgatgcattctttatgtagttaggtgcctggatgaagtgcaattgtaatttgtggattaacaaactaaggataatgttacgcaagtagtggcatttggacataatatttaaattgtaaatgaatgtagcacttaactgtcatgtaatatcttgttcttttattgctgtgtcgaggagcgatttgctcgctgaagttataagtgattctcaaattaataaattaatagctatctgacatggttctggagttttgcttcaaaggcttatgcctcaattttgttcctagatagttatattccagaatagcacactgcatatagaaagaaccaccattaacatctgttaccccctcagttttgcatggttaacttgaatgttttgatagtgctgatctctatagctctgttgaatgtttttgacttgcagttttccagaggatagaatgtaacatatagattttttttcagaatcctgtggtatctcattgttaaggaagttaattcttatgtaacaggtcacatgtttgatttccactttggtggcttgagagcatactctagttgtctgaatcaagttctctgaaagagagaccggagatgagagaggagggaggaattgcttctccggtacaatcattaaatctcttactttttctgtagactatttaaaatttgaaattatttgtaagtgcttgcggaaaatactctcattttttctgtgtctggcaaaaccagggcgaaaagcctattccgaatggtgcttccccaaatcatagccaatcacctaaaatttgctcaagaattacagataatgagactcaaggaactgcaacagcaaaatctttaaatgaaaagctagtgttggaaactgtgtcagatgattcttccacacagcattgtcagtcaccacagccagatgtcttcacaaatgtcaaagatgaagatatgcaagattctgtgaagagtttgagtgagaagcttgcttcagcccttttgactatcaatgctaaagatgacttggtgaagcagcatacaaaggttgcagaagaggctgttgcaggtaatctttcttttcactatgattttagacattttgcattattgtgatcccatgcatttattgagtctgtggcttcccttcattattcaaaattaattttatatgtgaggacatcaatagaactaagaaagaggaaactcattcaaatagttctttggcaaagttaaaatagtagtatcaaccaataattctgtttgtctgcacatgcgtgttagtgtgtgtggagtgagtgtgtcgtctgtctcctcagttgtaccttctcaagaaaatcatagttttatttattccaatatggaaccaaattcatattgaactttatttttgacttacttgtaggttgggaacaagctgaagctgaagttagtaccctgaagaggttactcgaagcttcaactcagaagaatgcctctttggatgatcaagtgaaccacctagatgatgctctcaaagaatgtgtcaggcagcttcgccaagctagggaagaacaagaggagaaaattcgtgatgcagttgctaagaagactcaagaattggattctcacaagtctgagctccagaaccatatttatgagctaaagcagcagctggaagccgctaaattagaagctgccactgtggctgtccagcatgatctgcaggataaacttcaggctgcagagaaggaaaacaagggcctgaagatcgagctgctcacgctagccaaggacttgaagagactgtcactggaaagagatctgagcaatgaagcagcagagacagcaagtaaacaacatttggaaagtgtgaaaaagattgcaagggttgaggcagaatgccgtaagctgcgccatctgacacgaagaacttccttggccaatgattctaggcctgcgcctaacaatgcttgcatggaatctctcactgatagccagtctgacagtggggagcgtatgctgactgttgacagtgaaatgagaaattctgattcatgggcctcggctctgatagccgaacttgatcagttcaagaacagtagtgccagctcaagagatgttgtaaacaatcatgttgagattgacctgatggatgatttccttgagatggaaaagctggctgcattgtctgaagtagaacgtgtaagctctagctttggaacagaaactgattctgaccaggctgtggctatagataaagcttcaaaagtcgaaactgaaacactaaagagccaggtcacagatttgcaggcaaaggttgaaaagcttgagactgagaaaagggatcttgaaatggcccttgcagaggctagagtccagcttgacgcgtcgtgtgatgccctgatggcagccaacaacaagttggcagaattacaaatgcagttcaacttggcaaatgagtctaaaattgctgctttgggacaagctgatcagttagatgctgagagaggatctttggcattgcagcttgagtcgaagtcaatagaagttgagaaacttcaggcagttgtggcttcgttggaagaaagtacagataagaaagagctggagtcacagttagagtcaacttctgtagagttagcggatctttgcaagacagtggcatccttgcaagagcagattgatgccgagagaactctgtctttgcagcacaaagcatatgcagacatggcagatgcagataaaaagtcactagaggcacaactgcagtccgcacatgcggatatcgggaaactgaggggatctattgaaacactggagagcgagttgcaaaaagagaaaaccatgtatgaagaacttgtggtccaaatggagtcaatgaagattgaatcagagaaaaaacttggcgtggaatctgccaaagaagcattggaggcacggctcctggtagtgaactcagaaattgcgaaactgcatggaacagtgaacgatctggagtgcgatgcagcaaaggagaaggcattttcttcggaactgaagatgcaactagaggcagtggaaggcatccgaaagatgttggagtctgagcttgagagttcacaccaggaaaccatgaagctccaggagaagatctcattgttggaagtaagacttaaggaccagactgcattgttggtagaattcactgccaaggccgaggatgcagcggtgggaaggaaggcaatggaaggccaacttgaaggagctaaactggaaatcacaaaacttacaaatagggtaagcttgctgcaaggtaagattgagcaggagaagctgctgtcagaggagtacgaagcaaaatgccgcaagttagaggctcagctgtcaagagacagtcgggaggcaaggctttggcgactggccaacacaaatggtgacctgaaggtcaagcaggtagtctttttatgctctctctgctgcatataaactggaaatttaaccacctcactgttataacactatagggcttaagagttgcaaacatcaggccaaaagtacaaggattctatctcctatggtccaatctacttgctagttgcttcgcttgaggttgtttggacatccaaatggccatttcttttgctaagtgtatgttataaaaattgctaaaatattgaacttgtaaactcttccaggg

SEQ ID NO: 72300 - DNA, 7002 bp, Oryza sativa
cgcgtggcgagctctccagccttggacctgggaaggggaagaagaggtgcctgaagtcctcgtctcgggtccccgcacgcaccggtttccctagtgcttcggcgacggacggtgagggcgactgtagggcaggggcggcaacaatggcgcggtggtggcgacgagggaaaacgaatgagggagatggggcgactgctgttttataggcgcggggtggggcatcgaggagaaggaactgacattggggcggtcaaggggagcgagctggcggtcgtgctcggagctagcggccaaacagcagtggaggtgcggtggctgaggttggaaaaagagaaaaagaagggggaaagaggagcttgaccatgccgtttcggggagggagagaagcgggagcgagagctctggctcctggttttggacgggtgcgggtggagcggcttgggcacgcgctgcagagctccatggaacgccatggataggtaggtaggtcaatcgatggacatacatatagttggatttgagaaaccgatagttagttcgagtaggttgatagagcgataggtagataggtcgatggatagatagatagatgggtagatggttagataggttagataagcggatagatcgatcgatggacagggaaggattcagggagggatttgacattctccgaatccggagaagtattggccaggaattcaaggaccggattgaattcccgtgtttgatttccgaagttgaatgggaattggaatcttcgggtggaggattttgatggcgatgagagggaataacaggatttcaattgagatgcagggcatgacttagactcgcactcaaagaaagaaaattttcgcaattaggattttctcaaactagtttttaacgtctcacgaaaagcggagcgttacactctctctcccccactcacttttctctcccacctctcccctcctctcccatttttccactcctcacatcccgacggtgggctcgagttggcgacgacgggagcgggagagcagtggtgggctcgtgcgggcgcggcagatcctgtgggagcgcgacggcgggtgcagcgacggcaacggcgaatccggcggtatggagggcgacgacggctgccttggcaaggtcgggggatggcgatgccaatgaggagaggcggtaaatgggattgttggaattttttttcacgatttttattttcgtgtgcggactacataagcaccggcacacaaaaatccgattttcccgtgtgggtgcgtcacccacatggaaaaatgggttttgaccgcatgcaaaaatgttttttttatgtagtgttcctaaatacttcttcatgtgattttgaggatagattgctacctaatgatttaattatgataagaaactatggagaatactagcgagagagaggttaggagatggataaggtcacacaggcgttcaagtcaagttggagacccaactcatatcaagttcgagtctacctcggctccaagagtagtctgtgctaaaaacatcgcctaggtcatgttcggactccattttagacgttctacctatgtatggaaaactaacaagaccacctttccgatgggtttggtcttccttcgaagtcattggggatcgtcaaaacaagtggtgtccagaatctgtccgagtgctgtgtcaccatctttttgtaccgttgggccatgtatcgtgttggagtccaacagggacgcatccaggggtttttgatcgaccgtagaacctatatattcagtagttgttgtcgagttagggttgggttttgcttagattatttttgcaattgcagtttcaccgttcatcggtttgtgaaaccccgacatcaagttcttaatcaatcctctacatttgtgttgcaatattcttattcttgcttgtgtcttcgattcgcacgcaaggatagccttctcggcgaggtcaatcgggtttggcatggttaataaccagaggagacgtggtgctgctattacatggttcatattatgttaatcgaaagtcggatcgtgtgtgccaagattttgccaattcgatagatctctacttgacggaagattgggcaccccattatcattataaacttttcccaaattactttttgaacaaaggatagaaacaccattgaatctatgaaattcctttacaatattttttgctgatccatgtggaaattttggaggaaagtcacgacgccgcccggttcaacctcctgaaaaatgttttcctttgactttattaatttcttgattcctgcatctatctgcggtctatgtatcatgtatttttcttgtattttgtacttctttgtttttttcttattcatatattttatccctgtgttcgacatgggcaattcttgataaaaaaaatgcatatgaattttctttgaagcaattctacagaggactttgaaagcctcatgctagatcaattcctcaagaacattgtggagaaatgttattcctatgctatgaattttatttaaaatggttgtctatatccacgtagatgcatgtagaaactggtgggtttttaatccaagcagttttaatccacgagttttcttccaagcagttatacaaattaaattactcgcatataagaattatttttcattgtattcccctagtctttctcacaagccacaaaatgcttcaacccaaaattgggtgatccgatcccctctaaatcgacatgggctgtttgcatgttgatccatcatgaataatcacattctaaaccattcgcggttataaacaaccctacttcgtttttgaaaacaacacatccaaattaatcgaaaaaaaaatccaatcatacaataatgtgtttttcctataccccatttatgacacaggcgagttgaaagtagaacccgcctgtgtaaacattggccaagggatggaccaatgggccacctgtgaagaactaacttagaacacacaaacacatagatctacaacaaattatgaattatatcgagcaaaacctctgccccttagttggtcgagcaaaacaaagcccctctctattcttcccaattgagctggggtgtgagagggaacgtgcatatatattatggacctagttttcccgattgagctgttggttatgtaatagatccaacacctgtaagctcataaatatagccgtgccagggctacttcataccggttcataactaatattggcatatataagtcgtgcaagactattcaaggcccttatatatgtggaagaggttatggaatcgaatccctcacatgtatgtgatctgtgatttttttttctttcctcgcttgcatgaaacttaaagcaaatctaatagtttaaaattacgtgaaagttatatataaattacaatgtaattgtattataattgtactatatttacatctattaagtttttaagaggaaatttgtagataaatatgtaacaaaatgttacaccgttattagctcatgggcaccaaaaaaatcttgtggttatgtcatccgcagaaggctccatcgtcgtgtgtctttgatgtttgtaccaatcaattaaactagatgattcccgcgtgtgtttttctacgagatatataaataaatatatgttaaatgttgtataatcatgaatagaatggagtgaaatattttaaaaatgatttgaagataataattactatgatgtggtatgtttgcatgctagcttttagaattaataataaatactatgcttacctattgaattttagatgtttagtgggtcgtaactttatagaacgtagaacatatagataaccggtatcctaattaagttcaagttcaacatgtcatcaagagtatatatatattcattaaggtacgtggaattatacttcctccatttctgaatagataatgttgttaacttttagacgtatatttgactattcatcttatctaaaaaatttattgtatccatctcatagaaaacaaacttagtactagaaagcgtcgatatagtctatactagttatttatgggagtgtgagctagtatgtaattataatttattttgttgtgagctttttatcgctaaaagcactttacacatgatttatttcttagatatttgcgaatggttaaatgtgtatgaaaagtttacatagtcagctattgaaaacggaggaattatgggcttgtttagatcattgatagaatttttcaccctgtcacatcgaatgtttggatgtatgtatggagtattaaatataaaaaaactaattacacagattacgtgtaaattgcgagacggatcttttaagcctaattgctccatgatttgataatgtggtgctatagtaaacattttctaataacagactaattaggcttaataaattcgtttcgctgtttataagaggaatctgtaatttatcctgttattagtctatatttaatacttcaaatatgtgtctgtatactcgatgcgacacgccaaaactttacaccacttactccctcggtaagaaaaaactcaaacctatgactgattatgtcatatcacattcctaggttaatttttttttaacgaagtgagtatgtttttacgctgacttctaaaaagtgagacgcctgcgtacggcctgacggtagtacaagtactcgatagaaccgtcgatcgtaaattattgaagagtgaagaaaaaccccgtgcactgcaattaattgtcgtgcatccctccctgccattgcacgttgccacagcagatggtccggtcggtccacctcccctccattggtgaatgacaagggcacgttggtgggtgaagtgaactgagtttatcgtaattatttgagggcctaaaaagaataataaaatttcacttgaaaattaatgattttgatttaagaaaagttttaaaaggaaattctaatgaacaaacttttttttaaaaaagtatattatttagaagcttaaaaatggtgactccgataatacgctagctagctattcccttaaaaaatgccctattatttgatgttcaacttgaagcatgcaagatatgcgggccgggcccaccaaggcgtgctaggaagaaaaagcatacaggtctggttccactgcagtaatgcagaagttcactaatagtgaacctttacattactgaggggatctggattttaagcgcactttattacattagataatatactcctccgtttcattttaaacgtagctattagttttcatgtccaaatttcatcgtctattttatttaaaattcttttatgattattattgttgttgttattagatgataaaatatgaatatatatttttttaaaaaaaaattaataagacagacgattaaaattggacacgaaaacttattgttgtgtttaaaatagggcggagggagtatatcgcaaaccgatctatcgtcggcggaaccagaatcagccgtacagataagtggcgctggtcctggtgacacgtaaacgaatatcgtggagaggcacatccatgggccatgccacgtaccgtcccgtacatgcatgtgcacctctggcgacattgtgggcacctcctggctcagaaacggaacatgctatactcgatcgatgacagttaataacgtgtggggggaagaaacgtgttacctctaattttaaatagtgaatttttactctctaaacctgttcatctatgttacccatgtttctaaactcttaaaatatatttagagtaatttttgttgaaacccttattttcataatcaattatgactttaccttttttttccttctatatagccatatttacttttagaggcaattgtgtctctgcccttgctttacatctcaattgtgattttacccatactttttagggtttgtgattttgcccatgctttttttaaacagggtagctgcctgcccctactctgttaactgatggtaacggtattaaatgtgtggtgaatggacgagtatacccctgacatgttttggcttgcacaggatacatgtttcaagttaattttgagcaaatttcatatgggaaataaatgttcacaaattttgtaaaagttgatagaacacaatattttggataattttgatagaactttcgcaataatttgaacacagtttataaacgatgtcagaacaatatttttgacaaaattttgacagaaattcatcaataatttggacacaaattatagaagataacagcacactatcaaggacaaaatttcagcaataatttctgctcgctgcttgctagctcgctgcaagcacacttcctgctcgttgcttgctagctcgctggctgcggggccaccggccgtggcgtctccctgcgcgtgcaacaccgcggggccgcgccgacacgccgacagagccgcgccgctcctttccgacgctcctcagtcgcggggccgccggccgccgcgcctccctgcgcttgcaatccgcggggccgccgtgccgacggaaccgccgctccgcagggccgccgcgccgccgcgtcgacggagccgctgctcctcggggccaccgcgccgcgcctgcccacgcccgactccaccgcgcgctggcccgagccgccgctcctccctgccgcgcgccgccgccgcttgcaacccaacaagctaggtttttcgattggatcggggacagcaaggtttggggatttggttgtttcattgaagcaagggtagaatagtcattcacaaattataatagcattttctttgggtgtagctatatttatggggccatatttttcatgaaaaaatagtcggcatgtatttacattgtaagtccctaaattacatatgtaattttagtgtatttataatgtaagtctaagtactaaaattacatatgtaaattcgaaaattacatatgtaaattcgaaaattacatactaattacatatgtaagtggggtgtaaatgaggtgtaactactgtgtaagtggctgaaaaaa

SEQ ID NO: 72301 - DNA, 7489 bp, Oryza sativa
cagtttttatatatcgtatcaaccgccaccgctctactcctttataggcctgttacttgaattatctcatcatgtgttttaaggtgatcttttctttcaatagtatttattttttttcacgaattttagttatttataaattgtattcctaattgaaatatttcctattttttttcaaatttcagaatttatttttttcagattttaattaataccatatagtgttcttttaatattttttttaattttagttgtttcaaaattgtattcctacttaaactctcttttagtttttctaattttggatattattttatttttattttgaatattaatcaatctcgtattgggttcttatatagattcttctttcaatattgcttatattaaatttcgaattttaattaattttaaattgtatttctacttgaactcttcttttaattttgctaatttcggattttatttttatttttattccgaatattaattaatctcgtattgggttcttatatggacccttctctcaatattccttatttttaattcatattgaaatttatataaatattcatattgtattttatgtacgtgttagttattaattatttttaatatcaacttttagttatttctaaattatattcctatatggactctagactcgtctttcaatattttttttaaattccatatttccgttatctgtaaattgtatttctatatagactctaggctcttattgcaatattatttatttttaattctgaatttttattatttctaattgtatttctatgtggactctaaactcgtctttcaatattctttaatttttaatttcgaatttcagttacttctaaattgtattcctatattgattttagactcttcttcccatgttttttttaatttcgaattttagttatttgtaaattgtatttttatacaaactctaaactctacttttaattttattatgtttattccgaattttagttagttttaaaacttttattatgtttatttcgaattttagttagttttaaattcctatatggattctatactctacttctaatattccttatttttaattccgattttcagttatttctaaattatatttctatatagactctgtttttttttctccgattaatatgagaatttctagaccgtgggagcgaacatggagacttttttttatttctttaataagttaatagattaggtgcacgaaccgattgccgcatgagatttttgaggttgtgtgcgagctgacaactctgttctgtcatgtaagcgcgttgctcgagtggaccaaacccaccacacattctcaaacccgttagccagagatcaaaatctaacataccctgcatcttaaaatggtttttgttaaaatatacaaggagaaattgaagaattgcggtattatttcagtacagcacgtaaatagtaagaccccttcccactttatatgttgtgcgcaatccgactgggctgggccggagataaatgtgcaattgatggctgatttggcccaaggatagcattatcaacaggaataagttcatatgagatctcttaacttgttagcgaatccgattttcgtccttcaaccggaaaaccggatacaacaattcctcagctgtcaaaaccggtgcaaaataagtccaaggaggtttggatggcgattacagttgatgtagctgctatgtggttaattttactcggtcatcctctaacgtggcattgacatgacgcttacgtggcaatttgatttggaaaataataaaaaccctgggcccacatgtcagtacccaaggggggtgggcgaagcatgcaggggcagcaggcgagagcggcggtggtagacgagagtggtggcggcgaacgagagcggcggcagcagctgctggcgccccgtcgccacccaactccggtgacgcctgccccctgctccgcttcgtgaggagatccacattgacctgctccgcttcccggggcggcgcgaacactacacgagcgtcggccgcgcgtgcccaccattttgcgcgtcatcccctccgcctctcgccgccagcgatgtcatcgtgccagccacctctcttccctctcccacgacaacgacgacatggggccagataaatggaggagcgcgaccggcatcctctcccccctctcccacgacgaccacggtgacatcgacgagaaggcgctggggcagcagggggatgacaccgatgagcaccctgatcccggtgctgccttgtcgccccgccacccctgcctgcttcgcctgccacacgctcgctcgtcgtgctcgcccgctgcccctgcttgcttcgcccgtcgtgcgcttgcccgccgccgccgccatatacatgtgggccccgcatactttattttttttttatttttctgactgggatgccacgtcagcgaaatcaggtgtctatactcttatagacctaaattggacgcttttatacagtctagggatgaagatttttgatattgaggataagggatgtaaaaaaaaaaactcggtgtaaagttgagggacggacttattccccgtaaaatatgaacatgttaggctcgatttaatctcagcccagcccatgtaagttttacagattggccgtctgatttgacgtgattttcgatgcaggcatcatcggcgggcggtggctcaagtactggacggaggccggcgcggtgctctcctccgtcgggttgttcgaagcgcagctgagcagcggcgcgttccagctcctcggcatggcggagctgggcctcctcccctccgtcttcgcccgccgcggccccggacgatccgccaccccgtgggtcgccgtcgccgcctccgccgccgtctcggtcgccgtctccttcctcggcttcgacgacgtcgtcgccaccgccaacctgctctacagcctcggcgcgctgctcgagttcgccgccttcctccggctccgcgcgagggaggagagcccctcctcgctcaagcgcccctaccgcgtcccgctgccgctccccgcgctcgccgccatgtgcctcgtgccgtcggcgttcctggcgtacgtggtcgccgtcgccgggtggagggtctccgccgtcgccgccgcgctcacggccctcggcgtcggctggcacggcgccatgagggtgtgcaggtccaggaagtggctcaggttcaacaccgcggttgccgccgaccatcgtctgcaactacaagatgctcctcctcctcctgctggtagagtctgaactctgaacccgttttggcagatttcgtcttgcgaaaagatgaaacacggtaagaaactcgaaatatttgctagtagaagactaattacaagctatactagtacaagactaattacatggttggatgaagctctaaagttggcgttttcatatttgttcctctaattaatcaccgtgtacgattgtggttcattatcagagacgcggtttaaattgaacggtctgtctctctcaaatctgaaatggtcacatttgtagtgaagtggacatccatgaaatggcgacaaggaggcggacatgatcatattcatatccacgtactaacccagctcctcttttgtggcacacgcggctccacactacaaacctccgttccgcgccacaaactgcaaccaccacacatgctccatcgcccgtagtcatcctacaaaccaatagacaccgcgcgcgcggaacgccatcgctgccacatctcatggacgacgtgtggccgtggctggccggcctggccggcgaggagccgccgccgccgcaggccgttgtcgcccttgccgccttcgctgacggcaccacgtccattgtcctgcaggccgaccacgtcgcattggctgaaggtgatgaggaagagaagactctagtagatttctctctcgccttgaacagcaccaatggcggcgcagcgcgcgtgctgtggacgtcgggtcgatttgaggccgcctccggtgtcgcgttgcagcggcagctgctggcgaggctgctcgacgaggtgatcacgctctcgccgtccgtctcttgcttgagcggaaacctcggactcggagtcggcggcgcaccgaagtcgaagttggacgaggagatcgtcgccggcatcgggaatgattctgccgcctcattcttctcgctgactctccttctgcgcctcttctggctgtgcgccaccgaggcacccgccgacaccgggtttctcttcttccaagctctcggcgccgacatccagcgcgctctcgtggactgccgcccagcgctcgccctgttcctggcctccctcggcccggacgtcgaggagcggttcatgcggtcgctcggctacacgctcgccaagctgtgcttgctacgggagatgcaagcggatgcggatcagccggcgccggcggcgacacggcgcccgcgcgcgctccccgcggtgtgcctgtcgtacgccaccgaggtgcacgggctgtgggttctgagaggatacgcgccggtgctcgccatgccccgtgtcacctgcgcggcatcgacgacggcgcccatcacggcgctgccgcacgaggcgccggaggagccggcgctgaggtacggcctggtgcaccagcagctggaggtcgtggcgcagctggagtacgccgtgcgcgctcgccgcggcgagaggttcatgaccgtcgccgtgcgcgtcgacaacgtccgggtacgcgtcgcgcggctcgggttccggagggacgacgcggacgctgacgccgacggtggcgacgctcacgacgacgccatggacggcgagcgccatttcccgtcccgtctccgcctctgggtcggccctaggttcggcgcgtcgtacgcgaccggcccgagcctcggccggtcgacggggaacccggagcaggacgtcgagacgacgcgcaccgtcaagggcgccttcgccgccgccggcgccacgaagctagccaacggcggcgtccctccgaggatcaaggccaagacgcggtcgtcggcccgggcacgcaaccggagctggcggtgggagcaggaggcggagggcagcgccggcgtgttcgagggcgtgctgtgcgacccggccaccggcacggagatctcggcgtggcgcggcgacaacaacaacaacaatggcggcgccggtgacccgcgcaacgggatgcggcggcggtacggcgggccgggcagggcgttcagcaagatgcgggggctggtggtggccggcgacgagctgcccgaggaggtgacgtggagggtggggagggaggcggaggggagaacgctgccgtggcgcgtggggctcaaggcctggttgacctaccttcccaaccaggtgaggagccaccatttcgagacgaggtgcgtcgagtgggcacacgaggtcgacctcccgcttgccgccgttaatggcgacgagaggtaaaaaaaaaaaaagaaaatctctctttatatcacctatgaacacatactagccaaaagaaatgaaatgatcttatgcacgtattgtgtatatgaaatgaacagctaaaataagaggttaagaatctaaattcagatgctgtccatttgcaccgatttttctttttttttcttttttttttcgcagggcatttgcaccgactttaagatagatcatcttaatacctgatcggagaccaaatcgtaatggatgcaaaactatttctataagggcacaactattataccgccgtaatggtataaccccccatttcaaatgctcatgcgtccactcactctcccactccatgcgagcacgcaactcccgacacgtgagcgcctgacacacgccatatgcatccattatgtgtcaagccatcttgatatgtatttatcgggctgaacctactagtcaagtttggttggttctagagaccaaagggtgggaggtttcgactccattcggctgggctagttcggttgttccatctagctcttttctcattatcaagttctcaccacacatatattcatagtcttgaccagtacatgtctatgatacttaattgatgcttaaaagtatcatcacatatataccttccaaatggtactcgtgtcgagcgatactagtcggcatcagacatcatcccctgatacatatcgataccaagactatactaatcagcactaggtccgataacgtttagtaccactctttgtaccctctattggtaccaggccggtattaggggcctgtttggtagagctctaactcctaaatttatctccaggagttgggtctaaagtggagttgtagagctacctaaacctaactccatctctctagttcattttgtgagagacctccacccaagcccactcccattttaggtggagctgaaactgtttggctgagctccagctccagaagaggtggagctggagttggagctgtgacaaacaggccctaggtctaatacccatcgatgctacacatggtactcctgatacccatcggtactaagctaataccgatcggtactaggtagagtatattggtcagtacaaacttgttacccttattagtaccatgtcgatatcgggtctgatactcgtcgataccagagttactactcctgatacccgtcggtacctatgtgataccaattggacccagtctaataccaatcaatacaagacttagtagccctgatacccggtgatatcagactaatacatgtacgtataaggtttgatacatatgtactagcctaatatttgtacgatattaggtcctatatcttaggacaaagatatgaacctgggatcggaaataatatgtatataccaattgaaaaaaaagaagaaatgaactctatatagcaaaagaagtgaagaaaaatgttcacttttacacttgacaccacttaagaaaagagtatataaattaaaaagtactagctataataagttggcaagaaggtcactaagctcagtcttatcgcatgattagggtaatggttttattttttccgacatctttctcttttcttctcattttgttttgccgccccaacatctgcagtgaacagttagacagccatagagtaggctgatcgatagttgcacgttctgacacatgtcatctgtaccgaaccacgtgcaaagttactaaccatatatagacttgtgtacccacgaagtctgtatgcaagaaggaatataattccataagctcatgtagtttcttacattaaacttttacagtcagtctaaaagcaagtttaataatattgtcaactaatatctttaaaagttaacacatatcatctacagccaacctaatagtatgttcactcatcaatagttagttgcaggcccggccacaggagaggagggggagggggttgagctatgccaccgcacagggcccacaaagtgaaggggcccaaccccatatatgctgtatataatagcccatagaaattaggaagcctat

SEQ ID NO: 72302 - DNA, 633 bp, Oryza sativa
acatcattttttttatctcgtttaataattttattgcctttgaattacatactgtcttaggacatccacaatagcacaatgtacactaaaaagtaaccataagcaataaatgctgctatagtacaacacatttaacattgtggagtcagaccacaagtcatgcaataaaactagactttaagcttaaggtgtggccacaaagctacaaaatataatacttgtaatgtttttctgttcacaccaataaaatatacatgtcagttactacagatagtaactacttctactagccgttggtgctctttcatttgagttgctcatttgctttcctagccattggcttcttacaacattcttgtgctacctacgaaaggaggcacaagtgagatgaacaacatattgatccattcagttccctagatactaagtggagccttttgttaagccaaacaagtaagcaacaaatagtgatgtccaaaactccccattctacccaatttcccacaagttatccctaaaacttgagacctagttttctccaaaatttccatccttttggtcctctaagcaactaccaactatatggacacccttccatcttttaaggtgctcaccaacaagattattatgcgc

SEQ ID NO: 72303 - DNA, 672 bp, Oryza sativa
gccattactcaaaaaagcatactggatgggttgcgaataaggcatagggtataacaaatatatatataagtcttcaagtctattgataaatattatataaagctcacttggtgttaaacaaaatgtatatgtaattcattggaaattgttccttttatcttttggtacagctaaaccagcaaaggcaaggtgataaacttgaaaactatcccctggttcagttgaaaatgttagagcacgcagttacacacttacactagatgggcttgagtcattcaatataaaaaaaaaggaaaatgccaaacgggacaaagaaattcaggacaacacgattctttgaagaagctcccaatttccagaagaatttaattccaagcatcgacttttgacagaggagtgaagcaggaagtgaagtactaaaagattggcgttgcgcgaatagcaatgcagtggtcagtgtcgacctacaccatcctatgatcctatcctagcatcttcttaatgttagcaacaataagaagaaaatgaaacaatcctctatagattttacaatccatatagtatcttctaacaacgcggataaccaccctgcatcattaacgatgttacgatgcgataaaaagaagacacacaggacgcgtgtcgattaataaaagagagttgatatctctt

SEQ ID NO: 72304 - DNA, 536 bp, Oryza sativa
aattcgagctcggtaccccctgaaaaagctgcacatgtcttttttattgtcttttgcacaattagttggtttcacttgtagggatgctaatgcctggaatgctatttcagtgtgatttaaacattattttacaaaggttgtgggtaaaacaagcgtttgtatgctattagttgctacagttcttaaaaaaaatacattccactcctttgaccttaatcttccgcatgctttcttatttgcttcagtgaacctaacggccctcttgaaatgtgaagtctggttgtgttggcaactctgactaactagcttattaatcagcaactattcttttttaatgttcataaatatatttgttccatctccccaactattcttttctgatgtatctctctacttctgcagtgctgtcatgcttagaaattcaacaacccgaatctctgtccaggaccagccagagtacacaaacgacaaattgatacagatccatgtcttacaaaaatattaaaataaacttacaaatgcagcagaaaataaaa

SEQ ID NO: 72305 - DNA, 11709 bp, Oryza sativa
  unsure (1)..(11709): unsure at all n locations
gtgcatcttgaccttttgcttctgcattaaagtcgcggaaacaaagcatactgaaattcttgatatttagccaatctgaaattctgatttctttcgctttcatgtgccgttgaaaacttacaataactagcgaagacaccttgcgccattgagaatctagtaatgtgtcattttttttgataattggaaggactgtactacaatatctatttgctacgagtattaaagtgtagatagtagctaaattatcgaatcaccacataatgagttgctaatgctgtgtttgaggagaatgagatagacgagattggaaatatacgcaaaatgaggtgagccattaacgcatgattaattgaatattaattattttaaattttaaaaatagtttaatatgattttttaaagcaactttcttatacaatttttttttaaaaaaaacatactcgggaagcgtgcgcgcggaaaacgaaacacacaaactcacaatgttacgctgctgaacgcagcctaagggtccgaagttagtttgatcgagttagtgcattcacataaccgattaagacacctttggacccctcacacctcgtattctgtcactttttgataacctaaggtcgtgctcgatgatgaacagtatgtcacttttagatgtatcaatcaactatttatcactggacccacatgtcatagacacatgtgaacccacgtatcattgagatagatgtgacaaatagttaattgccaaatctaaatgtggcaaatagttaaaagcgggggcgggttcattttccttccttcttcccctgagactgataggtggggcccacatctgtcctctaattctctccacccttctcgtttcggaacgccgccgccgccgccgtccaccgccgcaaccagcccccaccaactccggccgttcccggcgcgtcctcccgaacgcctcagcccccacccgccagcaggtggaggcctgcgccggcgcgtcgaccccggctctctctctatctctgtctcacctagtcgaggcgtggagaatcgaacatggagtccgagggggggaagacggagatggtgctcgcggggacgtttccttcaagaaaggcagatcgccgacaagtaccccagggccagtcccgcggccgcagtggaagcacctncggcttctncttcaggccgncgacgccaccttccttccccccgaccgccccactgtaagcgcctccgatccaaaccaatcttccccccctcccccctccccgctcaattaatctgccgatttcttcattgggatcagtttaatggtgtggatttatctaccttgttggttgttgggcgcttgtgattgtactactcatcgaggatttgtgtggattcacttctataggtcaacgagcccttgttggcattgggagatttatctggttagggattgagaattcgatgctatgcattattcatgttaggcccttgtccagccaacggttgctattgtgattgcgcattagattgttcttatgttctgttgcaattttacaatgttactatgtgaataacttaatatggtttagatttggtggtaatctaatagatttttgaggctacggaagctacatgttcatatgccttgtcttgttgcgaaccgtccatctaccgtgaaaacgcaaaccaattggatagggttatcatcatttgtttactctcccaaataatctggataagcaatctgagtccgtgcaaacaacttggttctggaagcggattcttaataatcaaacgatgtttttctactgaagtccaaaagcaggtacggagctgcttttgtggattttaagcggtaatgttataacataagagtattaacatagatggtgcatttcattgtatcaaaagccaaatccacaatcagcttttaagaatcccccttgtgaaaataacattccagaagcaggattgtgagaatcaaaagcaaaataaacaggccccgacaatggtacaataaggatttttttcatacaaatattatgagagatttctagtttcagtacaaacatttctaaaatatttaatctaataagtcagcctaaaggtaaatgctcacctctacctcattagtgttaaacttttaattagtctgttaggatgagatgagcactaatgatatgggtgtctgatggcagcatgatcagcaagtgatgtgtatagaaattacaacaatattcagaaataagttatgttttacaacaatatgttcatcttaatatttttaataaatatagtactagtacatatgttgtgcatactggcattagataaacataggaacaggaacataatatttccaaaatgattaatgagtcattaagcaaagtggatcatttgtacatatcatataatcatgtattgctgtgttgttcaccatgtctaagcagatgacagaatttgtatctttgatcatatgattctggcttttggtattttgatggttgatattgatactagtattgtttatgataagggatatcatgaggtactatttttttttctggttgtgtatgagtcagcattgataggcaagtgaactaagaatcaaatttattctatgagatcataagatgtatttgtttcacttcttaacatcatgaggtatttattcttacatctcctgaaggagaagcgtgggctgtgaatgtgtcgtgatatgttgggttgtcacttgttacataaatgtagtaattaactttgattcagtttgatgcaataccatgctatgagaaatattaggatccgttgtcctacttatcattcttgcttttttataagcttttttttaataagcaagataattgggtaccatttcattaagaggagagaatggaaagggagcagtggccaccaacccggtccaaaacaggccagagtctttacaacacacgcaaaaacctcacctccgaggggctatcgacctctcacggaactcctttagtctagaagccccggctagcgaccacatgatacacttattggccactgtttggaggacagcagttacacaagggttaacaccattaagcacattgtcatttctatgcttcccaatctcccacagtaccaaaatgatgagagctaagtccgttcttggtgtctttgtcccttcctctcatcacccttgaccaccaccttgataaattggttgtatctggacctggggctatatgggccagccccatcctttggaggattataaaccaaacttgccgtggacacctcttatcttaattatttgaatggccattaatgttataaatcacaaggcatggctgaaaattgatgttaagttaattatgccacatattatcacttttccatactgaggctattgcatttgtctttattcttacattatggtgttttgtgcagatttgaatatccagtcgcccccatcaatttatccacccaagagatattgtgacataactggttttgaggttagttactttgctgtgagttcgtcttgttggatttgcatgttttcttgttattttgaatgttcattttatgctacttactactgagtttaaattgatctaaatatcttctgagctagatgggctatacaatatctcgcggtttagtaatattatcaaagtcgacattctttgagttggatctcaaatgctcaaattaaaatcccgtatatgattagcatcagatcaataatccacagaaaatgttatcacaatagacaagctacatgtctggagaattcaatcctctgtaaaggattacgaacacatgcatgtatacagcaacaaaagattccagcaattaaatcttttggaattgttaggaaaaaaaaacatgtggtagtgatagtacaccattgtcattaactcactctataggcgaagatatccaattaaattctatataataactcaaccttttgtccatgctatcatcggatccttattttccaccctctgaactttgaaatcctcaacctttacatctctctgttctaaaactgcctcagcatataccgtagtggtatttgcttgacgacagtcatcagtagattggatatcttccatgcctacttttccttcttattgttgtcaaatatcaaatctcttcctctgtctgtttaaaaaaaatacattctcaatgtgacctaggctaaactcaagtgcatagcttcatggcctctgagctccaccacaggtgcaattttccctagtatgtcatcatgccttctacatctctcctagtcagcaatccatgccacctcccaaatcctcttttgctcctgcaaacacaatacatttcttgattcatttgatagagttgtgtagtattcgtgttagctaaatgaggagctggcccttagactgatcctacatgcagctcatactgcaaagctgccatctcaaattccttccctgttgtgaacgcctcatggacataaatgagctttatttccccacctgtaatcatggtggtgcatatgagggtggaggatcgttgcttacattaccactgaatcatgtgtcgctaacatgtccaacatgagatagtatctcaaattctcaattctactgcagacaagttactgagcatgaaattgaggctgcctgagaggtactgagagcgcgagggagtgaatatggaattgctgttgttttcagttatcttgtttaaattgttactagttacctggctaaatcagcaatagaagatgacatttggagccttcttgttgccacataggccaaaactgtagtggattgggcttttaggtgtttcagtgcataagtattgttagtcgaacttagaagtccaattttggtcctaaatagcacttagttactactccctctctttcatattataagttattttgactttttcttagttaagcttctttaagtttgatcaagtttttagataaacatagtagcattttcaacacaaaataaatctattatcaaaatatattcattgttaatttggtgttttatatattgttaaatttttctataaacttagtcaaacaaaaaagtttgactaagaaaaaagtcaaagggacttataatatgaaatggagggagtattaggtgtccaatttctctacttagagagcatttaagttactgttttggccaggatacttcactgacattgaaaaatgttagagcatatgtgactgacatgacgtttcaccaagaatttcctgttctatcttgttagtaatggtttgtcttggacatcaacttatctgtaatccactagaagctttatttgcgcccaacaacgctttaatgctcacacctaatactccgctaatggggagcacaaaataaactgagacaaacattgataatatcacttggtcttgcattctctatttgctcttcgactgcaatggtgttttgtgtgcctatttcttgtgttgtgtggataataattgtatattttcttgcaggcaccatatgtggatccaaggacaaagctgcgctatgctgatccagaagtgttcaagcaaatccgaatgcttcctgatgaatatgtccaaaggtatctggcactgagaaatgctgccgttgtactgagataactatgcaaaatctatgtagaagagaaatggggatttgtgctcttgagtctgttggcaaatacatctctagatctagtgtgaatgtatatctacttgtatgcttgtttcttagcaaattgtaagagatgacttttcctccgtagtgatagctgacatcatggctggggacgttcagttcgtgctttatcgacgttcatgaattactggtaatctgttctcgtgcaccatagccgaaattactttctggattgccctgatctttatcaaggaatgcaatgacggatgaatgtgcatgcttcttgaccttataaacggtgcgcaaaaaaactttcgatatatcaatttattagagaaccgatttaaatccaaatttgagctttataatatattttcaaccacaaaaacaaatgcagttgcttgtatacacgcgtgcacacaatatctatacgagcatcttcaaaaaattgagctgacatgtttttaaattgactgttgttacgggtgtcttgctatcatcgactgttggtcattgacaaaatattagccgtaaatgtgagcaccgtgctaagcttaggacttatttaattaatttatttgtaccattatataatcgtcacaaataattcagctattcacccatttaacatgagaacgaagccaagcatacggacgggtctcatcttttcgattatacttatgcttatcaacaaaaatttgaattttgaaccttaaatttagagttgattttggtgttttttcatcgtagtttatttttcagcttttgtttttagatcgtttagaacacgtatataaaagttttattcacaaattattttttatttataaatataccgttaggcttattccaccaaacagccaaacgatgggcatcacaagatcatgatttgatgtacctaaatcctggtccattcatttgtgtggaattgaaattaaatcctgggttatacccacatggatgcattgatcaacttggatttgggttcatacaaatgatgtcttatctctgaatctctgatatcattgaagttaccgataattcatgtaattttcacaaagagcaattgatgggcataaagtgcctgagattttcttaattgcatgcaacatcatatttttccttcaagcaaaaaaaaaaaagaaaaaagaaaagaacagccaaaacagctctgcaaatgctgttcctataactgatgactgaacaaagtccgtacctatagttaccatggaatgggggcccacatgtcaatatcatagttttcttttctaaatgtcaactaaaagaaagattcgatgatattccatacctcaacgggtcccacctgtaagtttttgttttcctttttctgttaaaaatctcccccagagtcctctttcatacatactccgatttcgtccatcttctttctaaatccatttaaaatgaagtcggtaagcactaagcactgtagtatctagtattaggttggacacctgggctcactttggtcggttctttggtttttgtagattgtgtgtagctgtgtatgactgaccatgtctgtcagtagcacgagcagtacatgcgtgtgaaagacttttctagagctgactttctttcatttgttcttattaaatctaataatgttcatggtcaattcgaaagacagttactattattatcattacttttgctgttatgtgcagaacaggttgagatgaacgtattgaaaagctgcatggctgacataccaaatgattaattatgtgctttcttttgtttctagccccttttttcttgaaaactcgtcttttgcatcaagaaaccaagaaacctcgttctactgtaatagactttgtgcaacatgtgaacaagcaacagtgacatttattgtttattttttaacaggcccccgaatcccaatcaaatctccccttatccaaacatgtccacactgatgagtatattctaataaaaaggtagcaaggcaagaaaacgtgtaaaaaaaattcaaacaacctaagaaacaaggtcatctggtaaagtcaaaatccatcagagatcatacatgcactttatcttgaggaacatacggcaattgggacagtataccaactcaactgcttgagcaaagttttaccaattccgaagttactgatgatgtcaagtttaacgcctaccatgtttgtctatttaagtacctccagcgatcctctagtgttacattaaatgtacacctgtaccttcctgagaaggtctgaggtgttggttgctgcctggctgggtttatggtgagaaatctctctgtacttttacctgatattgatccctgtgatgtttttggtgatacattgatctatgctgtgtgatcgtggattcagatatattatcttgttttcatgatgaatgtttagttattgtttcttctttgtattgagtgttctgttctatttagtttattttgccagtaatctttgtttagacttattccttgactttaagccaatatctttttaaacttaagtaccctcccttcttattttgttaacttccatttattttttaaaaaaatcttgtgttgaaccagtggactaggtgatggacgggtcacacaacttactgtccaaacaaaattgtcctcagtttaatggttaacgaatgcttttgctaccttaagaacaacataaatcagtcactgaaaatttgtttttttgatggaggtctctgcaaatttcagtttcactatgtttttttgtttcttcttaacggctctcagctttcaatggttttatatttgtacctttcgttcccagctagcatgcaaagtttcacgtgggagcaagcaactaatgggctccaaagaagcattccgacgtatcatattctgcgtcttgcttctactctgtgtgagctgcaaatgcttaacctcagaggtaaacacaacccaactggcagtcctcaaggttgatgcctcaccgcagcatgctcgaaagatccctgagacactctttgggatatttttcgaggtactttagtttccttcccttgaaaaaatatcccagttcttaacttgttaagacttatcaagttttaaatacgaacgtttacatattcttactgattactttggtaaaatactgtaggagatcaaccatgctggagcaggtggaatatgggcagagcttgtcagcaacagaggtacttctactggcctgccattaatctcatctctagattgtgctgtgtgcctcttgaaataatttttgtcaagttattagatagtagagagagtttactacgtggtgtttggtattttggttgggtgaacttgctatggaatgcaactacatctataacaattactgacatttcaatggctctcttacaaaaatagatgagtattgagatcaatgcctatctggtccaaccgaggataaaagaggttatcgtaatggcttataaatacaagtgcatgctatgaagtatagaaaataatttctgcccagcactggcccatactataacagaattgttttctgtttaacaattttttgacatcgaaacttgagcataaactggaaacagcattcaaacaggcattttccttctgaagtttagttcaaccagctcatgaattttatgatacaggtttcgaagctggaggccctaatactccatcgagcattgacccttggtccataattggaaatgaatctgtcatatcagtggcaactgatcgatcatcatgtttcagtcgaaatatcattgctctgaggatggaggttctctgtggtgactgccaagctggtggtgttggcatttacaatccaggattctggggcatggtatgaccttatgttgatcagaggttgaattttcatctcatagctgtcgttttgcgaaatgttttcattaaatttaaccagaaaatacacagtttctgtttggaacttttcgttaatgtttgctttcatgctctcaagtaaggcaaatgtttagtacacattgtgtaatcctgccaattcagctggataatgtgaccttgtcatgtcaacttacagaacatagaggatggaaagaactacagtcttgtcatgtatgctaaatcattagaaaatacagagttaacagtttcactaacaagctctgatgggttgcaaaatctgtcttctgctaccatacagtaagcattctttgtttactaaaacggggtaaacttttcatttttacaattttcatcagtgtatagtattttgttgccatagagttgctggtacatcaaattggacaaaacttgagcagaagttggttgctaaaggaacaaacagaacctcaaggcttcaaataacaactaacaagaaaggtgtcatatggttggatcaaatatcactcatgccttcagacacgtataaggtaccattgtagtttgtttcacaggtattgcttgatacttcgaacagcaaacagaagagtgaacccaagtatatttcacaggtcaattgtagttggattcttcttttatccaagatcatataaaagctttcatttctgtctgtatttatttgtttgttaatccattgagtttgatctctttctagtagtcatgcttatgacgtatgccatgaggttatttccatatttaacttccatttctttgtatgtacagggtcatggtttccggaaagaacttgtatcaatgcttttggatttaaaaccacaattcatgaggtttcctggtatgtgaattattctttccatcgttgcacatatttgatcagacatattttggacagttaactagattgaagggaactattccaggaggctgctttgttgaaggccagtggttaagaaatgcattcaggtggcgtgagtctgttggtccgtgggaggagaggcctggacactttggtgatgtctggggttattggactgatgatggccttggatattatgagtttcttcaggtaccaattggcattatttcagctctacattttcttgattattccataatcatattttcctttgaattgaacatctaagctttctgaggatctgggtgctgccccaatctgggtgttcaacaatggtaattatttttgtgtttattgcatctttgatcaccactaccgtctgcctttattgaaataattttgcctcttaaatgtcaggtttcagccacaatgaggagattaataccacggctattgctccatttgtaaaggcatgttttgagctcccaattcatttttataccagcatagacatatcttgatgcagtgaatgaattccatttgtaaatacattggaaggagcaattctcacttttcctgtacatatatcaaggattagaaatagaaattttgttgctcaatcctttctgagacagctattatatatatgatgggtctgctcaaatgatggtagatgtttatccatcataatcaatattgggacattattaagatggttctttggtttatttacatgtactgcacaaattgatacaacaccttgggttaagttcagattgtttttttcccaaaattattaatggattacttacaattttttttctaaatttgttcatttttatggataaaagttagtaacaactaattatctcaccacacgttgcccatattttccccagacttggataagttataactgaggctcatatcttttgttattgtcttttctccaggatatactggacagcctagaatttgcaaggggaagtaccaactcaacatggggctctcttagagttgcaatggggcatcctgaaccatttccagtcaaatatgttacaattggaaacgaagactgtacaaaaaaattttaccatggtaaatatatcagttagtttcttatggattaaatctatttcccactacaagttgattatgtttatgtatacaaggattaagctcattctttgtcaagaaaaaggaaacataaataattttggtataagcagataagttactcaaccttttcctgtagtttttaaacacaaaatataaacacctatttttatgattgggcatattttgcaaaaaaaacatcaatacaagaattttttttt

SEQ ID NO: 72306 - DNA, 878 bp, Oryza sativa
agcgcgcccgcgacgtggtggaggtggccgatgacagggagcgcccacggcgacggaggcagccggccgccgccgccgccgccatgccggagcgaccaacgggtcaggcagaggaaggggacggcgaccagcagagcaaggagaagtagatagagaggaagctcggccatggtgatttcccgtcgcaattcgtccgcacgtgctagcgtgttgtgccggtcattactcattaacactcatcgggttagagcaagtttaatagcatcgctaactattgagtattgactaagctaacatgcatactatatagtatagattatttttttcctcactatctttactctttactacttaaaaaattcgtagtggtgatggtgaagccaacgtaaacatacgtatagacaccacacccgcgcctccccctctcacgaccgcactcgcgcctccccttctcatgcccgctcccgcaccagctaaaaacgccctgcaccgccgccacgaccacaccgccgtgccgctccgccgcccctctgacgcctgccgccgccgctccgtcgcaaataatacctcacgaaataaactcataaatataatagtcgcatacaataaatttatacactccatcaatatactttataaatttatattttcttgatactagagggtaaaatagactttatgatgtgaatttaacggtcaactaacggtcaattgacggaaggggtatagaagtgatccaaactgaaatttaggggcatgggagagaatgagcaaatctcagggggtatagaagggattaggtgaactttcaggggtacacagggaattttctctttaagtagagtagggtggttcaaacagatctaaaaaatacaagt

SEQ ID NO: 72307 - DNA, 1432 bp, Oryza sativa
tcctgcagccctgcgtgttgtcgtaggttcgagtcccctagagggctacatttttttgtttcttgtttttttacaaggcgcagggtggcctgcggctagcctgtcttggctgcccatgtggaaaatgggccgctggcccagctgaaggggcagagcgcgagagggaggctggcccgagcccaagaggagagagtgagccagaaatggtccaagagagagtgtagcttttcatttttttaaattcatttgaacctcaaattcaaatccttttcaagcaaaacaagttttgaaatgccttttgattatcgtcacactgtgacgattttaaaatcacacactgtgacgatctggataaaaccgtcacgagttaacgggccaagaatatccactagtgcacgtccacgacggaaaacaaattatcgtcacggattgcctctgtcagtgacggtttatgaatccgtcaccaagaattcgtcatggattaacaagtttcttgtagtggaattccaagttctctgtcggagttttaacacgctgatgctacaatctgaaagtcgttgtcgccaccgctggtgagttactcattcccctccacaaattcaatgctaggttaaatatgttacatgatgacaaaacccagtaatttaaaagttacagataacacttgaaacatcaccaaatgagagtatgagtctgtatatatactgatgacatgatgacatccagttgatccttctttttttttctgtatgtcttatccatttccaaatgatactgtagcaatctatcgctcatggtctcggagcggcacacgcaaggcagggacaagcaggaggtcggagcaccgccgcgtggtgagccccaacgcctccgtcatgtccagctcgccgggaagcatcccgccgggcagctcccagtcgaagtggtacaggagggcggcgagcgcgagctccatgttggccagcccgaacgccatcccggggcacatacgccgcccggcgccgaacggtatgtactcgaagtccgtccccttgaagtcggcggcgccgacgccctcgaacctctccggcgcgaactcctccggcgagtcccagtgcgccgggtccctgccgatcgcccacgcgttgacgagcaccatcacaccctccggcacgtcgaagcccatcacccggcacgtctcccggcactccctcggcagcagcatcgtcaccggcgggtgcagccggagcgactccttgatgaccaggtgcaggtaggggagatcgcgcaggctctcctcggtgacgccgtcctgcccggcaatggcgagggctcgtcggacctcgtcctgcgccttgcgcatcaccctagggttcctcatcagctccgacatggtccactgcagcgacgtcgccggcgtctcgctgctcgccacgaacatgtcctgcacaaa

SEQ ID NO: 72308 - DNA, 17529 bp, Oryza sativa
gggacatctaactattggtatgtagttttgtggtccctagacacattctatagtgacatgtaaccgaatggatctagtactggtcaatgatctaagcacacccaaaggatttacatacctgtattttagtttgtgcctaaggtccaatcagacctgtcagttgagaagtttctattaacaattcatcttctgtaacaggataaagagctctccagtgctgctggaaaactcgtggagtgccagaagacgattgcgaacctcggtcgtcagctaaaatcgctgaccgatctcgacagtgtaacagccgagcctgaaaagctagagtctggggatgcacttctggactttagagaacccgatgttgaggtgccaccagcaggctttgcaaatggcctgtacgatttggatcttccaaagagcaatgggagctgcctgtcacccattcctcgtgttcagtcgtcttccacacattcgcaaacgtcagtgttctctggcggtttatcgtcgcttggtagctacaggaacaaaacaagaaagtgaaatctgatgaaaaagatttgtgcataaacttatttaacagttcgtggatgtttgtcagttgtcacctgatgcttagatcagtgtacatttacaggaaaatgatggttacttgtgcttgttccgcctgatgattttactgctatgagctcagcctcattttctttacttttcagcgttcaccagtttctgatgcaagtcttgttgaaagttgagactgatgtttgtcatatagtaccattctcacaagctagtcagttcgagctgaagatgtgctgaacatataagtaggcaattcactgaatgcaagatgaataatctgtcactgaagaaatgcagcttgaaacttgtatagtgctttgctcgagtttataagcctggaaactaaatgcttgagatatatagctcgaatgtctgaaagtgatgagagctggttttcagtaactgtaggttccgtacgattgaatttacctctgtaagatgcaaccacctccacactaccgtccaaaactgcgacatggagtactacataagctgtggcatggttgcactctatcgcacactcgaatcgtctcccattgttgagcaagcaaaggtctttgttcttcttgagctcagctcagctcatcagcttccatccatgggtgtcttcagctcggctcccaaggtgtacaagccggcgtcggaggtcaatctcggcgccgacagcaacgagttctacatcagccccaacgtcaaaggttacaagctcttgctgaattttctgtccattttcatgtcaaagagcttttgcattcagaattcagaatttcagttcttggaagtgatttgtatgcttatgtctgatcatttttgttttattgctttcttcagctccacgggttgctgggcttctggtgaagatattcgcatgggttcttgaggcgccgatcatcggctcaatcgtgctctacatcctcaagagagacaatcttgtcaacaaggtagatgatcatcacttcttctgcttggcacagtaaaaaaacacaagttgaaatgttagctgaaacgctgtagattataatggcacttgaactgtgatcagattgtttggatgctgattagttgctgaaaatttcactgtagcttgtctcggatgccgaaatcccggagccaccactgttcactgcagctcacacctggcaaggtctgtcttctgttccttaccttttgggatttcggccctaccatttcgagccgtttttgtacttttgttcacagtagaattcacatttgaaaatcaaatttagattcagctagaacctgaaaatactgctgctcctgctgctgttgcttcattgcagacatccctgagcagaatgtgagcctgacgaagccagacatgtcgccggcagagcgcgttcaggaggccgtcgtctgcctcccggctcgcctcgaatcggtgctcgctgacccgccatcgccggggttcaggcgctggacaatccgggacttcaccagtgcctacatctcaggagagatcactcctgtcatggtaaaacatttagtacagttttactgacagtaatatgttcgtgtttaatggtttttgtatcagtagttcagtacaatgcaatgcattatgacaatgtgtagtgcattgggggtgtgaattactcactgaattttagtaggttagaggtattcttgttcatgaatgctacccaattagcttgtactgcattgctggcaggttgcgaggagatttctcgctgcagtgaaggagtgttcaggccctgatctgaacatggccttgttcatcagctgcaatcctcaggacgtcatcagacaggccgaggcatccaccctcagataccagcaaggtaaacaaaattaactacattttcagtgtacattatgccaaagaaccgtatcaacaaatcaaaatcaatgaatcattcgagcattaaacagtaattatatcatactagcagtactcagcaagtgcctcagtgtctagccttcatcaccattgacatttaggttcagagaatctgcagaaattaaactgtcataaccaccatgtttacttctgtatgctactaccaacttgcatgcttccggccatgagtttttacttgtagtactggtgaagaagtactactattactgccattgcagtctggaactgaccagctggatgaacagtatcagcagatgctttacaggaaggcattgtcagagcctgccaatgcacggactggtctctgaaagagatgtttccacaatgaaacaacacgcagcttgcagcagattcagggctcggactaatctgacatggagcaaaatgttcagacttcgaacagaaggggctttctgatgaaagattccatagaaatggcatcggcatcatcccctaatgatcatgcattgactagactagctctttgcttgcttgatcgaatctgaaagcattgcatggtcctgatccagcattgatagctcatagggacggttagttgccactgcatgtggttgcacgcagaggccaatactacattccttgcagggcctggcctgctgatctgttgcaattgaaggcatctcgttgtgctgatgcatctgttgttgcagtatctcatcgtttactctttgcattcatgcagcttttacctgatcgattgcatgcaccatttcatttcttggcttctgttaactgttaattgttcttggattatgtcaagtgtttgactgttcttgatgctaattaactgcaggagctcctctctctgccatggatggcgtcctggtggccgtcaaagacgagatcgactgcctgccatacccaacaacaggtaagaacatcacaagatcaggtatcatcaacggtgctaaggttgtcgaatcatatataagaacaggaggtaaaaagcaatcggaatcaggatttaatcagctgcaggacggtaggtagagctgctgccgccatggagaggaggccccggtacggtcggatgattctgatgacactgttcatcgccgtacacactgtccgtcgatcgtttgcttcttgcaaaatgagtgctgacaattggcatgtgtgttttggattgatactgttcatcaacagaagacgtgatccgatttgttgcaaaaagagagaaatcggtgcttttattttttaaattagctacagtaggctgtactaactcgtttttttgtaggggacaaaataaattattgcattggccatgctatgaaatactgtttgcaaattaaaaacattttttctgaagaaagagagtgtatgaatctgaagattctaactaatgtcaggaccaaatctatgtcgacatagcaaacatgataaataaagaccagttcagattactgtcaaaatgaatatttccaaaatttggcaataccaaaatttgataggttggcaacattgccgagttttggtatgataggctaaatgtgctgtcaattttttacacattaccaatatttgataacagactaaattcatccacatgtctgtcaattttaccccaaaatggtatggtttaaagtgagaccaatacgatactagggtaggccctaaatcatatatactagttttatatttaggggtggaaatgttatgtctgattggttgtactgtaccctgaaactgatcaaagacgcatatgaacaggaggaacgagatggctgcagaggatgcggccgtgcgtgcaggacgcggcggtggtggcgcagctgcgggcgtgcggcgcggtgctcgccggcaagaccaacatgcacgagctcggcgccggcaccagcggcatcaacccgcaccatgggtacgcatcacttgtcgtcgtcctgttcatcatccgcgcggtctccaaatcacaatttttttacccttttaccaatgggtttcttacctggtttgatggtttcagatcgacgaggaatccgtacaacaccggcaaggtggccggcggctcgtcgggcgggtccgccgccgtcgtctgcgccggcctctgccccgtcgcacttggagccgacggaggcggtaaacctactcaactcgtacatgcaaattgggaatttttctgaaccctaaaaacatcctgctctgacaatacaaaacattgtgttgctctggcttctgttatctgatcggatcatcagtacacgcaaaatgggtttttttttttaatctgaacaatgaaactgaaaatgtcttgctctgacaaacaaaacattgctgaactagcttgtgtgatacaaaacattcagaacataatgggaaagtgatttcatccgtcgaggggatatctcctcgtttcgtttatgtcacctaaatagttataattttttttaaaaaaaaattgtcaagatagattaatatgaaatataggagtatcactctacaaacatgcaagataaaattcaacttctatagattgtaacaaaaataataaatataaatacgaatgtatgataactattttcagtttaatttgttctttttgttgcaacttataggagtcgaatttggtcttgtatgtttgtggagtgatatatttcatattaatctatgttgtcaatttttttaaatttttttataactatttagatgtcatgcaaacaacgacggaagatgaaaatctatatccgaacataatgaatgatgtttggattgaattctgccaaatgtacgacaagaatatctgcatgcagtattgagttattgttttctttgtgcattttaatcaggatctgttcgcatgccagccgcgctctgcggtgtggtgggcttgaagccgacggcagggcgtttctccaaggatgggttcgtcatgctccacatatatgtacttttcattctacaagatcaatcactagccaaagtagccatagctgcaatggatgtgcattgttcagacacacctgacctgggctatttctgatctcaggcttcttcctcttaactggaccgtcgggatgccagggatcttagccgcgacagtggaggatgcgcttatcgcgttagtaatctctcttgtttcagaaactaatttagctctcagtgatcttgttacacttgattgtgtatatatgttgtaatgtactaaaagttttgtgttgctgtttatcattcagctatgcagctattgctgatcagtcccaaccaagccacttgcaggcaaatgctcgaactttgtattttctcttacacgtttggatgttcagtgagactgaatttgcagaagatttgatattttttgtttgtttgcagcctgaactgaatcttcccctgctgaaagctgcaagctcgatgcctaccatcagactagcaagatatgcaaaggtgagtgcttcaacactgtaataaaatcgtgtcatctgaaactgaacattgtactgatattcgccacaaaaacagtggttcaatgactgttctgaagacatcagaagttgctgctacaaagctgtccatacgctgcggactcgatacggttgggaggtagtaagaacaactctacgcttcatctaatcctgaagttaaacaatgcactcagtgacatgattttgaggaaatacactacagttcatgcaatctgacattttatttatttatttttgcaattgtttgtgctactatctgcaagactgctgatgtgacaattcctgaaattgaggagatgcggctcgcgcattacgtgacaatgggttcagaatgcaccgcctccttcgataagtatctgaagaagctgtaagcgtatcataaattttgtcatatgaaatcatttttcaggctgacatgcgtatgaattcaaaatgatgatcaattcattgtacactcaaaccatgctgatgcaggagcaagtctgagattggttgggatgtgaggatcgcgctgagcgcctacgggtcgttcagcagcagagcttacctgaactcgcaacgaatccggtgagctatcatatctaccattcttcagacattcattccaccatcaaacttagaacactatccactctgaactcgaaatgaatgaactcttctttttttgcaggaaccgtcagatgtacttccacgacaagatctttgagacattcgacgtgatcgtcacaccaatgacagggtacctatgcaatcttgcatggaaaaaatcactcaccactactactgagtgtagcagtgacagtttcagggcctaactgtgtacttcttgtacagagtgacagcgcacgaattgcaggacaacgcggggcacaccggagagctggactacataaacggaggtgattataactcaaccaatcacgagcaattaactgaagaaaaaagagttcagtttcagaataattaagctggcatctcactaactcgtcagtgttgcattgcattggatcgatgcagctgcgctggtgaggtactcgatcgccgggaacttcctggggttgccggcgatcaccgtgaaggttgggtacgacagggaagggctccccgtcgggctgcagttcatcgggaggccgtggtcggaggccacgctgctgcacctcgcctacgccatgcaggtcaccgatctgatgctggaaacgaactgatgttaattgttctttccaaatcctgcattgcatgtggggagtgaaatgtgtttaattatctacacagaagtgattatttttaattttttatatatttttttgcaggaggcgtgcggcaagaactacaggaagcccatggtgtactacgatctcctcaacaagaacaaatactagtttcagtttcaaaagaacaaatagtagctatatatgttgtgagagttgagtgacagtttgattctgagagatttggactggggagaaatttatcatcgatcattcttaccatcccaaatacagaatgtgatggacattattattgtaattgttgttatgtttgttgttgttgctgctgcttgacataagcatgcatgtaagtcatatgcatgtcgctgtatatgtttactattattgaatgtgcctactgatttactaaatatgatatttcatttcttttactctaaactactactacttactactagtacaattgtttttctcactcaactctcctaagaatatcggtggacaccaagcttagcttggtaaaattctgtgaaacacaaagtcgagtggaaatggtgaagggcccatgtggcctatgggccatggcccatcatccttcttggaggaaaattagacagcacttctggttcccggacgagcctggtccacatgtcatttactattgcacccctgtcaactttagaatttacagttagctcgttgatatcgtagcttttatggactagtatgtcctggggagataaattttctttcttatggactaatccaaaccagagtaaagataagatttatcttctcctaagacaactgtatataaaggggcaaggtgagacatttgagatttgcttatactcaatatcatatctataattaaaagagaacttcaccctatatcgttgtctacttctacaatgttgttgagggcagaggaaaaggcacaggtattctacattttcttacgtctctactgcggcgggagggacagagaatggatccggtgatctgctaatagacgtgttggtttacaacagtggcttcacaatctgtacatgtttgttgtggggtatatgggctccggttggatgaagaaatatctcaatcatccgttaagcaccttgattgtacttgtagttttcatgatctagttgaattcatggctttttcagcacaaagattgatatacttgatatgttgattttgagatgtttggtagcactctaaatccataatatgctatattagaaatttatggcttcctcaatacaaagattggatgacaaaatatctccaccaccgtcaaatcttaggagtacaatctgcattcatgtcgagaagagtcagatagatagttcacactcaacctgaatggagttatcaacatggttaatgccagggtgaattataaaaaacttcgcaaaaccccacgttgccttaatcttgaaatggcttaaatgatgactaacaaactattgtcttattatagttaggcggaagacaataggggagattgaggaggagatgacctacaagtggctttgcactgtattgtttttttcggctcccccatggccccaagacattatccatgagacaaccgaacaaacaagaagcatcaataccggtagcagaagcacacaccgtcgctcaccctgctaactgctttgtactagccgaccgccactagctgttgctaccgtatccttcatctagaccacccacgaattaactgaaaccaccgtcgtgtatgtcccataaaatggtctacttaggattatatacaagtacacatgttgatcatgaacatgaaattttgaatacaacaatggtatttgatcaaatttggataactttacattcatacacaagatataaaataatattgctataatatgttactcataagcatgaagataataatactagcactacaaaatgtcacttgatgaaaccacaattgatgttaacacataaatttcttcccttccaatctgaatgccctagattaacatggagaaaatttttatctgcagataacactaaaccggatccaaaatttcccataccaaggctgtgtttagttcatgtgtcaattttttttaagtatacggacacacatttaagctattaaatgtatactaataacaaaaaaaattggtcacgcgatttacatgcaaactgtgcaatttaatatacattattagtatattatcaaatcatggcgtaattaggctcaaaagattcgtcacgtgatttacatgcaaactgtgcaattgatttttttttcgtccacatttaatactctatgtatgtgtccaaacatttgatgtgacagaaaagttggaagttcgaagaaaaatatttgaatctaaacgaggcctgaatggaaataatcaaaaccgcaatgggctggcaaactgtcgatttcagataatttttttagtacggacaaactgcagggacctaaacgaaaaagaaagaaaaccgtgacgtcgctcgcttccagagatcttcagatcagatcagaaatccccaaaaaaaaaaaacacaacaaaaccaaacccgacagatcttctcttcttcctcctccctttcccatcttcgacgaggcgacccggcgcgagagaagaagagatcgatcgatcgatcaaccgatctcgccggagaaggaagaggagcaaagatgtcgtcggtgttcagcggcgatgagacggcgcccttcttcggcttcctcggcgccgcctccgccctcatcttctcatgtaatctccgccatccctcttcctcttcccccgatcaagcgattaggtgtagaaagctccagtttttccaatcaaagtcgccatctttttctttcccccatctggttgatcctgcgatttggttcgatggtgatggaggtccacgcccctccgattcgcgcgatctgtgacgccctgagtgtgaattttcttcttcgcgtggctagatttgacccgattggagatcggatttgtggggaaaaaaagttgggagctttggattctgttcttgatggggggatttgcttatttgctttcattcgatctgttgcaggcatgggtgcggcgtacgggacggcgaagagcggcgtcggcgtggcgtccatgggcgtgatgcgcccggagctcgtgatgaagtccatcgtgcccgtggtcatggctggtgtgctcggtatctacggcctcatcatcgccgtcatcatcagtacagggatcaaccccaaggctaagccgtactacctctttgacggctacgcgcatctgtcgtccgggctcgcctgtggcctcgccggtctcgctgccggaatggccatcggcatcgtcggtgatgctggtgtcaggtaaagatgctgcctgctttgttgatctgtgatgtagttagtgtgtatatgctgttactgctgtgcattggtgattaagtatggttttatgatggaagctacaggttgattaacaattctagaagactttctataggttgttttgctaccaaatatgattaagggatctgtatgtagtttttgtagcgctgtctgtttgataacttgtattcattgtgttcttgtattagcctagtagttaatcttgaactggtagtgagtagctgttacctacaaggttgtgcgtttcaatggcttcaaggctgtggaaatgaagaacaaagctcatataatccttatatggtatttctggatcctcctgtttgtaaatccttgtggtctggtaataagttataagtgccaaggctttataaattgttagtatttatttatggggggttctttcctcgtgggcacttcaatacgtagcatatactgaataatgatgttgttcttggtactgctctctggtattttttgctgaagttttaacttttaacaactgaaaaaatgtgctgtggtgtgaagagcaaacaagtggtcaaggtgttatgccttaaattttttcaacgatgtaatgctgagtagttgtgatttgaatgtaaataatctactttcacaattttagcacttaactggaatatgattccattcatgatggcaagtgtgttattgtataatcgtacatattgtttcttagaaattttgacgttagaaggttaattttgggatgatttattagattgtgatgttactatgatatcatatgatcgaaatgtgcttcactgcttttttggtgttcacctcggtgttcatgactaccctttgtgttgagagcttgaggctactcctaagctgcctactttggattacaattctgatatctcttgttggtgttggcagggcaaatgcacagcaaccaaagcttttcgtgggcatgatcctcatcctcattttcgcagaagcgcttgccctgtatggtctcattgtgggcatcatcctctcatcccgtgccggccaatctcgtgcagattaggcactttgcggtaccataccgctgttattccactggctatattcttgagaaaacctgaaacttacttgggagctctagtttaatgtattaaaagatcgatttgtagcttaaggaaggtggcacttccagtcctttttgtttcttttgtggtggttcatgcaaagttttttgggttaggctggatttgctgctcctgagcaaacggatttaatctcattcgtggtgaataaaaaacacggcattgtagcaaaataaaatcattacaatatattatgttcatcccttcactctaatgtattggattgcaaaaatcatcaatgctcctttttgttatgagttcaagtcatcattatatcatccgacttgtgtgataagctcatgtgttcattgagatgagtaggctaattactctcagatgttgctctaagaaaggtgatcttttcctcttgaatggccgttctgtacaatcgcaccaaatttcgtacgctgctagtgctcaaccaatctgtaactattgttgactcaattcattaccctattgcagcatctcttgtaccgaaaatctcagataacctctcaaagagctaagaaaatctcaggtaatttacaagaaacaaggccaataccacagaattccaaatctacctgttccccatttcaggaatgcttcttccaaatgcattgacctacatctgtttcatcgctacccactgatgccattgcaaaaacagtggtttttggatgtttcgaaactaggaaagaaaattttgttattgccacgagacagaactcgtgctgttgatttttcttcagtatcagaaaaacagaatgcagcggcaactttagctgtataacgccgcaaggtcatcctcgtacgccttcttgatggcctccctcttgagcttgagggcagccgtgacgagtcctgactctggggtccatggctccggcaccagcttgactttggctgggatctcaaacttctccagccgcgcttgcttggcagcctgaagaacaaacacacgtcagtacgatccaattgtcataagacttgcatgtcttgcattgatattacttaataagcttgctagattcaatttgttttgagattgttacggtgcgtgcaatgtggggttgcattgcatactgagagtgaaaaattggtatttggcatcgaccattcggaccgtacacatgatatctggttgagctcatgaatgtacatcctttttgcacgcaaaatatggagatatcgtcgcagattatgatcatatcaaattgcatattagtgtatgggttatattctctgtttactggaagattataatgtgttcttttcctgattctactgataacctatgaggtccaacatatcctccgttgttctcatattggtacggcaataccacattgccactctcaaaagagagaaaaatagaagagatcatgttttgctgaatcatccagggaatgcaatcattagtaaagtagtactagttaattttgatggaaatattgagggttaatggattgctagattaatcagatatatctaattaattaaaacgcagggagaatacacacctttgctaaacattgaaggacttctttgacagtctcttgcttctcacacaaatctgaaacatccgaatacgtgatgccttgttgtgaggcccagcttttcagttcactgtgtgcaactacaacaagtgcaacgcagtagttgtggaaggggtcagcatggatcatgatgttgtcaacatatgggcacacactcaaagcagcctccacctgtggttttataatagttagattacaatagctgactgccgctaatttggctggaaaaggaagcttagcttacctttcctaaagatacatattcaccatgttgaagcttgactatgtccttcttacggtcaataatttcaaggcaaccatctggatgcaaacgtccaatgtcaccagaatagaaccaccgcatgcctctttcatcatccttcaataaattggtgttgttaaagaaaagttatcatgggcttcacagcacagattgctttggcatattatcgtaacataccttgtagacttcatttgtttttgcctcattcttaaagtagccttttgtcacgtttggacctccaataactatttcaccccgaggcattggtgaatcattagttaaatatccaccttcagcccaatctatcaactatcatatacaattcatattacgttaggaaagaataagatctgagggataagatattaatcttctgaatctcaacatgaaggagaaaaccaaaataaactggatgggcataatacactaaatttcaaaatagatgttcttttttgagtgaagcgtgcaaaagattacatgcatagctttgtgtaaactagctatccacaatgtcactggactggctgtaaggctagtggtcaagtaaagctatccgcaattccacgcctcatgtcaaaaatttgaacacaaaagtttatctgtgatctctaatacgaagaaaaacaatatctttttgcacttagcggaaatctttcgtacatatgaatatatggaaatgaggatacaatttatatcacagtgataacatgcatggcaacaataactttactatggaaatgaggatacaatacaccctaccaaaataataaaacatattttttaatgtaccttaatgtatgagcaaggcaatggagcaccaacacggccaacagaattgtcatcatactcggaaaatgtcccgccagcacatgtttcagtaagaccatatccttgccctattggagccctgcaacagcacaacccaaaacctgtcaattgttttggtttaaaatgcagtatgcaagttagatttgaatattgtgaagttcaatcacagtaaacacaagtggaccaaaaacaataacttgatattaacaaaagagacttgagaatggcttataaaataatgaagagtactatctcacccaaggcatatattgataaatctctgagtatctccagacagaggtgctccacctgaaagtataaatcgaatccttcctcccaagatcgcacgcaccttctgaaagacaagcatatcccacaaatgcttctctaatccccatgcaccaaaccaacttccattgatagcagctaaccgacggctataggcaatatcaaatagtttctttgctgcaccaccctttgcatcaacctaattcatctcatcatgaaaaaaacaaatggtcaagatggcaagaaggccagaaagaaacaatggataatatcattgtaaagaacaatacattttttctaacaccatcacgaacacgatcaagtatagcaggtactgcagtcataagtgttggcttcagagctgaagcatcgccctgagtccccttctttattttatttgatgtatcagtcagggtcagtggtgatccataccctatagaagccccaacagcagacataactgtctacaaatcacatttgcataaagtgcatcagcatcaacaaaaccaacatgtggaatagactgagatttcaatatgtcatctgacacctacctcagctgctaattcaagaatgtgtgctaatgggaggtatgccaagtagacatccttcttgccaagtgcaggcacaatggtcataacagctgatacaacagccaggacattgcgatggctcatcatgactccctgtggaaaaaaaagtacaaatgagaggagttgtaagcagatgatctgagaaaagacatccattagtaatatccatatcgtgaagtaatccaacatgggcactacaaaaaaatcaactaatctttgaacaaaccttgggcattccagtgctgccacttgtatacattatcaccgcagtatctgacggaagaggcagctttgcttctacaggtgtttccaatcctaacctctctacctcctcaaatgactcaaccctccagctggtgcatttttgagctaaggatacttcactagagacgccttcctcgtttacgtagatgacatgtttcacagtatcaagttgcccacttatgtcaagaagttttttcagttctttccttccacatatcacagtagttacctcagtctaaagagtcaaaacagaagcaaagttagagatcatatcacgacgcagatacagtaggaataaattgttatgtccaaactgttcaagataaccaacaaaattcactttggttgaggttttgttaccataatgatggacagggtgagaaaaaattcaagtgacttttgtcaaaaaaagaaagtcaactgacctcgtttagtgagtgacataacgctccctcgcccaaggaggaataaatggtgacaaccgtaatactttgtctgaagcatgcctttcaaatagaaaagaatggttagacaatttgcaaatgattcacggagctaactgctagcataacatgaagaacataagcgaaatacaacagtataattgatttctcaactaagtgagaatatcaatatggttaagctgaagcagttcaatgttcaacaaaatcagtttttcatgagagaatgtaaatgacttcttatatactcagctgtgtcattaatttgatcatttttgtcttgtcatatctatctagatagcacatagttccttttgttctcatgagcgcatttcactttatatatgcaaggatggtgatggaacattgtgaaaaggacaggttgagacacttcaagaacagtccgcatcatgtaaattcaaaccttttatgtacacacaaaaaaactatggaagttataggagcgcgtgggtagagaaagctacctgcaatgcaatctgccactcggcccgtgtatcggcgaaaatagcaacacgctcatccctctggtgcccaattcgcactaaaccagatgagaagttgcagacagtcttgaatgcatcagcatagcttttccactcatactgccccaaatgaagcttctcaaaggacctcccatcgcgggctgcctccatttccctcgaaatgagctttctggtgccaaggagtggcatgtagacatactgctcgcaggactgctcaaacagctccgcaagcgtggaaaccccttcccagtgcgtttcaacgggccgctcgaacttgtggttacggatcacatagccgggctctccgcccacatcaaccggcactccccttttcttttcacccttcctcttggtgaacagcagagatgccagaaaagggatagcgaagccgatgaaataaggattcatatttcccagccttacacaaagctactagtccgcggagtgtcggcactgatctgcaattgacttttcaagtgataaacctgaaatgataatgtagctacattatcagatatttatcgcgtattaacagacacagatacataaaaggggaaggcattgctatccagtggtctacaatcaattagaattagaatcctccccccaaacaaacgagttttgaattcctccccagatgcagaaaatgttactagtcggactcctctcctctggagcaactcgttcgcagcgagcggagctattcaaatctaacgtagtagtccactccatcctacaagatcctctagtcgagaaaaacccactgcggcattgctctacaagatcctactagttgccttgcagagacaccaccaaatcaaaccagcggacggatcagaccccacccccgcctactggatgctgctgtggaagcttctagaaggtaatgcagggaactagtagtagtagcagtagctacctgtgtcactcaccggcggaggaggcggcctccgggagaggcagaggaggaggagagtgcaatggcaggtaggtggcgggtggggggcggagagaaatacgggggggaggcggaggaagaggacggcggcgcgggcggagaatccaacgagggggggggggggggggg

SEQ ID NO: 72309 - DNA, 39408 bp, Oryza sativa
cgatcaaactcaaaaaagagttttactggaaaaaaattaaaagtgtcttttaatatgaaacggatatgcagtagaaagttccttttcaattggtcgacacccatgagcgtttgcttactgggcccaaatcagatgggtcgggccggatactccaaacgggcctactaatcctttcgtcttctcttctctctctcgccgtcgtctcgtctcgtctcctccgccgccgcgattcatccgacaccaccggcggcatctccggcgagcggcagcgccgaacacccccaaccccaccgagttctttacggctggtgtctcccctcccatcctcgctaccgcgtcgccggcgcacggggagggtgggggcgtggcggcgaagagattcctgggatctcaggggatagtggactatggggtcggtggatctgatcgccgcctgcctcgactccatccgccaggtcggatctcttcgcgacttctctctcttaccttgcctgctcggattcctcattgtttgttcgatttctttttattatcatgtaagagattaattttgtccgggttaaactgaatgtgtaagaagattcccagaattttcagtttctaattatctgaattttgcactttggagatgaatatgagactactgcgtttaattggactattggagcgatgaaattgttctttaaaaaaaaacccatctttacagcttcctgaccgtatttctttctcgttccaaaacgataaattacaggagctgcttaacttggtaaagatttatccttttagcttctgagctgacaagtcgctgttattcgttcgtgattaacttaagctgtggataactttgagaaaacaaattcctatttgatgatttgcatgtaaaactaatggactttatcttcgtggctttcactatagaaatttatgttctttttttggtctgttgctgctttgcagattggagatgagattgcagatgcactagtgtaccttgatgcaggcactctggaggcgtttcagtttattggagctttccccttgcttcttgagcttggtgctcgtgcaatttgcagcttggagaatgcatctccgcttgatgctgtgagattacttaaatcccttgccataaaagtcaattaattatactagtaataaagaatagatatggtaataatgcatactacctcccaaggtagttagccagtaagctaatagcaatgcctcccaaaagttgcaatgttgtctgctcagtagtaatttatgtgtcaaactgaatgcagcatgttgagtgcaccaaagctcaagcatttttagtgtgtgtctggcacatgagtggcaaagtttaggaagaaaccatagttgcaagtggcatttgtttcttgatttgtgtcaacttagagctaaggactactccctctatcccaaaatataaggcatggtcaaactcgtcacggtctccaaaactaatctttgactcataatttctcatatactataaagtttgtaggaacaaaattatagccatttgaaagtgtattcaaatgtcaatccaatgatactattagcaaataaaattcaatttatattatggtatggagggactacctttttggtcctatgacatcttgaatttctgtacttcatatttctttttcattctgaacttcttatagatgagaagcagtgcacctaacagccttcatgttaaccttagtgtcaaactcatattttcttatataaaaccataattttctttgttcatgtacaaaaagtaagaaaaaattatgcttttttttaatgacaaatgtgccatcctgttctttacatgatcaaaatgccgtaacttgtgtttggcaggctgctgaatggcactcaagttttgcacatccagcaaggaagatagtagtgattacatcacgcctgcttagtgatgcacatcggtatattttgcgctgcctgggaaaccatggaactatttcacattgtactgtgttgacagctatttccgaggtacttcattcctgcaagaatttgttactttgatgcctgtattgcttctgaaatgcttgaacatccagccattattttcctacaattatcttctgttcacatcaaaatggctttagattttattttattttattttttgcctggggcttaagttcctatttaatttcctttgaaaaaggtacatagtccatgttagtttccatattatcatgaaggtatcatatactatatctggattgtttgatttatcctttctccaggggatggtctcaacactcatgtatgtagtttgtattgttgcatgttgtccatttggaagcttatctaaaccattatttattgtatgaataatcttaatgtcctcttgaattatttgttgtacatagtatagctgaacacatatgagtgtattagtatgagctaatttgtggactttgttttgtttgcaacctgtggtaacttctgtggtgctcaaccaaatgttgataaacagcaatcttgcttcaacccatattataagatttttttttctttttgcaaaacttaagagtttttttattgaaagcaaaatcatcttaagttctgcaagcaggatttgaatcatttgtgatatattgcaggttggtcactcagcatatgttgattccccatttggaccagatgccttccgggagtatgagacattacttactcaggaccatgaggaacttctgaagaagtatgaaaagtcagatgagcacaaagataccactttttacacaggaaaagatttcacatcggatggtggtagatactccaattgggaatctggggtgcattatggctctaattctgaatctagcccaacaaaaaaggatttgtttgctgatgagtcaagccagctagaaactaaaggaaaaagattatctgtaactgtgactcactttccgatgattttctctcctatttcctctaggacttttgttttgccatctgaaggcacaatggctgaatcatgtttatcaaaccatcatgaagattcccttagtccagggctacctcccatatctactggtagatcttttgatggtgatgagattccccccggagtgacattgactgcccagttcctttaccatctggccagtaaggtaaagatttatcataagaacatatttcttactagtggcttcttatttttcattcatataaccacttagtgatccgtattacaaaacatgtgtagatggacctaaagctcgatatattttcacttggagatacatcaaaggtcatcgggaagctgatgatggatatgtcaagtctatatgatgttggtcgtaataagagatctgctggcctgctgatcgtagatcgtacacttgatctccttactccttgtttccacggtgactcatttcttgataggatgctgtcctccttgacacgcaaggaagggacttcatcctattttgtgtccaaaaatccacaaactccaagcaagcattctgaagctactgttaaacgtatcccactagatataaaggtcccttttgaaaaggtcttcagcaaggaagaacctaagagtaggaccagtatgttacccgaaagtatcatgtcatttgtgtctggatggaactctgctgaagttgaatctgaagtaacctggctacctgattacgcggataaagctcatgatgacaaactcagcagtcaacatggtagtttaaatggttcattcctatccaattatgctggagtgtgctacttggaatcattactcgacagaggagcaaaagatgggttaatgttgattaagaaatggcttatggaagctttacaacatgagaagttatccttcccatccaaaggtcggcaaggagctgcctctgtttcagagcttcattctatggttcaaatgctctctcgagaccagttatccttagtaagaaacagaggggttatccaattggcactggctgctgaaatggctctccaggagcctcaaagttctcgctgggatgcctttacaagtgcagagagaatattaagtgtaacatctgcagagacaactcaaagtcttgccagtgagcttcgtgattttatcaacactagcacttcagttgaatctcacaagcaagctaataaaactgagtcctctcagggccttctaagtttccaggatgttttgcttctaacaattatcgggtatatcttggctggtgaaaattttcctacatcgattgctggtggtccattctcttgggaagacgagcggtctttgaaagatattgtggtggactctatccttgacaggccatcatctgtgaagctcagatttcttgttggcttggagaatgagcttgaagctaaagctagacctaaagatggtgacaaaagtaatgactccatcgaagcttctaagagtactgatgattttgatgaccaatgggatagctggggtgatgatgatgataatactgatgatcagaaggatgaagcttatggggacatgcaacttaagttggaagtacgagacagagttgaccagctttttaagttctttcacaatttgtccagtatgaggttaaggaaccaaactcttggagaaggcctagcagcactgagcagatttgagactgacatatactcaagaaaaggcttgctctataagttgctattagctgtcttggcaaggtatgacattcctggccttgaatatcactcatcagctgttggacgtttatttaaaagtggactggggaggtttgggctaggacaggtgagttattagtttgtacttccttggttcctttgccaccactctgtagctatcctttctcacactcaatactatctgcagtctaaaccaagctttggcgaccaaagcattctcatcgtttttgttgtgggaggcatcaatgcccttgaggtatggtccatattctttggtttcaagtattcaatcataccagtatggcattattgaagctgtgtttctattatactgtttggtgtttaaatataaatatttgtttattttgtttaaaactacagtaagaatcctcaaatttgacctatattttctatgttttgctagtgtactggtagtgtggcactttcagaaccatcagttggtacacgattcctatcttcaaaatatcaggttacattcccatgtagaaaacatgaggttttagttagtgcactttgaaaagcgcataaaattgcactcatccaaataagagattacaaaccacaatagaactaaaaggaacttgcaaaaagttctctttgtaaagaaggtacatataatgtctgatccaatctgccgccaaaacatttgttagaatggtaaggaacctttctatattggaggagatatggaaagggatatggatggttgtattggtatatcaatatccgttgggtgtggattatccaatattttttaactgattatccagtgcttgttactccctccccaaattgatcatcatataatagaaactaaaatttctcaaattgatcatcttataaccgcatggacacggatttcatcggagtgcaattaatacaacatgggagaatgtgtatatttgtgcattatgttttaatcaatgcatgcactgtgggagaatatgtgcatattgtgcatggcgtcttaatcaatgcggtttaaattatcctaggtcttggtacacaaacattatacgatcaatttgggatggagagagtatttggactatctgcaacttttcccatctatgattgttccttttctctgtgcaatttgtgcttatgtgttggcaaagtatatatcgcagtgtgaaaaagtaaatctttaacaaattaaatgatcttttctatgcaaggtccgggaagtcatgaaggcaatatcagacagcagcagacctgatgtggagcttattcttgggggaacaacccttcttaccccagatgacatgtttgagttgatgttgggctcatccagctttagttagtctcaagcttaattgttgagaagctcagtccagttaacaccaatgcatctgccttggacatcttaagaatgatccagatcatttctccggaagttctttctccaaacgtggcagttcagatactgaaactctaaagattgtatcttggtgatgataccaacagcaagcataggcaattcaattcataagctcttcagatttttaatcgcaactgaatgcagcgatacagttcgtcttttgtaggacagccattgaaaacaatgacttttgagaatcatcttctggacattcattcatgctttgctcaaaagctggagtctactgctttggatcagtcactgtatttgcaagtgaagtcaaatatgaagtgaccctgctgactacacagtaaacactcaaaacaaggtgtaattctgtcttaagttctcttgctcctagaagtagctgctcttccgttcagaagccatatgtaaatttaatctatgtaaattgtttgctgttgattcgaaaatctttggtgttcactggtcaggagaactgtcaaattaggtacagcattgtaactgaaagaacatcattactcagttcagtgaactgaagtgtacatgcactatgttgtgacttgtgagtaatatcacaacccccaaaaaaaggcaaataaaattaggaatagtttgttatgttccagaaaaaaaataaacatatcataatgtgtgtaattggcctttctttttagtaggctacattttctggtaaaacattaatggcagctttcataatccaagatacataaatgtcttttggaattgtttgtagaggagtggaggcaacaatagaagttgccatatcagaattggtcagtggttttgatttgtctgtcagatgtgatcttccaatgctcgagggacatggagaagttcagcttttcagtggcattattggtgagccatgcagcttaaggaggtttgtgatggctttcagcttggatatagtgatgcatttgaagttcattcatggtagatcaaaagggctccaattttgttgaacattcttgttcctttgaacctaagaaacatggatatgcaagccatcaaataaaacttgagctctacttagtcaacattggggtggcgcgatgccaattctttctagatgaaatgcggatgtaggatgatggatgatcgatttgtttataggaaatgaatcaaataattatattttataaacctaacaagtatatcttagaataagtagcctaagtaatacttttgaaagtgtggcgcgaataatccataaatagttctggcccagtattccaagaataacgggacaaaacaaattcctttgtgttacattttgttatcctgagctgtatcagtaatattgtttaatatatgctttacagtggtattgttcaatatgtgtgtctttggatgttagtggcatggttggaaatgacaagtctgtatgcatgttggtttgaactttgaaccacttctaccattaagctttcctatttgccatttacctgaggaatcttggggttcacatattgcagattggacccttctcaattattgtcacagaaaagaaaaaagatgatcacacacacactgacacgtacttgagaaaaaagggagcttctcctagatctgaattctgacattagacttgtagagacactgggagtgttgcttaatcaccctgcagtctctggcctgaaaatgctagtgcttgtagcattgcttggcatgtactgtacctgccaggcttaagctcaacagctgtggttagttagtgctgggctaatcaaaatatttaacctgttctttgtgtgtccatggaacggcagacatgtcaggatctgaataatccgtgctcgtggatggatgcactgaagatgcatgcagggatgtctgcttgttcctgctgcagtgttcagttcttgcaatttataaagcatcttgctcttgctgcctcctgttgtcgttctctgcaactgggctatgtatcctgtgatttcgttgatgcattctgttcttttccattcttttgtttcttgcaatgtctccttctgtcagctaacatgatgttctttctcaaacagaaagagagagaaaaaggttatttagcagattaccaagttatttggtctaacaagctttctgattgtcattttgattgagataagaatcaactgatgataattcttctactaatttcttagtcttgcagcagtagcattctctctggcaaggttaattagtggagaaattttaccttacttgaaaaagtctttgttaattagtagagaaattttacactaaaaatttttatacctcaagatacctagtatctataggtaccaagtttttcattagaaaaatataatatcttccgatactttttttttaaaggatggtaaagactaaagatttccctaattattactaggatcatatagcagcctatactaatctgaaacggttaacacataacttcagagttttcagagctaaaccccacatcttatccatggctactgcaactcaatcatcctgcactgcacaagcaacagaacactgatcaccatcaccagaaaggaattttcctgttgacagtgtgttcaggcatcaggacaaggaggtgaagtctgaaaattgtaggctcttgctgcatctctgaacttttgctgttttgcactgcactggcattgcatgcatccagcttgctgaatatgatcactgtccccggacggcccaccggagacggagaagaaggcgggcgacgacggccgctacagacgccgaggagacggcgcggctaccgaggccggaacgtaccgccacggcacatgatccaaggcatctggagtctagctgaacaaacagttgagctcaaggtagagacgagctaagctaggggtgattaatttggcagcaactccttgttcgtttttcttcagaaatgttcagagttcagaacccatccgatcgaaacagttgtggtgatggaaggcagctcatgccgtggagtgttttcctgtttggtgttcgtcttcctcccacaatccgttgtcatctagctgttagcgtttctgcagagagagagagaggtgtttgtctgacaagtgcccatggaagctgtccatgctctgaccgaagaacaattcagacacttgaagctacttaactcaataatgcctcttgctttgtttcattgtggatattttttttcttctattagaacagtagagtttgagatattataccgtttctatgcaatgcaatgtgtttcatgtcatctcatgttccccacctgcaaatttcctgaaatcttgggagcagttaacataaacctgaaattttcaatgcaatgtgttaaaaatgttaaaaaaaatttaacacattgctgatggtgcatgatccaatacattgcattgcattgcagatttcagatgttgcaacatttttttttggaataattgttgcaacatttttaactgcaacatttttaacacgtctgaaaaactggaaatttctgaccttgcaacatctttaactgcccagttagctggctcaatgcattaggattcttattaacttatcctaaaatcttaccacagatccaaactacagagccctcatgatgcaaccatatgagaagctgagaattactactttgtttattcagtcctggacctcctttgtcctgtggctgcatccatgcatgcatatatcatatatcatatatgactttatgggactagatgcacacatatggtctccaagctagtcctttcttcacatcacagtaaggacatggaccacagctttgtagcatcagcttcagttgatgtatacttatcttcctttacccttttgtaattagaattcagtatcaccttttctgggacaaaaggtggaccattgcatgcatggatgcaaatgcaggcctgcatgcaggttcttcctctgatctgcaaagcttgcagactgcatgcagattaagctttttgccctctctgtcagtcatgtgattcttcaagtgtgattgtccttgagggatgtgggtatgatcatcagttaacagcatcatcagcaccattggatgtctctgcattgtaaaggatcaaaggaggccattagcattggtgtattggtaggaccatttgatttgatacacccaaacatatgtgcacttctaaattgagtactgccacggcatgaaaagttgaaaacttgcttgcaataatacttgttcacttactagtaggaatctgaatctccaatacttgtttaaaagacagaggcatgcacaacattgcatcacagaagctatatccatttctatcaaattaattaggaaagaaatgaaacgccaacaaaaaaaaacctaactgaacatgcatcacacctatgattcagagagatacatatagttcaattcgatccatcatatatcatcatcaatcatacacacatacacacatacatacatacatacatacaggaattaatctctctcctcacagacactaatcataatcaacaatgccatgagctcgatcgccatggaagattaagatagatgatgaagctcgcatgcaatctctcaactttttttttcttctctctctgtgcatcaatgcaattatgcaacagtaggtagcaggattaattaactcctcatcaagaaattaaccatggtaaaaaaaattaaaattctagtgtcttggagggcactggtagcacttggtgaagaggccaaaggtgtcaacttggcgaacgaagttgaccgtgctcgcccatccgccgaagccgaagccgacgacgagcacccacgcgacgacgaagcagttggcggcgaacgtccccggccagccgccgagcgcgcgcggcggcggctcgacggcgttctccctggcggccgccggcgcgaacgtcgccatgtgcgccatcgccgggatgatgtagacggtgaagctgacgaggaaggatccgacggtggagttgatggggccgaagaaggggaagatgacggcgaggaaccagatggggagcacgacggggagcctcgccgccgcgcggcggagcacgccggcgccgccgtggacgccgatggccttctcccacacgaagtagagcggcgtgcaggcgaagccgaaggtgatgaactggtggatgagcatgagcaccaccgcggcgtcgcgccacggcgtccgcggcagcagcgcgaaggcgttggagtggtccagcagcgcgtccccgaacgcccagtacatcgccgccgccgacggcagcgtcagcgtcagcacgtacgccgtcgcggcgaggtagatcatcttgaaccgccgcggcctccacatggcgtgcatgatctccaccgtcacggcgtggccgccgaacgtgtagaggatgttggtggcgccggtgaagtagagcaccatcgtcttgctcggcccggcgcgcggcgccgccccatccaccttgccgtgcacgacggcggcgacggtgaggtaccacgcggtgtaggacgtcatgaggaggccgaggaaggaccagacgcggtagttgtggaaggacgggacgaacaccgtggtggcgcagcaagccccgaagatgtaggtccatgtccgcttgtcgaggcggtcgttgatgtagtagatgttgctggcgcaggcgatgagctggatgacggagccgaagaggaggaaggtgcagttgaagaggaggccggcgttgcgccaatggcggccgaggaggccgtcgagcacctcgaaccactggatgacatggttgcggaagtccaccttgtcgcgctcccgccgcgtccggtactcgacgtagagcacgctgatgaggtaggccgtccacgaccccatcagcccgtagaacacctggaacgccaccccggacgccatgcccagctgcgagaaggagtagggcagcgtcagcagcacctgcgccacctgcacagaatcacgccattgatgacgtcaagatcgatcgtagtgatcgccatgagagtgtcatgtcatgtcatatgacgacggattgaacctggttggaggcgcagctgaaccaggcgtcgtagacggagccgccgtgccagaagaggctggagacggcgagcttgccgcgccgcctgcccgacgccgccgcggctccgccgacgccttcgccggcggtggcggcgccttcacgctccatctcgacgtagttgcccgccacgatcgtctccaccttctccgacgccatgtcgatcgatcgatcgatgcttgattgatttgcttctgaattgtgatctctcgatctagctagctctgatcgatcgatccactggatgaactggggtcttgtagttaattggatgggcacaggctgtggtgcaggctggctattgatttataaagaagacgctcgtcgatttgtactgtcttgtcgtgtgtattttagaatttagagtgatgagagtagctagcatgtgtgtatgtatgcaatatatggatggggcatgcagctagcagcacacgagcggccatgccactgatataaacaagtgataacaactacacatatatctgagcttatttgttattcccgatctcttctttcttgtatttcatagtcgtaaaaccgtgtgtcgcacagctattgttattgacatttgaaatatttttttttttaattttttgaggtcacatatacatttgtcgacaacttttcttctagaaatttgacagatgtaattatggtacaatcgagttgtaattacattgtaactacaatgtcacttgtatgtaacttttaaaaatctcttcgtagcatgctattttcgtgaaatggaggtcaaccgaatcctctcacatgtacgcacaatttgattttttttccttccttgccggtaagaatcttgaaacaaatctaacaattcaaattttttgtgaaagttgcgtacaagttatattatagttatatgtaaattacaatgtaattatatcatgatagtactataattatatatgttaaatttctagaagaaaatttatcgacaattatatagcaaaactgaatggtttcataattctgaattaataaatattgagttgtactcagtttgtaatcttagttgtagcttaccgacattttgcttagtctagaatttggaatcaataaaaaccccgttgtatccagtttgaagccgggttttataaattcccattataaaaaaaaacattcatcatgaagtataaactcccacaatatgtagatgtagaatagataagtttttaacatgacctgaaaagttaaatgcatatagatcatgttaatatgatccatctaaaatggtcagatattttttaacgtacgtacgaccagtttttagcaagtaccaattaggtttagatacgtaggagagatctattgtatatataaatattctgattgttcattgtgctccaaaataaataaacataatatggaatattacatgttcttagtactacgagctatgattttctactaatatattcatgtatgaaaagatcggagtttagtgtatatattatctctgcatgcatggctccaggggatgatctaatataaggacggcaagggctcgagtctccactactggtaccagaattatgagagctcttataaagatctcactaaaactttttgtcatacatatatataaaaagggttagagttttgtctagtttatttagatctttgctatatctctctgaatctactactgcatggcttggctaggcagtgagacagagagtcgtcaaagacatggaagtacagattatgtatgtatatcttctgaataatcatttctgataatatatattgctgtgatctccagggccggccctgactttttggtggcccggtgcggaaaaaaaataaaggcccccattcaccataaaaaaacaagataatatttaaaaactcattgtcattaacgaatttcaagcctaataccatagtatacatattttggaggcccctaatttttagaggcccattacggtcgcaccgttcgtactgccccagggccggccttggtgatctctatagcagatagctagccagatcgatcgatgcggttggagcttagtactaggagacgtggcccatgcatgcaaagttggccaatgatcaacgatccatgcatgtccggattgttgagttgtgatccaaattcatttacacttaataaaggccagcttctgccgtacggatcatcatcccttttagggttccactatatatatacctcttgtaagccgccgtgcggcgatgtaacctcacctcagatatagtgaaatattttgctggctagcgcccgtggttttttttctcctgttttgagagggttttccacgttaaatctcatgtcttttgtaattgatctattgttttttatcgtttgttcgtctatcgtttcctaacacggatgtccccttatcattggccgacgatatatagaagatctcaacacgacagctagttacactgatcggccatcatctcgattgattgcaaaagatatgcatgcgcacagaggccacttctatccttaattagttaattaacacgaaaaatacgcacttaattagtttttcgatactccctcttttatgaatattgtaagacgttttagattgtgtaagaaaaagaagttttcgatttatcctaaattaagtttcattaatttttaacaagtttatatagaaaaatatagcagcattctcaacacaagacaaatatacaacggaaatattggatttaatgaaacttattcgatgttataaatgttactgcgttttctatgatcttcgtcaaacttgaaccttaaacgactaattataatacggaacggctaatactccatttctctgtttcactatacctatcaatataattttgattgtcactgttttacttttaattagtttgacgaactttcaaatcgtttgttatgatgaacggatatatttattgtctaacatacttcaataatatggtaggttttgaatactcttgaatttatttataagtcagcggtggacaaaataaaacaaagccaatcaaaattagtaaagtattatgaaataagggagtattgtaatatctacagtaatttggtcattactcagacaggaattaatactccctatacgtctaaaaagacttgatttctctaagcaatctaagaaaatttactagtgaagaaaaacaccaaagtgtctcttatttagtattccctccgtttcataatgtaagactttctagcattgtccatatacatatagatgttaatgaatttaaacacatacatatgtctagattcattaacatctaaatgaatatggataatgctagaaagtcttacattgtgaaacggaggaagtattatttgtaggaaagtagtattgccaaatgggtagctaaaggatatatgttgaatggataaaactccacgatttatatggacaagggtaggggataaaaattaattctttttttaacaaatattgaacgcagtaaattaagtcattttgggacagatggagtaataactattttagaagacaatattaatattatttagcagcgtgattaataacgatgtgttcagtggtcttgtgcgcaattagtaaatatttattttagttttcgaaagtgtttatagggataaaatgtacgtgtatatatgttcataggaataagtatgtactccatccgtttcagaatgtaagactttttaacattatccacatacatatagatgttaatgaatataaagacatacatatgtctagattcattaatatctaaatgaatatggacaatgctagaaagttttacattgtgaaacggatgaagtacgtgtgtatatgagcggttttcatctagaaagagtcatgcaatgctagctagctgtttatataatcaacaaaatattgcatacatatagttgtgcgtagtgtaatttgctagtatggaagcacatattatatatacacacacgtactgtcgaaaataattttaatttcctcaatactatactcgatcaattaattgctttactgcggctttagacaagatcagatttcatacaaatatttttttccatatttttattgttagtgacatagtgtaatacatggagggggttctatctctccatctctctcagctgctgtatacatatggtcggcaagcagatcagagagagcagtggcataactaattagttgtcacacgtgtagcacaataatgtggagcaccattgcccactcgtggagaaatcatgttcaagatgaatcaaacacagaagggaccataaaaataaaaaaaaatgaaattaattagaacggggcataatactaattaatgacatagtagtatatataaaaggaaattaacataaggtaaatatataaccatataaagaaatatcatgatcaaattaagcaattaaagtcatatatagtgtattaccacacatttgccaggtcatgaaaccgttctatatacatgaagtatatgtaggtctattatgataattgtagttagtcgtcttggtatgtctatttttcaatagacattatatatttttgagtcgttatcatggtactattcccatcaaaatagtctcttctgactcataaatgcatcaatgcatttttttttaatccatcatatatcaatgcatccggctcagaataatcatcagtgttctttgcttgatacaggagaacttctttgtgaatcacataaaagtgtcaggaaagtggggaaaaaatgtgatgtgtggggactcaaaaatatcaaaattaaattaaagtgtgcgttcacaagttatgattgacaaggttctacaaggaatcaaggaggtaggcctagccaactttttttaatagtgctcctcttttttttcctcctttaatttctatatgattcaataaacaaggggaaatatagtgtactactccagtagtactagtgattaatttggaatcggaatttcactttgcatatactcatattaagtaacaatagaagatcaatgaagtactagtcttggggcaaattcaaatcaaatatcacttcccagaacgtgcagtcatgcaccaagaagttggtaggtcttgattatgatgatgagctctcacttgttgaaacatgcttctcggaaaacaataattagggaaaaagcaaatcctgttgatgtaatactagttgcaaagtagtaatgttatgcgtgtcatcagatcacataagccaatgtacgtagatgatttattatatgaattaacaaaatatatatagtattccctcagttccaaaaataaatatatgtacttctaggattcaaattttataccacaatataaaatttccatttattctcatcatttcaatgtttctaaagccaatcaaatgcttggaaaggaaatctaagcaatttgaaattcaaaaattgataactaaagtgattaaaaaggattttttttacctaacttagtatttgtaaacaacctagaaatctttatattttataatggagggagtaattgctacgtatatatttctacattgaatgatatttaataataataaagatctaaaaatagctctacgattctactattcttaggagactgattaaccaagtgaattacaaatcgagtatatcaaaaactataaaaaggccagcccaacacacagtagaatgaaaatgaagttgcaatgtgttgagagtgccaacctaactaatgtctggaatatttctagcctattcatgaagatcagccaacttttttgacttgcaccaaactgccaagctaacttaattattggaatatatattataatcagcaatcagaaaaaagggggaaacaacaatgtctaccgaatagctagctaggccggtgtgtaattggcttcatatatgtgcatacatatatattgcacaaacgacctatgcttcatacatgaacgttactccatccgtttaaaaatatataacgacctaatataaaatgagacatattctagtaatataaatctgaatagggatttcttagtatcgagatgtatcccatcctgtattacgttgctatattttggaacggagtgaagaataatcaatcaactgagcttacttgcttggtagcttccaactctgtgtgatctcatgattacctttggagctgcagttagctgttggttactaaagaaactaaaggtgcaatataatataatggtacccttaagcttaatctctctcatcatggccgccctcgatctcatggtggcctagctacctttatttctgagactttttcatctctgaatctgccgggaccatgcatatgcatatgcatagaggtgccccaatttctctatctttcggaccatctcatcaaaaggacgttcacagatgatagatcaactgttgtgtaataggtatatttgcaagtttcctttaatttcaattttggcatgatcattacacatgttgagatcgatctagagagagagatggcaggagtctttcagctggcttgagtacgtgaaggcagagctggctggctagctagcttatgttgaattcatcacttttgggctaaccagcattatgcattatgcatatggccatatgggcctgattgatgaaagggccattgcaccttgactgaccgtgagatcgccttttaaatgattatgtgtatatcgatcggccttatattaatatggctatactatagtaatatggtgctactacctctgtaaaaaaaaacttcattattttcctatctcacacataccaatataaagtcaaaagactaaaatgctctccatttttttcgaactccaatacatttgttcctcgcttttttaaatctctaatgtatttgtgtttcacttttccaaactttgatgtattaactgtcttaaaaatgaaggcattatgggacaaatgaaaaaggtaacaataaagtctttgtgtgatggagggactactacatatgttttaaaatacaaattgttgacttttgactattcatcttattaaaaagttaatataaatatgaataagtcatatttgaagtatatttaatgataaaataagtgatatttacatactcccttcatcttaaaatatagcaattctagctatatatacggacatacttttatgcaaatacatatagctaagttatattatatatttcaggatggatatagtagtatttttaataagatgaataatcaaattaatttattatcatcaggagtcaaacacatcatatatttaagagtcctgctccggtgctttctacttggagtagaaagcaatctgagccgttcattatatttaattgtagggttgtgatctatttctactcccaccagagttagtggtagtagaaatgtacaagggtatattcgttcagggataataattcgtgcaggggtattatcataatttatcaatatctaactcatcttcggcgacgccaccgccgtcttccagcactgcgacatcgtcgcacgcttccccctccgcggccagcagaacaccatcaccgcccagtcccgcgccacaggcttctcgttccaggactgcagcatctacgctgacaccgacctcctccgcggtgcccccgccggcagcagtgtggagacctacctcggccggccgtggcatccgatcccgagcagctcgccattctccgacacagtggaaaactaatggctgattccttcgacactatggcaagaacttgccatggagctcaagaacgccctctcaacctcttcagaggcatctctgctaatcaagcacatgacgtactctatcactgatgcatcgcacgtcaacgtgatcctgccatcatcgccggcgaagccaaattcctcttgagacatggcgaggagctcgccgaaaaccaccgtgcaaaggtacaccaatggcaccctcgaaccgtgccccgtcggtggtgtacaccgcgctgtggcccttgccggcgagagacgacgacaccatgctgcagcaatcgcctgtggtgcctgccgtgcccatccaccgaacctgatgtgatgcgaaccgaacaaaacatcccatgccaaaattacccctaaactatattaggagattacttacctgcccttttaaataaacggtcgagattaattctacttgtagtagaatactgcaagtagagtgcaccggagcatcaccctttatttaaaagcagaggtagtcgtagtttttatctagatattaattatattacaacacatttattctgagacacttttgttagacacgtggaggaggataagtctacggttttcatgacaccacaggagtcatcagagcttcactagatggtggctgacactaccaacaaacgacttgaacgtggttcttataccctagaactactatgcttttgaacttcctagtcctagtattgccaaataacctcccaatattctttttttttgaacgatctacctcccaatcttctgaataccttgttcatgtgtatgagccattgatccatagatggtaagtacccacgaaccattattaatttagctagggcatttgtaaataaaatgatttaaatgatgatctgaacattgatgtaaatttacattaggcttttaaaacattcagaattgacaatcgtcttgaaatgatgatatatgtgtgtcgagcaataatgctgattaaattctcatgtctctgtcaccataagatcggtcgacacatccgcatgtgcttctgctttgttcttgtcatgtgtggctctcttccattaattactttgcattgcgtgcatgtatcatatgcttaatcatggctcctagctacagtcgctagtggctggatatctaaatgcaattaacccattcgatatcgatgtgcggctcatttctggagcgtgctcgttgaccaaggtggctagctgaatgcctgaatctgatggcatctcttttgctcaatactccgaataccatcgcaaaaaacagagtctaaaataccattgtataatgtgtcatcgacatatgattcgtattgtgtaactcatgtagtatctctattatatgtgatggtatttttcatatttctttctcttttggtaattagctcaattattcagacttgaataaaaagaactactactttcatcaagcaacatacgatgattacaatatatacacgccattgaaaacattactgctttcatcaagaaacatatatacgatgtttacaagatatacacaacattggagatggcatccatgttgacaaactccctacaaaatcattcgtgaatggaaggagactaccagcaaaaaattaggaagcccacaaagttggccaatgttcaaaataactaaccagcccatgtacatataactgggccggatttggagaaggcccataaacttgtacataaaaaacagtttttgtcactttgggttggtttggttcgtggcctaaataggccttatcaaattttgtcagtgccaaattttagcaagttttagcatgactaattttggtaaggcaaagttgtgtttgtattgaagccaaaatagtttgagttcactattgaaatggcctattttcttaggcatgtcaaattttggcttcaaaccaaatagacactaaacactattgaaattgccaaatattggtaagtctaatttaggcctcaaaccaaaccagccctttggcaatttacagtacaaatataaatttttaatgcgttaataaaattggacaatgttgtctataattttaaatgaactcaatgttctttcatcctatttgaaatacagtaatttcactaaaatagtatagttttcgtaaaaaaaaatagtaagagagatttctcgcgctccaaacattcaaatacagcatgattgtatctcgtcgtggaattgccagtatatgcattattgcatacacgttcaaatacaacatgatttgtattgtcagagcccaggtatatgcatgattaaccactacggagtactatactagtagtgaatagtatctggtccaaattaatagttcctctctgatctgggtctcagatgtgatgaactatactaacatgcaattagcgtatactaatcgctggaacctggaagcgcgcgctcatgcatgttcaaatgttctttgttgcgtacatgcgagcgagtggcttttctttataggaggacgaataacatatgccaaaaactttagtttttctttgaaactttgtccctcttctcaaattaaagttggcatgaaggggaaaaatgtcaattgtcaaaggcatttatacattaaattacaatatactccctccccgttccttttacttacaccagacacagttcatgtagagtaccaactttaatagcttatacttttttagaaagaaaagttacaatatgtcgaagatgtcatattatcagaatacttttattataaatataactatttagttcgtcaaaacatcacaacttaaaagtcttcaatgttctaaaataatacttccttcattctaaaatataatatttttaagctactcctattaatctagataagtgtaatgtccaaattcatagataaaaaataaatatataataacggatacaattcacgggtgcatgtggcagctagggatgcaaatggaccgacacgcgaacccatttataggtcagataagtgagtgacccaccggttcccatatatcgtggcagcttgccgtacctgaggatgcaagtggttcgacccgtgaacccacttatagattaattaattctaagtaaacaacatgtcaattcgtggcccgtgggttacccactgattttcggcctcgtattttcgtttatgcttatgcttatcagctaaattttgaattttcaaacttaaatttgaatctgattttgaggttcactcatcgaagtttattatttaggcattgcttttagatcactaataacacgtatataaaagttttattcataaattagttttcgcttgtaaatatgttattcggcatatttcaccaataagccaaacaataggatcctttacctgtaagtaggttcgtgggtctagcaacatcaaatcatcaaaaaccgtcgagttcagctgtgcgtcaacacgacacgtgtcacaagaagggccgtggcgtctgacgctgacaggtggggccagaaaggggtgcatgacgcagaacctgctggaagtatgcggaccgtctgtttcttgtgatgaacggccgagattgattgacgctgcctcgcatcgcggatcatgtctgctggtctccgtccgttcctgatctgtggacggccgggatctctccccacaaaatctgcacacgacgatcgtatcacagtggaattatttcttccaaatttttttccaaatcactttccaatcatcatcgcgtgcgccaatccgaaccaaatcacgcagagactgacaagactagctatgaatgacaaagctatgctacagattagccgtttctgaatctgcgatgctaatgatcttccaaagaagaaatctacgtacagaagtgctaatgattgtgagcagtgcagcagcagggctttttaggcgaaactgaagatcttatctacactgcattattacttgactctctctaatatacatctttaatttgcactcttttgactgcacagtaaccgctaagaacggatgctgggattaatccaaactaatccacatcaacctgcaccaatcatgccatcgagatcacaacagcatcttgcattgcaagcattcttcctgctgaatttcggaactgtcacattcagaatgatgttcagaagtttgatcgttaaaccatagaacagcgtataagcaaccacaaaatagtttgtgggcaaaacttcaatatctgtgctattcgtggtttaaaagaaaatgctagaaagaaactacaatgagaaagccacaaagtcaatttcaaaattcaaattctgacaatggcttataagctgaaaagcaaacaatgacattgcagaaattcagtcaaacaaaacttaagagagagagggagagaaatattcagaaatagtattttagtgcattcttgccacaaatgtagaagtattcaattaacaggtgatctttctactctcctctaatccatggctaataaaatgcagagaaggaaagaaacaggtgatcacatcacatggtctcatcagaaggtcaggattgggagcatgatggcatagcttctgcatgcccaatcgcccatgctgcaaccgcacataaagatccccttttttctccttggcatttgtgttgcatttgtgtgtcttttcattcattcccacaccacccaacaccaccacaccacatttacattacattacaaccaaaagcttcattaaggtcattagtgttaaactaatcatggggtaatggagcctaaagcttaagctgtcttgctcaaaaacaacaagtttttagcttagctaggcatagtgacaacacactcactcccctcatttcatcaaacaccttcttcttcttcttcttctccaatggaagctagtgcagccaaggagaaagacaaggatggcaagaagatgagcagggttggaagctggggatccatggcgttctactcctcgtcttcttcctccagaagccaaccagtgtctgcagcagaaggcaagaatggtggcaagaaggagaagaggaggagcagcatcagcaggagcatcacgtgtgccggatcgatctgcagcaccaaggagagttcggtgtcgagcagggggagaggccggcgccgccggagcggcggcggcggcggcggcgatggcggcggcggagggagcacgtcgagcaggtcgctgatgggtcccgggtaccacggcgactccgcggcggctgtctccgcgtcgtcgtcgttcaactctgtgatgacggcggcgacatccgccaccgcgaccaccaccaccaccaccaccagctcgtcggcaacctcgccgccgtcggcgctgtcctcgccgctgtcatccatcggcggctcgttcagggcgatgcagatcaggaagctctccggctgctacctccactgccactcggtgctcgacccgcgcaccctcgccgccgtcgtcttctcctgccccgactgcgacgaggtgttcgtcaagcccgactccctcgagctccatagatcaaccagacacgcaggtatcatcgcatcaccatctcaaaaccatcaaaatttcccacagtatattcgctcgtttcgtacatgccacctaaatagtcataaaaaaatttaaaaaaaatttggcaacattgattaatatgaaatatatcactccactaatatacaattttaaatttaacttctacaagttataataaaaataacaaatatagctaatatagctgcgagtgtatagtaactatttttagtttaatttatttttttcaacttgtagaaaatgaatttggttttacatgtttgtggatgatatatttcgtattaatctattaaactttttaaaaaatttaataactatttagaataacatggaaataacgagaggatgtctctcgagagatagaaaatccacatcccactgaatcttctcatctaaaaactaacaatccatccattgattcgattgggattgcagtttcagagctcggggcggacgacacgagcaggaacatcgtggagatcatcttccagtcgagctggctgaagaagaacgcgccggtgtgcaggatcgagaggatactcaaggtgcagagctcggacaagaccatcaagaggttcgagcagcacaaggaggcggtgaaggagaaggcgaggagcgccggcgacgaggccgggaggaaccccaggtgcgtcgccgacggcaacgagctcctcaggttccactgcaccaccttcgcctgctccctcggcctcgccggcggcaccgccctctgctgcgcctcctcgtcgccgccgccgctgcactgcaagctctgcagcatcatcaaagacggattcaggtaactcgaccaagatgttcagagcccataattctttttttcacaaattcatactacctccgtttcaaaatgcttgatgtctttaatttttgtataacgtttgactgttcatattatttaaaaatttagtatagatatataaaagtatatgttaagattatagtttctttaataacaaaacaaaatacataatatctatataattcttagacgaatgttcagatgttatatgaaaagtcaacggtatcataggatggatggagtatttcgtaataggttaatgtgtattttactgacaatatggatccgatcccacacgtcagtgagacaatgggtgtcatttaaaagatttatgaagaacattttgttgaattataagttgtttggtttgattgatgaacaaaaaaaaaattcatcagggtggatggcaatgggaggatcacgacgatggcgacgagcgggcgggcgcacgacacggcggaggtttcgccggacggcgagaagagggcgatgctggtgtgcagggtggtcgccggcagagtgaagaagctccacagcagcaattcttcagaggatcatgactgtgactctgtcagcccctgctcagaaggggtttactcagatttggatgaactgttcgtgttcagtcccagagctatacttccttgctttgttgtcatatacagtggctactagatcaaagaaaaccagtagaatagcttgattttgccactgttcttaatctagtttctttctctgttgtaggttgtagtatgtttacttacttcatgttcatcaagtcagatcataatgcaaaaatggaaaaaaaaaaactgcctgcaaagtgcaaatctttctcttgtgtcacagttgctctcaagtgtcattcaaatttgacatgtttgaaaagcaggtacaagatgggaacaaggccatgagatagacaccaaaaacagtgattttgcttgcttccaagatctaacagaagtacaaaaccattgtcaatgcagagtttttgtccatgtgtgctgagcaaacattagatgcttacacccatgaacactttgggttcttggaagaagcatctacttagacaaaaggctaagaacaaacagctactttggaagaagcaatgaactgctaaatgttatactattcctaccctgcatccagctacatccaactcaatatattactaaatgcaagtatagtacagatccctagcaaatgctgcttcttaattgtgcagctctacaaatataaattcctctaaccaatataggttaagagctaagcagtagaggcgatggtgattatacctgtattttagtcaatcatattctgaggttgtctgcttgtggacgacaagttgcacaaactgattccaaacaaagagagcacacattcaccagattcaagattgttcatcaacaatttgttaatctagcattatcgtggcctctgatctgttcactgcaaaactggacaaacgtcaacagacaattttacagcaagaatgtcatttgtcacgaaagcttaaagaagatcagtgtcctcaagttgcctgtttttgttcgtttggattcagcaaacaacgtgcttcgaacgctatgtcaggatgtgccatgatttgtttaaagaagtcaagtctgcagtagatctaaaattgattgtcttacctagttatctgcaatttcacatcaattggttcaggaacttgcatcagctagtgcttaactagttgtcttttgccgtacaattgtttgtcacaactcacaaaattaccatatgccatggattattgagctaagatgcctggtattgcaggctacattggataccagtgggtatcaaaattcctagtggtgaaaaaaaaatcgacatccttgtgagttgggaaatttggtcagatgaggagtacagcatattagcccaactcttaatctaagaaaaaacagattttgaggctataaatgtaccattaaaagtctaaaattgccaggtcaaccacattctagagtgacgtggcatgacacgtgtcgaatcaaaaggagtctcagatccacgggaaaatttgcaataatttgtatatatatataggctgtgttataaattttttttatcacacaaatatagataattagataaaatagataggttgagtgactgtcttgctcatgtatactgggttacagaataaaaactgagggccagaaagatcgcaacacaaaaatgtcagcaacgctcaatgatgatgaggccagcaagatcctcctctcaccagagcctgactaaacacaatcaccatccatggagcacgccggccgattgctgaaaaatcaaactctgcttcagaaacaaacggtagcataaattgtaaccatataactgaaatgtgtttcttcagtatttcttatagcaatgtaacagcattttgtccttataagctgttacttccttcgtttcataatacaagtctttttaacattgcgcacattcatatagatattaatgaatctagatatatgtgtgtctaaattcattaacaacatattcatatgtctagattcattaacatatatataaatacgacttacattatgaaacggaggaagtacgttattgctataagaactactgaagaaatgctacatataagagcaggtacaatagcagcctattagccagctataaacatattttaatgagataaaagatgagagagagcagcggactacagatctgtaaccagctacagcatggactccaagacgcagtgtgtgtatgactggtgggactatatattaatagtatagcaagcaactattgtataaattggctattagattggctataaataaattggagctaacagtggactatctaaaatgtcaacaccccccctccccccccccaagcaagtacagttctaaattattgaaagctccaaaatccaaatgatatattatcaagaaggcgtggtggttttacaatgcgccagtgatttgtcatttcaacagcagtacaagaacctcaagcacaactgatgcaggtaatcaacctgagcagacggtatcagggttaacattcggaagaaacctccaaaatttcggtgggtcatggtgaatgttctaccggctgaaaaaaacattagtagcaaaatatgcccaaaattcgttacggaatttcggtgacccacggtattgttaagtatcggatatcataaattaactgtatgtcccctcagatttgcttgaactacctagattgtgtttttgcaacacatttccaacttcactccctcgtttttcaagcgtacgtttttcaaacagttaaacagtactacctccgtcctaaaatacttgttgctttaagttcttgtttgtaacgtttaatcatttgtcttattcaaaaaattatgaaattattatttattttatttatgacttgctttattatcaaaagtacttttaagtatgatttaagttttttcctaacgttgaacattagtcttattcaaaagatgatttaagtttttttctaacgttgaacattagtattattcaaaagattatgaaattattatttattttgtttgtgacttactttattatcaaaagtacttttaagtatgacttatcttttttatatttgcactaatttttttaaataagacgaatggtcaacgttagaagaaaaaagttaaatggcatctaatttgggacgggagtagtattttttaaaaaaaaagtttctatagaaaagttgttttaaaaaaatcatattaatctatttttcaagtttttaattaatttaattaatcatgcgctaatgaatactaaggaacctcaactaaggaacactacccatttcaaaacatatgatttatgtaagtttttcaaaaaagtatttgaaaaacgtgtacattttagaatggaaggagtggcaatttactagtagtaaagatacaataaatatttcttcgtaaacacaacctttcccaatcataacaaaatcgaggtgcaacccgtaagatttttcttttttaaaaaaaatttgcacctctcctgtcgcggaactgcttacggcaacatcatatctctcggtgtgccgacatcaccggagcagtaaccacctccgccggcggcgccgacaccgacggcttcgacggggagacaccggcctccacccgtccatcctccgcttccttgtgcgttgccggcgatggagaagacggcggctgcccctgcatctgctgctgctgccgcaggaggcgccggaggtgaggcggggcgtaaaacctatcattggagctgaacacgaagcagcagcaggaggaggaggaggaggagggtgggtcggccatggcggtagggctacgaggctgcggatgatggggttagggtttccgagggttgtggggttgaagcgacgtggtggcgatcggtttttttttttcagagagagagagagatggcgatcgagttgggtccaggtttccaaaccgccgggccagggttaccacgccccgacagtaaacacggttatcgcgcggtaaccgcggtaaccgtgaaaaaccgtacaaaaccatgcaaatttcatcaaaaatttaaattattttttaaatttatttgaatttaaggaggttaccgcggtatttacgttaccgtatccccgcggtaagctcggtaaccacggtaaccacgcggttacgggcggtatgatgaaccctgacttgggtcgctacaatttctagcggtcaagattaaatgggctgggctagttgtccgcataatgggccagacacggcggtcaaggcccaatctgtcagaaactgatgggctgggcccaatctagtacacgatgttgcatggcctttttctgacgaaaatcgtcaaggttattggagagtaatgtaaagcagtgatcaggaaacataaagaaactgatgatgatagcacatttgcactgttgaacatattgatattcaggaagctggaagatcacatccaaatgatcattgcatgtgttagggacgcgcacgcgtgtgtatgcgtgtgttgtggtgtgagtgtggtgtgtgttagtgtgcatcctgagttatacccttttaaaaaaatgatcatggcatgaacatgttgaaaaattgcacgaagaaattggatgagctctgcaggaaaatttggctggatgaggctatcattcgccaatcttcgctaattttaatcattagtaattaattagtgataattaatatatggtgcaaacaagacgtcatgatcatacgtacaacatccgtccaaaaaagacaacttctagaaatgaatctggacatatgtttattcagattcatccccagaagttagtattttataggacagaaggagtaggtggttttcctctaaaacaatatttttacgcagctcttttaagggtgtgtttagatcccaaaaaattttggtcaaaaatgtcatatcaaatgtttagacacatctatgaagcattaaatgtagacggaaaaaaccaattacacagtttacatgcaaattacgagacgaatcttttgagactaattgcgccatgatctgacaatatgatactatagtaaacatttgctaatgacgaattatttagacttaataaatgtctcgcagtttacaggtaaaatctgtaatttgctttgttattagtgtacgtttaatagaaagaactaaacacggcctaagtaagcatagaaagtttgtgtttttgtccagcaaaagaaaaggtaggagtctgtatgtgaattggtgataaacaaattcttgaaagtaagaatgcaaaagatgaaaaattatcgaaagtagaatacagaaagaaagacaaaaaaaaaaattgggggtctgtcagaccacctctgcgccaccctgcactggtaccaccagtcaggaacgatcctctacagccgtcagatggttccttccagagatccatccaagccgttaatcacgctctggcccagaggtcatggacccatcaaccagactagagtgcttgcctccttattggtaaaggatgcaacggtacgagcctatagaacagatcctgttcaagtaaggtcgtgccccaagcctccaagctccagtttataagtagctcccgctccaccaaaactggcgaggtggtactaatcgacagcgcttgacctgcatacatttcgctggtagcataatgggcccagcccatctaaatcatctgcgagttattgaagtccacaatcacattcccaccgaaccacgtgtgctgtctgcactgtttattctgagattaagcttgaaagcaaacgttgtatggttccaattaaacaactccaagcaatatagagttttttttagataaaaacaataaagagatttgagctgcttacttatgggaaaataatactatttcaggttcaacaatgcatattttcgagtagaaactagtagcagataacttccatgtctgctgttatactaaggtcctctttgtttaggcttataagccaacttataaatcaaaaagtctaagccaaaacaaacaagcagctttttcatttggcttttttgaagccataaaccactctaacactattaagccaaaagctaggttggaaaagcttttttggcttatatgagatagatgtatgactccaccactaaacttaggacattaaatccactggcttataaatcatataagccaataagctgacttaaaagtctagtccaataagcctaagtctaaacaaagagggcctaaatcaaaggttacgagagaagcataatgctttgccagtttgtttcctggccggtgtgtactgcaaaacattcatgaactatcccatgcttttgctctcaagaaacatgcaggattgcaggttacctagaacatgagaatattcagttgcctttgccaattttttttaattgtggatgacatgatactgtgggagtagtagaacgacctgctgtatgtaaaggatgcaactttggaaacttatgtaacagatcaacaacaccagaagttcagttgtgagcagaaattcagatccatggttatgcaaaaaaaaaaaagttacatatgacaactgtcaaagatgcagaataattctatccaaactgtcacagctcacaagctgccttgggggagcactattaacctgctccaagcctccaactgcatatttgaattcagtgtgaactatgaaatggcaatcatgcagataactatatttcatcagtgttgttacccataccctgagactaggagaggaaaaaagagcacaccttcatacaaaagatataatcaacggtggaaaatgaggccaaatgaattgttcaaatactttgttgttggaatcaaaccaaacaacagtcataccatatagtattattagttagtgaactatatgcaacaagtaactctaccgaacatgttcaggtttctgcatattgagcaccagagacgcaaattggcatgcctgcatccaagcccaacaatccaaatgctcatgacacaacaaacataaaagagtacatgcttagtcagcgccagcaatcataatgttaatattataccatattccatttcctaagctcaaatacagatgtcaagaatatttcggtgaactgaacatcgcatcctaacgcatttcacttgtattacttgagcttaagtctaagaatcagtaacatcgtttgcacatctcaaattactaactgggaactcctcttaaaaacagagagatattgaagggggtaaaccctttctacaactctacagcaatatcacctagtgagagagaacagatcaacagcaatgccctgcgcctggaatgcattagcagtttagcactagcccgactactaatgaactccatacatacagcaaaaaccaaataaatagccgctgttattatagtaaagaaataaacttattgcagttcatatgatcaaaggctcaaagcaaacaggcaattagtaggtctttgatgctttccattgtcaatattgcttctttctattcatttcctttctttcccctttttcggtagaacattaagacaaacaatgacagggacgatcacaagtgactctttaatcgcttttcattctaaccatatttggttaaataaacatcaacttaggtatgtgactatatgaaatatcaattaatggactctttcaaaaccaagggacacatcaagacacaaatcattgcaatttatgctgctgagaattccataagatagtagttgtagtaaggaacatcaaattaatatatgttcggtaagaaatgcataaaacaagtcaatacataatcgcctgctaaaatccattactagtagtagatagcacactacaccatgttcttttcatcaaccgcacacataaatgtgaaatatattaattcatcagctatatgcaaaaacaataacataagacaagataacttacaatacagaactggctacatactaaaccaatgcttttccaagccacaagagtcgacctttacgcattgcaaggtttagtagacttcaatgaaattccagtgacaaactcatgagaaaaatgaactcttttatcaccactgcagaaaatcttacaagatgtaatgcaatcagaatcattttgacaggagcagtacatcaggcttccgctgcttgcctggtgtgtttggcttggagctgggtctagagctcgacgcggtgctaccagctgtgcctactgacacgattgccccagaagctgctgcagctgcctccttggcagccttgcgtgcgcttttgtcgagctcgatcaagctacgggacgccaagatagcctgtggcacaagctcatgacacgcgcgggcatagacaacccgcacagcttctgcggcggtatcccgcacctccgtcggattcagcggagctaacaggcagtgaccaagaactctcatcactggctgtagaagctcccatggaagtggcaccctcccctctctctcgccacaattccgaccattggtgtctccgttgacgcgcatctttgccatttcctcctccaaggccttcccgttctcggcctccgatgacaatggcgaaacggaccccaatgaatcagcctcctcctcttccaactccttctcatcaagctcaaatcggcacttgcagtactgccccgcccacgccgccacggcgttgcaagcatccaccttcgatgcaggcggcatctgcgaaatcttggcatagtacgcctcgaaggcaactccgataatccccgcgcgcttggtcgacttcaccgccgcctgtggctcaagcggcggcgatagcaccccgaccacaacattccccgcgggtggggggatcggcggcggctgtggccggcgaggggacttcgagctggggctggacagcggcgtgtggtagagggaagggacggagaggtcgggtacctggacaaggacgggcttgccctggcgattcttggcctcggaggagtagacggcgaggaggacggcctcgaagccggagagcgaggaggggagcgcgggcggcaggcggaggaggtagagcgacgagaggagcgggaggaacgcgagcgcggcgaggcggaggtcggggtccggggacagcagcgtatcgtagagccagtggcaggccgggtcgtcggcgccgccccccgaccggagcgccgcggacagcgcgacgtacgcggcggacgaccggagcagcgcgcgcgccgggcggtcggagtcggcgagcgccgcgacgtcggaatcggccggcgccgggaggatggacgacagcgccaggatgcgggacctcgcctgcgagaccgactcccaccaggacggggtggggtcggatgcggacgccgccgaagagttcgacggcgaggccgccccggcggcggacggggacggaggcatcgccggcggcgagagagagaggaaagcgagatgagatttgggcgatctctctccacagctctcgaatcgagggacctttctgcgtctcgcctacttctccatgggctcttttgtaaataaaccacaagcccgaggtgttattactagtactactagtaggtggtagttgaccatttctttttcttttcattttttttgagagagaaaaatagtgagacgtggcagttgactggttcacacgtcgacgtcgtcgtcgtcatcacgtcgctgcaccgagcggccgcatgcgcacccatgccgcggtgctgggcacgccggcgtggagcacgaaccagaggtagtaccccggcggcgccaccgacggcgacggcggcgcggccacctgcgcctcgtacagcccggcggccagctgcgcgacggtgcccacggccagggacaccaccctctggttcatcccgaaggagtgcgtcgcgaacgccggcgccacggccgccacgcgcacctcctcggggccaccggagaccgcgccgccgggcacctcgaacctcaccgccgccgcctccccgtacccgacctccgacggcgccgccaccagccgcggccgcacgccgtcgagccgtgcgtcgaagtatggtggtaggaacgcctccaggctgagctctgtcgggtacgtcacgttgtcgaacacgtagccgacgtgcgggttgctgccgccgacgagcacgcggccgagcgtgtccagcgtcgccgacgagtggtacatcctcgggatggttgacgcggcgagcacctcgaaccgcgcgccgagctgcatgtccggcttgtacagcaccgggtaggtgaccggctcgcgcccgagctcccaccccgccgtgccggccgccgcgccgttgacgatgagcacgtcgccggtggggagcagcaccatgtcgcccatggcgcgcggcagcggcatctcctccatcgcccacaccgggttcgcgtcggtcggcgcgatccggccgcaggtccggtcggccggggcgaacgtgccgttgcggagggcgaggcggtacgcgccgcgcggcgcgccgccgcagacgagcacctcggcgtgcgacggcgagtccggccggagcgggaggaggacggaggatcccgacgacgggtagttcctcggcacgccgccggggatggcggggaggcggcggagcggggcgcggttgtaggggtcgaacacgacggcgcggtcgttggcgaagacgaagacggtggcgtcggggaggaggtggaggaacgggtagaggttgtcctcggcgtccatgtcggtcgtctcctccaagaacgggaacaaggtcggctgcggcgccggcgcgtcgtcgtgggggaagaactcgaagttgaactgccgccggccgccgaggatgagcacgcggccgtcggcgaggaggatgtcggtggcgtaccaccgccggacggccaagaacgacgggagatcgacccaccccgtcgacggcgagaagaggcgcgcgatgcggtcgccattggagaacccaccggtctgcagcagcgtgccattggggagcagcgccgcggacgaacaccatgggttggtggcgagcgggtacggccgcagggcgttcgaccggaggtcgagcagcaccgagtgcgcggtgcagtcaacggcgccgccgccgccggcggcgagggcggtggtcgccgcggcggcgcacggcgagagcgcgtcgagggagatgttggaggggccggagtcggtgcggtcgaacatgaggacgtagtcgccggggagcagctgcatgtgcatcgccgagacgccggtgttctggtgcaggagctgccactcgccggcgaggacgacggctggctgctgggccacctcgggctcctgccatgggtcgccgccgatggcgtcaccggcggcgccatgggcaatgtagatggtgatcaggaggaggaggaggaggagggagaggaaaggtgatgcctttggcatggttgctctgcatgcatgtagattgatctttaagctgtctgatgcacggcattgctgtgatgtgatgcacaagggtttgtacaaaagtgtggtgagttttttggtacaagtttggtttgaggaggttgaagggaattcacatttgatggttaaaccttcaaactttaaaattcagtttaggttatcaaatagttttgtggctccgctctgtttaattgctacgcctatgttaatctgatcgaaaactatatttgtgttttcacatcatggtctaagtactaaaacaggaagatgagcaaataattgttgtgtttagttccacgctaaaattaaaagtttaaagaaattggaacgatgtgacagaaaagttagaatctaaacaaggccaatgacacaattcgatgatatttaattgttgtcgtttacgttagtttatttttctcatgggataattttcttagaggcagtggcatttccagcaggatttcctttggttggtttggagttagcattggaaaagagagagccaatctcttgacatcacgccctattgatgaaagggatttgtggtttctagtaggtagaaattacatttaggagaccggtgataagaacaataagataaagggatttgatgtttgctcttatttagttccaaactttttctttaaacttttaactttttcatcacacaaaatttttctacacacacaaacttccaactttttcgtcacatcatttcaatttcaaccaaacttttaattttggcgtgaactaaacacaccctttgtcactctattagtcgagtttcttgccattatgtttgttttattgggcccgcttcaataatcgggtcgaatacatttgctactaaacttgtaactaaaaaagcaccttgtgtctcaattgttttatcgatacacgtctaatccagtttgaactataaattctcatatcgatggtttcctctccacatggtttcttaaggacacgtttaaatcttaagtaagaaaaattctactcctactttgctaaggcacgagaggcatttggtacaaatggaaaaaaacagagcttttaaggcaagccgcacataaccgcctcaaaatccttgcccaccaaggatgatcgactctcctccgttgataagcaatggacgcgggcggttttctttaaacaaccgtaaaaccaaatgaacgctcctgccataggttatagccaaacgtggctgccttagcaatagcgatccatatgatttgtgtgttggtgatatatgttcatgtttacagagctgctcattatgtagtatgttgtgataaaggatataaaaaaacaatgttataggcaatttgcaccatttatagtttttttcttgag

SEQ ID NO: 72310 - DNA, 663 bp, Oryza sativa
gcaatagcattgcaactaatagttttaggaaccgaaaaataaatggtaacagaaataagcgatctagtgaatatccctccgttggattgtgaggcagaattgcctccgttggtgttgtcgatcgaagcgccgcctcctgctccgggtgcacctccagtagaagccatagcgacgacgacgatgagcagaggaagtagcaagagcagtcgtggggaagcactccccaaaaacctgatcacccgcctacccgtgcagatctcaggcaagggtgtggttccggaggccctgctcgtcccaatcacttgtgcgtgcaagcgattagaaccggggaagaacagaagcaacataggcacagaggatgaaccagcaatggagagaattcgtggagagcctattcgtgtgtcgctgtctcgtcctaatagcgcaaggagagagaggattcgcatccgttgccgcagtaacgatgcgatcaatcagaattgattcccccacccatcacagaggtaatctcgtgaattgaattctcagcacagaggatgaaccagcaatggagagaattcgtggagagcctgttcgtgtgtcgctgtctcgtcctaatagcgcagggagagagaggattcgcatccgttgccgcagtaatgatgcgatcaatgggctgcagga

SEQ ID NO: 72311 - DNA, 39787 bp, Oryza sativa
cttgtccgatatattattcttactttaatatcctgatatagagtagtatcggagtattagctgatacatgctagatctatctgatcggctatactataaacatatatagtcttgttattgacatatattttaatttaagtgatttatactgtctcggcatggtgaccgatctatcccaatcacttgatttaagtatatattgatataagaagtatatatcattagtcgatcgagtagatttagttcttctttacttgttcatgactgctgatcgatgcacagatgacatcggcttaaagataaatgatatgtcatcggcatctagccgatcggctatcatttatagatttaaccacggtttctttgcttctagttcttgatgattacaggatcaaatcagctagcacgctaacacatctgaatgcgagctttggacctgcactagagttaagcagatctctcagaccacgtgttttctgtcaacatccctctgtttcagattataagacgttttaattttggttaaagtcaaactactctaagtttgaataactctatagataaaaagtagtaatatttacaacaccaacatagtttcatttgagtaactccataattgataatatttcataatttattagtttagggttaaaaatattactatttttttttacaaaattggtcaaacttagagtagtttgactttgataaaatatcttataacctaaaacggagggagtagctaatacgtgtataatattttttatacatgtattaactgccaaaaaaaatatagggacgaatgaggttttatgaaatatttatcctaaaacctgtgattctttgaaacaagttataaacacatgctacaaatttagctggacggtttctagccaaaaattattaagtccatatcttttaacaaacccgctccaaaattgatagaaacctgggagagttctttttcctcattgatagaggcttgtttccatgacagcgtcttctgaatatagtattagcacttgaaagaaaattctacagcagagaacagctcaccgatatacaaaaccagagattatgcactaaaatatgtagtaacaaaatagattcgagcgtcatgggcggcaggcctctgcaaggctgcaatgaacctgtagctgtcggcgttgcctttctttggttcttcgcgaaacagaaaacggacatgtactacatgcctagcacgttgcattagttcttagtcaagtggcagttccattctcttctttcggcgtcatgacctctttataagtggacacatgtacagtacttataagttcaaagcattcatttaatcttttattttttactccatccatttattctaaataagtttatttataagtaatcatcacattagagtaaataaaggtacaaaataaatgcattgaaagtaaataaaaaattttttatagtgggatttgataaaatagatatattctagtcagtttggttttatattggtatgtgtaggatgtgtgaaaaataaacttattttgggacggatggaatttttttaataatataccatcaataactataaaattaacgtcatattttcaaattatcacgctacaataaacatagatgttacattaaatactccctccaattttttgaatctacattaaaagatgattgtagtattagttaaaagttacggatatttattaaatgccatgcacttactcctagataagtattaaggcatactattgtatgggttctttttttacatgaaatactattgtatgggttcttttttttacatgaagtacatttgataacatgaaagagagaagagaggaaagggaaacctcgttactatatttgatattagcttagaatcgagtcttagcatttactaatactaaaaagaatttggttgcatggagtgaaaaaaaaaaagataataccaaatattttgatacaataatagataagaaattttgttgtctcaactattaaaaagatagttgtattaacaagagcatatattggaatttacccatgtccatgcccttatctagataaataagcaggagtattttcatttcccaaatttgtctgacccatttggccagttcaatccaaaaaccaagtgtccaaaatggaatggatccgtgccattgttgccttaatgccgtcctcaggcgattttctccgttgtacacgccctgattacacgggtggcaaaaaatagcctgattcttctcttcttccttttcactgtgctccatatgccctcaatatcctatcaaatccaataaatacccttgacacactaagaatcgaattataatatttacatttctgcccctcacagggctcaactgaaattacagaaaattgtcgaagggatcaagcgaaaggcttcttttatgtggaaaatggaataaaagtctcggattaaagaagcaattgccgtttcagacgagggtggcagccatataatttgcttgcgccaaaaccaaacatagagcagcaatagagaggaggagagggagatgatggcccatctccttctcctccatccacctgccagctcgaagatttctgtctgaatcgatcggatcaagatcaaatcaaggagggaggaggttgagcaattcctgacagggacagatcgggaaagctctcacagctttttctttgtttttgtttgatttgttcctgcttttcgattggaaaattgggaggggaggaaggtgatagccattgaggtggtggcatttgctgtcaccacctttagctatcgccttcctcttcctcgtctcgctcgccccccggtctagcttctttctgcaggtattcaatcgatcgagcaatcagttattttcgtttttgttcttgttttttcttttttatcatggaagctctctgttcatctgattttggtagtgaatctttaatttgtttgtatggcacgattcacccataaatcaatcgataattttgatacgattcagagagtgattgatttactgcactggtttcatccagggaagaggggaataaaattactctttttgcaaaaaaaaaatctgaaaatagggaaaataatccagcaaaatcgcatgtaattttgatgtttgttcatcgtttcaaactatacgtattaggagaaaccaatctctactgctcctggctgattttgtgatgaaaaatggccagtttcctctaaaacaatgaccaaatttgacaccctcttgttcttgaagggccggacggaaaaaacaaaacaaaagaaggcaccagccagccatggcgatggtgctggactccttcgtcacccggtgcacggcgtcgctggaggacttcgccgggcaggaggcgtgcggcgccctcggcatcggggacgacgtgcggtgcctcctggccacgctccggcgcgtccaggccgtcgtctcccacgaggagcgccgcggcagggtgctgagcgccaaggtggacgcctgggtggcgcaggtgaaggacgcgatgtacgagaccgacgacgtcctcgacgtctccatggtcgagggcggcaagatgctcgccgagggggacagcccgccgacgcccaaggcgcgctgctccctcatgttctcctgcttcaagcctgcatccgcccccaagttccaccacgagatcggcttcaccttcagggagatcgacgccaagctgagggagatcgaggaggaaatgcccaggctccccgcaggatctttgcactctgaatcaagaagggattggttcagtagaggcatctgcagtaacttctctgacgccattaggccactcgcggttgggacacaggttcagaaatctctggatggccttgtgcctaggatgattagagagggcaagaagaaggtggatgtcttggccatcgtcggcgcagtggggatcggcaagacaatgcttgctagggagatttacaacgacgagaggatgaccgaaacatttccaattcgtgtgtgggtgaagatgacaaaggatttgacagatgtggatttcttgaagaagatcatcatcggtgccggtggtggtgtcaatgttggtgagattgagagcaagaaggagctccttggaatcgtcagttctactctttcgaagaggtttctcattgtattggatgacttggacaacccaggtatatgggatgatctgctcaaagatccactgggagatggtgtggcccgaggcagaatactaatcacaacacggagcgaggaagtggcaacaggcatgaaggccatggtccaccgcgtcgacaaaatggatgcagagaatggctgggcattgttgtgcaggcagtctctcccagagtgcagttcagaagagctcgcgtcactgaaggatgttgggatcaagattgtggagagatgtgatggccatcctctagcaatcaagatggttgctggtgtcctaaggtctagaggcaagagcaaggctgagtgggagatggttatgagaagtgatgtttggtccatgcggccaatcattcctgagctgcctcaagctctctacttgagttatgttgatctgccttctgaattaaaggagtgcttcctccattgctctttgtatccagaagaattacccattcagaggtttggtcttatccgacgttggatagctgaaggccttgtaagtgacaaagacaataagttgctagaagattctgctgaagagtactatgcagaattggtaagcagaaacctgttacagctttatgctggtaatcttgatcagtgctggataacgcatgatcttcttcgctcactagcacgctttctgataacagatgagagtatcttaatcagcggccaacagagattgagcacagacccattgtcattgtcaaagccacgacacctgacattgtgcaacatggaaaacagatttgatgatccaatttcagtaaagcagcagatgagcctaaggtcattgatgctcttcaatagcccaaatgtcagatcaatagataatctcgtcgagtcagcatcatgcttgcgtgtcttggatctgagcaagacagcattaggtgctctcccaaaatccattggtaacctgcttcatttgaggtacctcaatcttgatgaaactcaggtcagagacataccctcttccattggctttcttataaacttggagactttgagccttcagaattgccagagattgcagagacttccttggaccgtcagggcattgctacagcttagatgcctttcgctcacaggaacttctcttagtcatgtaccaaagggtgttggtgatttgaagaatctgaactatcttgctggtttaatcattagtcacgacaacggtggacctgagggttgtgatttaaatgacctacagactttgtcagaattaaggcaccttcacatagagaacctggatagagctacttcaggcgcttctgcacttgcaaacaagccattcctcaaggatctacacctctgtgaacaggcaccattgatagaggagcagcaatctgaacaagaacaagagaatcaagatgaccaaaaggaaacagaggaagaagagaaggaagtacttgatgtaaccaatagccaatttagtagagaggaatcaatcaaagcgagcgaaaagatatggaacgaactcaccccaccccagaacattgagaaactagtaattaagaactaccgaggtggaaagtttccaaactggttgacaggtccaaagctgggcatatcattccctagtcttgtgtacttggatatcgacaactgcatgtcatgcacggcactgcctgctcttggcctcctaaaccaactccagtccttgcaaatctcgaatgcagactcagtcgtcaccattggtcctgaattcctcggtgctgcttcatcatcatcggccactgcttccttccccaagcttgagatattaaagctcagaaacatgaagaaattggaagagtggtcattagccgtggaagagaatcagatattgttaccatgtcttaaatcactgcacatacagttctgccccaaacttaaagctctaccagaaggactgaagaatgtttcgctgcgtgagcttcatgtcgagggtgcatatagcctaacagaaataaaggacctgccgagaatatctgatgatctccaactcaaagacaacagagcacttcagaggatctctagcttgcccgtattgcagtctctcaccattgacaactgcccaaagttgaagcatgtttcaggccttgacacactgcagcatctcaggctggcgttccctccatccacagagacattttattttgatgagctgatcatcttctggagtattgcattcccacggtggctggagctgttgatccgtaagcgcgatgggctgtgccatttcgagcttcagtgcagcctctcattgctcaggagctgcctggacggtggcaagaactggagcatcgttcagcagatccccgaggtgcggatcaccagcaccgatggcaagaggtacatccggtacaacaaacgccggtgcatctatgagacgaatgctcaatctgaagattgaagccttcgtgaaagtcccagtgcagtacgtttttttttttcatcttcattgtgcagttcatcttgtcaaggttctcttgttcagttgtgtggtgtcattacttacagaagtgtatattttcgttgatttattggcagtggtttgggttgttacaaggacacatctcagttttcctgggtagtccttccatgagttttgtttgcaatatttgccaacacgtgcattcacacaggctattatgtaagcctttgttctatcttttctaattacatttgttttgcaaatcaaatatccgataaaatttagttatcccttgggataagggacagattgaaaaactgatatgcaggtatatttttctcacataagattccaacattgatggaaactagatacgataatttgttcggagtttctaacaggtcaattcatatatctgtataagccgtaggtatattaaacatgtgctggtttaaaaagttgatgattacaaaacctactctcttcgttccaataaaaaccaacctaggattagatttgatataataattgtggaggttggtcttttttttttttttttttttgggatggagggagcatttcacagtaatctcacttgcacatgtttttttccaggttatagtaaaatgaaaattgtagacaagacaaaacaagtctaaaatgggtagggatgaaaacggtatgaaaacttcccagattccggacctattttcgaaaacaaaaactttcagtcggattttttcggaaatggatatgtttgaagtggttcctacctatgcggaacgaatgaaaatgtagaaccttgtacagttggaaactcggataaagcagagttggtagaggacgattcaggagctgaatttgtatggattcaagccgcattttcccgctaataagtgaacaaccatgatgatttcgccatgacgttcctgctatatgcgatgggataaatgtattgatgatattcatgaaggggcatcagcagtttccggctttcccgcggagtggggcgggagggaaaggagaggaagtgggatggggtagcggaggcgccaccatccaccaggcgtcggcaaagcggatgtgctccctgccggctccaaccaacagagagaaacgccgcgggtggtggagctggggtgaggaagctgctgagggtgctgatcgagcttccctagtagcaggctagcagcaagccaagcctctccatcattgggacttgggaggaagagctatcggtggagacgtagggaggagaggcaggcgccacgctgttatgtcatggcctcatggggaggttacgggaggaggaggaagcatagctgcctagaattgggctttttgatattgggccttccggtctgcacatgtgcaaccagttgtgattagggaatttttttatttttaatttttttaattaaaagttttacaaaaaaaattttatttcaaaaaatgacaaaactaatctccccagagggcgggaaatgtgacgtggcagacggccgttggctctcggacgatggccgtcaaccgagggcaggacattttgcaggcggcccccttgccgccctcggcaagggcggttttaaactgtgcaggggccacctacaagagggcggcgagagggcgtggattttttttgcaggcggcccccttgccgccctctgggagggcaattttgtactgttgagggaccaacagccaaaaaaatcatagttttgtaatggttttgatttattttgttatgtttttgtattgaatcgtttgttataaaaatttgctaaataatcatattgaaaacgaagaaaacatgagtaatgtttgtagatttgtttgatgtaaaatatcgtatttgaccgaagaaaattaggtaaataatgagtctgaaaacaggaaaattaggtagttttttttaaaaattttagatgaatactttgcagtcaaattggaggccgaggaggtggtgtgtgactttgaagtgttaggttaatgatcttatagaaacaaacatagtatgtaaaattttgtaagtattggatggtatatttttcagccggattggagctagggatggtgtgctctagatcaaactaaactacattttacaattaacactacgatctaagtctcaattcctactaatatcttctgtgccctagatctatacaaatgtgttgtgttctacagatgtactaaaatatatggaactaaaactaaaatgcaacataaattaaaaacacaatgtatttacagatgatgaagtgagcaaaccagcaggggcttcgccgctccccttcttctaccccacacccctccctttttcttttttttggaattttgagtgattataatgaaaattcagagagggggaaggggttttattgtgtgtgtgtggggggggggggctgcaaaattccaggccactcgctgcccttttgcaggcggtcccctcaattgtgtaaaatcgctctgtgtaagggcggcaagggggccgcctgcaaaatagccaagcccacgtcgccgccctttttgcaggcggccgcccgcatagtgtaagatcgcccttagagagggcggcaagggggccgcctgcaaaactgcacgccccctgttgacgaccatcgcccgagagccaacggtcgtctgccacatcacatttcccgccctccgggagggcgatttttaaaaatcgtcccccccgagggcggcgggagattagttttgtcaatttttgaaatagaaaattatttttgtaaacttttaataaaaaatttaaaataaaaaaattctgcgattaggtcggatggctatcatttcattggtgacaattagatggttgtggtttttgttggtgacaaggcttcaccacaacatagagaattgctattaactacactaagtggggatgcattgtataggtttattataggataacacaggtaatcttaaacgctacaagtaataacacaggtatacagtagtgtagtaccttggaaagatatagcaaatcgttaaatatcatatgaatacttaatttttcttcaaattgaggaaaaaatggtggcacattatgataaacaaaattgtattacatgctccttccgtttcatattatatgactttctagcataacatatatatgaatgttggcaatgctagaaagtcttataatatgaaaatgatgaagtatacttttttcttcaaaaaaataaaataaaaattctagattatgtcgaggttcgtggtagaagtttacacgtagggattggtgacgatacatgttggtaccataataatacatcgatgatacttagaggtatgcttgttagatatgggtgatgatacacataggtaccagtggtttcgttggtacgttttagctggtatcatataggtgttggcgatgatacagcataggtatatatcaatgatgatacatttaatataaatactagagacggtgcaacataagtacatgatacatgtatgtaccaaggattatataataaggttggtgatgatacatgtaagtaccagggacgaaacatgttggtgagatatacttgtactagtgacgatattttgtcagttatgaacttgtgatgccttaagatattattacaggtaaagaacccatctttacttatggttcgcaaccccttttaatccctggtacacaaccaggataaccaatccggaactaaagatgcccatctttagtctcggttgaaatagccgggactaaagagtttttttcttttcttttttcattgtttgcatattgatttcgtgccaaactcacggatcaaataagagtaaattacactagcggtccttaaacttgtaacgaggtttcacttaggtccacgaacttgcaagcaaaatgagtatcgtggaatttttttattttttctcccttcttccttcttttttttttctcccttctgccattggcccacctgtcagtgggcctctctgacctcacattagcctcttctctctatcctctctctctccggccggttacgcaggatgggcggccggctaccgaagcagcgacgggcggagcggtcggcgagaaaggagcagtgcgtaggcaccgaccggcgggaggagaggagcggtgcgcgtgcacgggcggcggctggagaggagaggagtagcgggcgtgcgtggacggcggttggcgagaaaggagcggcgcgcgtgcacgggtggcggctggagaggagaggagtggtgtgcttgcacgaactgcggccgacgagaaaggagcggcgcgcgggcgccagccgacgggaggatgcgcgtgcacgggcagcaattggagatgagaggagcggtgcgcgtgtgggggaggcgtcgccgaccatgcccgggaggagaggttgctgactgtggccatgcgtgcggggggaggcgtcggccatagagcgcgctagcttggcggtggagatgaattcgtcgccgaccacacgtggtagaagtttacatgtagggatttgtgatgatacatgttggtactgtaataataattacattagcggtccttaaacttgtaacgatgtttcacttaggtccatgaacttgcaagcaaaatgagtattgagatccctaaacttggtttaatgtatcatctcggtccaaagcctcgtttgaccgtgatcttgcctacgtggcgtgccacgtggacgatgacaaggaatttttttattttttctcccttctcctttttttctcccttctgccacaggcccacctatcagtgggcctctctgacctcacttttccctcttctctctatcctctctttctccgaccggttgagcgagacgggcggctggcgatgggcggggcggccggcgagaaaggagcggcgcgtgggtgccggccggcgggaggagaggagcggcgcgcgtacacgggcggcggctggagaggagaggagcgtcacgtgtgcgcgaacaacggccggcaagaaaggagcggcgcgcgggtgccggctgacgggaggacgcgcgtgcacgggtggcagccggagtggagaggaacggtgcacgtgcgggggaggcatcgccgaccacgctcgggagtagaggttgccgaccgtggccacgcgtgcgggggaggcgtcggccatagagcgcgcgagcttggcggcggagatgaagtcgtcgccgaccacacgtggtagaagtttacacgtagggattcgtgacgatacatgttggtaccgtaataatacattgatgatacttagaggtatgcttgttagatacgggtgatgatatacataggtaccagtggtttctttggtacgttttagctggtatcatataggtgttggcgatgatacaacgtaggtatatatcaatgatgatacatttaatataaatactagagacgatgcgacataagtacatgatacatgtatgtaccaaggattatataatgatgttggtgatgatacacgtaattaccagggacgaaacctgttggtgagatatacttgtactagtgacgatattttgtcagttataaacttgtgatgccttaagatattattaccggtagagaacccatctttactcacggttcgcaaccccttttaatcccgggtacataaacgggacaaccaatccaggactaaagatgcctatcttttttgtcccgattgagcgggatgggcggccgtcgaccgaagcggcgaaggacggggcagccagtgagaaaggagcagcgcgcgggcggtggttggagaggagaggagcagcgcgcatgcgcggatggcggccggcgagaaaggagcggcgcacgtgcatgggcggcggctgaaaatactccacatatataataccttattcatattaccttgctatttttaacgtagagaaaagtttcagtaactgaatttaggtgatggcattaaaaggtggtcttttctcctgaagatgaagacgaagatgaagatgaatattaggtttttttacgcaaaacgaggtggtattaatgtacgattgattgagttttaattattacaaacttgaaaaatagattaatattatattttagagcaactttcgtgtagaaatttttcgcacgaaacgcaccgtttagcagtttgaaaagcgtgccacgaaaatcctaatctttatccaactcatgttggagaaaagaacaggaccaaaatgtgttgcacaattcagggtgatgagacaatacacttcttttttgtgttgttcctgtactgtatttatgctcccttcactaagaaatgtaagacatggtttgtcatggcattctccataattgaacttgtccagatatagtgtagttctttatgcatcaggtggtattgcaaaaggagaaaaacataattaattcttcaggatctatgatgctaaattggttagtccatgttttgcactgttattatcactgatctggaattattctcgcagaactcttaagggtcatccgaagattgaatttgaaagagcagtggactgatgtgctacttcactttattactttgtatgctctgagatcaacaatctctcatgatagatagcatattgtgtaatgctggagacgtggatagagattagtacgttcattacaagtgaactcgtggcataattctcttgatttttgtggtgtttgatacatgtctttaatggactgtatttgattatttcaattcagtccctatcatttgatttaaaaatatagcattcatctgtaatctctggagataattttcattttgtaatatatataatagtttgttatatgcacatagatcatgattttttatgatgttcagaagactggtacatgtgaatagaaaaaaagggaaatgtcatgttgtttggggtgaattggtgatagtttatggcaatgccaatgtatttgtacgggaggtatgttatagggagatctgcagctcatccatgacaaatactatatctaggtatgcttgatgttctagatattaaatttccatagcattcttctatctactactatgttctaaatattaaacaccatgagattgttttatatgccagaaagcttacactcggattgtgtagtggtaatagattttttgtattgaaattaatttgaattaaactacagaacaattttgatttgtagtctcttcgatttgccagatttttaaccgtgttcaacaaattttcactcaatgattatttaacatcttttcacctcatataatttgaaattgatatatattatttcacgttgcaacgcacggacacccagctagtatatatgtaatttgtaaatatcatttacatgttttagcaatgtaataatcatgttgtttacttgaatttattggagcattcagttttgtttgcaaccataaatttatttccttagcaacgcacatgcacttaatttgctagcataataaattcaaaattgctagacgagcgaaaaagttagtgacacacaagagattctcttgtgtattcgtaggagagattatattcgtaagagtaacaggaaaactcaaacgaaattggctgcaaatgaaattttgaggcttaacttgtcataagtcacggctatttgctagctgacgagtactcataatgttgaacagaaactaaacaaacaaacatcaattaagttcgcccgccctatatatctgtagaacagtagaagtagcagatatgaatcaggccattgtaaagcggggttcagagcctctcgccacggatcctcctggcgagctgaacgtctttggacatgatggtgacgcgcttggagtggatggcgcagaggttggtgtcctcgaacagacccaccaggtacgcctccgccgcctcctgcagcgccagcaccgcgtggctctggaacctcatgtcgtgctgcaccgcaccaaaacatcgcaaaaatcaattaacgtacgtacaagcatccttagaatagaatgaatcgatcggcataatttaaacgtttggttaccttgaagtgctgtgcgatctccctgacgagcctctggaacggcagcttccttatcagcagctccgtgtttttctgatactttcggatctccctgcaatcgtatatatatgatataattcaaataaatataatataatataactgcagcagaattacttatggagagagttaagcatgcatgcatatatgctatggaaagatcgctcaaacaattaattaatttgcttcatcgttcagttctttagaagataaaaaacagctatagcgtggcgctgggacatgtacatctttgacatagatgctggattgaattctgtcatcattgaagaaaagaatcatgtatctacctaagggctacggttccaggacggtgtcgacgaggcttcttaactccgatgaacggaacggactttcgagcgactcctctgctggacggagcaggcataacagcggctatctgcatgtcgatcgattaattgtaaagatgcatcgttcacaagtgaaacaaaattaattagtattgtagtaatcatttttggcaaagcatttgtacatacagcacggagtggctttctaggggcctttcctcccgtggatttccgagctgtctgcttagtacgagccatcctgcaatccatatagacaagaatatgcacattatccacattggctataacgctaagacaacaattttgaagaccctataatatgaacaagaacggcgggagctctgcggtttacaaacctcacgcagatccaaaaacttaattacaacgttcacgaaataataataatgttaattaagattagacttaagaccttaattagcgccaagaacaaaaaaaaaattctaatccagaaaaaaaaaagaacaccttaattagcgtcgtagatgaataatggtggcgcttgattggcccaacagatttgaagagggtagaagaggtggaggggcgatgattcaacggctaacaattctggaaacaaaccggtgacaacagtgtttcgggtctttggagtagaggagaagagtccggatcaggaagggaggttacaagttgcgaagaattgggaagaaaatagaaaaggagaaggggaagaagaagggtcaaaaaggacaatgcggatatttgccaataaattcttggaataaatttggaactctgaaacatggttcgaaaagtgtagagagcaagcctaaaaagtctttagatatgcatgaaagtaagacatttttcgtcaaaattgagaaaaaaaaaacaaatggccgagcaattatggctttataattaattagtcgcaataaatctaatcttgtttaaatatctcgattaagttaaactaagaaaataaacaccaattcaaattttaaaagacccgtacaaactaaaaaaaaagaggaaaaccgggatgttacagacagagagatgcttattattagtacaatttacaggaaactaactagtgtggagatcgattgaagaacacgttaattagtaggacaaggaatttcattagattaaaaaaatgataacttattttatacctctcacagttcgacgagtgcagcaactgctattgctgtgtgtgcctccgaaaatccccctcaggtatgttttggtgtgcagatctgaccggagaagagggctaatttataggcgatcgggcgggctaatttaccgttccataaaccgacttattaattagtttttatttaaccagagctcgattgattaccgttgcatttaattaatcgacggctgatatggtttgtttacgtggtggcacggatcggtgtcgatgcacgccgcactgctattggctggcgctactaacacaaggatttcctggttcctgcgaatttatgatggtaatcctcctttggataaaaattgtttcctttcactgtagatcatcaagacaaatcatgccatatatatctatatctatatctatatctatatctataatataaaaaggaggagttgtccacctccaatcctacatacaaaatcattcggattgatccctaccgtccatctgcgcgagtgatttcaccaccacacgatccatccatccacgccgaatacgccgaatacttcgctcctcctcctccacccgcgaagacatcaccccacgcgcgaatacttcgcttctccagttctcctcctcctcgctcgcttgctcctcctccccgcatgttctaccgccgcgccgctgcatcctctctggagatcttccccgcgtggactgccgccgccagagcctctgattcttccccgtcgccggagccagtgcttcttccccgcgtggattgtcgccgcatccccgccgccggcgccgctgattcttccccatcgccggagccggtgtttcttccccgcgtagactgtcgccgcatccccgctgccggagccgctgcttcttccctgccgccggagccgccgtggccggttccgacctcaactccatccgccggcgccggcgcctagatccactgccgcggccgaagccgactttccaccgcttccttgagacgttcaacgagagagacgactgccggtgcgacacttcaacattatgctctaccacaacgctacagagtacagaccaggttcggcacaatactaggtttcctcgcttttaacttcacaattgcttctgttccttctggtgtttgttcccacaaaatgcatgtggcatggaagatgcttgatggaatactcaattgattattcgatacagtatcatttgttgcagtttttagatcttccaattaactagcgcaacaacaacagattctggttcctctttctttattttctgcttgccatttatatttatatttatgttcgttaaaagaaattcagcactgaagtataaatgttcacccatttctctgtgatatcaggcttgttaacaacaatgtttttgtgcaggaattcctatttattaaaaagctatggtatgttagctacattttaaacgaacaggatatgattatctgagctttgtccagctccagtctctaaagatgggatgttcagtttgtaatcatagaacacacgcgcaacaatcttgcagtggggaataccatgatgcacaggttagaatgagagagggatggcattggaattgtcaaagatttctcatacacctaagccaaagccctttcctcttttggtctttccttctttctatgtaacaagggaatgatctggtcacagaatactgcagcggtttgatcaacgaaaagcaggtgataaatgttggtgtttgacttatgcccaggttactgtcacgcccataaattcacgaaccagaatttttaagctgaatgtgcattaaatccctgtctaggaccagccaggatatacaaatgacaattgttgacatatagatccacgtcttacaaaaatagaaaagattacaaatgcagccgaaaagataaaagcgagctaaaccgggaagcttgacttcagcagcggggcgactccactccacacaggcaatccttgacggcggcgatgaaaccaactttgacaagacagctcccactaggaagattttcagttctggtgtggggaaaaagagagcaagactgagtactacccactgtactcagcaagtcataccggaagaggaggtatgatgcaggatataaccaaaggaggctaggggttcatttgcataaagcaggcatttaaaagcagaagttgaaaacagtaaaacaattgtagtaattaatcaacattaaccaatcactgtccaatgctacaccacgttgcaacaagcccaaccaaccacctgaactacaccagttcattaagctaaactaggggtgagactaatcacggtgaatctggttgatcgcccataaccacgggcacgactattcgaatagttttactctggccagaggtgtacaactgtactcacaagacacaattccacacatgttgccatgccccgaagtatcaccatgatactgcaaagggggaaatcgtgacaagaccctccgcataaccctcccctaaccatccacaccacgctaaggtttcacccgcacccccaacgggcagtgggcggtcccctcttgcgccgcggtgaatccggcagctggacaactggacaccccggctgacccaactccatcatgcccaccctcaccaccggtgcctaggaaagggtcgagctatacttcagatcaagcagttacccactcccgcttgtggtaagcacgataagtcttctagggtttcccgtgaaccggtccttaattgccatgggtgcgaccagaaaaaccatgcacccacagcccacccttcagtgtattttaattaactaacaccaatgcggtggcaccaatccaaagctatgctcatagtcaaagtctatgtaataatgtgatccccatttgtgtactagttgaactacacatagctaagcatttcctaaaccaacatctagtcatttggacactcaagttatcaatggcataaggtaaacaatatatggctgagtaatgggacccatcccacatgacattgtaaaagaatgcaacatttaatagaaatgcgggatatttgtaaattgggtacaatatgatgaattgtaacgcatgacttgccttcctttcgcactgatgagcccacatcaacgtcttcgtggaaccgcggatcgacaaaacggccgaaatctacgcgacaaacaaaacacacaagcaaaacacactataagactactgaaaaaggaaacaaaaccatttttaatggattctagggatttttatgaatttactgagacttgaatggacttaaacggagctcggatgaattaggtatgaattttagaagataaactgtgtttttactactaaagaaaagcccttaattaattattgcgcaataaatccccagggctgacgtcatcaagggagggggcggcgccggtaagcgggccccacatctcagcggctcgaggtggccggtccaccgtggaccgggaccacatgagtggtccaccgccggtccacgggaccgacggtacagatcggcctgaggccaatcggacggcgtaggtgaggctaggcatggctcggctcggcacaaagacggccggccagccatggggagcggcggcggcgagcgcgcgccggcaacggaaagcggcagtgcgggaggcagcggcggacgtctcactggccggcggcagcggccgaaggcgatggcgagcgcagagagtggcggcgcgtgcgggacagagggaaggagggaggagaggagctcctcaccgatgagcacggtggccggcgcgaaggatggaggtggcggcgatgaccgcgatgcggagggacggacgggcggcggcgacaccctaggagaagatggagaggcgtcaggagaggagataacgaccacggcggctttaaacaccggccgaagatggggtggacggcgtgactcaccggcgtgcgaggagagaggcgctccagtgggattccggcaacgtgaggcggcggccgggaaagctcttgcggcggcggcttggcacggcggcggccctagaagcgacagcacgcggccggagatgggcggcggcgacggagctcggcgagcgcggcgcgacggcggtagagggcgtgggagtggacggttaatgggggaaatgagagagagagctcgagggaggatttttatgggcgctttgggggcagaaacggccgaggatggcccctatttggccggcgacgtggggagtggagagagagagagaggtggattcgaatgcgaatcccgcccatttttgggcgtgcgcgagagcgggaagaggtggaggaggtgggcggcgatgtgggcgcgagcgcggggcgcggagtgggggcggggaggcggaaaacacggcggcgcgggcggttactgccggggcacggtcggctggaggaaggggacgaccccgacaggtggggcccacctgtcggcgttccggagggaaggggaaggggaaacaggccggcccaacaaggggaggtggcgcgggagagagatgggccgacggcccatcaagagaaaaaggaaggaaaagaaaagataaagaggaaaatgattttcctgggattaaaaatattgcacttgctcatttttaattggttaaaattatttatagggctctgaaaattccactaaaaatcttgttaatgcattagggcatggggaactcaagaaaaattccaccacgctatttccaattattagttgcatttattaattagggattcaactctaggttaattagaacaatttctccagacgatttatttaacaaatttttaaaacaagaaaaaggggaaacttcaaggcgtgacaaagattacccaccttgattttgtgcctaccttgaaacatgaagcctcaatatgattgttcaccattccagcttaccaactatattgaaatatcaatctattatgtaagctgcctttacaaattaattattactctttgttgataatgttcagagccactgagcttgttcttgctttcaaatatggtgctgctctcatgaatattgataaagtttgccatctcttcatggtagttttgtatgtttgtgcaggtcttccaaattacacatagttcattatgcttgggacagaataatacaatagttgatataaatgtgcagaaaaaactgaaagaaatttcagattgcttaatattttgatgtgagtttatcacgggtgcatattggagtgactgaacaatgattctcattggtaatcattttctcctaccttctacttccttcagtttctcatattccttttttacgaattatatacctccgtatttaaacagctttttatatatttgttttctataaatattaaatgataattactcatttttcattttttttcgtggtggtacactatgagaattttccgaaatactatgtcctgccacatggttgctgaatacattcaagggcattgcactgtccattccattcagtactgggcatatgcattacattaggcacacacaggagaaacatgccatagattaagtcatagagttctgccttcaaatttggaaagaaaaagatattcagagtggcttcagccttcaggtaatgttacgcaagcggacaataatgttgttattaatttgatatatttttaagtgctatagaaatcgatgaaactaattcaggttttgtagacagcttggtgatcaaggcctaccaatatttaatgagttatgtcccttgattgatacactaaagcttattctcataggcaattttgatctagcaaaatatgtgtgcaatgggtgcaagtaatagaagctgcaaggcatattatgaacaatcaaattgtttctgaactgaagtagcaggtttaattttggtcaggtatttaatacagaccaaatttatagtggtaagaagtaacgagaaatgcccgtgcgttgcaccgggtattggtggggtggctgaagtttgatattaacgacttatcaaaagcacacgagatgattataagtacaatgataaaaaggtcatgtttgtttttgataattaatttactctatatttggacgacttagatgacgcttctgacgtgtgtgggcttgatggtcatggcaagggaggaatgagtggcgaacaattaatgtgtctccttttgcatatagggcgacatatggaaatttatgtgatgaaaaatgaatggaattgacctaaaggcacctccccagatttatatttccccatatttatatttgtagtttaattaaactttcttcagcatttatttaatagagttgtaaccgaaccaagggatttcttgagattcttaagttatcaatggtgagattctgtcaggtgacttctaaccttgaatttgtttcagaagtcaccagattgtttaacacgctagatgctatctcactgcaagatcctgcctttttttttatctgaagttatactgagctgctacctcctcaggcttcattctgtccccgtccgcaccttcctcgatgatgataaccctaccgcaaggtaactattcatgtcatcttctttgggtattcacgcacatgtggcaacacaacagattggtacatgtgcttttctacagccagatcattgcacaatgtctagaattttctacttatttgcagggtgacatgagaattagtttatcaccccggtcgaaggtatgccccaaaaactagattgaatatacttatgtctctataaagggatattgtgtggattctatgcagctttcagattcgtatgctaaattctatatagatgtatatgctgaattttatgccccaaaaactagattgaatatacagaactatatgcagcttttactctttgaaggtgtatatgcatgctaccatgtttcctgctaagctgtatatagtgcaatttactacgtcctctcttttttttatatatataccttcacagaagacagtaatggatgcaggtagctaactgcgtggaaattggtcttccgtcactcattcgcaaaaataaaagagaagcgtctccattgcttctgaattctggtgccttgcatttgatttaacctcaggataaaaagagtcttgggatatatggcttctttactttacggattgctcttcctgcccaataaatgtattttgcagccttcaagcagataaggatcatggaggctctccaaatgatatatgcttctgttcataatctgcttgtgggttactgtttctgttgacacggataattagtccatctctgtagtcacagatgacaacttttttcccttcaatgcagccacatttttgtgatgctttacaatcttgacagtcagtgcaaaaggaccaatgcagaaatccataaaactgaacaaacaaatggtctatgttaactgagattataagcaagttatttttatactgaaatatatttgtcgccctaggaatatttgagggctaatatatttgtcaagcttaaatattgaattccaatccatgtgcacttggcttcaaggtaaacataattttatttctaagatgtcattttagtttacagtagatgtacacactttaactaggtatgctgtttttaactgtgaactcaataggtgtaactcctactatttaaatgcagatttcaaaaccaagtataccaaaattggcgttgttaagtagttgtacagcaatactgactattatttggtttttatacaatacaactctgctaataagtatagaatcacatcagacatgtaggcatatatgtgcacatgcataaccaggtgaccaaggaagctatactatagaataatgtgaactccttccttttctttttctaattagacactttattgcatagtgttgtggtttgaatgtaaaatagacagatctgttgctcgaggtttccaaacatttatcaagctatgaaaaaaattacatatttggtatcattagatggagttgtttgaatgtaaaatagatagatctgttgctcgaggtttccaaacatttatcaagctatgaaaaaaattgtatatttggtatcattagatgtccttcatttttatagttagtgtaaagggagagttatgtggcatattaatattaaattttgtatttatatgtcctgtgtgttacacgtcgtcggaaaaccatataaatttgattgtgtttatatgtttactatgatatatagtgcgggaacgtgccttgcacgtgcactcttactagtatggaattaaattaagagatattacttatactcaaattaaatattatatctctatctatactattctaaaaattaaagattccgctaaaattttggtactccctccatttcatattactccctccatttctaaatatttgacgccgttgactttttttaaatatgtttgaccattcgtcttattaaaaaaattaagtaattattaattcttttcctaccatttgattcattgttaaatatacttatatgtatacatatagttttacatatttcacaaaagtttttgaataagatgaacggtcaaacatgtgctaaaaagtcaaaggtgtcaaatatttagaaacggagggagtataaaactttatagcatacattcattaacatctatatgaatatgaacaatgctagaaagtcttataatatgaaacggagggagtatgtcataagtgtttgagttagttctatgtcaccgtatccaattcgaagtgactccacccagcttaatccaaccggctcacaccaccttgatgctccatcccgcactgcgcgcctctccccgatcgacgtcttctctctctctctctccttttttttttttgctatttctccttttcttttctcccaatcatcatgtcctcttcctcccctttcaatctcctctattttctcctccttttctctttttccctcatttttcttccaaatttctctcctcataaatatttttttaaaaattatcattaaggtgtgtatggggcaagagtgttactttgcaaatgttttccatctacagttaaattcttttactaattgaatagtcaaaatttcaatctttgatcgatgacatatagcagaaaacataaacgtcaacttatggaatagccacccgatcgatttctgagactatggaaaggtgtacataaaagattcttcatgtgatgatgcatgaagcgagtgcaaccgggtttaatactatatatgatttatgactttgttttgtcattgttttgtttttttgtttgtcatttaaattggtaaagtttttatcaatcgtggaaattgtcttcacccgttgcaacgtacaaacatctttggtagtatgcatggcccctagtccaatttgcatctttgctaccgaatatgtttggtttctgcttccaacgttcccccttccccttctattaggtctaggtcggaagtcccttaaaaaatgtgatggccttttccacgtccaggttgaattacaatttacaccagatcgagcaatcttttgtaccctcctaactccatctccctcttccttcttgcttcatcctcccgccatcgccgcgagacatacgatcccatgaagcttgctcactcactgaaaggagaattaatcgtcctagctaagtgtaatatcccacatcgtacgagattgagtcgctaacgacgaagaagaaagcaaatacttgaagaatgggaaagggattctgatgtgaccatcaaatatatgaatacaaccaagtatgaatggacttgttctggttggtagccacgtcgcaaacgtcgcactcgatcaaagcgagagttatccccttattagaagatcgggccacgagagagagcgtcatcaaattcagagaaaagagggaggaggttgtcaacttacttcattttttctcgccaaatcctataaatctataagtgatcctcacttaatgtagttattacccaatttcctatcctgtagttcatccacgtcataaaaaaaacgtcaatcattgtatgaaatctcaaaggtttggatgcacccaaatcccaatggtatggatcagaacagtccaaacgagagagcccatgagcccatttgtacgtagcctcccgccccgcgactattaccaaaaacgattttcttgtacaaggagctctttagattgcagatagacagcacaaaatcgattttcctatacaaggagctctttagaaaattgattttcgcaggcaggcctcttaatggtccgcacgtaaaaataagcctatttttgcaggtggacctcttaaggggccgcatacgaaaatcaatcttcgcgtgcagacctcttaaaggcccgcctacaagtctattccccctcctatcttccctctcatcaatttcaaaatttttaagtcccattctttatctcctcacctctcattccacagccttatctcctctcccttgtcaagtgcgttgtgtgatagggtagctggccctcggctacggagctcgtagccgcgcgccgtgatgttgggcgaggttttccccctcagcaccgatagacagaggcaaagaggaagaatagaaagtttgtgatcaactccttttcttccaaattctgaatacaaacttaagtaggctctcgggccttaattcatggcgctaatcaaatcattgtaactaattattcctattactaaggatctgattgatccttctgttttcaaatccacgcgctaatcctgctcagccgcgcgtgatcgcgtatacggcgtcgacggcgcgccttcagtgcccctgatcttgcggcccttccttgtataggtgcggccccacatgacatctctccctccctcgacgagcagctcgtcctcgagctagaatgctggatagcgatccatgaaggtatccacatcttcccatgttgccgatgttgccggttctcccttccactcgatgaggacttgtcgcactcctcgagcaagccgcatgcgggtagcacgttcaggttctgggatggcagcaccgttgtggatggccagcagtggtggtcgtgcgtccggcggcattcccacaaacttcttgagaaggctgacgtggaacacatcgtgaagacgagtgcgcggtggtagtgccagccgcacggcaaggttgttgatgagctcattgacttggtaggggccaaaaaatcttggctttagcttgccttttgtgacttgaggaagcgaggccggttcgcggtggcgtagacgcagccatacccagtcactgacctggtaggagacgtcgcggtggtgccggtcgtagaaggccttttgaactgcttgtgcttgctccagccggtagcgtatgtcagctaggatcttgtccctgtcttccatgttgcgagctactgccgccatccgtgtttcacctggttcatatgaacggatggttggtgggtcgcggccgtacaccacgcaaaacggggtatcccgtagtgacgtttggtacgccgtgttgtaggtgtactcggcccatggcagccagtggatccattgtcgcggctggtcgccggtgaagcacctgaggtacatgacgatgactcggttggccgcctctgtctggccgtcggattgcgggtggaatgctgtcatcatgtgtagcttggtgcccatgagtcgcatcagttctcgccagaacaaggaagtgaacactgggtcacgatcggagaccatggactgcggtacgccatgcagacgcacaatgtcggtgaagaaggcttgggcaaccgactcagcagtgtatggatgcgccagggggatgaagtggcagtacttgctgaagcggtcgacgaccgtgaggatgacggatttccatcctacgcgcggcagtgcctccacaaaatcgaggccgatgttggcccagacagccatcggtaccggtaggggcatgagcagtccagccgggtgaagatgttctgacttgtacctctggcacgtggcgcatgccttgatgtagtcctgtaccattcggcggacgttggggatgtggaagtcgcgccggatgcggtggatggtgcgctgcaccccctcatggccgtcgtcgtggatggcagtcagcaactctaggagcagtggggaggacggtggtatgtatagacgtgcgtcgaacgccaccatgccgtctatcagtgaccaaggcgccgcgcgtgtgccggcttggatctcatcccccaaggccctgatggcaggatcggtatcctgtgcttgccagagtcgctcgacatagtcgaaccgtggcgcagagatggcgaggatcatgccgtcgtcggtgtcgcgacgtgagagggcatcggccaccgtgttcaaggcacccggcttgtattccacagtgaagtcgaacccaaggagcttgccgacccagtggtgttgtgggatttttgcgagacgctggtcgaggagaaactttaaactgtagtggtccgtgcgtaccaagaaacggcgtccccacagatatggccgccaatgcctaatggcatggacgaggccgatcagttcacgttcgtatgccgcgagagatcggtgtcgaggtgcgaccggcctgctgaaataggcaaccgggtgcttgtcttggatgagtacggtgccgaacccatgggacgatgtgtcgcattcgacgacgaatggcttggtgaagtcgggcaaaaccaggaccgacgccgatgtgatagccgtcttgagcgcctggaatgccgtggtcgcgtcgtcgttccacaggaacccctctttcttgagcagtgctattagtggtgcagctatggtgccgtagtcgcggacgaacttgcggtagtagcccgtcaagccgaggaagccgcgcacagcttgaacagaccgtggttggggccagtcacggacggcctgtaccttggcgggatccatggcgacgcaggactcggtgatgatatggcctaggtaggagatggaggagaccccaaacgcgcacttggaacgcttgacgaatagccaatgttgttggagagtgtcgaggacggcccggagatgtcggagatggtctgcccacgtgacactatatatgagaatgtcgtcgaagaagacaaggacgaaccgatgaagaaacggccgcaggacgtcgttcatcaatgcttggaatgtggccggcgccttgcaaagtccaaacggcatcaccaggaactcgtacagtccgtcgtgtgtgcggaacgccgtcttggcgacatctgctggattcatctggacctggtggtaccctgaacggagatcgagtttggtgaagaacttggcgccatgaagtttgtccagtagttcgtcgacgaccgggataggaaaagcgtccttaacggtgatggcattgagggcggtagtcgacgcagaaacgccacgtcgcgtcggctgtcttgacgagtaggaccggtgaagaaaacgccaaagagctccgacgaatgatcccttgctccatcatgaccttgcactatcgttcgagctcatccttgtgtgtggccgggtacctgtaaggccgaacagccaccggctgggcacccggggagaggacgatgctgtggtcgcggctccgtggtggaggaaggccttgaggctcggagaaaacatcagcgaacgcgaagagcagtgcgtcgagcaggttgtcgccggctgtggtggtgtggagtgatgtcgtctcctgtcctgccacgccctgccagcgaacttgacggtcgctgcgccaaaatgacatagtccgggaggcgaaatcccagagaatcggccccagagacgcgagccagttggtgccgaggacgacgtcatagccggccagcggtaagacgaataggtcggccgtgaaggtgtccccattgatgacgacgctgcttgccagagtacgctgaggcagggaactcgctccccattcgcgacggtcaccttcatgcgagcgcgtcggtgtagcgtcatggccgtgcgtgcggctgcgtcctcggagatgaaattgttggtggagcccgagtcgagtagcgccaatagggtcgtgtcgctgatcttgatgtgcagctgcatggtggcgctgaggcggatcccgacgatggcgtggagggagatgtgcggctcgctgtcgtcgtcgtcttgagactcgtcgtcggtgtcgtctgcagtttccagcaaaaataggcgctagcataccttgttgtggccgcggccaaaattttcgttgcagttgtagtagagaccgagtcgacgacgctcctccatcttggtctgtgacaggcacttgacaggacggccttccacgatggccgtcggcggctgagcgtttggcgcaggcaaggcgagacgtggtgccggcggtgggagccgatctcgttgttgtcggactggtggtgcggcgcattgcgctcgcagctccagtttgcgggccaaactcatggcgtgggcgagcgagttgggattgtgaatctcgacgtcgaggctgagcggaggttgtagtgcagcggtgaagagctgcaccttctgtgcttccgtgaggtggccggcgcgtggcagcagcgcctcgaaacggtcctggtactccaccacggaccctgtacgcttgcaggctgcaagttcgcccagggggttggaatggagcggcggttcatagcgcaaatgaagtagctcggtgaagcgacgccaagacggtgtgccttcctctcgctggacttgtatgaaccacatttgcgcaccatcctcgagattgtacgaagccatccataccttctcctcctccatgacgtgttgctggtagaagtaggactcgcatcggttgatgaaggcgagtggatcagtcttgccgtcgtaccacggaaagtcgagcttctgaaaccttggcggtcgatcttgggtgtgttcgcccgagcttgtcctgccgcttgtagacccagtgcactgattgttgaggagttgaatggcctgtgagtttgcctcgacggaggcttgcagcgacttgatggtggcggtgagggcttccagtgatgcttggatagctgcgtctcccatggtggtcgatcgctacggcgtcgttggagcggaactggagcgtggtggctgtggaggtggtgtagcgcggcgcggcaaggatggcctggatcgtgataccaagttgtgatagggtagctggccctcggctacagagttcgtagccacgcgccgtgatgttgggcgaggttttccccctcagcaccgatagacagaggcaaagaggaagaatagaaagtttgtgatcaactccatttcttccaaattctgaatacaaaacttaagtaggctctcgggccttaattcttggcgctaatcaaatcattgtaactaattattcctattactaaggatctgattgatccttctgttttcaaatccatgcgctaatcctgcttagccgcgcgtgatcgcgtatacggcgtcgacggcgcgccttcagcgcccctgatcttgtggcccttccttgtataggtgcggccccacatgacatccctcaccactaacttacctctaccttctcccactttccaacggcgaccgacggcgacggctcaggagatggagaggcgcggtggcgggcgtcggacccaacgacgggtgcggctgtgaaggcggtggagaggtgctcgtgcggccgccggatccgaagatggggatccgcaagaggctcggcctctagtggctggatccgtcgccggcaaccgtttgtagagtggatccatcaccggccaccacagggagggcggatccatcgcaggcaactgcaaggacgacgacggccggcctcgggcagggtgaagatgatgacgacggctaggttggcagcagtggtctcccgtcaacggtagcaccgaaaacagtgttagatccgccgtcgcggggcctcgggcggctggatccgtagccggcgaccacagggagggtggagctgtcgtcggcgaccgcggggactaccacggcgggcctcgggcagggcgacgatgacaacagttctgccggcgacaacgggaggtgcggatccgcggcgacgacgatgccgaggaggaggtggccgggagcggggtcctcggccccacaacggccgaatctgcgccgtccccgccgatgatgaggaagaggcgaacgggagcagcgccaccagcctagcgcgcacgtgcgctgaccagattcgcgcctccgccatcggattcccagggttttgatttttttttatttttatattttttttggatttttagttttccttccgggcgacataagcacccgcacgcgaaaatccaattttcgcgtgcgggtacaccacccgcacagaaaaatcagatttcgtagaccttttggcacagacgggccaggcttccacacatgaaagtaggttttggctcgcacagaaaaattgtttttgtactagtgtgccccccagctcagtaacgcatgtttctccatctcccgttctgcgagaaacagaaaccaccgccgcaaagttagaagacttcatggctgtcatcaagacagtggcatcatttcctcaacttcaagaaaccatattttctccacatcatgcccctcacatttcttctactaaggttctgaataaattatatttttagttttttactgctttgaccaagttaattgaggttctaaatgtagagataaaattatgaaaaaaaataccagtgagttgcagaggttgagtagcatttgtatgaatttttacatgattttatcttgcaccacttacttttaagattttatataggcttgacattacatatatgttttattgttaagatgcaactaaatgctaaataaaattataactagcttatgtatgaccttagatgttgttgttatgcttgatttctatctttcatgttttcataagttgcatgtatgcatattttgtgtcataataaacaaaggttaaggtgaaatatgaattatgtatgagtaaatgtaattatataattttgtattcatgagatgtattcaggtgaattgccaatttagatgatggattctaacatatgtcatgttgtaattttaagtcataataattttaggaaatgattttccatattagatgtagggtcatttactttaattactatgtgatactccgcactttgctgcagtattcatggatgagtatacgttaaatattgtcgaaatgatgaaagttgaaatgttgagaaaataatgtgtggaagatgattagatgcatacttgttgatctctataatataatattgtaaatgatgtgtaattgttagtgagtgaagatgtagcatgcttgcatggattttaaatgggtttgaatagtaattgctagtgggtgatcatgtggtatgcttgcatgttgaggtttagcttctaataattgttagtgtgtaccaactatattgaaacaatagatttgcttctagttttaagtaatgcacacgagacctattatgaagtgcatttaaaatccaaaaacacacaaagaactcaaatcacaccaaaacaatcatgcaaaaaatgcaagcacactctatgttttattttattctagaactgcaatggaaaggttttaagggcatgttcactttgatgccattttcaaccttaccaaattttggtaaagttaacaaaaaaaaagtggctacatttagtttgcagccaaattttggtaactatataagaaatcctaacaaaattttggcgagttgccaaaattgccaaaatttggtaagatttttttggcatcaaagtgaacaggccgcgcttaaggtttccggtttaggtggtaaacttttaggaaattacctaagaaacacacttttggttatgttacatccgatggcccacatgtcattctaaatcgtctgaatttgagccaatccactgccaaccgtcataggggccaacctataatctactaggaaaagttagtggccgaaggtggtggaggtggttcggccgaaccagccttggcggccccggctgcttccttgcacatggcagctgcccattagttggtgatggcggttgtggatgaaccgacctccacaaccgacattccaacaataattggaagctataataggataagctcactcactttccaaatgcacaacaaagtggagtacaactcatttttatattctaggcatcactttagtatgtggaattaggtagagagtgagggggagctccggaaggagtgtcccaaatgttgggtttgtcgacattcttccactggagtttcggagaagcactgaagttatcggctttcttctctcgcttgtacctcgacggatgctctttgaatgaagtaagtattcgagacgtctatatggtatttaatttatttgcttaagtgacatatattcctatctttgcgggttcctcgcttagtattattattgagtgctttagtactaggactcttaataaagaaggaagttcctgcacaatatagtagagtagtaatcaataacttagacatgctatctaggttagcggttatcttcatttgttgcgtactccacggaaagtgaagtagacagcaggaggtgatagtcatatccttcaatgttcaagtacattatagagccgtagtccggactctgcttggtagaccgggggagtcggtgcctgaagccatcgatagtttagtaaattaacccataggaatcatctatggcctaaacctaccattagttgttgtacttagataaagtactattcttacgctatacacatgttccctgtgaattaatactcttatctcttggaatactctaaggtaaggtgctacaatggaatccccatgattcagtacatttggaatactctgaggtgaaatgctacaatggaatccgtgcgcttgctgatttatttgtgagcgtatcaagtaccaacagtggtgtgttatttttgtattctgtgtagcatgatcctattctggtctagcagagggagagggaattaagttggggtcccaacaaaattgccttcaaattaaagtttgtggaatataccatcaagtagaacttgcacaccagtagcttaattaacttggcatacgagtagtatttataatattgaacggaaactaaacaaattaatggccgacaattaggttcgcggcgtaacaactagcgtaactgatataagctagtatcatatatgttgtcgaatagcagcagtatgtgaatcagaggcccatgcagtgtgaggttgggtggaattagagcctctcgccacgaatcctcctggcaagctgaacgtccttggacatgatggtgacgcgcttggagtggatggcgcagaggttggtgtcctcgaacagacccaccaggtacgcctccgccgcctcctgcagtgccagcaccgcgtggctctggaacctcatgtcgtgctgcacccaccaaaacatcgcaaaaatcaattaacgtacatacaagcatccttagaatagaatgaatcgatcgacataatttaaacgtttggttaccttgaagagctgtgcgatctccctgacgagcctctggaacggcagcttccttatcagcagctctgtgttcttctgatactttcggatctccctgcagttggagcaaaattacttcagtcttcatgagggttaagcatgtgatggtatggaaaacattgctctgaaattttcctcaaacaatttgcttcatcagagttcgatcgatacaacagaaagaaaacgcggagatgctggattgaattctattattgaaataaaggaacaaccagcgtgaaattagacgaaaaaaattgtgaatatgtatatacctaaggttacatacctaagggctacggtcccaggacggtatcggtgtggcttcttaactcctccaatgcacggagcagacttacgagcggcggcctgcatgtcgatcgattgtaatatatatacatcaacgcacgtgttggcaagcgaagcaaaaaaaaattatgttcggtaaactattaaataatgtattgtggaggtgaaggatatattgtacatgtatagcagcgacgagttgctttctaggcgcctttcctcccgtggacttgcgaacaatctgcttagtacgagccatcctgcagcaaaccatgcgcacgcatacacatatatagacaagaacattattcacacgttggctatatacaatagtaatacatcggctttcaagactcttataaggagagcaagcttttttttcatcgcacggaggggaaaaggaggggaaaagagatttatagatgtcggttttaaatgaatcggtttttatgaaccgatacatatgagagattttatagtagtgaagttagaatggcgagagagatctgaatttataaaccttatcccaagaccttgcaatgttcgcaataatactacccctatatatttaaataactttttttggtacttagcgtgcaactttaaccactatttttgaatcaaaacataataataataataataataataataataataataataataataataataataataataataataataataataataataataataataataataatacaaaaaatattataaaagtaaagcaaaaaatataaaaatctacccatatgatttttagttatgttttaaactaagtaatttgagagctagattgttgaagtttaagaagtttaaccgagtaaactcaatattgtcacatatttttatacggaggaattagccactcgttcacaaaattagaatggacacattacctgtcgagaaaagataaaggcgaatcctacaaaagtatttactccatctatttcaaaataagtttatttttagtcttcattatttgtggccaattaaatgaacctctatcgcttcgtctagttacctatccaccatttttatactatttttttactagtagagttattttggatagagggactacaaattagtacaattaaaaagatgcatgaaactttgcatcacatcaaagagctattgacgaagcaactatgcttgaataatcaataagtcaaaataaagctaattttgttataatatttgaattgagaactaagaatataaaacaccaagagaaactttatagagatcttgggaagctaacgtgtgcggaagaatggatgataactcgtacctctgacagttcgagggcagtaaccgctttgctcttcagggatggccgactactgatctgtttcttggtgatccggacggagaaagagggcaatttataggcagtcaggagggagggtttaccatcttgtgaaccgacttaattactcatgagcctttaacgtggggtcgtttgattgccgttggtttgatcggacggctaagagggttcgattaggtggtggcacggatcagtggtgatacatactgccctcctattggctgtcgctagtagcacaaggatccctgtgtagtaggggtgaaaacggagcggatagtttccgtccgctccggtcaaaaacggatacggatagtgttcggagcggatttttttcggatagttcgaatacggatacgaatacggatattttttctccggatacggatacgaatatggtaacgcagtttccggcgaatacgaatacggagccgaatatccccggagattaagatgcgcggatatccgcgtaacgcttgatgtctctccagcctccagcccatcccttcaatttcagcacatagttttctctcggctatctaaaccctagctgccagatgggcgacggcggcggcggcggtgacgacagcagcggcaagccggcgacagtggcggcggctgtcttagatctccttggctccttgctggagttgctgggcattggccttcaatccccctagtgcttgtttctgcttcctatctccctaaatcgtgggacagtgggaggctaggagccgttaccaccgccggcggcaaggcctcttgcatgcactaatctcttaggtaatccattgatttgttcttctcctgtaacctttgttttgtgcctttcatgagatcgataaactgatgtagatcttggatgtgcttttttttactttgtgtctagattggtgatggagtctggtagtgcaagtagtgcaagtgcagctgcaagtaccactgcatcatctccagttttgcaactcccagcacctccaagccatgctacggcagctacgcaggacacttctcctactgctggtgccttggcacacaatgatgcaattgatttgacaaccaatgatgattctgaggttttacctcctcctggtaagaagcaaaagaagtgtagttctgaagtttggcagcactacactaaatataaggtaagcaagaaagggtcagatgacactgtgattgtagaggagtatgctaaatgcaacaagtgctcatataaacgtcggtgtgagagtaattgtggcacttctgttttctggaatcacttgaataacaagcacaacattaagtcaggtcaacaacaactacagatgaaaaagagtgaagatggtactgaaagagctgttgagacatacaggagctgttgagacatacaggtatgatgagacggttagcctgaaaaagttctatatggcaatcatcatgcatgagtatccctttaacattgttgagcatgattactttgtggattttattaagtctttacgccctacttttccaattaagagtcgcattactgtgagaaaggatattctaaacatatatgaagaggaaaagaagaaattgtggcagcatttgcttacactctcatgccgttttagcacaaccatggacatgtggacatctaaccaaaataaaagttatatgtgcatcacagttcattggatagaggacacttggaacatgcaaaagaggatcattaagtttatgcatgtagaaggacatcattcaggaagtaatatgtgcaaagagttttatgacaacatagttgattggaatcttgatagaaggcttgttggacttactttggacaatgcatcgtctaatgatgtttgtgttaagggtgttattttaaaactccgtaaaatctctcctttaatttgcgatggcatcttctttcatgtgagatgtttcaatcatatcttgaaccttgttgcacaagatggtctgaaacaaatcacaggagctgtattaaagatcagaaatactatttcaattctaaagcactcgccactgcagtttgaggcatttcagaagtgtgccttggaagttagtttggataacacaaagggcctttccatggatactcctacaagatggaactccacatttctcatgttgaagaatgctatctactacagaaatgcttttgataggttgtttcttcggcatggtagaaagtatgcaaagtgtgctcccaccaaggtagactggtctatggcaatagcactatgcaagtgcttgaagccatttcatgaagcaactgaactattctctggtactacatatccaacagcaaatcattttttcggtaagttttgttccatcaagctttatattgttgattggtgtaacagtacagatggaacaataaaaaccatggcaaacgccatgcaaactaaatatgataagtactgggagaagtcgaatatggctcttgctgttgcatgcttccttgatccacgttacaa

SEQ ID NO: 72312 - DNA, 8909 bp, Oryza sativa
tccgtcaattttcaaaatggaaaattatttttgtaaaacttttaataaaaaaaattaaaaataaaaaaaattcgtcgtccgacgaagaggagtcgtagtaattccagcggcccgacctaacggcaaacatggctgcagatttagacggaaaaagcttgctcacaatgtgtatatattgatataacgtacgtactactactactgtgtagcgcccgctcgttggagacgaggatcgctgtgaaataattggaatacatagctaaaatatgctccccacccctaatcagatcaggtttgggttccgtggagcagagtttggatcggatccgtgcggacggctgtagttatagggcggtaataaagtcgaggtcgcaattgacgacgatgagctcgcgtcgtgtcgatgtgccgcccgtgccaggttcctcgttgggcttggcggtggtgaccgcgcgcggcgggctttggtacgtgtggtgagggtctggtaagcggaagcatgggccgatcgatggttggcattgctggctaactgggctgttcggccttgcccttgctgggcctggtcagcgtggctaggctaggtgactggatagacctggccggcgtggtgctggctcggcctaatctagctggctggtttgagcatggccgactgggctagcccggcaggtttccggttctgaagaacttactttgggaataagttcacttgccttccctcaactttacattaagtttgttcggcataccttaccctcaatactatatatcttcaaccctaaactatacaaaaccgtgcaatttagttcctatggcagaattagcagctggtttcgttgacgtggtatcctagtcagcgaaagaaaataaataacatacgggtcccatatgtaagtgagaagaaagaaaaaaaatatatgtggggcccaacgtgtcaacgcttctcttttttacccaccacgcatgcgaggtcaacatctggggaggcagcagcggctggggcggctaggaggtggtggtgacaaggcggcttcgactaggggcgacaaggaggtggtgatggctaggggtggtgaggaggtgacggcggcgctacaccggctgtggggtagcgatgaggcgagctcagctgggggcagccggtctgtgcggtggcgaggcaacaccgcgctcagggtgttcgccggtcatcctcttgttgcccaagcacctcgctcgcgtttcatctcctcttcgttgacattggcgagccagagccacgacagcgtcggcagcagcgcagggtggggtagaggatgtagcctcaaatccgggtcgacgtcgtgaacctcgaagggagaggaggggagaggcggtcggccacgccggcgagagagggggaagagtaggccaacgaacctaggagggagaggggggagaggcagctgaccgtgcgtggtggagagggggaggaggccgatgaacctgggatggagaggggaagagaggtggtcggcatccatttcacgcccagaaatttagccctaaatttccagactattttgtgtattaaatccctgtccaggaccagccagggtacacaaaatgacaagtaatatacagttccaaacgtaaataaagcgtaaaatacttacagaagaggcacttagtcctcacaccgaaacaaaagccgcagcagcggaaaaaggcgatcctagcggggcttcagctccactccacaggcaaaactcaactggggtctgagccttggtcctctaactccgtcttcagctcagaagcactacacttctgaaaagggggaataatagtaaggctgagtacaaccaccgtactcagcaagccacaccaatgatgcagacgtgcacggggacacaaagaggggtttgtggctatttgcgtaaaggcagttgtaaaacattttattgagcaaaatagtaaaacaattgagtaattaaggtaagattaaatctccactgatcaacgctaaaccacgttgaacaggcccaaccaacccacctgaactacagtgcattaagtcgatttattaggggtgagactaatcacggtgaatctggtcgatcgcccataaccgcgggcacggctattcgaatagttttactctggccagaggtgcacaactgtacccacaagacacaatccaccggcatgtcacagtgtcatcatgtgcccatgatgaacacgtcaccacgtcgagtgattgtgacaagactcttcatataactctcccctaaccatccacaccacgctaaggtttcacccccaccccctaccctagaggtgggcagtcccctcgtgcgctgcggtgaatccggcagctggacaaccggacaccccggccgacccaactccatcacgcccaccctcgccacggtgcctaggaaagggtcgagctatacttcaagtcaagcagttacccactcccgcttgtggtaagtattgtaagtcttccagggtttcccgtgaaccggtccttaattaccatgggtgcgaccagcaaaaccatgcacccacagcccaccattcagtcgcattttagttggataattacgaccatgaaacatggtcaaatgtctcgagcacgcagctcgtcaagatactaagatgtctaatattgtaattatcacatcaactgagctagtggcaattaagcatggctaagcatatagttctagctgtgtcacataagtaacatgagctagtcgatttatcacccaaggttgacaaaggacagatatcaagtaaacatggcacaagcgagcagataggtaaatcccgatcccatgtaattagcaaaacatgcatatttatttgcaaaaggtaaaacatttgtaaagtaggatcaaaatgctcaagggaaatgtgtgacttgccttgcttcttcaaacgatcttcagaactcttttcctcgcgaccgcggacttccgaaacgatggattatacacgctggcacgcaaaacgaggaaaaactctaataaaaaccaaggaaatagtacataaaaagtaaacaaacatgtagagctcaattttagatgaattttgcaagttgaatagctcaattcggagttcggataaattagatatgaattttagaagttttgagccaccttaatggatttatagaattattaatgatttattgcgcaattaataatggtttatgacgtcaccgaggggaataggttgcgccgacaagtgggccccacctgtcggtggctcaaaggaggtcggcgcacggtggactcagtccacgcgcgcgctgcccgcgggcgcaccacgtggggggccgcggtggacggggaggacgaggtggcgccgacgtggcgccacagggcagcgacgccaggcggcacgaggagagccacgtggacggcccatatcgccccgaagggggatggggtggccacgggcgagcgggagccggctcaccgaccggccggacggggagccacggcgcatggcccgatgatcgccggcaacgaccaccggcgcgacggcatgtgcgggaggcggcagaaagaggggaaagggagaggagatggagggggtcctcaccgaggggcgccggtgacggaaggacgacggaaggcggctggcggagctcgggcggagggaggcggcgctgctccggcgatgggcggcgcttgggaagaaactgacgagggtggccgcgacctgcggaaggggaaggagggattaaggaggggaggaccagagcggtgcagccaaaacaatggccggcagcgacagtactaggtggagctcaccttgagtgatggggatggggtttcggtgacgattcacggaggatgagcggtggccgggcttgcccttgggacggcgaagccggtggaggtggttgcgcggcacggcgatggctaggacggcagtggtggtcggctggagacggtagaggcggcggtggctcggttttgcagtagggcggcgtttgtgcggtggtttcgagggggagagcagcggccggggtggggcttgatgcagcgaagccgccggcgcaagcggcgaggtgcggcgtcaactagcgcggcgacagcggccggctgaaggttgccggcgagcggcggcgatggggagcggcgtggggagagcgggagaaggcgagggaagcgccgacgaggaggggaaacgagagaagggagcccgaggatggattttataggctcggggagggaaaaacgttgccgggcgtggcggatttggggcggcaatgaccagcgacgtgggtgacatcatgggcgaagtggagctcgatcccggcacgatttttgggggaaacgtggggagagtgtagaggaggtggatgggaaccgatttcatgcggtttgggcgtgagggcgtgagcgggaggagccggaatcggcggcgatgtgggcggcatggcggcttcggcggtttggatgagggaggctggaggtagaggaagggtctgacaagcgggtcccgcagccccacttgtcggcctgaggggagggaggaggcgcgcagggaggcaaagcagacttggggaggggaggcgcgctgggccggcggcccgaggagagtagggaggagggggcggccagccttagagagagggagggcgcccaggccgcggggaggcaaaggagacggcccaagggaaagaaggggaatttaaattggttttctttttattttaattgataaaatgaactttgtgactttaaaattacttcttgagctccgaaaattcgcggaaaaatccagaaagtattttagggtacaaagaatattacaaaatgtttccggccaataatttttaagggaaaattttaatttcccctataatttcacttgattaaattgcttaaatttttatttaatttctgggaaatgcattattaagtgatttttaatcccgaacgaaaatcggggcattacaatccagcagttgctcctccatccagtcccccgtcggtccttctccgctcagccccccgccgctccttcctcaccagcgttgcctgtgtgcatcatcggtgtcgtcgagccggtggagctcagccggccgcctccccccggcgccagcgacctcccgagaagagaagagaagaaaggaaaaaaaagagaaaagagaagaaagaagagatttgggtcccacatttttctcacttacctgtaggtgtcatattttatttatttatttatttgctgactaggatgccacgtcagcgaaaccatagatatatactgctatgggatctaaattgtgcggttttgtatagtttagtggtgaagattttttgtattggggattattgacgtcatataaactcgacgtaaagttgagggacagctgttgaacttattcatacttctactttggaagaagagattttgcgagtttttttttatttcggttgctctctgcctctgtagctatctcatagtatacagagtaaattgcctctggaaaactactcaaaattcatggatacaattaataaacaaaccaacattgaataactaaacgatgatggtacgtttatatgtcaacagcatacgatgaaatgaaatgcgatacggtgtcataattgcatgggcatctggccaattttcaagccataatagtactatataaattgatgccctatttggtgggtatcttttctttctataaagttaaggccaaaatctcaaacctcatgcttctacgtcatcatcaaattgtgaaccgttggatgaatgtattaggatgaatgtattagattgcttctcaaacgttggagggaatgcagcatagagcctaacccatcagtcaccggatgagtctcttcgcctacttagtgccaaatatagcccacatgaacacattggcccatctccacacacatctacatgtatccagcccgtcaatccgtataaaatagttttatggctgaacgctccttcagttgacatgtgctacctaaattatctacaaattttggatagggctgctaaaaagaatttcttcaagaaagctatttgtttcttttgtttcttcttgagattgtacctcctatctaacaaattaatattaaccaagtcccacaacaacgcgaggagccctctagtattatatatatgtgcgttctgaagaaccaccaaaacgaacacgatccttcacccggtcacccctactggccaacgtgttgttatagacgctacttcctctgtcacatatcaaattcatttgtagctctttccatttatctcaaaataaatagttcatatttagaaaattattgcgttggaatagttatattggaagaagataaagtatgagtattggtatacttcctccgtacttataaaggaagttattttagacaatgtttaagtcaaaccttaggaatataaatcaataataactcttaagttgttgagtttgaaaatataaaaattatattaatagatttgtcttgaaaagtactttcataaaagtatacatgtatcacttttcaataaatatttttatagaaataagaaatcaaagttgtgttttagagatcgtgtcgctgttttaaatgactttttttacgagtacggagggagtatgtgggatggatggaaaaaaacttattttgagatggatgtactattaacatgagttagtttcaactatatttagaatatgtcacgacttaatgatgatgggatggcaacattgtcaaccagctttaattactccttaatctcttatgctcctagtcttgcatacctggtgacggtggtgagccatgcgggaacgacgaactatcgtataaaactttgttgatttcttagccccacatgttatagaccccatcaaaaataaaatttggtaatagaatattataaaagttttcatctttacaaaataatgataaatttattataatgataatatatttgagaaaaaaaccgttgcaaatcacggagattatgctagtgtttaaatagcaaatctggtaggcctgcctgaagccatgctgactaggagcctgctagtgacaggctggctggcaaccactttggatgcattaaatcgaccatgagcaaataatagagaagttgctcacaaaataagcaaaaaaaaaaaaccaatacctgtatttatctcagagcgatggcactcatggaataattaattttggtaattttattttctaatccttttagtacttcaattttatgaacatagaccgttgaaaatctttacatatctatattagtccccactaccaactccttatttttcttaaaaaaaagaagttaaaatgacatggatccacatatcaactacttccaccaccaactcccaactttgtgagaagaaaaaaaaataatgcgagacattaacaaatatatgctgaaatcaaggtatgctatatacatagaaaataatgataacaatgggctatataataattttttaattaaaatctcatcccaacgtataggtaatatgcaagtaatctaaatactactacaaaactaaagttagtgctgagttcatgcagtaaaaactgcaaagctttactctgctcatgcctcattgcctgctcaagctttctgtcgttgtgacctgttctcgcttcagctttttttttttttttttgcaaacacattaattgatttataattaagagtactacagacagagctgaagggaaatatcatccgcagtacattgccagaaaagataaaatatatacaacaaaaccatccattcagacataaagccaattgaactaagaaaaactttctccaagataatccaaacaacagtaatggacgagatcgacaagggactgtggcattgcgcgacgactacgtccacgagcctctactaaagacatgcacaccgctcttcggctgcctccacggaagtgacactcttcgagatttgttgttgagttgtagattttgcttaaacttcaccagactcaacaaaggatcgccaaggagttctccatcaaatctgaggagcactgaccggtctgtactcaacccgaatggaatcctcaacttaattggatactgctgcaaggagaaccggaaaaagtcttcacaccccagctcgtctgaggacgctgattgtcaacattttgtcaaatgaagaagaagaagaagaagaagaagaagaagaagaagaagaagaagaagagaagattggaatgagggagaagaaaggtgaaataataggggcagcatcaaccatatgaacatatatattacattggttactgcaaaactaatttggtgatattatcaaagacaaaaaaacttggtgtcaaaagagcaagtgcagacaaattcggtcctacatcatcaaaatttcctagtttattaaccagtgggccaatgctgtcttatcaattattgtcagaactaaaaaaaatagatttggaaacaagttccaggatgatttacttttaaaacatcaataaggccagctagtgcagaaggttctttgggggaagcgctacacaaaacgacatccattcatattatttttaataattgcattagatcctagcgtttagttcgagagtttctagccaaaaaatattaactccatatctttaactactttgggcactccaaaattgatagaaagttgggagagttctttttcctcaacgatagaggcttgttttcatgctagcatcttttgaatatataacaaaacaagagatcacttgaaagaacattcctataccgtctattatatttcatttctaactcccgcacttcatattgggaaaagtaaagatgcaaacgctggtagaagcatcatataaatggattacatagacccaaacagaatgtaatcgtttaaaacgatgtttatttagaaagtactcccttgttaacaactaaat

SEQ ID NO: 72313 - DNA, 8701 bp, Oryza sativa
gaggaggacaacacggacgcggcaacagatgaggaagtagagtgcgaaggtgttgccctcaccaccgccgtcggcgcagagcacaacgagcacgtacttggctagctcgtcgaggtggggaaggacgtggccgtcggcgacaagctccgacgcggcgtggacggtggaggatgcggccgtctacgacgagctccgacgtgggacatggatgatgaaggacgcggtcgtcagcgacgagctccatcgtgggacgtggatgacgaaggaagcgtccgccggtgatgagctccgacgtggcgtggacagtgcaggatgcggccgtctacgacgagctccggcgtgggacatggatgacgaaggacacggctgtcggcgacgagctccatcgtgggacgtggatgacgaaggaagcggttgccggtgatgagctccaacgtggcgtagacggtggaggatgcggtcgtcgacgacgagctccggcatggggcgtggatgacggaggacgcggccgccggcgacaagctctgacatggcgtggacggtggaggatgtggctgccagcaacgagctctagcgtgggacatggacggtgggatatctggtaggtatcgtctgatacctcgcaagtatcacattctacgtggtaagaatcgcatgatatctgataggtatcatctgatacctcacaaatatcacctgatacgtggtagaatcacatgatacctgataagtatcacctgatacctgataggtaccatctgatacctcgcaagtatcatctgatacgtggtagaatcgcatgatacctgataggtatcacctgataccggttaggtatcaggatctgatacctcacaagtatcatctgatacgtggtagaatcgcatgatacctggtaggtatcacctgataccggttaggtattaggacatgatacctcgtaagtatcaccctctatgtgataagaatcgcatgatacatgatagatatcatctgatacttctcaagtatcacctgatacgtatgtgatagaaacgcatgatacaggttatgtatcaagacctgatacctaaccggtatcatcccgttcgaaaacgagattccgttatatagcagcccccgcttgaaaactaacccctcttaggacaaaaacacattgtttgaacatattttaagtcacaatatttttaacatatgaattgcatgtatgaaaaatcatatattttgatttgttggatatttagttatcttttatgaaaaaaaagcttcaattgaagactatatcgatgttgaaacgatattttttccaccaaaagtgagtactatttaggtgtccttggaagtaaatttagaggttttatttttttaagataaaggaaactttcttgatggatgtaaacaattataataaagtgatacaattaatctaagatcactcttggcaccagcatagtaggttgtccacaacctataattattttttagaaagaagaacgacatgataacaaatatcatgccatagtgagctacaaccacaagctttatactctatacacgcatcacttagaaaaccttaaaaacaacacctccaaaataaaaattgcattgtcattgccatgatccgatcaacaaaacccaaatcataggttttcatactagagaccaaattcttcgaattctagacaatgccttcaaccatgcgtaatgcgcatactgtagcggcaggaagccgagtctttcgatgatgcactagcactgagcccgaagtgtccacacttgcatagttggtccctctcaatttgcttgtgtttgtgttggagaagattatcgttatgtcttgctgaaagaatctatataaactttctacctatattaagggaaaaaaatcatgccttaccagtctacctaccaattagtaccaatttaagcaatacagtaatatatcgtcggagagtggattttgaactctcgagtgaatgacccatcgttgtttacatgtcactcaaatggttatgaaatttttttgagaagatgtattaacatgtgatatattactccacaaacatgcaagttaaatcaacttttataagttgtaaaaaaacaaactacagataattaaagtatattcatagtcaaatttattttttcgttacgatatgtagaagttaaatttgactttgtatgtttgtgaagtgatatatcacatattaatatattttctcaaattttttcataaccatttgagtaacatacaaacaacaaggagacatcccctcgagagtttaaaatagtttccccgtattacccagtttggaggaaaccagaaatattttaggccatagccatgatacaaggtgaaacggttttatttcagaatctggttacaagagacttgaatttcctttactacaacggaactaaattcaacacgaataaatctacagacaatttaatgaaacaatcaataactttccgacaccttgtaatcacatcaacccctgagcccaacgtccatcagcatgagcaactttattctccttaatatcgtgtgttgcagtctcagttaatcgctcgtctgaggtgatgagcagccgcagaggagctgccagatgctcttcttgacgttgttacgcttggacttccccattcttgctccaggaatatccgagctgcacaagctctaatgctccaaatgaaatgctcctgtaaacaaaggaaccaattgaaaatctcctacaaaattacgcgaagatgaaagaaatatacacagctaaatagcaaaaaggaaccagcagagtaaaaatagaatgctattgtaacctccagttaacttcttcaggaatcaggggatgtcaagcttggtgcatttggtgaatgagagaagctactcctatttataagtgttgcaagactgaactgtacactgcataccttggcttctgaatattgtcggactttgcaagtaaaagttcgcgagaatccacaagaatattcaatgaagaaggactgaatgagtccagaacttgaattctgtccacttgcacaaacttaattcggtggtatttgcccgggattagcttattcaacccttgtttaattgcacctcacctctgcttgttagagacaagtagaggtgaggtgcttgttagaacgagaaatactcaggggtctttcggctagctccacaagatggtgggctagacgacctgggttcaaaacctaaccccttctaattatttgatattaggtccttccctaatttttgagttttttttttttctgcttgttagaacgagtcctagacgtcccaaactgctttaatcactatattagatgcaagcgattagaatgcgcgtaattaatcggattaagtgaatggtttggaacttcatcgatctatgccatgtaaaaagaaaagcattgcgtattccctgggttgcttctactgttacataaagtgtgctgttcgtcgtcctgttgattgaatctttcatctaagaagaattcagacacagccacgggttgcgaaatggcccggatagactctgatgatttgatgggctgcgcgggcccaaaaccatgaaggtcgccatcccttgggcctagtggtagggctttgtctcgcgcggcccagctcgtcggtcgctgttggtctgctacgccaccgatcaaagaagttcacaagcacagttggtttgcagtagcgtactctcgatctgttctaaaataaacaaatctattactcttaatattataaataatatataatatatcttaatactataaatctgttctatcaaatattatgtttttgtttattttaatatgaagaaaagtaggaaactaggaatgtacgtaggggcttttcaactgaagttgaccgaagcatatgtgcataataatttgttgggattattgtattgagaggcattgagcgtttccatccagggcctatagctgtgaagaagaataaaatttgagcatacgattccgctcccgttttgtaaaccgccaacatgcccatggttttggacctttttttgtgccaaccttgcaatcttcaactacaaataaacttggatggaccagttctcaatacgaatgaacaaaacatagtactagtaaattacggcctgtttatagttccctaacaaaaattttgcaccctattgcattgagcgtttgaacacctttataaagtattaaatatagaaaaaaaattaattatacagattgcgactaatttgcgagacgaatcttttaagtctaatcgctccatgatttgataatgtagtgctacagtaaacatttactaataatatattaattagggttaataaattcatctcgctatttactgacggattctgtaattcgtttttttattagtgcttgaacactacatgtgacaccctatataatacccgatgtgacatgctaaaactttacacctctcatctaaacaccccctacagctgctaggcaagtgaaatatctctatgttctggaaccgtacttgtttccatgtcattggccaggaaaacaagaaactgcgtcagaattgagacctggaaacattattggctcctaattaacgcaattgacactgggccacagatcaaagccatacttgtactgagcttggacgaaaatattcttcgtctttccagatgattaaagagccttctggagagagaagcaccatcatggctgcctatctggcgaacggccgatcggccatgtaaaggagaaaaggcagtttgcacaaggaataaaggcaacctagtctacaagttcgctatcaacaggcgatatgtcaccctatttctgttgctgttcaacgacgtccttaaataggagtacttgtgctacaagcctaacccagagatagcaccacaaatacctctcttttctttaggtgtttacttcgacagcttcaccaccttcgtttacccattgccatggcggctgagaagcgaaccattgggctcggcatggactactcgccgtcgagcaaggccgcggcgaagtgggcggtggataacctggtgaaggccggcgaccggatcatcctcgtccatgtccttcccaaaggagcagatgccagccacaaggagctctggaagagcaccggctcacgtatgtaggggcattgcattttttttttcttttgccttttcagtttcttctcttgttcagcaaattctggttcagaaaagattgacaggttttgcatctgatttaccgttggtttttgactttgtgtagctttgattcctctgctggagtttatggagatgaacgtgcaggcgaggtatgggatcaaccccgataaggaggtactggagatcctgcaagctgaatccaagtccaagcaggtaatgattctgcagccttctctgaattcttcatgaattacctgtgatgggactgtaaaaactagaagggaaggttgattcaaatgtaatcaaactaaaaagaaacgttgatccaaatgtaattcaaagcaaaacactgattccatattggctggatcaggttgaagtactggcaaaagtttactggggtgatgcaagggagaaactctgtgaggcagtagacgatctcaaggtgaatacctttgttcttggttgcaggggactaggacccttgaaaaggttagcatttaaacctttttcattctttgatctaaacctcttctcagttaaattgcgtgtgaatcaatggtttttacctcaatgcagggccctacttggaagtgttagcaactatgttgtcaacaatgcaacctgcccggttactgtggtgcgtgcaccaaccgtgtcaaatgcctgattctatgctacatgggactgctggaaattggaatgctgggcttgttttgctgttcatccatcttttagcagagaaccttcatctgagttggtgccattgcaaggattggtctctggctcctgcacttagcttttccatgctattggaatgttattaagttgaatcttcggtgtatttccttctgttacttcctatgtatagttcattactactgtttaatggtgaatgttaaagattgccaatggtgtgcttgctttatgtatacgacaggggccctaagaacagttttttgcttaggcaggtctttgtaacagaaatggcatatctgattttcttttttataaaataaaacaatcttacataagcaaagataatagaaaaggtgcctggcagtacatcaaatgtatataaacctttatttccaaatggcagaaatatatgctttattctttaaatataacaaacagtgttttacattaaccatctgctttgaattttgtcgtacaaattgaggcgaatactctttttagacaatgagatgtctgaaacctctaacaacaatggaagcaattttggagcatagcaatcagaacatcttaccagttccatctttgcgtggaacagattcttcaagatccattctgcgccaactcccactcaaagatgataactcatcaaccttatcatacaaaccaagaagaccacctgtatgtacaaaaagaatttttcgcccttcccacttagctggattagcacccatgtctttcagcattccatatgctgcctttccactgcagaaatatgaagcatatatctttaggcaatgatatggccagtctatcatgaacttgtgatgaccttcaatattagtctaacagaacaaaactttttatacttttcgacaaatggcaagtatactggttgtaaaattagagttacatgcaaaaggtgtttcttgggattaatgtttcaacaaaaggaatatattgtacctgtagactggatcaaggacaatgcctgttgctgtagctatatctttaacaaacttaagctcctcagctgtgttcatggcataacctaagcccttagcctgtgaagcggcagttgcaggtaatcaagtcaaatgttcacaaaattctaccaatgcacattagcaggaaatatcatcaattagagttgcaccataaaattggaacaatgaaatgaataaactagtttcagaacaattatgttatatactgatacgcgcataacaatgtcataattagaggatgtaagtccactcttcaataccatttaaatatcaaatatagaactttaaaaatgtacttacattttcaatgttgactaaatcatgtgaacgcaaatcagaatgaagtccatcaatcaggtcttgaacataggaatggaaatatccaggatcatcacaaacagagaaagcatggacctatcctaaaaatggataattagtcgaacaatttcagcaggatagaaaacaatcaaagaaagtgcatacttttgcctttaagctactcaattttgatcctaaagcaagaccagcaatggttccaccgctgcataaatttaaaaatcattcaagtcataaagcagcaattgctactttcaggaactaggcatgacgcaataacaagtgagtacataagtaccccttaaaagtaaagaatggtgcgtattgacaaaatacctgccacatgcaacaacaatgtcgtcaaactgaacatcacctgatatctgaatttgatgttcaatctcccttattgcttctatatatcccctatcaagaaacaaaacaagttctgatttacaaaaagaaaaaggaaacaatacaagttacaaagataggtcaagtttcaacaatcgggtatcactttcacaaattctgagacctgtttgaactttgaagtgcaaaccttctctttacagtaatcttatattctattcaatgttgttgattaaatgtggatagaatacactacatttgtccttcagctatgctccacttgttagccaccacacaagatagaaccggatcttctagtgttgcatgagatccactagattcagagcctagggccttagacaattccaacattccaggtccaacatagtatattgaccaatagaaatttgccaaaaaaaagtgatgccctaatgtttattcaaatacaaactaatctcttcttttctgatagactgatggcaaacaccaatccatgaataataatagtccctgaggaatattcaaagtatgctataaacgcacaaagaaattgaaaatgcaaaaatggttcaatagttaggattgaacagaaaacaataccaagttcctagagagtttgatccaccaacaggaataacatatggttttcggccttcttccaaaagcttctttttcagcaagtccgctaaagcctgaaccaaataaatccatactaggcttagggacttttaagcaatatcaatatgaataaagaagttctaacaagaaaaagatcactcagatattttaataggcaatgccactttaccagtttatctacatacatattcaaagaataggcaatataatcatgatctttcctcagaatagggaaaaaatgaccatgctaattgtatgatgcagacatatactgcaggatgcattacttgattggacctttagcccctttaataactacttgagtatggatatcaagtatcagtataacaccaaaatataaaaagttcctttgctacacatggcccgatggaattatgaaaataataataaaagcaataatagcacatcatcgaaaagagcataccacactgccaatttttccatattcttcttttgaaacaagat

SEQ ID NO: 72314 - DNA, 9867 bp, Oryza sativa
  unsure (1)..(9867): unsure at all n locations
ctgtggttctgaaagttccgaatgnacnnnacnanngngcnngcgcgnggcgcgcgagagaggggcactctgcgcggcgacgcgcgctcgcgcgtgcggagcggtgttgatcggaaggagagagggagagagggagcgggagcgtgccgggggagagagaggaaagggccggggaagaggggaagatgggcccagagaaaatcggcccatcgaccccgggggaggcaaaatggacttttgcagaggaatttgatttggaaggatttggattcggagttgaactcgacgatagatcggggatcgagatcttgagatggcacgggcactagacaacaagcaaagaaacagatttcgcaattagggtttttaggagataattttcccgctaggcgccaagacggaacgggcgctacagaccaacccccctaacaagaatctcgaccccgagattcagcacctaagggagcagctccagaaactcggcgcggagaagatcttctcgctcccaggttgcctcatcttcagaatggttgctccattggactttgtagaacttgatggtcttccttcgagtctgacgttctgcctcttcaagaaccttgatcggtctttccttgtaggtcagattctttttcagcacgatattacccaggggaatttgctcttctggaactcgaagacatttctttagctgggatacgtggaacacgttgtgcacatctgcgagaccttcaggtagctcaagctgataagccacttcgccacgtaggggccgatgtagcggggtgctaacttgccggacatcccaaacctcctcataccacggaggggtgatacccgcaggtacacatgatctcctttttcgaactcaaggtcacgccttcgattgtcagcgtaacttttctgacggttctgcgctgtctttaaacgttctcggattagcttaacttgttcttctgctgacttgagtatgtcaggaccgaataccagcgcttcgcccacctcattccagcacaagggggtgcggcactttcttccgaacattgcctcattcggcgacatctgaatgctggcctgataactgttgttgtatgagaactcagcatacggcaaacaacgatcccaagtgccttcgaaatccagggcacacgcacgtagcatgtcttctaggatttggtttaccctttcagtctgaccatcggtctgcggatggtaggccgtactaaaatttagatcggttccgagggcttcatgcaattgtttccagaaccttgaggtgaactgagtgcctcgatctgacacgatcttcttgggacagccaaatctacatacgacatgggtcatgtagagttctgctagtttctttccatcaaaggtggttttcactggcacgaaatgagctgatttcgtgagtcggtccacgattacccagatggagtcgtacccgttaggggttcttggcaaactggtgatgaaatccattccgatctcttcccatttccactcgggaatcggtaggggttgcagcagaccagctggcctctgatgttccgccttgactctttggcaaatgtcacacagggctacgtattctgcgacatctcgcttcattccagcccaccagaagtatgccttgatatcttggtacatcttcgtacttcctggatgaatggaataggcggactcatgagcttcctttaggatgagatctcttaactccttcttggccggtacacagatgcgtggaccgcaccaaactttgccttggttgtctatggagaaattggtgtctttcttctcctgtattctttttattaattcttttatcccttcgtcgtctttctgagcctcccggatttgcgactctagggtaggctgtactgtcaagctggcagggacacctgactgtaccacggtcagccttaacttctccaattctctgcacaggcgatcttggtcaggccgtatttgagctacattgcaataggccttgcgacttagcgcatcagcgaccacgttggctttaccagggtgatagtggattccaagatcgtaatccttgattagttccaaccatcttctctgtctcatatttaactcggtctgtgtgaagatatacttaagacttttgtgatcggtgtatacttcacatctgttcccgattaaatagtgcctccagatcttaagagcatgaaccacggctgccaactcgagatcatgggtgggataattgacttcatgaggcctgagctgcctggatgcataggccacaacctttcgttcttgcattaggacacatcctaagccttgtcttgatgcatcacagaagatctcgaaatcctttcggatatctggcaaggtgagaactagggcagtggttaaccttttcttcatttcttggaagctgtcttcacaggctgcagaccattgaaatttcttttccttctttaacagctcggtcataggtctggctagcttagagaatccttcaatgaatcttcgataatatccagctaagtcgaggaagctgcgaatctctgacacattcttgggcgggttccaagcaagtacagcttcaaccttgctgggatctacttcgacaccattggaggaaatcacgtgtccaagaaatgctactcggtctaaccagaattcgcatttcgagaattttgcgaatagttgatgatccctgagcttttccattatcaacctcaggtgttcagcatgttcttcctcgttcttggagtatatcaggatgtcatcgatgaataccatgacaaactggtccaggtattccatgaagattttgttcattaagttcatgaagaatgctggagcattggtgagtccgaaggacattactgtgaactcgtataaaccataacgcgttgagaaagcggtctttgggatatcttcagatctgattttcagttggtggtaacctgacctcaagtcaatttttgagaaaactcttgctcctttaagttgatcgaataaatcgtcgatccgtggcaacgggtacttgttctttatagttacttcattcagggctctatagtcgattaccattctctcagagccatcctttttcttaaccagaagcactggggctccccaaggggatgagctaggtcgcacataacctttactttccagctcttcgatttgtcttttaacttcggctaactcattagctgccattcggtagggtctttttgcaattggtgcggtgcctggtgccagttctatggcgaactcaatctctcggtctagtggcattcttgttaattcttccggaaatacgtcgggatattcacaaactatgggcaccgactccaaggaggtgacttgtaaacaggttaagatagaccgacttgcggtaggagtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagtcaacttcctcaattctaaggttaacttccgggcatatttgagttgcccttatattccttccaggggaatgtactatcattggtacacgtaaattttgggttttccaaccatttcttttcacaaaagcttgtgatatgaaagaatgggaagctctcgaatcaaacagaactattgcgggtatggagttgacagagaacatacccatcacaacgtctggagcatcctgagcggtttcagcttgaatgtgattcacacggcctcgaccaaagtggttggaagcatgtgaaccttgtccacttgcctgagtgctaggacgagactgagctgccgctggagtaggagttctggcagtgctgccattagcatgccctgagttggtgttggtagaattctgagggcactagcatagtgacccatctggttgcaccggaaacactgaactgctgatggtccctgtggtgacttgaaagaggtaacactgtttggcgcagtattgccactaggggcacgctgctgtggctggggtgccgggcggttcatctgaggacgaggggcgtagcctggctggcggttagcctgagtgaccgactggtggtattgcatgggttgaccgtagcgagggcgaggtgcgcctcgggaggaattcccctggtggttagatttgcgtttcttgtattcttcggtagcctcttttctggcatcctcaagtagaagtgccttgttgatcatatgttgaaaagtggggaagtcatgcgctagcaactggagtctcattccaactgcgattcctttcaagaatttcctgatcttcttcttatctgagtccacttcctcaggggcgtaccgagccaacttgttgaacatacttaggtactcattgacactgctgttgccttgcttaagtctgttgaattcctctttcttcatgtcaatggtgctttcaggcacatgagctgcacggaaagccgtagcaaactcatcccaagcaatgttagtgggttcagggtgtgcattgcagtaattctcccaccaatctgcagcaggtcctcttagctggtgagaggcgtagagcgtcttctcgaccggagtacactgcactaagttgagttttctatcaacatctttcaaccaatcgtcagcctcgacgggctcgacggtctgagagaactctggcggacgtgacctcagaaaatctgtcagcttggatctattgttgcccatgtgagggtggccatttccatgcgcattatgctgataaccggctacggctgcggctattccttgcaagatttgtgtctgaactgccattaagtgttgcatgttgttttccacatgagatggggaagggaggcgttcttctccagaattatgactggcagtgcggtgagagcggtgagactgttccatttctgcatcacgggaagctgtgcgatgcgagcggttgctacggcggggttgctcaacttctgcattgccggaaacagtacggtgcgaacggttgctgcggtgagactgctcattagctgattcatgatttgcttctggttcgactctaccttcttcaaaaccgaagcgggctggcgcacgagctgcacggcgggggcggctagccatctaaactcccagaagagggcggggtaagagtcagataagtacttaggagggcaaggagcaaagtaaatagcaactcagatagcacacactaggcataaactagatttttcaaatcttaaaaacacctgatacaacgggtgtggacaagtcacagagctacgccgagcttgactgtgcgcacaccacctaggagaaccagactaccaaacaacacccacaatcaaacacacgcacgcactacctcgccacgactccaaaagagttggcggcggaacaaaagggcctaacacacggacgactgctgaagactgcctcctctactcctcgtcggcctggctgcctcctgtagtcggctcctcagtcgaagaaacgtcgatcggctgacgtgaagggaccggcggaacctgtcgagggccggcagcagcgcgggccgctggcggtgggggagctgggtggtggaaacggaacacggtggaagaaccaacaacacgcttccacgcagtgcggataaagcgtggaccacggcgggaggaaacaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtggcagaggcggcctgagtcccaggagatagtgtcaactgaggtgacaccctcctcggccagacgggcctccaaagcggcgtagcggcgggccagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcctccgagacggtggctgtagtcgtgggctaggcgacgaagcgcagtccaggaaaggtcctggtacgcgatctggagagtgggcctggccacggtgaagtggtgggggtgaaggccagctccgtgtatacctccacgagggtagaggtacacggagagctcacagtgagggggaacacggtccacggagtaccccgtgtactcgggacacgagaagccaaggaaacgggtgaggtcacgaagctgagcgacgtggtgaccctcaccaaaaccgtgggaactgaagctggcgttcactgccatctacaattttgaaagagggagaaggatcagtaaccattttagaaacaaactattgaaaataaagaaaacaaaagagaccttagcttttcgcaagtagttttgaacttagtatccttagggtcgtcctaagcgtcgggtttcgccctagggccaagcctgtgctctgataccatctcttgtcacgccccgagctagtcccgactggaattagcccgtgacgctccaaattaacctgttaatcgataccagtcccaggaaacagtgctggtatcacaggaagatagaatatcacagcaacagaggtctctttattatagagtaggagtacagtcatgttgggctgcggacagatcccgagctcacaactgcattagaaaagggaaacggaagccgggacttggaccaaacaacacaggcgcgacttgggaactaggccgaaaccctaaaactcatcgtaaccggcttgctcctggaagaactcctcatcagcaggatccgcttcatcttcatcagcaactagggggggaatatttatatagagcaagggtgagtacgggagtactcagcaagccatgggaaataagtgtttaatgcaggcttcaaggaaaggctgttgttttcgtaattgattttatttgaactcttttctaaaaacatctaggtgagtgcttctcaaacgacacggttgagacagtgcgtcccgtccggtcggagtatgtgcaatgtatcaatctttagatcttaaaacaaggttggcacccggccaacagcttttcaaacggccacccgggccaacaacttttcaaacggccacccgggcctagctgatcccgtcagctgctgatttttcaaacatcgaaccccttttcacaacagtaatttcacaagcagttgtcaaacaaaactacgctaggaatcacctcacatccgcccatgaccgtgggcacggctgttcgaacagtttgttaatctctgcagagggggtacactttacccacacgacattactaacccggatcacccagcccgtggggatcagccacgtcgggagacctccaagctttcatgacaaggcatttccaaagccgacacaggcttaccatatgccgacgagaggggtcccagaccaacaacaggttaggttccagaccatactgtgctaggaagcccagggggggtcctctccgacaccaccccggcgaatccacatgtctctcggcatcatggctcccctgataagctagttactcagccaggggtgtcccattccacccatgtggtcgtacttgtcttttgttcggatgaaattccaaggaatcggtccttaagtgcgggagtgggaaaaccgtacacccggtacgttccccggtccgcggttttataaattcatttagttcgcaagcaccgacccaggtgtcgggttttccaagtcttttgtaaaacccaagttttacccaagttgtttttcagattttaagtttgaaggcgaccgtcgatactcgcacagagtgcacgaatatcgaggcgcaactgggtggttacaaggggacatggtataacaattaacaaaggaaggatcaaatgcaacaaattaggcaggtccgccaatctgccttgcagacgggacaacagattaagtgcgatcctatcaatgcataatattttgcaagcaatataattaaatttcaaatataggctcaagatgttcaaaggtggcttgccttgctcgagatctggagcttaatcctcgaaatcctcgcactgcgggtctacgggctccgaaactacacgcgaaacgggacaactcaacaaacggcgaaaataaagccttattaatgacctctaagcgtgccattaggtagaactcgagatttggggaattttggaagttgaacggagtcaaacggatttacggtggggaagatattgaatttctaagattattggatttttagtctaaaggaaaaggatttaattaaatcctttttggaaaggataaagagaagaaaaagggagagggagggaatatagacttccctcggacggctagggcgcggcccgagagaaagggcggctcggccgagcttaacgggccgaccggcccaagaaggcggcccagagcggcccaagacgcgtgcgcgcggaggaaggagagagagtccggtggaccgagctcaccacgcgcggtcccgggtaggacccgcttgtcagcggctcggctcaccttgcggagggagcacgcggcgcggcgctagggtggaggatggacgtggtgcatgcacgcggttcgcggaggacgcaggtgcggcgggcccacgcgcagcctcacggctcgcggtggaacgcgcacacggggagggactgaccggggtcggcccgtcccgacctcggctgagctggcgccgacgtggcgcctacgtggctgccacgtgggctggcgggaggtagacgacgacccggccgcgaatggacggcgggcggcggcggcgagcggcggagcgaaccacggcgatacgggcgaaagcgagcacaccgggcggttgttcgtgatgaggggagacgagccaacggctcggattcgccggagggagcttgacggcggcgaaacgcggcggcgacaaccggcggggagggaagagggaaacggcgacgaggccacgaggggtcgattcccggcggtgagagcatctacgcggtttcgggaactcgatgctagcgtcggattggatggagctacgccgagcgaggctggcgacgtgcgggtgctacggagctcgagcggcgacggcggcgagcacacggcgagcgacggcaacggttggggcggcgccggctagctacggggagtctactcgtgctaccaccgaaaactaaggggggaagatggagcgaggaggaagaacggagggagacactaccgtgcgggacggggcgctgtgacgagaggccgacggcgcgggagtaatctctccggcctcgggccggggaagaggaagaagagggcgcggccgaagtccccttccgcgtcctcgaacgcaccggttctcctggcgctcggcgaaggacggcggaggcgagacagagcacgggggcggcggcaatggcacggaggcgaatggaagaggaaggggaaaggggaggctggggtttaaatgggcggcaatgtcggtttgggaaccgacttgcgcggtcaagggcgcgagctggcgctcggcggtcgcggccaaagcggcgacagggaggatgacgccggcgaggaggaaaaaggggaaaaggagggggagaaaggggggcttgcccctttgccgattcgggaaaaaggaggaggtgagcggtggcgacccggcaaaaggaggagggatgcttgcttcgtccttggcggcttgcgccggagtggcggtgccggctatgaccactgcgatgacggcggggcggtttggaacggaacggttacactggcaaagggtcct

SEQ ID NO: 72315 - DNA, 10851 bp, Oryza sativa
cgccggcccgcagccacacgtatccagcgacggcgccgataccttcccttgtccaccgcgatcgggcctccacgacggcgcattgcgcgacaccatggcgaagtgagtatggctggggtcacacaccacgccgtgcaggtgcagcgcggcgagcaggagcgcgagcgcgagcgcaagcaggcgcgcattatggcctgaagccgccgccatggacgcacgttagatggtggtgagacgtgggggggaagacgagttttaaggaggaggaggaggagatgggtccatggctccatgaactccattgacatggaatggatcagcacaagtggagcgtgctttatgggaaaaactatattcattttttaaggggatatcatctcgtttttacatgtcactcccaaaataagtgcagttttaacaccgttcatgctcaacgtttgaccgttcgtcttatttgaaaaacaattatgactagtatttttattgttattagatgataatacatgaatagtactttatgcgtgactaatatttttattttttttataattttttcaaataagacggacagtcaaaacgctggacacggatatctatggttgcacttattttgggacggaggtggtaaaaaatttagtgtagcagattatggctcggtttagttccaaactttgaatcccaaaaacgtcacatcgaacttttctacacacacaaactttcaacttttccgttacatcatttcaatttcaatcaaactttcaactttagcgtggaactaaacacaccctatatgtgatatgtcacttcaaacatgcatattcaaattcaacttatacaagtaaaaacaaaaatagcaaatttaactgtgaaaagaacacgtaatttacggttaaatttgtttgttatttttgtttcaaattacatatgtcgaattttaacttgcatgtttgcgaaaagatatatcatatattgatcacaatatatatcttgataattttttttaaaaaaattttgataactttttaaacgatacgcacaaaacgagaggatgtcccgacaaaaatccacttccgctttatgggtgaaaagaggtgggaataggagagaagttgttttgccggggaagagaggaggcaatggcagccagcaaagagagaggcggtagtggggttggcggttaattagtcgtcatcgacggtaggagtgaagaagaagaagaaatgaagcagcgctcgtgcgtgcaggcagcggcggcgtgcagctcgcgaccactggccgagccgagcggggcgtgcacttgattccagggcgaagtggctacgtgcctagctcgcgaagtgaatacacacataatagtatggcagtgtgcggtcaaggcgttttgtgattttgagttgagttgttgatgatgggtcagtgcggggaaggcaatagcgtcggctttcctcggcaggagggcagaggctgcctcacgaccgggctcagtgctctgtagtctgtacataccggtagtatatgattggggcactggggcatgacaaaaggcacaatgtgtgtatgtagcaagtggaacatcatcatcttctgggccaggagcaaagatatgttcatatagcatattagcgtttgctaaacatgaagtcagcatgacatgactcggccggaagcaatatttgccgtctgattcataatagcaaaccagaaaaaaaaaggtgtcttctctttgccagaataatgcttactatattccatatcacaaataagtgtgcagatatgtgtactgtggagtatagaaaaagaatgttggaagatggagaacttatctgcttgacccagtgagtagtgaccctacaatttggatacccacccaagtttttatgttagtgtcccaaaaaggctctgcactggtagtcttgtaccataatgctcacacatattgaattgccaataggcgtcccctttcggatatgcctaagccaatttgtccactggtgcccgtaatggccttagcccctctaaagagaggtgttgcatactggagcctgagcagacaacttaagtttgaaaatatgttatcaaggctggctcatgcataatttgtttctacaatgaactgcacagaatttccaaatatgcatgtggttgctctgacttgtcttgttaatttttcttaatttctagcatagcgattttacaccaacacaaaatacttacatgatacataagttttgcagcaaattaatacaccagaatagtaaaaactgaacacaacggttcataagtagtagagaaaaatggctggccctagacgattaccaaagattcaggtatgcatgtgtgcagtttggcatcgaatgagctcactaaagtttattagggaactatttaacaatgagaatcaagaacactaaaaaaacggtttagtgcaccagcaaccaacatatttgtatatgccggctacagaaaatgatttcaggggaaaagtatatatcattatccacaagatatgtgcccatgataaacctcagcatgtgtcatgttacttgaaaaaatatacaaagcattccatttctcaaattgaacagagtgcatgtaaactacatcagcagtcaaacatgacatcttcgatatccaagaatatttccagtggtggttcacaggtatggagagtaactgacgaggttcatgaccaaccacatatgacaaaagaggttcctgataagacaaaagatgatcattatagagaagtatcatttctcaggaacaacagaagatggtctcagaacatttgtaaatttcatgtgtggtaacagttcaactccagaaaaacaaacttctgaaagtgattacttggttgtatttagagtgccttgaatgccattcctgggctggtggtttctctttttattaacaaagggaggacatcactgcctcgcctttctaagaaagaccatttttgccttagaaaaatacaacagaaatacagaatacggtgagaagtaactctatccatttgttcaacgagaatttatctcatctttgctgcccttagcccttaggtttttgtgggacttttcgagtaacaaagatccactggcattgccgttatagcatcttaaaggttttttgaactattgcaacattatgtaaacttgagattgcaagagttaaacaaaaatgttgtccatgctatcatgttaacgaaatgtgtagcatactaaatatgtgaaacacaaaagctattagtggtttgttggatttagagtataccatgaactagtaaaaaagattcaaaccgtcttagaagctcacccaatgtagcaaaaacaccggttactcagtcttcttttgcttggttgattctccagtcttgctaatgatggtatctaagtgccttgatagtacactgtgcgccataccaatcttttcatcgacttggtcctggtacttctcatacaatggtggaactaacagagaaaacattacacctagagaaaagccagaatgatacaattattacatatgagctatcataaaagaacgattgatccatacatgaataggtccaggaagttaaagagaaacaaattcagtagtactcaccaatgtaaatgagcgtaaggaagttgaagagcattccaatgtatgaaaccacccataaaatcaatataacctatatgaccaaacaaaataaggggcataagaagaaagcatacaaaggcaggtacagccatatagacgtacagttgtgtgtgtactagtgggcatggatgtgtgtgtataagagagagacctttataaaaacactcctatctctcttgatggcaatatcatggccaacagccaacaccttgttgatccatacaagagcccgatctgcagctttctcaacaaccacatctgagacctctagtttagggagtggtggaagaggcctgcaaaaatcacaactttgtgtcaaacttggatagatgatatgggcaatggaagtacaatgccagtcacagagaacaacataaaacaaccaaagtgccaaaaacagctctttctttttcggtttagcgatacaatcgcagagacactgcataaatgcatatcaattctaggcaacaatcaagtcagatggggaacacaaactcataaatgagccgataaggaatggcaagcgcggtgattgaccatgtaatgtaaatctaggaaaaaaaccttgtggattgcttgcagaagagaccatatagcacagttacaagctctagagaaaatgacacatgctagcagaattaacttatcgaactgctatcgcggcttagctttaaagtaaagcagcctctttactttgtagataagggatcggatagatgcattattggtaatgtaataaaaacgaaatatgcaggtttcaggaaaagggataattaggaaaccccgacatatgcagagttcaaacctttgaacaatctctaatcttaggagatcatcggatcacttccaattacaaactgctctggcctgaagtttagtttcttactgcaacccgtaattcaaaaatgctaagcaagttagtgtatgaaacagtttggcagtgagcttcttgaagccaaaaagatgcaacaaccaaacggttggggaaaagaaagtccacattattcagcaaaacctcatacacattacagtgaacaccgcagttacaactacagcgaatcagggccgcagggcgcggcgcgactctacatgagatcagaaacacgcggtgctgtagagccagggcaaaaacccacctgttgagcagcgaggcggacttggcccagaagaagaggatggcgacgaggaggagcagggcgttggccatgactgacgggaagctgtaccccgcgcgctcgaagaggaaccacaccgccgtggcgcccgccacggccgccgcggacacgttcctccgccgccacagcaccaagtcggcgactgcgagacgagagaacacgagtgaggagaaaaccgaacccaaattctcgacccggatcggagagcgccgggaatgcgcgtgcgtacctgcgccgccgccgaggagggcgtggagggatcggcgggaggtggtggccatcgggatcgccgcggggagggttagggtttggggccgcggccgaagcgaggagaggaagtggggtaggtgagtggagctcacgaggcggaggcgacgaggacgagatgggatctctctctgtgtcctttgctggatcaggaaatggattcggtttcggagacggcgcgagcgaatgaattccgtcgaattattttgaaatattatggtgagttattgcaattttgcgggcaagtgatgcccgatggtgttggaataactccttccatttctatacttttaagatttaaattttacaccataatattcttatttttcactgatttttgtgattcccatcatttcaataattttaaagctaatcaaatgcttggaaagagagaataagtaaatttcatttaaccacccgtattatgatctacctcttaatcacaaataataataacctataactagatgggatacattatagtactacgaatttgaacatagagcatataatacccaacgaatttctgtcgagatttatagtactatgatgtgtcctatctagtactaaattttagaacaaattgagtaaattaaaaaaacatacgattttttagcacataaacatatgtattatggtcatttcaaaaaacacaatatttatcattctaactttgaattaccataattttaagttatacaatcgcatctcgaatttatgagttatttatccatcatataaatgttacatccatggccttttaaaaatttgatatatgagtatgtcaaattggttacaatgtggttttgtggaactttatatccatagtacctatgggtcatgtgctatgtgtcaaaatccttgtagttttgtgtaattttgatcataacgagtgtatttttacaaaatttcccaaaagaaatacaagtaattcgaaattcaaatgctaacaactgaagtgaaaaaaataaattatttattgtaacaatccttatattttaaaattgatggagtaattatgtgcttggaccttctagtacattcagtaaatatatactgtttagaatgatttttttctcttaaatatatcatggccataaatacgtttggtcatgcaagctactagtttcatgccgttcaatttggaggactggcactttcatgctgctttgtttagatacgatgtcatttcgaagaaaacaagtatccaaaccaacagattagtggatgctagcatttgacgacgacatgtttaaatcaagccgaattatgggtccaaacatggacatattcttcctatttgttgaaaacaacagcgtggaacatgagtacccgttccaacgccaaccgagtaatcggtccgatgctaccttggctgtgtttagttcagcgcaaagtttggattttggctgaaattgaagatgatgtgactgaaaagttacgtgtgtataacaggtggaggtggatgtgatggaaaatgattgaagtttggatccaaacacagcccataccaactcacatagttcgtggaagggagacaataattgtgatcctctaaaatatcacagtaaatttctatttttataataaacacacaaacgaacctgaacagtaaccgtttcatattaaatgaatatacggtccttacctgagacctgttttttcagcaaaactatatagtcatggcatgtatctatatatagaagaccaagatgcacttatagaatggaatgtgtgatttcaattttgagaccccgtgttcaatatctaacgcgcttacaattttttttaaaaatgtgtttggaatccaaatatcgtcttttatctatagaagaacattttgttcagtacaccatattgagtctggtggatatcctagaaaattccaactccaactgacggtacgccagtacaccgccattggcagctagcctgaagtgatccaatttttaatttttaaatttttctgatctttttaactcttatctcatcatactttaagtgaacaaacacttatccaaaattatatcagaaatgctattacattttaaaatggagaaggtatggcacgaaaagcaccaaatccaatagctagaagccgcattcagttcaagatttgaagcaatatattcaaaactcaaaaatagcctgaactcctcaagattagctcacacgatgatgacatgactcaactgaagaatcctggccttgtaccaaaaacaagtccaggttcagagaaccgcccccttccgcggaaacggcagctgttacaaatcccacccgagcagcagccacttccaacacacacgctcacccgattccccgcttcgccgccggcgctcgcatcggtcaagtcaactcgacgcccacacacgcaccggccatggccgcggcggcggcggagcagcagcagcagggcttccgcccgctcgacgaggcgtccctggtggcctacatcaaggccacgcccgccctcgccgcgcgcctcggcggccgcctcgacgccctcaccatcaaggaggtcggcgacggcaacctcaacttcgtctacatcgtcctctccgacgccggctccctcgtcatcaagcaggtccctatctcctccacgcgccgccaccgtcgccgctgccacacatgtagtacgcatcttctgtctccgttctttcgctgacgacgctgcaatccaggcgctgccgtacatccgcttagtgggggattcatggccgatgtcgagggagcgcgcctatttcgaggcctccgcgctgcagaagcaccgcgccctctgcccggaccatgtccccgaggtctaccacttcgaccgtgccatgtcgctcatcgggatgcgctacatcgagccgccgcacatcatcctccgcaagggcctcgtcgccggcgtcgagtacccgctgctcgccgagcacatggcggattacatggccaagacgctcttcttcacttcacttctctacaactccaccactgatcacaagaaaggaggttggttgatttattacaggtttggtttgcctgtgaaaattgagaagggagaaaaatgagaaccgaattgatggcatgttgtgttatgtgaattgcagttgctcagtattgcgataatgtggagatgagcaggctcacagaacaagttgtattctcagatccatacagggtcgccaaatacaatcgctgcacatcacccttccttgataatgatgctgcagcggttcgagaggatgctgagcttaagttggagattgctgaattaaaatcaatgtaactagctctcctgattaaaccagcgtttctctttccttttcattggagatgatggacatgatttgcatatgcaggtttattgagagagcacaagcttttcttcatggagatctccacactagttccatcatggtgacaccagattctactcaagtgattgatccagaatttgctttctatggcccaatgggttacgatattggggccttcctggggaacttgattttggcatatttttcacaagatggacatgctgatcaagcaaatgatcgtaaggtgtgtatggatttattggctaataatagtaaatgaaagtgcgtaatcttacctgggtggttaagttgttttgcgtttgctaagataatggcaaccacatgtcttcctgtgtactaatttcgataggatagaagtttggaacatgatacttgtatcctatagaataactagcaattgatattgttgatatatgccgtatgtaacagagggaggagggtgctcagcagacgatgaatgtccctgagtattactccctccgtttcatattataagttgtttgatttttttcttagtcaattttttttaagtttaaccaaatctgtagaaaaatagaataacattttcaatacaaaacaaacatattatcaaaatatattctatgttaaatttaattaaactaatttgctgttgtaaatgttgctaatttttttctataaatctggtcaaacctaaagaactttgactaagaaaaaagtcaaacgacttataatatgaaatggagggagtacttaatgggaactgcagaaatgacaagttatgatatggcaaagtgcaattgcaacatctagattctagaaggtattttcatgatgtttcgccaggcataaaataagttctatgtctgtacatattttgcaggcttacaagaaatggatcttgaagacaattgaagattcatggaattttttccacaagaagtttgtcgaattatggaataaacacaaagatgggaatggggaagcatacctgccccctatatacaacagctcagagcttttgagccttgtacagaagaagtacatgacaagcctatttcatgacagtcttggatttggttcagcaaaaatgatcaggtaattaaacagtacaattatgtagagtctgtactactaagtcaatttgctgaatcttatttacgtctagactatgaagatatactagacctgccctttttaaatgtaagaagctcaaaggcacagtaagttagtccaaagtagaggtttccgatgccaattttgatgcagcacttctttttcataaatgtatatcagtatgtgctatcctaaaagagatgttccagaagaccacctttgacgattataagtatgactgaaaaccgtcataaatggttaaattggaggctattcaggatattatgttgtgagaagctaagtgtaaagaacttaaaatcacatttaaacgccattttcaaattttttatctgtattccgatgccttgtgcatgatcctcacgcgacttctgtttactaaattggaccatacatatgtaggagaattgttggaattgctcatgttgaggattttgagtcgattgaggatgccagcaagagagcttcgtgtgagcgacgtgcccttaattgtgcaaaggcaatcctgaagggaagacgccagtttgaaagcatcgggcaagtgattgtgcatgtacaatcgtttgatcgggactgataatgccaaccatctacacgacctttctgattgaggagacaaaagttttcatctgtttaccataagcgattatctgtgcctattacaaagcagaattggccagttatttgtgcttttagtactttggatcatgaaaagtgtgtgcactctgcaagatcgatgttttttttcaccacttggctaagccttccaccagcttccgggcttcttagtttatgagctgaataatggaagttcagcacaaacgtttgtccatggatatggacgagtgtgttattacaaataaagttgatagttttcggcaaatagattgttgttgttttatttcaaagagatgtagtcccccttttgttccttttcatcacttaggctgcgttcaagcgcaggagaaagagagaaagatagttttgttttccgcgtgcatgcttcccgaactactaaacgatgtgtttttttgcaaaaaatttctatatgaaagttgctttaaataatcatattaatccatttttgaagtttaaaataattaatactcaattaatcatgtgttaatggctcacctcgttttacgtatctcttcaatcccctccttctcaaacacacccttagacctgattacttacagcttgtacaagttatggttggaggttcagtaatttcagctgtaccttttcactcttcttttccatcttaacataaaccaggcaggaccgcaggagttgttttgttggcacaatttgcgagttggatgggg

SEQ ID NO: 72316 - DNA, 34898 bp, Oryza sativa
  unsure (1)..(34898): unsure at all n locations
atcaaaagtccgggtcttcgcataatgacaaccattagcttttttactttgccaccgtaataaaaaccctcaattaggaagccgaggctttgcgttgaagtggaaatgaagatgaaagatgcaactattccactcagaaatattccctcgttttttaatagataatgttgttgatttttaaacacatgctcggctatttattttattaaaaaaatatgcaaatgtataagatataagtcatgtttaaaacattttaaataataaaataactcgcaacaaaataaattataattatgtaatgtttttaataaaataaattatcagacatgtgataaaaaaagttaacgggctcatcaattagaaacggaggtactagtatttaaaaaagaaaagacgaactgacattagggcattaggcttaatcaagtggagtacatgcatctatatgcgccgaaagcctgggagcagaacaaagctgctttccaacgacgtttcctctgttgctgtcacactggaatatcattctacttatcaactgtgctctgctaaaattgcttctagaagagtaggaaaagttgcttaactgtactttagttgccatgctttgcataaagtttatagtatgggttatctattttgataattaaaattagcaaaatgagtactatctggtctaagaaatacgatatttttaaaaaaggaaaaatatttttagagacatgatcaaataatccgtggcaataatacaatgagctattccccttattttaaatttagctgtctaagtcaatcatgtctatattaatttgaccatcattttttaaaaatacatatagttttaaaaaatataaattatataatttcttaggtgattaaaacataaatcttactatcaccttccccaaatgtttggcgttggttagttaagttttgaacaaaccaatgtcaaataaaaaaaaagaaagagtatgatgctaaactatataagtttttacaaatcgatgatcaaatattaaaatatttgacttagagaaaaactgaaaacacaagtaatttaaaaagagtagctaaggacatccacaatgtagtaaaaaactacagcaagcattaaatattctcttgttacctagcaacaagtattgtgagagtgatgaataactactacttggttatatggctactaccgacaacaagtaataaaatgttatttgtacagtgttgatgagtattaatgaattcttttcttggaagagtcacgacagctgaggattggtgagtttttatggtgggctcatgttataccctaccatcaaacaaaaacaatgtggagttcatctcctactactagggtttaatatttcggaccgaaatttcggtcatatcggaccccccccttacgatatcattttgacagaaattttaaatatttaattttttatgaatgttagcaatatttgttcaaatttaactaaattttgtttaaaattttagaaatctcgccatatcggcatcctcttatacaaataccgaaaccgaaagattgagctctgcatgctactactgcctgttgtccggcctacattactaccgagctcggtaggaaatggcctacattatagccctaaaacaaatgggcgtaaactttttatgggctttattgggctgaatgggttgaagagaccgaggtcaaagcgccacggtggacaaaaccagcgccacgtaggacaaaatcgtgtgaaatactgccctaggaccacttgtgaccggttttagtacaatactgccctaggaccacttgtgaccggttttagtaagttaagggacccccgatatctggttttacggtttgaggatgtttttttttatagtgacaagttgagggaccttcggtgtactttttccgaagagaaatcatataggacttaattgaacagttgttcatgggctaagttagggcaaagacttgtttatggtccaagtcagcgcaaacacttgttttgaggtgctcgccagtaaaagtgacagatatgaatggcctcaccaattgctttggaccaatgtatgggcaagtccgattcaaaacaagaaggtactgtactgaagtctgtaactgtgcctctcatcgttttaaggagcatcaagaacttaattaactaataaactgataattccaagagctaacacagataaactagataaatacctatcttagttaacctcaatatagattaacagtgtctgttggatacttggacgccatcatattacaagctaaaaaacctatcctctgctgtctgctccatgcgtgaaactggggcaggaacctatgcaagatttgcatttcttccccttgctaacaaactcatgtatcatccaaccatgcccaatctcaccccaaaaaccatccataacttttcctttgatatagaaagaattagcgaaaggaggaagaaaacaagtgaccagatgatatcttctgttatgttacaccgaaatggcaaaactccgatgccatcatcacagctctgaaaacaatcgggggttcagacttcttcagtcttcagagaggtagccgagcctgtgttctgtgctgtgtgcagtgtgctagtgctgctctgattcatcagcagtccagtatgtcttgaccgccacaaggaccttctccgggttgaagggcccgtcctcatggtccaagatgcggctctcccaccgcatccgcttcgctatcgcctggaccttggtgaggacgtcgaccgtgtcgcggatgatcgccgtgccctcgggcctcaggatcctgtccatctccaagaggatgttggttatgtcacacctgcaatgttgaagaaatgtgcatcagtaagcaggctataaaccaataatgtgatttgcagttttgcacattcagattgccccactaattcagacattattgctggcatgggatcatgtgtcagcgaaagcatgagcaccggtagaaatatcagagatgcgttttcaaaattgtataaaggctagcggtttcacaggcataatgaacagtgctgtacaggccatacaagtcatggcaatgatctaaccagtaccaaaggactatgatgccagtagtcttcatttactacttgctcattttctccatcttttggtgtataattgaaattcagctaatatggagtactcagtactcacagctgtgtagcttaagctatactcgttctatctggattcacctagaaaatgatgcagaatgaacacttgaaatatcttctgagggtaaaactagaccagtagattctttaatggctaagctaaaatcaacatacttgggagggtgtccagtgtaatgcacaaccaaatggtggcagcttgaacatggttaagcagaactaagagctagcagaaatgatatgtagtataaaagtttctcacctgtcctgatagatgctaaacaaattgtcagcatgcaacaggtcgtaggttctgggatacgtcgagaaagcttcacaccagtcctggtacgtgccaatgaatcctcgctcataaattgctccaagcgtgtcccggtctgaatttacgggaacgacgttcatcacccacacagggtacttcactaaagaagcagcaaatccgcccaagtttgcgttcatgtccatgacatttctgtatctcccatcggctatgggtagggtgcgcttgtagtacgccaccctcttttcccacaacttcttgtcctcctcaaatttactcgcatctatccctggaatcatacccctcttcacccttggagggaccgcgaatgccctctgtggccatctctccaaagctccacctgcgatctcaccctggttgcttacttcaggcaatggagtaacacatgcttccatctgcttgtacctgttcacatgaaggggtaaaagaaactaattcagtggcagacatctaaatgaattatcagatagtcttgttggtgcagcgattccataccaggcagcatcaggattgtcactcttgcatatatggggtgtcttatacttcttcttgatgttggcacattcaaggtggttcttaggcttttgccagatggagagatcccccttctcaaccaccttgttccagcaaaggctcctcgcgacatcctcaatattgtcttgctcttccttgaggtcttccttagtcctctcccaccccttgtagtgtgtcttccaattgatcggaggacccgagagaatccagtatcccccgggccttagaattctgtcgacttcagctaggtatattccatctaacaaaaaattcagaacatccaactcaattagtgaacaatatttggacctaaggatagcttgaaaacttggggcaagatacattgaaaccaattcaaatgtattgaagtgctcaccaaactcatgccaaggaatcaagcagcgtgaacaatgtgccatatcaaatgacctagatgggtaaggcagccgttgctttcccatcacgccgatgatggccggcacaccccgctccagcgcgaattgcacctgagcttcatgggtgtccctcggtgcaaacgacattgcaaggatgttcctcttcagcaagtaagcaccccagctagcaacctgcaaagaagatgcaaaagcatgagcacattgccacgacatcaagaaacctgaagctagatgtttcttctgatcttctccccttaccccgcaacctgtgtcgatcgccgtcctgatcttcccgtccgtcaacgagatgagcttgccaatgtcgtcaatgtaggcgtcggcgcctcgcgggaacatggtgccgccaccggggaaccggaacctctggccgtccacctggatccagttctgcacggccttctcgatgctgagctccttgtgggggatgttgttgaaccaggcgaagtccctgctctgcggccacttgaacggcgtcctgtacttgggcggtgccgggatgaggcaccggatctcctcgtccttgccggggcaatgccgctcccggtacaccagcatcgcgcgctcgaaccgccggccgcgcttcctgtcttcgcacggcgtgtactcgctgaagttgagcgggcacgccgggaacggctgcaccgccgcctcggcgcccgtgtcgtcgaggctgagctggtggtgcgcctcgaagtcgagtgactcctgcgaggccgacccgaacgacggcacggcggaggactgccccgccgccgccgggtcgcagccaaccttggtgatcgccgagctcgccgccggcttgggcactgtggtgttctgccacgcaccgaggacgtagaaggcgacgcagagcgcgctcaccacgaggatgtaggtgagccgctgcttcttggattcttgcagctgctgagctttgggggaggcaggatactctttagccatggctgctgcaagtttcaagaactcgtcagctaggagcttaatttagctgaaatctaagctttgttggatgcagaaaaaggcatgaaattgaagaacttgagctacaattgcctgatctgagctgaaaacgaaaagctgaattgatatgcaaggctctaaagttgcctaatggatgaattggagttgtattactggagtatggtacaaatttaacactatcttaaaaattccccatggcatgtactgcagcacactaattgtggcaccaaccttagtactactagtgaagatcacatggcaataaatttcggattacaaatttgaatatggagtcaaatacaacagatcattgtaaaactctgggatctaccgagcaaaattgtttaatctgactactgacaacaccaggaaacatacacctgactgtttgtcttaaatttattaagctgcagcagttgaaacaattcaagactatgaaaacagacgaacagatagcattcaagaaagcaggaggggacgcaaaataccactaataactgtagatcatgaaatgattcttaggaagaaaaaaaaaacactatgcttcactcaagaggaggaaactacacagaagcataggctcatgcttcttgctgaaggcttatgcttcaccaaaatcagtacaagcaagatttatgcttccagctgaaggcaaagaaagttgctactaggataaagggcaaagaggctaaagaagataaatattctaggcaaaaggcaaagcggaagcagcaagatggtggcagctaagcaccacaggccacagagatccagaaaatctcacagaaatggcaggggcaacccacatgaatgccacaccacccagcggtagctagcacctccattccccaatggatccacacacaccgacaccactccaatccaagaaacaatacgagcaagaaaccaagctgaaaaaactacggacctgtagtaaagaagccagctcaggaagaaagatgaagcagagacccctcctcttctcttcctcctccagaggctgagagggagaggagaggagcagcagctctgcctatttatgcgagctcttgcactagcaatggtgaattggtgagtgagtgaggcagccactgagccagtggagtgaagtggtgtgatgccaaacacggtgtcacatgtcagcagcggcttccttcctcttcccagctaacccaacccccctttcataaataaaggagaggaggatgtgcgtgtgaaagggggccatatgccgccatggtggccatactacacccgcaggggcagaaagatcacgccgacacggggattaaaatagggtggaattgggcaggaaaagaggggggtgccccactaccaacaccaaagctagggttcttggagacctctgtttcttggctcacgtggtaatggcacattggtacagtggcagtggaccaaaatgtccagatgaccaatggaaaactaaattcagaatatctccttatttctgcatgtcacttaaaaagttataaaaaaattgaaaaaaattagtaggatagatcaatatgttatatgtcacttcacaaacatgcaaattcaaattcaacttatacaagtagaaacaaaaataacaaatttgactataaatagaacgtgtaattcatggtcaaatttgttatttttgtttcgaattatataagtcgaattttaactcgcatgtttgtgaaaagatatatcatatattgatctatcttaacaatttttttaaaaaaaattaatatttttttaaacgacatgtacaaaacgagggaatgtcctctggaggaccaatatccacttccgatggtgacccagtagtggatttcttggtttcctgcgaggaagaagagccccggtctccggtccttgcaattaggcctcttgcactgagtgtggctgtggctactggctggtattttgctgacgggttatctatgttctttaataagctaaaatgatttattagaaaataaaaactaatttataggtaaactattgtatgtgtgtcattagtgacttaaaaaccaatatgaaaaaactaatcttgaaaatatcttaaaattaacttctaaattaagtttgaaaatttaaattatagctttgactttagtttaggccaaccgatggagcctgaatgttctagcgctattgttttccgaaccgtcttggacatctgagaaactcaccttcagtggttggattatttttagctcttggggagggaaacatggaccaatcatcttccatttctgtgctaagcttcggtttcaaggtgtaacagttgggacttgggagtttgtgacgctaaaaggaaaatcacttccactatgcagaaagatcaaaattcaaaagtgctttgctttggttcttgtactttattttttttgctttttcttcgacaattcacttctcaaagcattgcaccaacagtaaaaattcttttaggtattaaaaaaaactgtctaggtcatacaaaactatagcatgactattctaacaaagagaagggggaattctagcaatcgattttacgataaaaaatgagcaattgcaaccatatattaatcatttctaccagaatagggatagttcgtctactttagaagcacaatttaaaaatatgaagaaacgaccacaagatacataaaccatacatctccaggatacagaacaacaatgccacaggaatcatcaacaaaaggaatgcaagaactagagaattggaatttaccttcagaatgcagagatcctagatcctccctgtgacctcagcaattgcgctctgccgacctcacagccaaattgtgaatttctatcattaatctgggcagctttgcccggccatgatggtggttgtttgcagtagaagcaggggggtaaaaaacccaaaaaagcgcaactttttagctattccctttttttatctcctcacaccaacttcctgacgcttttaccctttggctgccttgcaaaatctgcatgcttggagtggacaggatttggtcaatggcgaaacgacaacgcacacagtggttttttttggagagagattgtcggccctccatttgcttccctgcattttcatcgtttttcagctttttcttttgaacttaaaaatgaatcttgacagtggatggaaaaaaggatgcttgtttcatgatgcagtatgatgcaggaggtgatggagtagtgtcggtgcaatgaaatgcatggaccacaagcaacataatacggaatctctatgcctttgtcacacttgttctgcatgatgatattttgcatttgatttttttttaggataaagagatatttctgcaagtgattttactaccaaatactaacagtttctagttcatgtctccgctataccaacagtttcattacagaagattaaattaaagttaaaaactaaaaaagacgtgaacattaaggaagaacttaatatcaaataataagaaaggggtgagacttcgaacccagttcgtctaacctaccacattgtggagctagccggaagacccctgggtgtttcttaattaaagttaaaaactatgccaaacacatcagtttttttacggatttgagaggatttttaagaaataattgaaaggggtcaaggaatttacgatcatccagatatggcttgaaaatattgagaagaaaagactacttcgtactatatgatgatcttgcagctggaccaaaagcatttgtggacgatacaaatttttggatcaaaaggacaacgaaacaaacaaaaaataatagtaaaacagaagatttgcacgcaaccggaagaatctcaacaaaaggaatgacatcttcctcctttctaccgaatcccgcatcgaggtacctagggtttcatcaaatccatcaactagaccctctccctccccttcgtgcgatcgccacaaagaaaaaacgcaagcgaaattgctagtgattccagccatggatccactcacctcgaggatcaaagtagagctcgaagtcaatccgcgcaaccagggaggggggagagagagagagagagagactcgcctccgatgatctcccagttcgttgcaactcgaacgcttttgaattttggagaagcagatgagaagagaaaagctcggtgccgccattaatgggctctccgtacaaaaagaaatccaaatccgaattctccaagcccattaggcccagtagtagtaagcccacgaagcgagggcttctcgcggcttcgcttgaggcggagaggcgccgccgccggccgccgcgatgtcgctgccggcgcggctgctgctcgcgcgggggaagaccacggcggcgcagcacgtggcggcgcggcacctggaccacaccttcgagaagctcgcggcggcgcacctgccgctcgtcgcggcggcgccgctggtggacgccctgcgcgcgtcgcccgccgagcctctcgcgctcccgggcctcgcccgccgcctcccgctccgcctccaccggcggggcgcgctccacttcctccgcctcttcccgcgggtgttcgacctccgcgccccgctcccgctctccctctcgctcaccgcgcccgccgccgagctcctcgccgtcgccgcatcccccgcggcggcggctcatgccctccaccgcctcctcgcgatgtccgcctcccgctccctcccactccgcgccgtcttccgcgtctggcgcgagctcgctctccccgacgacttcgaggtctccgtcgtcgccgaccaccccaacctgttccacctcgctcccaaccccgccgagcccaacacccacatcctacacctcgtcgccgatccggcgaccgaggagttcactccggcggtcgacaagacacggccggagaaacacgccttcaagctgcagttcccgccgggattcaggctgaccaaggaataccgtaagaaggtgaaggagtggcagcagctaccatacatctcaccatacgaggtatcaattcagaagggtgtgggaagcaagagggtgtctaagatggcgaggaagaagatggagaagagggcggtggggatcgcgcacgagttcctcagcctgaccgtggagaaaatggtggaggtggagaaattcagccagttcaggaaatggttcgggatcgaggtcaatgtccgggacgtgttcttggatcacccggggatattttacctctcggcgaaggggaagcggcacacggtgttcttgcgtgaggcgtatgatcgtggcaagctcattgagccgaatgatgtgtcggaggcgaggaggaagcttgttgagctcatgctcctccgtcgtcgtgggcttgggaatgccaattcaaatgctaacatggcttcacgtgcctgtgctggtgctaaagaagacacaagtgatttccaggaggaagagatttgatagttatgtccaagaagctggaggagaaagtatgctgcggatttcatggacaatctttcgtctaccataacctgttcaacaggtgcttggactaccttgagtggtgaagatgttggtgatgcataatcatgggcagtaaatttcgcgtggcatccattaaccagatgagggatatggatttttttcagggatttatgctcattgtttggcattatctgttgatgcaatgtgctggactgagtatagttctggttgatgctcaaaactgnnnnnnnnnnnnnnnnnnnnnnnntgattggtaggtcagaattgttgttgaaatgtagcggcaattacatgtccgataatgtttttttttcccagtatggcaatttgcttctgcatgtggaatagtatcaccaagtatttaccataccagaatattttagtcggaacacatccttttatctttcactagtttattttcataatgaaatgtgcttcatatagttcatctgttcttgttagctcaagatttttcatgcccctaaaccagtcacatactttactagccttgtttacagcattgggtacacgaagatggcatttggcatttttttttcttcttcttgattttctagctttataagttcctaccaaaatttctacagaagctaacatgacaaattgtcatttaacaggtctacaattacgccagagcaaaagcagtgtgatgaaagatcttggctgaagtttgaaattgaatatcccttgtttcactggagatgatgtgaaccgaagatgattcatataaactagagaatacaaaattgcctttcttgctactgattgtgaactgcggaaggccactgggatgtgattcacaataccacgggacctatgatcaaaattgcagtcatctccgactagagaatcctgtagtttttatcgacaaactaatatgcatcagttgtcattacagcagctcttcatcatatacagtttaacttttgagtgtacttttgtcgctgtgatcatgcccttgtaacagttatcccatatgtctggatgtcttccttttccagtcagtaaagatgtacatttagtttgactgaaccagggtccacaataccgacgaaaactgatcaaaatataaaccactcaatttctcagtcatgttaaaaaaataaactgaatctttgtttgacaaaatttatctggatttcatcggtatttgtcggtttatcaacgtttttccgcttgtgggcaatttttcatccgggtatcggaattgcgaaccctgtgcagaaccaattcagtatctaacattaaatctgcccaggtgaaactaacttaaatatatcacagtgattatacacattcctacttcttctaatatcctaccttaaatcctacctagctgtatacacacacaagtcaccaacatagctgcagaattacaagggattatggatgtttaggagtgaaactcttgtctgcagcaacctcctgaacaccttctcgctgccactctccatctcaccaatgcattcttccagctcctccagtttctccaatgccggcgacgccgccttcttggccgcccgagtcacgccaagccacgcccacttgtgcgatgccgctgtctgcaccatggccggcacgtcccgcgacattgccgcgcaccggaggaggatcgcctccgacgccgccgcggtcaccgcggccgcctccgccacgatgccgaccacctcgccgtcggcgtcgttcgctgtcctcgacgccgccgccggcgtgcgccgcaccgcgtgtcgcatcgcggcggcgaggcggcacagctccctctccgtccgccggtgcgctcggagcgccgtggcgaccgtcgcgccgtcgccacgccgcgcgccggcgcgcagctccgccgcgctctgcctgagcgcgagcaccgccgactcgaacgtgccgtaggcgtcggcgagcgccaggaacccgtcgagcgcgcgctcgcatgcggcgccgccgccggcgcggtggatggccgccgcggcctgcggcagcccaagaagctcgccgagcaccgccagcacgtcctccacgagcgcgagcccgtcgcacctcccgtcgccgtcaacaccggacaacctcgccgcggcggcggaccatgacctgagcgcgctgatgccgccgtcgagccgcgccacgaccgggtgcgagtgctccctcggcaagctggccgacctcgccgccgccggcctgatcgtcaattgcattccaatcatcgagctcaccgctgctgctgccactgatcaggtcgcttcttcaatcttgatcggtcgaatgaatccttcgtgttcgtgaggaagacggcgtgcggggttttatacgggaggcggggggcaggtgatggtttgcacacacttgcacgttgaaaaatagagaaatcgttggctttttcgtgtgttggctaaggtcatttggcttgggcagctcggcttgcccactttggagttggtggtgcggtgcacggcgccacggcgagctgctgtttttctctcctccggcatgagcgcaaaactgctaatctaatctgctgctagtgcttagtactatactggtgtcagcatgagctttactgggaacagctgtgactgcctaaatggcttgaaaaaaatggcacatggataggagcagagtttacgaaaccgacggcaccgcgcttaccgccgagatacggtaattggtaaggccacgatgaattcaccaaattcaaataaattttaaaaataattagattttttttatgaattttgtacgttcctcttgggtaaaccgtaaccgtgcttatcgttggggtgccgtaacaccagccccgaaggtagggaaaaacctggataggagtacaaggtgtaggtgagctggtacatcactctagcagagtcagctccacacttatatttgaatttttttgggagtgacagatggtattatactactactactactatactccatgttgttgaattattttgtattgtatgaatttaaaaaattccatctccatgtcagctgtgcgctgcgctgcactgaacttcctcccctccggtttgtcaggtccgctgttttcttcacctgccaaaacctcccaggtttcagagaagagccacaaagcctgttcctggttggagcttatcttaagctcaactactaaaggcaaggactctttagcctaatctaatcatctccaaagattaaaagaaaccacttgattttgtctagtattctagaaaaggcagataaaatatcaatctgacccaatactggcaccatagccttggtagtggttgttcagtgcacctgttcctgtgtcatctctcggtgccaacaattgcgacggcacgagagcaagaagaagacgacgacgacatcgctgaagccactaatcctgtcctgtgatgtgcacacgcccaaagatggtggcgccaatagccaataggcgcacgcacaatgcttcgacccgtcgcgtccttctccgacgagaagcaaagccactgccatgccatgatcaggctcgaacaaggtttggttggatcgatcgctgggttggatgaatgcgatgtcaggcacggcatcgcgacaaatccaccctctgttgcggttgattcgcactgccgttaagtcaggtgactttagagtgacatatgagttctcttttctatgcacccatatatcagtgattataaaagttatttgacttaaatcaaaagatctcaatccaagtcgaagtcgataagtaagaagatttcaatccaaagctgtttttttatatagaaccctgagcttctcaaaacaggtgtaactttttagcatgttttgtcagacgataagaaatcgtttcggattgactagccaattgtagattgttcgtgcgttgtaattggaaactggaatgtaagtcaaatagacaatgtggaaactgctcgtggaaccagccattgtggactcgaatagaaatggatgtgcaaaggggttaaatatcgaagaatgtatgaaaatgaagatgtggtattggcacggcaaaattcagaattttctctgtttctttatctgagaaattacaagggattatgaatgttaagaagagaaactcttgtttgcagcagccgcctgaacaccttctcgctcccgctctccagctcgccaatgcattcctccagcctctccaatgccgccgccgtcgccgtcgccggcgacaccttcttggacgccggtacgacgtgcaggtgcagcctcgccagccagtttttggatagcggcgagctggccatcgacgacgacatgtccggcgacatcgcggcgcaccccaggaagaccgcctccgacgccgccgcgatggccgcggccgcatccgccaccgcgtcgcccacgccgtcgcccgtggtggcgtccgccgccggcgtcctcgacgccgcctggcgcatcgcccccgcgaggcggcacagctccttctccgtccgcctgcgcgcgcgcagcgccgcggcgaccgcggcgccgtcgccgcgccgggcgccgcaccgcgcccccgccacgctctccctcagcgcgagcagcgccgactcgaacgtgccgtacgcgtcggcgagcacgaggaaagcgtcgtcgcgcgccgccgccgccgcctcgccaccgtggagcgccgcgacggccaccggcagctcgaggacctcgccgagcgcggcgagcacggcctccacgagcgcgagacccgagctcccctcgccgccggagcgggacgtcgccgtccacgacatgagctcccgcacaccgccgtcgagccgcgcgagttccgggtagtggcacgggtggctcgccgtgcgggcgtgcgccgccttcctcccagggctaagtgtcaagtgcatcgctgcgtagtcgtcgtcttcgtgatcagtagtaaaacgaagcgacggcgacgaggagtttatattatacgcgacgggaggcggacgcgcgggtggttgcgagttgcggctaaaaaaaatcgcgggatttcacatgacagcgtgggtgtttttttgcagttggcacacggcgccgcgcgcgctgctgtttctggcattgtcgaccgaaaactcggcgttcgactggtggtatcgcggagttgacaccaatattcagtgggaacagctcagaagctcactgcctataggctaaattatagtataatttttcgggtgaaaaagtaggtgcggcgttgacaggattgtcacgatattaatacgatgaatcgatgataaaagtaaggcacaggtacaggtgatctatcagcgtcgctcgagtcgtcggtttttgaagttgttcgtgcggccaaaaccagaaaccacagcgtgcacaaagggtggaaggctaagcgaatcattttatccgggataaataaattaatgggaaaacgaagccatctgctgcttttctggtcggatcggaggtgacccgtgcagccctgccgccgtgctgcggatgcgggtgtcatccggggaagcgattttggccggcgagtccggtcgtttttggcaaatccaagggtcggtgacacagttgggtacacgaccactctcccatccatgatccgtctctgcatctcgcagctcatcgcgacgcgaaatcaccggcatctgctcccctattggctgtttccaccggccagcgccgaacgtttttgcacacgaagaatgtgctcgtgtgaagtaacttcccacctgacgtgatcactgacgtggttggcacgtgaatggtgaggcctacgtagccatccccaacccaaaaactatcaagtagtttctatacttgccatgtcatataaacactctgtgtagaaactatgtatacaatggatgctgtctttaacttaaattctcatcaaatcacccctcttctctctccttttattcacatatcatcttgtttttattcttggtactttatgtagagatggttttttacatgaaaaatagttttttttttatctttttacctctctctttattaactttcttgccatataggatttttacttatgtgacgatgtatttaatgctatagaaactagataacatggaggattaaggatggcctaaccgcctaagggaccaagtccctctaaggtcctattcgtttccactgctagcagtggatgaaattttggattttcgtggcacgcttttcaaactgttaaacgttgtgtttcgtgcgaaaaatttctatatgaaagttgttataaaatatcagattaatccatttttcaagtttgtaataattaaaactcaattaatcacatgttattaccacatcgttttacgtgaaatacttaattttcatattctaacattacgttaaaagatcttgatcgtattactttagcctataaacaatcatgttctaattgtgaaaataaattctctaacctggattagaagccattggaagccgatatttgttttccttttattcctctgttccttcttcttattcacctgcacgggaacggtttgcgctacgaagcatcccagcattacgcaggatgaaaacacaagcagcgcacccattatgtaatcctttcgagaactgatgtaaatcatatttatcttagaatcttcagctctcccaataatacaaataccgacaatttgagaatatgtaattatataaccctgaaaatgaacaaaaagctacaatttgggaatcctagcattttcatattttcactagctagctacttcttaaaatctcgacctccccaaacaggggcatagtatcttcaagtagtacaagctcatgacaaagaggatgaacattgcaaggttgcagactagcagttgcggtactagaaaagttcaagaatctcaaatcaatttatgaaatcaaactacacacataatgttcttgactccccacgtacttacggaataattatattggcatacacaaaaaccggagctaatcagagtagatacacccatagacaagccatcagacccaacaatttttttgtccatgaaacagccagctaatgctaatagacaaggggttctgatggaagatacagctaggccacatctagaagcacttcctgtggacgatagctgggccagattcttcatactcagcccttgagatccacatctgcacaaaaaaaaggaaagaaacatatgtcaagaaccttctcgaacaatctagaaagtgtatcaagaattaactgttggatgattttgcattacctgctggaaggtgctcagagatgcaaggattgatcctccaatccagacactgtacttcctctctggcggagcgacaaccttgatcttcatgctgcttggcgcgagcgcggtgatctccttgctcatgcggtccgcgatgccagggaacatggtggatccaccactgagaacaatgttaccatacaggtcctttctgatatcaacatcgcacttcatgatggagttgtatgtcgtctcgtggatgcctggagcttccatgccgatgagagaaggctggaacatgacctctgggcatctgaagcgctccgcgccaatggtgatcacctgtccatcgggcagctcatagctcttctcaactgatgagctgctctttgcagtctcaagctcctgctcgtagtcaagagcgacgtatgcaagcttttccttgatgtcacggacaatttcccgctcggcagaggtggtgaatgagtaacccctctcagtcaggatcttcatgagggaatcagtcagatccctaccagcaagatcaagacggagaatggcatgcggaagggcataaccttcgtagattgggactgtgtgactgacaccatctccagaatccaagacaatacctattgacaaaaaatatcaagaaacaaattacgagagaacataatgacagtttttgtgtattgtaacatctgtaaaacaaggcagtaacttaaattttatttggtttgaatggttcaatttaagtttactttagacaatatattgctaattttggttgtgagcatagcatttgatttgaacatcacccggtttgttcctgctctattgagattccagagtagcaaaacagaatttacaaatgaaaatgcttattctttgttcacttaccagtagtacgtccactagcatagagggaaagcacggcttgaatagcgacatacatggctggaacgctgaatgtctcaaacataatttgtgtcatcttctccctgttggccttagggttaagtggagcctccgtaagaagaattggatgctcttctggtgctacacgaagctcattgtagaatgtgtggtgccaaattttctccatgtcatcccagttgcttacaattccatgctcaatggggtatttcaaggttaggatacccctcttggattgggcctcatcaccgacataagcatctttttgtcccatcccaaccataacgcctgtatgtcgcggacggccaacaatactcgggaaaacagcacggggagcatcatctccagcaaacccagcctatgaaaaatgaaaacagttaatacttgatgagcttctcaattgtaacaataattaccatcaggtagaaattttgttcaacaatgcgatgccaagtcatcactttttattaccttgaccattccggttccattgtcacagacaaggggctgaatgtcctctgcgtcagccatttattttaactgatctgcataacacaaaataaatcattcaaaacagtgtttacaaagactatagattaatacagaaaaatgtaacttgaactaaacattcatcctacaaaaacacgagtcttcatcaaacatgaatgacaaaatacatgtctttaagatatcacattcaaagctattaattgactaactagtattgcaaattgtgaaagagggaggattattcaaacaaaaaggaaggcgcagataggaagaagtataacactttagttgtatataggaaactcccaaaatgaatggtccatgatgcgtaaattataactagatcaagtgacttgtagttaagaaattcaaatcaatcaaccgaggctggtctgaatcaccaaccctccaaaggaatggtgctctctcctaagagcatacaatgcaatgtgtatttgaatcgatttagaccaatcttcagggagaaaaaagggacatgcttcagtggatgaaatgaatgcaacatgatctgctcatatcctggattgtctgattggttgatctgaagcattattttttttctgatcagacagccgtcatcaagatgtgaagcatcttagaatagtggtccataagcatacattttttagtacaaaatttaaactccatgatttctgaaactaggcagttttcagttaagcaacttgcttctttaattcagattttagaagccatgtcacataatgaaatcgttggtatgcttgtgtttttgtgtgaactatgaaatgttttgttgaggagaaaaaagtctcaaaagaaagtcgatcggtacagtactgaaaactgtttttttcccacgccaacaagaaagcaaccgtggaaatgaaaagaaaggaatcagctttttcacaagtccccacctacggaatgaccaatcaagacagtttcttgagtaccgcaaacaaaccggctatgagcatgcgaaagtctgtcagttgatctacaattcagagaaactatacccccaacttcacgccttaggccttgtttagttcgcgaaaagaaaattttttggtgtcacatccgacgtttaaccggatgtcggaaggggttttcggacacgaataaaaaaaagtaatttcatagctcgcctagaaactgagagacgaatttattaagcctaattaatccatcattagcacatgtgggttactgtagcacttatggctaatcatgaactaattaggctcaaaagattggtctcacgatttccatgcaaactgtgcaattagtttttttaatctatatttaatgctccattcatgtgtctaaagattccatgtgacatttttgggaaaaaattttgggaactacaagaccttagcacaacacaacataaacacgaagagatctactgcaagactactcgtcacctcagcacaaacaagatcggatacatcctcaactaaagcaatggatcggatcagcattcaccaagaacaacaaacaaccagtatacgcgcatccctgaactcctacagtccaacggatccaacatttgacaacacacaagcaaaagcaaccagccacacctacttcagcaactcagttcagtagttcacccatctaacagaactagaacacatctccgattgcaagaaacatcaagcattaaaacagaaagcaagcagggtccgggagggcctggacatggagaggcagttgctcacctaaagaagaggagagaaccgaaccggggatggcggcggcagcaagaaggaggcgaatggcgtgggagggaggagggggagggcgagatataggagaggtggtggcaatggcgatggtggtgggaaattgggggaatgagatgtaaagaggcgccggcctcactggaaagttgagagcttgaggctgtctctgcgctgcggccgtgccaacgcggaataatttgctgcactgcacacctgggccaacctagaaaatctgccttttttatgtttactcctacgtgcacatcactatgtacccaatactttcttattctattaaaaaatgatattttatcattttgcttttagaaataaatagtagtggttgatttttttttttacagggatggaatggaaccctcactgctatggaaggtggacatacacactagtagagagacgaatctaaaacgaaaatatcgaggagactgatatgttaaagtcataactaacttaagcatattgaaactatgtttgtcgatctactgtcaatcaaatttctaattcacactaccaaaacataatgttaataaaagaatgtgcaacatgcattttttttattttgttgtacacgcaattaatagttcggttagctataaccaaatgcagctagtatagctttttcagccaacaatccctcgctcatttattgttataatgcatcactatatcatgccaacatagggtacttggtagaacatgtttggctggctagagctgaggccgaagccccaacaagctctaaaaatagacatatcactaaacgtaaactcaaggaatcaaattagttgatgtaggcatggaggatccctaatagagagtagtttaagacaagaaataacttagaaaggagagctttaagaggcaacggcaacacaacagccgttaccgatgcctaaactagaatggttcttttcaacgcagctcttgattaaacacacatactaaactgatatacaatgtaaccttgtggacgcgtagcgatttctctttttctttttcccatgcgtgtgtcaaggaggagggccatcgatcaactgtttgtacaaactttgcaatctattcttcgtactaccatcgcatcttccttttttccccttgttgtcgtatgccttgagctgtcgctgctttcggttgctacctggagtatgaaggccctgtttagatgtgactaaaacttttaaatccctatcacatcggatgtttgaaaattaattataaatattaaacgtagactattaataaaacccatccataatcttggactaatttgcgagacgaatctaatgagcctaattaatccataattagcctatgtgatgctatagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccaccgaagtttggcacagctctagctctagctccatcatttctggagttggagctcaacaaaacagtttcagctccaccaaaactataagtgaagctgggtaagctctctcataaaatgaattagagttgtagagttgggtttaggcagctctataactttattatagacccaactcttaaagtgaaatttaggagttggagctgtaccaaatatgcccgaagaaaaaacgagcacatgaatcaagctacgaaagatgaggtggtggacggtggcgctggggccctgcaaaggaataggcaaaacaaaagcgattgggtggggggcaccacggcagccttttcataactttattattgcttcgttttacagctgctttacggctacgcctcccttccatccggccaacgtttttctccctccgtcttgaaacataaagaattttagataaatgttacccatatagtattacgaatctctatgatattaggtgtatttagttcttctggtgtaaagtttttaaagtatacggacacacatttaaagtattaaacatagactaataacaaaacaaattacagattctgcttgtaaactgtgagacaaatttattaagcataattaattactgtagcatcacattgtcaaatcatggcgtaattaggctcaaaagattcgtctcgcaatttacatgcaaactgcacaattggtttttttcgtccacatttaatgtttcatgcatgtgtccaaacatttgatgtgatgtttttggccaattttttttaggaatctaaacaaggcctttggctttctatccaaattcatagtattatgatgtgtcacattcatctaaattcttttatattttggggaaggagggagtagtacccagggttcacaattccgatgaaaatcggtcgaattccgtgaaattttgaggtttcgacgaggctcgaaagtagaagccgtatgagatttcgatgagtttcatctaaattcaaatttaaattgataaaaaaataaaaatcaaataaaatcttataaatagtatgatattcatagaacttattgggttataaatttttgaaaaaaaaattgatgtatcgtgtgtatttactgaaatttacgagaggaaagtaaagaataatgaactaaaaaatgaaaacaatttcagtttacctctttttctttttctagttaccggttgaaatttcaaagatttcgctcggaatttcaccaaagctggctggttttcgcaagcttatcgataaactcaatgaatttgtattcaaaatttggtttatgaaatttgttcaaaatctaccggctttccaccggatttcacgaaaaccgccattccgccagagcccgaaacggaataccatctcggaatcgtaaaccctggtagtaccaccacactttgctccttggagggcgtcaatcctctcatctttctgcatcctttacattttaatctttttttaaaaattttgttttacaaatatgttcttgcaaaaacttattttagaaacagactttttttctcgacgcttgcaatgaccctagtgtcggaatttcaacgtcttggtgccaatgatgctagcacctacacgctcgctccctgtaaaagttaagtcactgatataaagggggtcggcgaccatgacactggtgctgagaaaagggtatgtttctaaaataaatttttatagatgtgaattcgtaaaataagttttttaaaaggtgctaaacataaaaagaaaatccagtcgtccttcatcagtacaggagtacagcaatcatttttttttcctgaagtctgatttcacgctgcgatcacttgggttggttgttgacagtggctttgctcatggtgcgtcttttttatgtggcttttgctcacctcacctgattcacttgctgaagtttgtatgagctttgctcacttggtacgtttgctgtaagtctgaatggtgagatcagcaatgagattgacaccgtcgaatcaacgaatttttttatttaaatatttacataaataattttctatttgaaaaatttataaaactagtcacccattgtcgtctggagctgccaaaggacaattttgccgacttggtagacggccgttagctctcccataacggccggccatcaaggacgccaaaattgtctaggccggccccttgccgccctctagaacggtggtttcttaccgtgcggggttgcctactgcaaaagggtgacgagggtgtcttggcattcttacggtcggcctccttgccgttctttgggagggcaattttctacagtgcggggtgccgccggattaaaaggtagtaggggtggaattttttcaggcagcccacttgtcgccctttgagagggctattttctactgtctgaggggctgcatgcaataatgtcaggccgccctcgccgccttttcgcaggcggcccctgttcagtaaaaaaatcaccctcctagaggacaacaagggggccgcctgcaaattttcagcgtccttggtggccggccattatggaagggctaatgactgtctgccacgtcgacaaaatggccctttgggagtgcgatgaggtattaattttgtaaattttttaattagaaaattattatttaaatattttaataaaaaaattccgaatcaaccgtcatgcaccaccaaccagcagcccaatgcaccgaccgcccatctctaagcccatttgaccgcgatggcgtggcccatgccggccagcccaaatttcgccatttctaagcccatttgacctcagaattcggaagccttcgggccaatggccatgctaactcgattggtacatcatgtttctggtcaggaataagttcatctgtggtcccttaacttgtcaacgaatccgattattgtccctcaaccggaaaaccagatacaacgggtccctcaactatcaaaaccagtacagattaggtccctcggcggtttggatggtggttttgactgacgtgacacctacgtggctaatttgactcggtcttcatatggtgtggcagtgacatggcgcttacgtgacaattcgatttggaaaataataaaaaatataggccccacatgccagtttcatgaaaaaataatttaaaaatggtggggccgatgtgggccccacatatcattctcaccactcctcttcttcctcctctatcccaaactcccctgtattcatctctttccccctcttctctgtcctctcttctccatgcatgcatgaggagacgcggcgcgcggcggccaggcaaggaggggcggcacgcagcggctgggcgaggaggaatgcggcctgcggcggctgggcgaggggggggggggtgcagccgggcaaggagagaggcggggcgcggcggccgggaatgagggatgcggggcgcggcaaccgggcgaggaaggatgcggcgcgcgggacgcagcgccgccaccatggcgcgatggatatccgacgaaccgtgcgctcctcctcctcccccggggcatcagtttcgtcacatccttcgagacagtcgcggtgacgtctcactgcattgcctgtcgtatcgtcttctctctagcctctcttcggtccaaccagcgacgagaaatgcagagactccagtggtgctgtgaggattttcgcggcttccggtctccagcgaggtcgccctggccgcagcggtgcgtgccctccacccttagtttcgttttatacccaccacagcggtgcgccacctccctcctcgcccggccgccgcgcgccgcctctcctcacgcacgcatggagaacagatgagagaggagaggggtagagagatgaataaaggggagttgaggagagaggaggaagaagaggagtggtgagaatgatatgtggggcctacgtggaccctaccattttaaaattattttttcatgaaactgacatttgaggcccacattttttttattattttccaaatcaatttgccacataagtgccacgtcactgccacgtcatatgaagaccgagtcaaattagccacgtaggcgccatgtcagcaaaaaccgccatccaaaccgccgagggacctaatctgcgccggttttgacagttgagggacatgttgtatctggctttctggttaagggacgaaaatcggattcgttgataagttaagggacctcggatgaacttattccttctggtcatcacgatgatcgccggagaaaagctccagcgccaccgttgaggcttcttggtggaccccacatcgccgttgccggggaaggcagcggttgcgagacccataacttccttcaccacctgtcacgaactcgccacaaccactgaacgtctcgcctagtgaagattggttcaggaattagagatatgatcatcagatttagggatttgtggagaaaaaggcaagagaagcataggagtacgaaggggatttgatctctattcttccttccccaccaacacaaccgcgtttaatttgcaggtacagcaatccaagacagtagtacattgggtctgtttaggggagctttagattctgagaagcagctatttgatagtcagcttttaagaatctggaaaagctctgaaacccagcttctccagcttctggcttcttatttcatttttcagaatctgtaactacagattctcagaagctgtgaactgtttggggcagcttctagcagaagcagcttttgagaaaagctgcagctgggagaagctcccccaaacagggccattgtcccacctcgtggatcacacaaattgggtgcttcaatccactgcatctcaactatactcccatcagagcccaaattttcagaaatacaaaaaaaaaaaaactaagaaccgtagctagctattgtatttctctgtgtacataggagatagtactgaactactgatgtatgatgcgcaagatcacaaacttttacaacacccaaggatggtgccccatactatcaattacttaggatatggaggccaccacaaaatttcattgagatcaagctggctggcaacaattttggagataaagggtgccatgcagtgtttccaacatgtgcaagtgtacaagataaagagagaaatgaatagggtggcgcacgatcttgctagaatagcaatgagtactaggtctaatgctgagtggaggctatgcgccccagcacaaatcctagacttgttaaaccaagattgtaaccatttattcagtcattaataaagctctctctttaatgtaaaaaaaatacttaggatatggaggccaccacaaaactcaaaatcttggcatcacctccaattcctccatactgctgaatttctgtggaaaaaatgaagtttgtgtccggtacatcatactctctacatctatttttgatagtcatattttcaaatctgaaaaatttacttttgatagacatatttcaatccaaccatctattctcttaatgaatttctcggatttaatagtgactctctattcttcttcacaagattagctacatgggtatcgagaaatgtaaatattaatgaatcgcttgtttacgaggaataactagtagtttgtttaaatgaatgataagtagaattacttatccttggtcattgtgccaaaataaaatattactatcaaaagtagttggagttggagggagtatgttacagtgaaaacagctcatcattttcaggggataaaaaaaaagtaaagtgtattggcggtccttaaatttgtagggttgtgtcatataggtccctaaactcttaaaatacatatttaggtctcagaacttgtcaaagtgtatcatctatatctcaaattgacacatcccctctaggatcctacgtggcactgatgtggcaatgccacatggacgtgacgtgtcctttactttttttttcttcttttctttttctttttcgttttcttcttattcttttttttcctttttttctgcacaggtcacgagaagaaagggaaaaaagagaaggaaaaatgaaaataattaaatgggtcccatttatcaatcaaaataatgccatatcatatccgtgtggcatgccacatcaacgccacgtaggattctaaaggggttttggcgatttgggatctagatgacacactatgacaagttctaagacttggatatttattttgagagtttagggatctagatgacatacccctacaagtttaagaaccgcccgtacactttacttaaaaaaaactcaaacttcacttcagactaaagaaaaacccaacttactaccaataatgcatcgccattgatacaaactgcataaattcctacccccaaaggcccatccaatcattggacctggaagcaaagcatcagcaatgggatttcgctgcttctgctcgaaagctcaagctcagctcatcctactgctaccactactagtgctagcttcagcctcgtcatctgcagccaagcagcagcctcacaccgcctgcagcaacacttcaccagcgacggggcagccgccatgctccggccaccgtggtcaagtccctgcgccgccaatcttgggacttcttggtcgtaggcgagcaatcagagctccgcctccgccgcagccacatccaataacgtcgcctacctctccattcccggggcggccagtcccgccaccgccgccatcgccgtgcttgtagccgtcgactctgtcgttgcaggttcagtagaattcagaactttcaatcagcaagaaagttccatggatttactctgtttcagcgcacttcagctctcggcccctcccaggctctcaccattgtaaagtacgttctgctcgtttctgtcaagactcaagaccctttttttctgctcatttcgaacgagttagaagatcacaaggtttgtagtggatctttcgttttttttctatttttccggaagatgttttgtaattttaatctttactcctgagtacagtctgattatcaatcataatgcgtttgtccacaaatgttctattctggtcgagattcattcatgaaattactgttcaagattatggaaaaatatgtccaccgatacacagctggaagaatgaaagttggcgttttgatttttacagtgtacgaaactactgcactttgcaaacccagaagaacaaagaagttgaaagaaagagggaaaataaattacaagttctttaagaccaccaatgaaatctttgatctaacaacataattctctcctacatttaacaccaactacaactatgaaaaagctcgctacttcacaaagggccttctaggacaaaaccaagaagacggcgcccaatttgtccctccattctgaagccttcttgggtaagggatcacttccaatgcacgcacctgatcccaaatcgaacacaaatgcccaatgctgtaatccgtgatcctcatgttcattgttgccgcggcgcgccaagtagtagacatgattccccttgatcgtaggaaactccattgcagagaatgcgaaacattcgccatgccccaagaggagagcatgatcaccaagcctcgtccctctcttttccgggaatacgcaaggagcgcatcatttgtattaagaagaaataaagtttatgtaaaatgcaggctcgtcactctctcatggatctcaaaatgttacgggcagtacatcaaaatttgtccacttgccatcttggaattcacatgtcacattggattgcgaatttctcataccaccgcaaaactcaaaatctcgaccgtatctccaattcctccataccgtacgtcgaatttctagagacacgtctttgtctggtactacacgtgttacaatgattagctcggcattccagtttatttgttgataaaaagaaaactcaaatttcagttcaggcttcagaaaaaacccaactcctcaccaatgcataggctgcataaattcctgagacaatgagagcttcggcatttgtcaggaatgggatttcactgctgctttgtggctcaagctcttgtgatcttgctagtgctagtttcagactcggcaactgctggcaagcagcaagtgcagcaacctcgtcctcatgccgcctccagcaacacttcgccggcgccgccggagcggcctccgtgctccggccaccgctgtcaagtcccgccggcgccgccgcggttggggcttgtctacagcgaccgtagggcgcctccatgcgcacgccgatgtccgcctacgccgattccgaatccgaatccgaaccaccacccggcgtacgcatacctatgggctatggccacatccgctgcgtcgtccattcccgattagccttgcgccgcaaccgccgccgccgccgccgccacagctcttgtagtcgccgttgcaggtttggccgggccaaatccaggatcttcaatcagcaaggaagctagctgacggatttgctgctggttcatgcatgcacttcggttattgctaattgctaaattttgctttcagctgattttttttcagactttttggggcttttttttttgttttagaaaaaacgtgttctaagatcaccaggtgtgccgtgtgcaatccctcaaaaatgttttctttagacggacaacggtggcaactttggtgtcattgccttcttagaggaggcgttgtgtaggaagtctttttccccgtctttgacttcttctctttgtctggtcgtagacggttcttggttgtcgtcattaggttatcgtaagaggcgagtggatcttcttctctctcgtcctctccctatctccaacccctctacacgaggataactagaaacccgtcaatgatcttctaagcggagtcggtgcgcgggaggcgtttgtgaccccctttagacctagctgcgttgggtcacgtgagactagctgccaacgtgcggcgatggtgtgttgtcttttgtttttcctatttacgatcttccagtgttgtaatcatgtaatttttatatgttatatcagtacgaaacttcacactatcttgtgtgggtcgtttgaaaaaaaaatcacctcacttgtatcaacatctcaggtgattaaaattgtgcatcgatccttgtttagatgggagggactaatttcactaaaatacaagcctatatagtagtgactaaaatttatgtgagagggattaaaattagtatggacttatatttctgtgagagggattagtcctcccatccaaacaaggccttaggaatagggcacatagggataggtgacaattagcatatactccaatgtataatcacatcttaactattttctgcatccttcaactgagccttccaaacctattgaagtggcctacttgggggcaaatcctcatttcagtttgatttttacccagcctttgccttgacaaacacacatgtctcaaatagtgtgcatcacataattgtactttaatcctctcttcactgtactaatttcatatagtacataagcaccaactaaactaaaccatcgatttaaggactctctaggaatctatttaggaaaacataagattatgagaaccaacgggttggtagccagattttaagaatctgaaacaaaaaatctgacttctagttcatataactaacaacttctttgaatctgaataaaaagggcctctttgatgcgcaggatagaaaaaacacaggaattaaagtagtaggtttctcaaatcctacaggaatcagcaaacacaagaaaggcaatataagtcctttgatagtgttctgtgaaaaacaaaggaaagttcacaaagaggtcacaccgcttgctaaatgtgaagaatagaaatacaatcctatgaaaaattttctttctttcctatgaatcaaagggacatataggaaaaaatccataggaatttaaatcctatgaaaatccttcgccaatcctataaatcaaagggagccttagattctcagagaacctgcagttgtcagaaactacacgaaacagaccttaagaacaaagtacaagtcagcttgtatctgcccaaaggatggtcgaatcccatattgtggaatactccctccttcccaaattaatcatcatatcgtgaaacctaaatttttttaaattgatcatcatataaccgcatgagaatgtggcatgctaaagagtgtaattgtgcattattttttaatcgactacaattaatgtttaattgatgcgatttaaattatccctgatcttggtacataaatattataggacaattaatttgggatggagggaatacttaggatttgaactttcagtccaccacaaactcaaaatgttggccttacctccaactccaattcctccgctctgcagaatttcagaagaaaaaaaaatgtcttcatccggcacttcacatgtcaacagtgtcggtaggtgattaaaaaaaaacttagatttcacttcagaaaatccaacttatcaattatgcataaagccccatatgccatccaggcattggactcggaatcatccctctgcagccagagatgggattcagctgccgcttggtgatggctcgagctctgctcctgctcatcctagcagcgctagcttcggcctcgtcaatggctgccaagaagcaggggcgacagcctcgcggctgcggcggccacacctcgacgtcgccgacgccggagctggagctgccgccgtgctccggccaccgcggtcaagccccagcgccagtgttggggcttcttggccggaggggatcacctggagctccgcctccgccgcggtcacacccgccggtatcatacgtacgcccacagccgcgcccgtggccaccgccaccgccgcatccgcagcctccattcccgatcagcccggttgcgccgccgccgccaccaccgccgccaccgtgcttgtagtcgccgtcgttgcaggttcagtcggattcaggattttcagtcaggaaggaagctcaaatgatttgctaatctgtttcgggcacttcggaactattgtaaattctttgccttttgggggttcaagattttcttttgctcatttcaaacttgttcgttctagatcagctgatgtgtcatgtactcgtgtgcaatctctcaaaaatgttcatgtactcaggtgcaatctctgtcctcctataaatatgaaattggcacatcctgtgccggttcgttcagaaaaaaaatagtgcaatctctagaaaatgttttgctcgtctcacttggtcaccgcagtatttcgaatctgaaaagctggaattcttatttttaaattggaagctcgaattcttatactctaggatatgcaaattgcaaagaactcactggtagagtatcattcatgtgcgcgctcgaatcgcaagacaaacaaattcaggtcaaccatcgaaagtttcagtataaattcagtttgagttcagcagccgccgtgcgcctgcagtcacaaactgttcttggctacgatgaggctgttcgagctcatcgccggagttgccatcctggctgctctgtccaccaccacctcaaacgcgccatcgccggtcgccgtggcggcggggagggcggtgagggcgccgccgtcgccgaagccggcgccgcccataaggccgctcttccgggcgccaccaccacctccggcgaggtcagttcaaccaacgtgttcgtcagcgccgccaccacctccggcgaagtcagaactagctatgagttcgccgcctctcgccggcgaagtcggttcaaccaacgcctcagagctaccatgaatccgtgatctttcgtttactttgcaactcaacttttttttttcatgagaaactttgtaattttaatctttggtagtctggttatcaaatcatgttgtccgagatgtttgtcatgttgagatctttatcaacgaaattacagatccagatcacataaaaaccgtccaccaatccacagctcgaagaaaaagttggcgttatgattttgtaaaaagaatctagaacatacaagaccgaagaacagaagtttggcgttctgattttgcatgcataaaaacgaaaaaaaacatattaacagatcaaaaagaaactagggaagggtgaaagattaaacgaaatgttcttaagactactaga

SEQ ID NO: 72317 - DNA, 2787 bp, Oryza sativa
taatagtaaaccacctcaatagtatgtctacataggtatctatagctctctcatgcattgcttcgtttttctctatagactatctctaagctagtagatagctttgctctctctcttcatttaatatcttccaagtagaaaaatatgctgacatggatctcttgtagatagcttatagataaccattgtgggtgccctaaagtttaagtccctaaatccaaataccacccgacaaagcccacctcacgggcacccctaaacagaagtaaataatttcaaaatagtccctcaagccgtcgccttcctcacgctctctcccactccgccactgctccagctccccctccccgcaaggcggcggagatcccaaggtcgtcgggggatggcggcggtggcggctacatctccggcgctaaccctcgctgtcgcggccgcggtgatagcggccgcgtgcctcctcctctgcgcggaggcggtgtggctggacttgccgcagtcggggaccaagtgcgtgtccgaggagatccagtccaacgtggtggtgctcgccgactacgccctcatgtacgagtcccacccctcctcccaccccaccatcgccgtcaaggtaattccccacatttctagccgtctctcgcttcggattctatgatgcagtgaggcgcttccgttgttttggaatttttggatgggctccgatctaggttgcggtagttttggacgaattaggtcaactccatggtagaacgatagatggatgattattccgtgaaacggagcggtggcgtgaagtttttggttttgctgcgggtttagagatgcttagcgcacattatattgtgctggaataatcgttgaactggttgagtccttgagtgcgagggattatgtgttattggtgcagctgtgctcgcgaaagacagaaaaagtttgtgcctagtgttcaccggattgcgatgggagctgaaacttggaatcatatattctttgtgtaacctgctaggaatttgttgttctctaggatctagtgctctgtctagattccatttgcatcgcagggaatgatgatgatagtattctagaataactggctgatgcgtcaagtggattggtatgattcgcattgatgacgcagggtatgcttacatatgatccacaaaccgcgtcgattccttctgtctaaattgcggtggtttctgtccaggatgtcactcgtaacagaatacaaggtgattcatcttacagaatcacacacttgcttttctagcgacttctgtaagaaactccatgggttgtgggaagtaaaaggtgatcaataagaatcgcatcgatgcgaaataatgagaagacaacgatgcaatcatgttattatgtgatgtgaaattaatactgtaatgacttggtaccatatgtgtatctttttattcggaatcatttgcatgaatatgacagtgtgttgccatgctttttgcgttcgaacaaacaaggggacatactgaataaatagactaacgtgtagacatatggttgataaattgcgagtgccgtataagattgaataagtagatagacttaggtgagataatggtaatgtcatataaattattaattgtagaacccacttaagtgagcaggtgatatctcaactctttcttaatattattttccttgaaaatgcacaagaggaacttcatgggactaaaatttccaattccaaggcaaatggatggagtagattgtaagggttactagggttaaatggccatgcaactcgctatatactagtttctttagtctttactccaatttatgtccactgattgtaattttatttatgtgaagtataatattaattcattaggagatctattttcatccatgaattagtactggctagattagacactaagcatactatttgtgtttgctccattttgaacagtccttatgttttttcttttcgcagctttcgaatcaagaatatggttttttttttttactgtgcgagtatcaatctgcagttactgcagtccactaatggagtaaacgatgctactccaatcctctcaagcttagcatttcttcgagaagcttagcaatttgcttttacatgatttgttgaatgaattactatctacttgtgctgttatagttctgcaaatgcttatgcttggtgcaggttacatcaccatatgggaacaccttacatcacaatgaaaatgctacggttggtcagttcgcattcacaacttcagaagcaggaaactagaagcaggaaactatcttgcatgcttctggatagatagcgcagagaaagggtcaggaatatctattaatcttgattggaagattggaattgcagcaaaggattgggatgttatcgctaagaaggaaaaaattgaggtaggagtaggcttagccaaactgctgacggtccatatgaccatatttcactgatgtccagtttaattcactgcttctctaattgctgcaatctaattccttttgtagggtgtagaactagagcttagaaaacttgaagtggcagtacaatccatccatcagaacatgatatatctcaaagcaaggtaagttttacttccacatgattgacttactgtggttgaggctttaaaacgaatattggtggtactaatagagggttcagtagaatgccaatggaacttggaagtggtaatgaaacaatcatattgtcttcaattctcagcactagataccattcaaccacaaagagcgagcattgtttacaaaacttacgatctgcag

SEQ ID NO: 72318 - DNA, 8392 bp, Oryza sativa
cgaacccgacggcgccgacggcgtggtgcggcggcgaccctagcggcggctagaggcggctggagcaatgaaaaaaaggcggcggcgggtgggagcacggtgcgggagcgatggggagcttgggagaggccgacggaaaaaaggaaaatgaggaggaggatgtgggatgaattatataggggcggagaggtcgggaacggccgggagtggctcgatttcgccggagttagtgggggaagttggaggtggggagagagagagaggcgggattcgaatttgaatcccgaccatctcgtgacgtgggcgcgagcgggagtgagggcgtggacgcggggaaggcggggcgtgtgggggtggggcgcggggaaggcggagaaggtgggcggcgcgcgcgtggcgtggctgtcgccggctcggggaggcggccggaggttggggaagggactgacaggtgggccccacctgtcagcgcccgagggagatagggggaggcggcctggacttcgggaggagaaggggaagcggaccggcccgatatgggaaggggcgcgggaggaggaggaaatgggccgacagcccatttggggaaaagaaggggaaaaaaggaaaaaggaaaagaatttccagggattaaatattgcttgtgctcaattttaattggttaaaattatttctagagctctgaaaattccactaaaaatcttgttagcgtatttcgacatgtagaactcaagaaaaattccacatgccaaatccgattattatttgcattaattcattagggttttctcttgcttttacaccgatattttctctggtggattataaattcaatttaggcttgggaaagaacttcagggtgtgacaggtagcttgtgaagttgtatttggataaagtgaagacaattaatgtgtgtatttttctatttcttggtatctccaaaaaaaattatatatggaatagtactacatgtaaaatctcatttacaactagaattgttactataagagaaactcttctttaagagaagctaatgttttttttttttccataagggactttctagaagtacagtttgttaaatgtatacaactacaatggtcgacgttccagttcgcatgcacacccagcagcccagaatgaattgaacccgtggtcggcggcggcgcatcccgccggcaagccaaaggggaaagtttcaccggagcaaacgcaagaccgattcgtcacgggctcgcggctagggcatcctctagggttcatgataccatttcaagcatcctcatggcatggcgcggcgcatctaggtggccaacggcgaattagcggcggaaccaggtgaacacgagtgtggggaaatatggcgagcaacaagacacagcggtaagctagctagctagtagcctttggaaggtgtatgagctagggaaaaaggattgggagactaccgagacgaagggcgcgtagtgaagaaatgccagcagagcggaagtaatcttccgacctcggcgcgaaccaattaaggtcggggtaagggaagacgacctcgccccagtcgccaggaacgcaccggcacctcgggcgagccacgcggtggacgagagcggagtggtggaagcgatcggcgagctctagggatggtgaaggagtggaagctaggagggagaaagagagccctggggcggctttcatagttcatagagctatcggtctggaggagaccgagccagcggtgtgtgccgagcttgttgtaaaagttagtcgatatagtggaacgacgactaaccttcccgatcgtttcagtcgttgatcgcccaagacatgccagatgacgacacaggaacacacgatatttgttaacgaggttcagccgaagcctacatccccggggctctgattatggacgctcctccccaaccaacatagcacctagccgctacgagtccatggccacgccgccatcctctcactgcgtgtctacgctacattgtagtcgtcatggttacatcgtggtgcccccctctctatttaagatagttgccgggttacagagtccgactctaactccacccctaacacctattacaactccaagtccaactataaccaaataggactagtatattcgacacctattctaacagagctggcgtggtcaaggtggggcgagcgcgtcagagcggcgacgtcatcggcgtgcctgcctccgcgtctccccgagctagaggacaaggtagaggcaaggaggaaaaaggaaaagcgcgaggcgaaaaagcgaggcctccctctgcttgactgcttctggtggcgcgactggcaaggcggactgaccggcgtcgacgccttggacactagcggcggggccatggtgagacgccggctgtgacggtaaaggcaggcatggtagcttggcgcctggcggcgagcggaggcaaggcggcggccagagcggtgactcgcacgcgagggcgggaaacggcgaggttgcatggctggccgcgctggcgagcgagcgaggttgcctactctcctgcatgtgcgcggcagcacgtgatgagcagccgtggcgagtcgggctcgggcagaccggagcttcggcacgcgagcgtaagggagagggatctgctgggctgtcctgcttagataaagaagggagaaagcggcctgattggagaaataggcatgagagggatttatttggatgaagtttgagggtgatttgatttggatttgaaattggacgttacggagatttgattcaagtttgatatttgaatgtagggactactcaaggaagggaaacacggtgggactcaaatattttggagttgtaagattacttgaaacgaggattggatttgaatagttgaaaggatttactgatagacttaaggagggaggttcaaacaagcaaatttaaactccgagtctatttcgaaacggtaattttgaggagtcaattttggttttgaaggaaaggagataaatagagcactcagaatacgagattttcacggataggtatttcatcagttttgaacgccacgtaaaaaacggggcattacactagctataatctcaaaagaattgtaatttagtaacgtttggtttggctttaaatccactattcacaggatgagaatccagagctgaagctttgtcgtaaaggacagtaatcgtgccctctggtaggcagtgcacctatttgctcgaaaacttccgtaagtttttttttttccttcaaaactattagatttttaaccattggattacctcgagatttgcgcatgaaagaattttttttctagaaataattttttacacatatcacgcgtaagaacatgatgctaactaatcaaaccatacttgaatacaagttttatataagttactatatcgtagttaccatgtaattacagtacagttacaatgtaattgtgtctcaattatatactactattgttatatgtgaaagtttttcattaaaagaattgagacatttttttagatactcccgtaccaaagttactaccactatataaggaaacatgcaatttatcaaaattgtagtaaaaactttatattagactgaaatcgtcttatatccgtgtgcatgggccataactttactcagtttaaactagtttagcggccgtccatgaaatgggcctggatttagcctatataaaataggccgtacatgggccgataattggatctgaacgatactctgaatattaaattctcgcggagatgcgtcccgcccgcccgtgacgcgtacagccgtacacccattcctccacgctgtttgctccccgcgcgccacgaagtagagtactccatctcccaacgattaatgccaagtcaacaagcaacaattctttttgtcgaacaccagcaagcaacaaatcatccagtcagcccgaacacagataatgcagccgtcgcaacgatcccgccggccaccgaggttgagccgccgcaatgccatccggcagtcggcgtacgtggcccggccggcgtcacagctctcgccgccgtcggagtcggaccaacccgccttctggtattcgacggaggaatccgttctggaggaaagggttgtggaagatgaggtcggagatcatgcagaggcaggtggagccgaggcggccgcattggtggtggaggaggcgtcgacttcgagctcgtctgcggtctctgtccacgcggctatggtgatcaggaggagcatcttgaattggagtaagctggatcttatcggggccggatcgtccggcagggtgtacaaagcggtggctgagtaagtccgcttgcgatttaccgtttgccttgctcatgaactgttcgatgcaatgcttcattgtacttcgtgtctggttgtgtgttctattctttcagcagaccggcaatttcggatgagttatctctgtatttctcaatgcttcttcgtattattgccttgtcagggatgggtttgtatttgctgtcaaagaggcttcgttgattggtcccgaaagctatacgaagcaaaccgcatgtcagctaaagcaggtagttttatctcttatcaattaattaggtgaaaaattatcttgtaagtgtttaattaagcaaattgcaatttttgtcaggggtaaaatttcagagtattgatgttctccaattctaaatgattccaagtataagctaattcagtattagtaacaacatttcaggaaatcttgcttcttagtcggttggagcacaagaacatagtgcagtattttggtgccaaaatggtatgccagttctcatatgctagttgaacaagtgtcttcattatgttgctgatcgcctctgcaaactgttgcctcccaaacaccttcattttaggttatttttcttcggtttgagcttactatccctgtttggatttgcttgcagggagaaaccgtgctatgtattttccttgaatttgtgagtgaaggttctttggtatctgtatatgagaagcaacagctggaggaatcaactatatcatctttatacaagacagatcctcaatggattggcttatctgcatcatcataatgtaatgcataggtgataacacattatctccacaaaaaaattcttgctgctggcccggtcatttgaaaatgtacttgttatagtagtgatcaagttaagtacagatgtacaactctcgatcaaatgactaaatgagtgaagtacttctttgtcatattatggtaaatctgcactgtccttcccttttcaatgcagagatattaagtgtgcaaatattttggttgataaaaatggagcagtgaaggttggagattttggactggcaaaggaggttacttcatttttggtttcagtgtccttttttcccctggtttgactgacagattatgaaatgattttgtttgatattgacgatgtgaattctcaacccttttaattgatgtaatgccagataaaagtctggaagcagaaaagatcttgtaccggaagtgtatattggatggctccagaggtaattgtttgacttagtatttatacatagagttttgctcccatccagcaggtaccatcgggactgtccggtaccaaatctcagccatttaatcagcgaaatcggacggtggaaaataagtggtacctccaggtacaaatttgcccatgaggaggtgctaaaaaatttcgagtggtggaagggtaaatttgttttttcgcgtaggagtgtccagggaggcagtggcgagttgcttcgtgcttcgtcggcggcggcgagttgcttcgtcggtgacgacttgcttcgtgggaggaggcggcgtggcggcggctgatccgtttgaggctgcggcgtctgatccgtttgaggcggaggtggcggcgacggcggtggcggcaggtggttcgttgcggcgaggttgtgttgggcgcagtggtggcgggcgcggcagtggcctggtgctgctggtggcgggcgcggcggtggcctggtggtggccacggtcacgaggtagcggcggcggctggtgtgtgggcagccttggctgcgaggtggcgacgggcgcgatggtgccggccgtggtgatgaggtggtcgtcggagccggtgttgtggcggctgcagcgacgagatggtcatggagtcgtcttagcaggcgatgtggcagtgtatacatcgatttcttttcatccgatctaaatcattaggttcggttggttgcagcagtagatactttcattttctgggctgcatatactcttcttcttcattgcttataggatttgtattgtacgatttattggatgttttgatgagctcaaccattacttgttctttgtgaatgttcaaatggccaataccctcccatatcatttactgattactgcaattcgagtaagggcgtgaatgaagccgctggtgaaggagctcgctggttccgccgccgcggatggcagatgcggggcgagcaagcgagcgcacaggcgggggcatggatgcggggtgagcatgcgcgcggctcaggtgggcttcgcacgggtggggctgcgctcggagggaggaaaaaaaaggagattagatgagaaagcagcgccacacggagggaggaaacagagaaagagcgaaaaagagaaagcgagggtgcgactcctttctctgtttcccgatcgtacccttctaacatggacggatggatttatctctgtacctgccggtaccagtacctgccggtacaagttgctggatgggagcaaccctcttagacatattagtatgaagtatctagataaacgttactctgaagaatttattgcacttttactttacgatagtcgtccaactttccggaccagcagaatctatattggttatctgaatatctgatgatgatcaggttgttcgtggcaatccgtatgggtattctgctgatatttggagccttggatgcactgtcttggagatgcttacccaaagaattccttatcctgatgataactgggtcagtaaatcctacagtactcatttagacttcttacagtctcttcaaattcgatactgattcagttctatcaggtatcagtcttctaccaaattggccgtggtcaacttcctccagttccaggctccatatcaccggtgtcacgcgatttcatccacaaatgcttgcaggtgaatcctgatgatcggccttctgcagatgaactgctgaatcatcccttcgtggctgttccagaaccagactagtatgctgcatgtttgcttaacattgctaggcgaagaacattcagtagctccttgtttccttcctgtaagttcagggtcagaaagtcagaatgcttgtggttggaaattcatagtcctatggctaatttcacgagtacttgtttgtacgacatctgttccttataaaaatatcccactatccaactttgcgactttgaccattagttgggagagcaatcaaccaatcatgtattttatggttgagacttacgacgacttgctactccgcgtctgcatgtctgagtctgaagtctgaaccgacggcgctgacgttcccggtgacgaaaccaaacagccacacactctgaatcttacaagcaaagccaattccgcaattcccacgacttggtactcggagatagcggttggtcgtaacgggagcagttagccagttaccgatgacgtcgtctcgatcgacgctcgggtcgctctcggggtacggggagggtagtcggctccacgccgttataaaaggccctcatccgcaacgcgggtctctttccggcgtcgccttgtcactcgctcgccaccacccctcggcgccacggcgagcagcgcaccgggtccaggtcaaaagcgcacgcacccacatcgcacggccgcgtcgccgtcgtcgcgcgtgagccccccgtgcctagtcaaaccccaccacgagcagaatcccccaatcttctcgcgatccgctcgctctgctgctgcgccgcgggagcgcgggggaggaggaggaggaagagggaggggcactggccatggcggcgcgccagcggccgcaggcgcagctcgcgcggatcaacgccatgaggcactcctacaccgccgcgggggacgatggctccggggacgacgtgtgtggggagctcgacgacggcgggggcgagtacgcgtcgcagaccagcttccgcatccgcggggggcgcggggccgcggaggtcaccgccatcttccgcaagctggggctctccgggcccgaggacttcaccatcccgcccgcggtctacgccgccgccatgtcccacctctccagctccgcccgccgccgcgcgtcgctcgaggtggcttccccgccggagcttctagaagcttctccagccgaagccgcggttccga

SEQ ID NO: 72319 - DNA, 14995 bp, Oryza sativa
tttttattgtttatttaataaattatgtatcaaatatactatttgtaagtatcctataaaatgaagtattttgtattggcatcatatgtttattttattcattttctcttttattaatgtgatgaactaaaaataattaattttttaaacagattattcttgaaatatacatagttctacttacaaaccgaactcgatagtcaagctcgccccaagcctatctaaaagctggaaggtttcgtaggctcggctcgagcttaagcataggcaagcgagctcggcgccacgcctcggctcgttgacagccaatacacctaatactagcttgaaactgatcaagatgcctgtgtatatgaatgcatgtgcagttttgtaccacagtagcagttactctcagtcaaccttgcagtgttgaccaatgaccaccagcctattacacacaagtacacagtgcctttggcctcccacgtagcccgacagagcttgtgatgatcaccatcattacctgttgatttgctcagctcccactccctggcacgtgcctcgtgcgagagagccacagctacagctagggcctccacggcctgcagctagctagctagccactggctcgagcattctctgctttcctttaatatgagtgagaaacacgcgtgaatgacgctccggccccgtgccatcagcagtactcgcgcgctagcttgagactatatgcatgctacatgcaatgcttgcacgcttccgatctgcctaccttttgatctttttttgttctgaacgcttgcacatggtcaaagtgtacatgtacgctcagctggtacgacgtagctcccctattgatatcgttgctcatcacaagcaatgaaccaatcgtggctctccatgtatgtaaaaaaaaacaacgagaaaaaaacactatggcatttggcaggtgaacacgcgcgaggacaggcagagttacgttgcagatgcagacatatggaccggtgcggcggtgcgtcgttgccggctggtacgtacgtttgccttgcccgcgggaatgggcaaccgggcgcagcgcagcgctgcctccgcggattcgcaggggcgcgcggttccgtggcgcgcgcgcgcgcgtccgcgtccgcgtccgggaacgcgagagtgtgcctgcctcgcctgcgcggcgcgcggcgacacagcgggcagcgactggcattgtcggcgtggccggaggggtcggggcgcgcgcgcgcagcagcagcagcagcagcgccggggtgggccgggtcccgaggcacggcaccggccggacacgcccgttcggccgtggcatcacgcgttgcaggggcggtccagtggagagcagcagataccgtactgtgcgagataatagctgtatgtaaggtatgcctgcctgactgactgactgccttcaatccttgtaggtggtgtgacattatgtaatggactattccatttcttctcctggctagctagcttctcctcaaggaagaaaacatgcgtatgtccatcagtccatatgtctacacatgccatggaaccaacgctttctgatattagttgattagtattacaaaaacaatatccatttgaatatgttgttttcagaatttaccggtgttctttcctgcatgatgagcgcctcaaaatgtacgtagtgtagtaatattccccgtatttcgtggccaaaaagagagtgaacaaaaaatctggtgaatctggtgtgtttagttcgtgggtgtcacatcggatgtttgactgatgatggaaggggttttcgaacacaaataaaaaataactcgcctggaaactgcgagatgaatttattaagcctaattaatctatcattagtacatatgagttactgtaacactttatggctaatcatagactaattaagctccaaagatttgtctcgtgatttccatgcaaactgtgcaattagttctttttatctatatttaatgctccatgcaagtgtccaaaaatttgatgtgatgtttttggaagagattagctatataactgtcgataactttttagatgaaaaactttcaaatgtaactccactataattacaacgtagttacattgtaactagactatagttacaatgtaactggcacaaaaacgctcagaatcacgttgttgcttagttggttaacatatgcaccgtgagatcgtgggttcgatccatgccccaagtgtggatgtgatttttttaatctgcttgtgcgcatcttgatgtcgaataaggcctaactcgcaaaagaagtggacatcaatatgttagagaaaaaaaatgatgaatcaccgtccttggacggaaaatttagtccgttggacttggaggcgtccctcgcttacggagtcaacaaaaagttgatctcgagatccgcgtgcaacgtcgggtttgaacggccacgattaagtgacgatcacacgcgaccgaccggccctggcccacgcccacgcccacgcatggcgaattggcgatgcttgatgcttgcaagttggtgaaggattctcccggtcgtacgggctcttttcgcggtgaacgcgcgcgagaaaaagaaaagcaacggtttaactcttgtgcatggcttgtggaccatagaccacagtacacgtggccaacggctgttctactgctccagcatgtactagtgggtactactcctgccagtttcacatgcatgtgagcccctggtttcacccagaattttatcgagcagacggtgcacacttgttgggtgaactgatgatgaccagttgagtgtccattgtccatcaacttggacataaacatacacatgctgcataagagacaaaaaaaaggtgatcagtaaccagcttaccgagaagcgagtggttgcagcttgcaggttctgactctatcaacttgctaaaatgggggatcgattgaacgattccccttgtcatttcctgttccacgcacgcgcgcgctcgatcgttcgggccagctgctgcttgtatggttcaagccacatagccatgcaaagccaaagcaaacctctctgaactctgggtagatgtctccattatttttgctagctaggttaacagtggcgcataatgcagcaacgggacaaggaggtagccggaggagcccaagagagagacagagagggagagagttgagacagggtcatgtgcggcggtcagaagagccttggccgccgggtagactggcgctgtggcagcagcagcagctgcgcggcgcggccggtcaattatggacaaatgatggcgccggtgattaggtgaggggacgacgcgggccacaacgccagtacgtacgtcttcggcttcgatcagtcgcttcccgccgcgcgacgacgccacacggcgccagttaccagttggccgtttgggctttaggaaattaataattttatgattaagtttatttcgggcggtgtactgcttcctcttctcgcggccatcggctgctgaagtgctgatcatgtataagccccggcccgttgagaagttatgatgtacattgaatattctgggacggaaggaaaccgtggtactaaactcctcatcagtgacggaaattaaaccagcactactaaactttcggcactaccatccttaagcgtgtatataggaagacgcaaaacccctacttacttttcttcaagtccaatatacacattttgaaataattgatagaagttatcacggagcgaagatatgatatgaactcatggcgagtttacacggtgagtgcgcaaacttgtgacatgttcgcaatgttagcgcggagagaagtgaactatcgaagttagtggctcgtatatacgagaacttgaaattatcataaattttgacaatttgatcttttccgaaaactaattttacaaatgaaccgcggccaaaacttattttagaaataatcttttttatcagcaccaaatcgtatggcgctgaacgtaatgtcttaaataagttttggccgcgatttatttataaaattagtttttggaaagggtcaaattgtcaaaatttgtgtgaaattatccgaatcgaagttaacagcggttagtcacctacatcgatctagatagtcggtgttgatctacatgtgcatactgactacaactttgtctcgttggttaattagctatccatccgcaatggataagcaaaagagtacgcaaggaggaaagaagtgagaggggttattaatttcgtctgcatccggtccagctagggcaatctaagcatggagatcggccaggtgaaacaagcagccggagtacagcccgtccaccgctgctcaccggtgcccaaagggagacgggcgtttgcgatgaagcggcacatgtacgcaggattggggacccacgcccacgcttgcgacatcgtcgtgcgcaaccggttcggcgtgtggtcacggcgaaaccaaaagtacatcaggaagacgcggtatttcaagttcgtcgcgctcggttcggcgatgtccaaggtgagacggaagctccaggagtggatcaagcagcacggcttgttaacgtgggctcagtactcggcgcggcgggaggagttggaggccgctgaggcaggtctgcagaagcttttccaccgtcgcatgcccgctcggtttaggaagctgaagcggcgagtcgtgaaagagcgcgagtgggagcggcgtctcttgttgaagaagcaggcccacgcggcgcagggtgcacccataacacgcgccctattcgtgtatatgtcttcatgtctagttcaactgttttactatctgagaagacttatgcttggtagtgtcacgcccagaaatttccgaatagaatttcaagtaaaatgtgcattaaaatccccgtccaggaccggccggggtacacaaacgacaaagttgacatacagatccatgtcttacaaacattataaaagtcttacataaatgcagcggaaaataaaaagataactggagctaagccttgacttgcaccgcagcgggaacaccactccacaggcatcctcgacggcacggacgaagcctactcggagaagccaccatctgacgcatacttaaactttggggttttggggaaaatagagcaagattgagtactacccactgtactcagcaagtcataccggaataggggtatgatgcagggaattatcaagggatagctataatggttcatttgcataaagcggtcatttataaccagaagttgaaagtagtaaacagttgtaataattaatcaatattaatcatccactgtccaacgctataccacgttgcaacaggcccaaccatccacctatactattcaattccaaaagactagtctagggtgagtctaatcacggtgaatctggttgaccgcccataaccgcgggcacggctattcgaatagttttactccgatcagaggtgtacaactgtaccaacaagacacagccccacgacatgtttccatgcgccgacatgccaccacgacataccggaaagaggccgtgacaggacccttcgcataaccccctctaaccaagcacaccacacttcaggtttcacccccactcctcgcaaggcagcgggcagtcccctctcgtgcctaggcgaatccggaagccgcataggccgtcgcagggcccatccaaactccatcacgcccacccttgcctggatgcgtcggctagaggaaagctacactacaagcccagccgttgcccacgctggcttgtggtaagtacgaggaattcttccagggtttcccgcgaaccggtccttaattgccatgggcgcgaccatcaaaatcatgcacccacagcccaccatttaatatattttaattaagcaacaccagaacggtggcactaatccaatcattaacataaggacctacagtctatacattaatatgatttcccccattgtgtgctagttgaactaatcatggctaagcactccctagtccaatctctagtcatgttatatcccaagctaacaaaggaacatggtacaaaatagcatggctatgacagtaggtaaacattccacagtaatattataaaacaatgcagtatttgaagaaaaacaatagagcatttgcaatataggatcaacatgttcaagtgacaagcatgacttgccttgctctgctgctggaggaatctcgacgactatctcaaagtacaccggagcgtcgggagagccggaatctaagcgacatacaaagcaaataatacaaacaggctataagactactgaaacagagaacaaaaccatttttaatggattctacacatttttcttgatttactgagacttgaatggacttaaacggagctcggatgaattagttatgatttttagaagattctctgtgtttttactagtaaagaaaagtccttaatgaattattgcgcaataaagcatcccagggctgacgtcataggggggcaggcggcgccgacatgcgggccccacgggtcagcggctcgagagagagagggaggggcgccggcacgtgggccctactggcagtggcacaaggcgggagggggtgcggctggcaggcgggccctaccggtcgcggctccaaaaaggggggggtggcgagacgccggccgggcccgacatcaagccggccggcctgccatggcaagggcggcggagcgcgcgcgtcgccagcgacggcaaccggcggcggaagacggcggcgcgaaggcggcggcccgacccggctcggcgctaggagggagaggaaggggaaaagaggaggaggggcgcctcaccatgagttggccggcgcgggggaagacgacggcgaacggcgacggcgacgaccggggaaatgacggtgaacggcggacgggctccgagacaccctaagagagaaaaagagacaggttagagggagagagggagtccatggcgagcgggaaccgtggccgacggcggcagctatggaaaggctcaccggcgcacggcggacggcggcctccgatggcggaattcgacggaggaggggtggacgaggtggagctcggccacgcgaacccgacggcggcgacggcgtggtgcggcggcgaccctagcggcggctagaggcggctggagcaatgaaaaaaaggcggcggcgggtgggagcacggtgcgggagcgatggggagcttgggagaggccgacggaaaaaaggaaaatgaggaggaggatgtggggatgaattatataggggcggagaggtcgggaacggccgggagtggctcgatttcgccggagttagtgggggaagttggaggtggggagagagagagaggcgggattcgaatttgaatcccgaccatctcgtgacgtgggcgcgagcgggagtgagggcgtggacgcggggaaggcggggcgtgtgggggtggggcgcggggaaggcggagaaggtgggcggcgcgcgcgtggcgtggctgtcgccggctcggggaggcggccggaggttggggaagggactgacaggtgggccccacctgtcagcgcccgagggagatagggggaggcggcctggacttcgggaggagaaggggaagcggaccggcccgatatgggaaggggcgcgggaggaggaggaaatgggccgacagcccatttggggaaaagaaggggaaaaaaggaaaaaggaaaagaatttccagggattaaatattgcttgtgctcaattttaattggttaaaattatttctagagctctgaaaattccactaaaaatcttgttagcgtatttcgacatgtagaactcaagaaaaattccacatgccaaatccgattattatttgcattaattcattagggttttctcttgcttttacaccgatattttctctggtggattataaattcaatttaggcttgggaaagaacttcagggtgtgacaggtagcttgtgaagttgtatttggataaagtgaagacaattaatgtgtgtatttttctatttcttggtatctccaaaaaaaattatatatggaatagtactacatgtaaaatctcatttacaactagaattgttactataagagaaactcttctttaagagaagctaatgttttttttttttccataagggactttctagaagtacagtttgttaaatgtatacaactacaatggtcgacgttccagttcgcatgcacacccagcagcccagaatgaattgaacccgtggtcggcggcggcgcatcccgccggcaagccaaaggggaaagtttcaccggagcaaacgcaagaccgattcgtcacgggctcgcggctagggcatcctctagggttcatgataccatttcaagcatcctcatggcatggcgcggcgcatctaggtggccaacggcgaattagcggcggaaccaggtgaacacgagtgtggggaaatatggcgagcaacaagacacagcggtaagctagctagctagtagcctttggaaggtgtatgagctagggaaaaaggattgggagactaccgagacgaagggcgcgtagtgaagaaatgccagcagagcggaagtaatcttccgacctcggcgcgaaccaattaaggtcggggtaagggaagacgacctcgccccagtcgccaggaacgcaccggcacctcgggcgagccacgcggtggacgagagcggagtggtggaagcgatcggcgagctctagggatggtgaaggagtggaagctaggagggagaaagagagccctggggcggctttcatagttcatagagctatcggtctggaggagaccgagccagcggtgtgtgccgagcttgttgtaaaagttagtcgatatagtggaacgacgactaaccttcccgatcgtttcagtcgttgatcgcccaagacatgccagatgacgacacaggaacacacgatatttgttaacgaggttcagccgaagcctacatccccggggctctgattatgggcgctcctccccaaccaacatagcacctagccgctacgagtccatggccacgccgccatcctctccctgcgtgtctacgctacattgtagtcgtcatggttacatcgtggtgcccccctctctatttaagagagttgccgggttacagagtccaactctaactccacccctaacacctattacaactccaagtccaactgtaaccaaataggactagtatattcgacacctattctaacaaactccaccttggaaaatatacgtcacctagaagtagtagaatcaccatgccgatccacctgtcctccagacttggattatttccttttgcagcttcaccacgagccgcccgacgagcgtacaccagactcaccgtcttcaagagactccactctccctgtaatttcttcctcttgactccacctgcaacagcgctccgccttctcatctatcatcacggtcgtcttgccaagcgaaattggattccttcctagttgtcccatcatagactccccaaagaccatgttcacctccacattccgtctttgatttgattcaatctaatccatggccagataaccaatgtcatcactaaatagacaaatcaaactcaccaggcatgaagaactgaaccctttcttccttgttgtcttatgaaccaagctaacaaatccaacatccacgcttcttgcatctgtagactgaatccatgatattttgagaaaattcaccgtcgcctcgaatcacttgaagaattaccatgatagccttcgctcttactccttcagtgacgcagatttccatatatcccatcatgccgacccgcatattctggatatatcctgtactgccaaacagtatcgttgaccccatcaacgatatttgacccgatgttgcccgggacttctcgcatagcaaaccacccgtttgccactgccgcaccggtccaaccaatctgctacacggccggtctacctccgtcctgcttctggttcggtccggccaacactctagcatactccttgttcctgagccatacctcgccaccttgctgagcaacctcgtcaccgtgagactatctctacagagttcccaaggagccttctcgccaagtcactattttgcgccgatttctgccaattttgtgccatatcgaatcttcccaagccagcttttaccattgcccaagaaagtcccagtcaaactgaattccaaacaaccgagtctgactctgatggacttatgcaatccgattgcacaacttgactctaatggccacagaaaaagatacaactcagccaccgtgtccgcctagacctctgttgcgttttcctcacgtccaacttcctctcagcaaatagcttgccacaccacgctcatacacaaattatgcacctgcttgcatctagcctcccatgcattagggcctttttctttccgcttaggatttattataatccagcttattagaagtaagctgaaagaaacaggaagattatttttacagcttattataatctagatgatgggttattgtaatctaataagctcaccaaagggagctttttctggattattagatggcaaaagacccactgcccctgattaattctaattatttacctgaattgccaccgcgtaccgcttcgtttctttttttcgttgaccgtgtgaccgcttcgtatcctgcgcgggagtcgcgagatcccctttcccctccactttctcttcttccaccgagaagatcggcaggcgagggggctgtgcgacggcatcggcctaggcgagcagagggcgtccggtgcgcggcagcagcgaactcgggggcatgctgcgtgcggcggcgaggtccatagcccattccgacggagatggatcctgcagatggtgaggactccctctcgaaagcatttcgataccgtgatgatgtggtgaataagcgatcccaatcaggaggcaaccatggcgtctctggcctacatggctccggcagcttctctgatggattttggggcgacggcgtcggcgaagatggacatataggcgatcttcatggctcacccggcgtccacggccaccatgtctcgcctgccccccatggcgccggcagttctggcggatcacccgtcttccatggagccggtgccgggcaccgcgacgccactgtgttccaagcggtggcagatgtgtctccccctggcagaggccgtggacggcgtggcgggcatggtggtggacctggacgtggtaagagatcggccacacaaccttccgcacgtggtggccgaggaaacaaggtgccatacaagccaccaaggccatccagcagtgcaactgttgtcggcgacgccgagggagcagctggtgtagacaatgacttcacagaagaaacaatggacagtgcgcctcatggaatggtacgtctacttcatttctctacttcaaaaattaaggtttaatgcatttatctactgcaaggattaggttgaatctaattgaatttaacgtgtatgtgtactacatatgaaaaattaatgtgtatgtgtctatgctaattggtcatgtatttaccatttctaatatagaaatacttgtgaatatataaacactagtggtgtaaaacaacatgtaaatctgaaccttgatgtgtttgatttatcaaatagaaggaggagcttgataaagcagattggtctagcacacacaataggatattttgtgaactatgcgtacaacaaattgaagacggcaataggcctatcgggataatgactactagatggtaccagatcatagccaaaaagtacttccaaaagacagggctaagacacaataagacacaactgaagaaccggtgggatgtgctgaaatccatgtacagcttttggcttggtctccttaacgacacagggcttggatgggatcatgcaaaaggaacagttgctgcacctgttgagtactggaaaaaagtcaccaaggtaataattcatgtctcatgtacatgattttcatgaaaatgttttaagtgcttgcaataattgaagatttgatgttttatttttagggacattctgaatggaagaagctacaacatggaccaccagaatgtttagaattgctggatgaaatgtttggtactattgctgttgatggttcttctgcttgtgcacctggagaaaatgctggaggggatgatgcaagtggtgatgtacaggaccttggcgacacaccagtagattgctcattgggtaaaaaaccagtgaagcgagggtcttccagcaccgccactagtccatacaagaaggttaagaaccccatggttaggataatgaggaatattcaaaccactatggataccaattgtgatattgccaacaaggtgatgcaaggtgaatttaggttcaattccattaaggaggtgatggatttggtggtggattgcggggcagcagaaggaagtgcggagcatttcatggctacaagattatttgtgaaagctgaacatcgtgatatgttcaagactcttaccaccaaggtgggaaggctctcttggttgcagagatggtgcgagaaggaagggcagcagtagaaaattgctaattatttatatgcatgaactagttatctctgtttttactttgtcagacaatatgtattagcaagattgctacttatttattcgcatgaacttatgtactgcctggccatgtaatatggcgccttaattttgattggatgaactactgtttagtgatccatcaacatggtctttctgtgactattgaggtgatatcatttgttgcattgtttgtagatgggcatgtatggaagtgatgatgacgatgaggaggaggatgaaactattattgttgctagcagacaactagatatgatgagaaaatttggaccggtgttgacatcatttggtatgttctacgctgaaaattatttgaacaagtccaagtatagaaaagctaatttagcgggtcatgcttgggttatgagaaaccttgaagttccacaagattgttatgacatgtttagaatgagtaggccactctttgagaggttacataatttgttggtctcatcttatggtctgaagtcaactagtaagatggattcagttgaagctttagaaatgtttttgtggaccattggggctccacaatcatttgttcaagttaagaaccgatttgagaggtcaaaaggaaaaattagtagaaaattcaatgaagtgttgcagagtatctatctcctttcaaaagatcttgtcaaacctagagacccaaacttcacaactattcacccaagactacttgatgatcggtttgagccccatttcaacaattgcataggtgcaatagatgggacacatataccagtagttgtgcccgcatcaaaggtggttcaacatgtgggtagaaataaatatccgacgcaaaatggcttggccatttgtgactttgacatgaggtttgcattaattgttgcggggtggcctggatcggcacatgatatgagggtgttcaatgatgctttgcgcaaatatgccgctatcttccctcatccaccacctggtaacttctcttatccgtttaatagtctcgtcgaactagcatcaattataaaataatgtctcatggtttatgtttatgctaacagggaaattttaccttgttgactcgggctatccaaatcgactaggatatctatctccatataaagggaccaaataccatttaccggaatttcgagagggtccacgtcctagtggcaagaaggaggtgttcaaccacttacattcatcgcttcgtaatgtgattgagcgctcttttggtgttttaaaaatgaaatggagaattctattggacttaccaagttatccaatgctcaagcaaacaaaaataatacatgcttgcatggcgctgcataattttattcgagatagcaaattgagtgatgaagagtttgatctgtgtgataatgatgaaaactacatgccgatgccttcatctcaagggaatgccagtcacatgggagacgaagatggggacgcaaatgccttccgtgatagtattgctgatgctttatttgctaggagataataatttggttttaagtctaatatatatgtggaagaaatattcatgaatgtataattataaatatttgtcaaatttttatttatctacatcaaatttatatctattgtataaagtcaccgaatgatgacaaaggcatccaaaaaaatagttgagggcattctagactttagccatgcaaactcaataatccaggtttccaataatctagagaaagaaacagctcacagcttattttcctctagcttataataatccagcttataataatctgactcaataagttggattataataatcctaagctgaaaaaaacagggccttaatctcagcactgtaacatgcagcttgtgcatatgcctgacgaccaccatgcactagccatcctatattttaatgcatgcagccatgatgattgtatacaaatcgtgccgcatgaaagtgtcttctccgatccatgcgatttgctcgactccgttcaagttgtacgcaaagaacagcatccgtactgttcgtctgtacctccgcacgcaccgcagtcgcagccctcgtgttcaccgtctacgaccccgtcatcatcggccatgcacgtccgccgcgccgcgccacgctcgccggcttcgcccttccatcactagcctccctgccgccgcggatccgcgatcgccgcgtgcgtcgggcgcgccgtccatggcgctacccctccgatctctccgaacgccttcggccacgcccggcctcgtcttccagtcacgctccgccatcgtcggtctgatcgcgagtgaggtcgtcgcctccgcaacgtcctcgttgtcgccatcgatctcatcgccatgactgacgatctcctgtcgatgcacgatcctcacctcgtgtttcctcctccacatgtcttctcgatccaatactgaaaccttctgctcgatgggt

SEQ ID NO: 72320 - DNA, 618 bp, Oryza sativa
cttcatcatatacctcctctgataccaatgctatgaaacttccagcttttttcttgattttcagatagcacaacacacctgtggttgcatgtacatgtaactatacaccatgtagtcccaccttgcataaaatagttttctaggtttaatatacttgatacagggaggtggaatctagtttcttgtatgcataaaatagttttctaggtttaatatactaatccttttattttcccttttcaatgcaacaggctctgtccagagcaataacagaagatgagcttatctacatcagagcacagtacaacttgctagaaccaagtagtacagatggtcgactatgcattgaaaacttcaggatggtaagtgatcttatgctatcaagtcctcgcaatcatgattttgagtaggttgttcacgttctttttttttttgagcatttgaattactgccattgtgacactgagactcaattactcttttcaacatttttactctccaggctcttttacaaaactctacagatgctatgaaggaatccagagcccttgatatcttgaatgcggtatgaaatgcccactcagctcacaatttcattatcttcatataaacatatgc

SEQ ID NO: 72321 - DNA, 5924 bp, Oryza sativa
ttcctgcagccctatgaataatcggtaaaaagataaaagtatcaactttttttttgcagaaacaacaaaaagtagtaccatctagttcgttttgttcatagtctatttatgggcttggttgtcaagtttcatacagggcacatttatataaattttgttttcgttgcagtatccgaggctttccctcattcccggtaaccttgagatgcttaacacaactgggctcgcggcagatcacaagaaaaataaggagcccatgctgactatctggtaaggccaattttgttttttttcacaaaatcggcttctgagcccagcttacatcaaaatttgttgggcctctgtttgatttgctatcatggctgtgaactcaattcaataagccgaaccacaaaccaaatggttgactaatttctggattgccaattgttctggtttggttgagtttgggcacaaataaacaagccctgtatctctacgtaaaattagacatgtttggcttttaaaaattattttacaagttattcaccttaaacttgctctactagatagtaaaaataaaaatagattgcacacaaaagctagctttggaccctctcatgtatttccatgcctacagcctactagtcgcagtccttgacctgcatctaattattcctaacatcaaaattacttgaaatttgcgtgaccaatccattcaaaaacaaattgaatgacctaattattggtctacagttggacttttattttccaacccacatgagtaccgactactgaactctttgaagagacatttgacattgtccatttgtacctgccatttgagtttgttagacgctctcgtcatcaaaataaggctgtgtttagttcacatcaaaattaaaagtttagttgaaattggaacgatgtgacggaaaagttggaagtttgtgtgtatagaaaagttttgatgtgatggaaaagttgaaagtttaaagaattattttggaactaaagatacagtgcaaatgcaaagcacgaagaaagctcatgcagaagatctggtcttacaaatttgaaaaagccaaatggaggacggatgcgagccgtgtgcttccgtaagttttgactttataataaatgaaatgacatagtatcataatatcaaaacgaccaaatcgtctacaaataaactctatagtatatatgcagtctgaatgcaacgaacaaattaagaaagaaaccccctaaaagaaaatcgatccacatgaactgagtgcaaagcataagcatcaagcaacgtgatggcctgcatggttgatatggaaagcgtcttttgcggcctctaccgacattcagaagtcagcactaacctcccctgcatcctttgcttggatgcatgagacctaacctaattgacctgcagcattaacaatcaagtaggagtactaatcaactcctagttggaacgtagaagacctgcttggatgcttgcaggctagctagctgcagttagcagaggcgctacgctttgtcttagaattttccctttaaacaatttagattttcatacaaattctgaaaatttgatgctataaaatgcagaaaataaattagaaataagaagctaaaagaacctattttttttaactctcaccaacaagttactttatcggttgtttcttctaatcttaatattttccaaacagagctttcatctaaaaaaacaatttatctaaaaaaacagagctttcatcttcgactgttcagcgccatttgcacactaaattatcctcagagcaggtacaatagcagactattaatcagctataaacatattttaataagataaaagatgagaaaaaaaaacagcgggctatagatctatagccagctacagtacggactccaagacgcagagtgtatatgataggtatgaccatatattaacagtatagtaagcaactattgtataaattggctattacattgactatagataatttgaagctagtagttggctatactattagagcaggtacaatagctggctataagctagctataaacatattttaaaaagataaaggaagagagaagagcagcgggctacatatttgtagccaattacagcacggactccaagacgtaatgtgtgtatgacatgtatgaacagataatttggagctagtagttagctaatactattaaacttgctcttacaactaagaacaatgcacgcagtccatgcaaattatgtattcaatcgagacagaaggtgtctatctccaagcgtcaacgctgctgtacgccgtagaagacggtgtgcaacctttaatttgccagcgaaagcttgccatcttgaccccaattaattaactatccagcgattcctccccagctcgtccccatcaacatccagatcagctcgtcaaccgagaaaacaaagaagaactgcaaaccaagcggtagtactagtaccagtttccagaagtacagggcattggcataccgtgtctgaatggcattcaccaaaatctcggaggtcggtagttgatacagcaggacaatgaagagataaataaatacagggagttcttatcctatgctatgcaatgtaaactcccacaactacggaagaagatgcgttcatatactctcaaattacttgttatttatagtatttgtttagtatatatggtttttagtcaaacaattgtaccttcaacaattgatttttgagaaatttatatagtttaacattgtaagatttacattttcttatatttatcactgaacatacttccataatatataatatactccatttaaactttaactacccatctttaaaaaaaacaataaatacttgaaaatatgttatattaccgaagtacatggtgtcataaatataacccaataaatttcatccatcatactataatagtaacttattaggagtaatttgtggtcaaagtgagaccgccgtagtgaatatctatagttattcgagaatagagggggtaattcgcatgttaatatactatatgagtttttgcttgtgttcgtgaaaaaaaaaagagtttttgcttagctgtttggaggggcattgagcatacagctctagctccttgttagtctagtggcggtcggttcgatgctagtctttttatggttgtgtgcgaaggcgattttagtgtgtggtgaggacgtttttttgttctcttttccttggctatattgttttagggttatagtcaatttactcatgctttgttcactgaaacttcgcactatctaggtgccactgttaaaaaaaatatgattgtaaaatatagaattatttaatttttaataaaaaaaaagattgacgtcagtaatacacaaggctaaatccggtggatcttaattttttaaaaggggaagtacagaaggagagagtgacactccaaatctcaaaagcccttttgtttgtgaaaaggaaaaacctggatgcatcatgctcctgcatgactggatgtaggctgtgcagcatcaccaaacttctgggcgcggcaaccaaccaaaccaaccaacaaacaacaaacaaccatgcgtgcgcgggctatctggggtaggccccgcgccgaggatatcaagccaaccccgcacagcaccgcccggcacggacgcgtagccccgtccatccgtgtcgcgcgaccttcacctgatcctgcctccctccccctccccacccatccagaagaaaaaactgacccgagatatgagatatgcatgatcccgttcccagtttctaggcttgctccacgaaacgtgccgccttccctcattcgcatgtgcatctccccaaactttgctaactcttttctcgacggtccatgcatcgaaatccttcgtgaagcaccatccaccatcatgataaccactaatattacgtgtatgtaagagtgtttgtaacaaaaatttagtgagattagaaatatatatatatcattaatttccgtctggtagagcatgtgttaaggtacacgtatataaggtgtgagtccggtgttatgtgtgtagtgatgtgtatgcgtggtgggaaagagaacacaataattaaggatttgtcacttatagtctatgacacatgattaaatatctctggaaactaacgtgcgccggtgcgcgtacgcggtacacctttgcccgtgacttagcgatgaagtcgggccagctagagactgcgtgtgacatgtgcaccgaggcggccggcagcggagagctagctaagctaagctagatcgacgaatcgtacccgagaaaagccggctcgggcgcgcggccaccaccgccgctagctatctcctcgcgcgcgcgaggggacgggacgacgaatcgattccatctcccgtgcgcgcgcggcggccgtcccgtttcgtcggctggtgaatggccgtgcttttcccatgtggatgtgggattttttttgcggtggcgcgcgcgcgcggtccaggtgatgaggagattattcgacggcgcgcgcgtgctgcggcgtacgacgtacgcacgtgtgtgggactgtacgtgaggtggtccagtgcaacgatattgcgcgtgtagcgtgtgcgtgacagcgtgaggggacgtggaatggaacggatcgtcctactgtgactcctgcggctgatcgatctgtgcgatgggtgactgcgacgtcggcgatgtttcggtgccgatgacgatggagttagctgggaatggtcgagcatggtttgacttgaccccacaagtctactgcaacgcaaagtatcaataggaggtgttatgaaacgactgataaataaacgataaaaaataatagatcaatcacagtagacacaagatttaatgtgaaaaactctctcaaagcaggagagaaaaaagacaggtgcaaaccggcaaaatatttttactatatcggagtgaagttataatgccgaacggtggcttacagaaagtatatatatgaaggtaaaaccctccgctttgctccgtccgaagttggccttatcgatcgtgcgtacgtgagacaagcgtctaatgctagctagctcagctgtgggcaattgtgatgatcaggtcaaaccagttaattaaaagcctgtatatgtagcatttttcaactacccttttgttcttgttggtgaatctatagcaaggattagtttcactgcaacttgtacacatgctggttggtagctcagttctattactggtacagacagtcagacgtactagacatcatgcatgtcacgtatggatgagatttctctccgcaggagcaagccacgccagtatgagtatggcagcatgcaatgtctccactaaccttgcccccctgccacaactccaaccccatcgatcgatggccgatcgatttatcactctctcagaaaccactcctgctactccacgacagacttgatgcatgggtcctatcaattctgttgaatagtaaaagaaggggatcacactgtataatattaaacatctctgtaccaattttgttatatatttgtcgacaaatgttctcctaaatatttgatagatgtaattacagtacaatcgtagtgtaattacactgtaaattgtatgtaaactttcatatgattttaaactgttagatttgtttcaagatttatgcaagtgaacaagaaaaaagtcactgtgcgtatatatgtgagagaattcatttccacaacctccgcttcaccgaaatagcatgttacggagagatttttgaaagttatttgtaagttacatgtaattagcagtgtaattacatcacgattgtactataattatatctgttaaatttttaggagaaaatttatcgataaatgtataggtgatctattagagtttcattcatatatactttaacatcttcggcaatttaaatgtgagcttgacgtttgaaa

SEQ ID NO: 72322 - DNA, 3305 bp, Oryza sativa
cccagaatgaggctagctagaagcagctatgactatgatacgatcgagagacgcttcaagactgacgtgaagcgaccggtcgaaagcgaagagaagaaagaatccccttcaattcgttcgcggtggcacgcgcgccggccacacgttcgccgagccgcacaaacgagagatcgagcatcctgcgtgcggtcatgtggcgcgccttctctgcgccctgcaaaagatctcgcgcgcgcgcggagagaatgatccaggtaataacacgacgccgacgtgcggcggcggcgcggtctggaggcggtgtcagcgcgcgtcacgtcgcgccgccgtgcgcgcgcgggcagccgtggtgaaatcgctggctaccccaagacctgttcacttggatgataaaaaaaaaacttaccaaattttagcaatgttaccaaaattttaacatgatttcttatatagttaccaaaatttgacagcaaactaaatgtagctacttttttgataattttaccaaaacttggtaaggttaaaaatgacataaaaataaacaagcccttatttgaacgacgaatttgtctgggcaccatgcgcagattgtattacgtagtaaacctctgtttcatatcacgggttgtttgactctttttacagttaaacttgtttaagttcaaccaaatttatagaaaaatacaataatattttcatcacaaaacaaatatattatcaaaatatattcaatgttagatttaataaaactaattttctattttatatgttgctaaatttttctacaaatatagttaaacttaaccaaattcaactaggaaaaataaataaaatggcttataatatgaaatagatagagtatttacgtgcgactttgtcactttgggtagataaagatataaaaacttaatgaaatatggctctctggtgagaaagcgcagtacttaatacacgcagagaccaaatcgaattatgcatccactataaatataggagtttatccatgtttgaatttggggcaatgtcatccacgatcaggataattaagaagacacggaggagaaaatttccggtcaaccagcgaggcctatagcacgcttacgtttaagcccatcatagttcacctcatatgtgaccaccacaagaatatccttcatttccgtaatccacccaaaccgcctcgaaacagaacgcaaaaacaaacccgaccttgaactcgaaacaggcgcacatcccacacctacccatttgaccgtaccccaaaacaaccgagaaattagcgggagagatcgacaagcaagaaacacacccgaaactaacccaaacacgaacaaaacccccaaagctaataaaaaaagccatcctaatctgaatcacaccgcccctagccgcaaccccaacaaaaaaaaaaaatccccttatccccaaacgcgactcgcgcgcgcgcggtcgcggcttggctaacgacgcgcgacgcgacgcggccacgacgtggtttggtttggtggttacggcgcaacggccggttcagaccgcgagatcggctataaaatccagcgcgcccgcgtcgcaacgaggagacccctcctcccctcggcaacgtaacacaagagaagaagagatcgccatgtccaacgtgcccacctccctccgcgactcctccctcaccgtcttccgcctcgccatctccagctccgacccctggcccttctccctttaaccccatcaaacgcttcttcctcttccaagaagatcacaagcttcttcgtgttcttgttcttcttcggatcactcggttggtttcttggtttcttggtttcttggattgttgcgagatgcacgggaagcatcagcatcagcagcagcagcagcagcagggggggatggtggtggtggcgccgaaggggtgcgtgacggtgagggtgggggcggagggggaggagcagcggcggttcgccgtgccgctcgcccacctcaagcacccgctcttcggggcgctgctcgaggaggccgagcgcgagtacggcttcgcgcagcggggcgccatcgccatcccctgccgcgtcgaccgcttcgtccacgtcgagcacctcatcgtccaggacctccacggcgccgccgcctcccacctcctcgacctcgactcctcctcccaccaccacacccagatccacctccacctcccccgcttcgccggttgcttccgcgcctgatccttccatcatctccatggatgcatcgccatggcggtggagcggagctcccagattgctcttcttcttcttcttcagggttggttggtcgattaattacttagtttagctagttttttggtttccttttgcttcgtcctccgatctctcggtttgttggggatggatttcgattgggtttgtggacgggagaatcggaggacggattcgatgctgatgacgacgaaaaattgagatcgatctcaaaagtgtaaagacagagtaattcttcttagtagctttattctagttttattttttttatcttttttctttgcttgtacatccacttcttgaaacacatcaataatacagtatactttgatcgatatccttgttaatttaatttgtactttgtttttttttgctaattgtttagcctttgacaacgcaattgccacatcacaaacgcgtggattcaacgttatttataatgataaaatacgtcttttttcggcaagcatgttgctttcgcttgaagccttcgacggacggaattaatttcgaaggaaaacttcacacgaaatgagttataattagtagtattattaatctttgcgtgcgtttggtaagaaataatctttgtgtgcgtttgggaaagaaatagtcgctgtactggtttaaagacagaattagaaacgtaagtactttcgttaaagttgtactacaattacaaactcaaattggcgcttcatatattccgttccccacctttctcattactcattagcttattcctaagtaatattctatattccgtgtaatattctttttgaaggaaggcaaaagcttacttttatagtgatattgatagagaagtaaaaacctctctctgataatctctcttgagttttacggtccccgccttgatttaagtttgcaaatattcgggggctaggagtatttacatggtctgcattaaaacaacactgaccaaaaaaaaagttgtgggaactactctccgaaggggataatctgtgaaatttgagggaactactctccaaaggggataatctgtgagttttacggccactgcctttgtggttgttttaa

SEQ ID NO: 72323 - DNA, 566 bp, Oryza sativa
tatttccagtcacatgggccaatactcctggttaatcgtagccatatggcctgaaaaaagaaagttgttgcagtaatgtcatcgagactcgtgttctcaaaatctttcatatattgtgtttgatttgtagtcttgtgttcaatgacaaatatttctaaaattccatggtgtccctaaatacttcactatgtcactcctgatgctcctgaattttgttcgatcttctatatgcatcacccctccctttgttactttaccatcagttcacatccatcattaatttcttaaaacatttgcgttatcccttacctttatcaagataagatccaaattaagagtcaaataactgatcatgctgcattgatgcatggtgcggctgaaacaaacccactaactcgtatagaaaatcattcataccactttctcctgattgacttcaaaaataaaatatcctggtgctattgaggtacacttgttcaataaggattaaattaaagcatgcgcaaccgcataatcttgctatgccctaaacaaatcagtgttgggggaagctgaatacgggtgtc

SEQ ID NO: 72324 - DNA, 615 bp, Oryza sativa
tgcaaagagatatgcaacagttttcaaaagttaacagattcgaatgggatgaatacatagtagtaaaaaagaattgacaagagttgcataccataattgttgcaaatttctgcatctactaatgaatttgatgagctcaggacctcgcacagtagcataactcagattaagtgatgtgaggccttcacatacacaatagaatgctggcagataatctggaacagcatcccaagccccagaaagccttctcaagcttttacaacctccaaacgccgcctccagctttgcaaacagatcggaatggtaatcagcagagaatttgccagttccgagttcaactagctgaggagccttatgaaggaggctagcaagcttgtcaagggggatagcattgttgagcttaagagtcttcaggttgtgacatctggtcactaaccgttcaagtacagtgatattgacctccccctctaagcatgaaaagtttagagttactagagaagtgaacgattccgggaagaggctgagccaatgaatagaacaatcctcaatctcgttctcttgcaggtcaagttctcttaggtgtctgcaatattagacaaaatcagaagttgaaga

SEQ ID NO: 72325 - DNA, 503 bp, Oryza sativa
atatttaggcccaaaagtgtggtgttaaaagaggggtagacgggtatacggttagcttaaattccccaaattcaccagggctcctttgtagagtatttgttatcctacacactagcatgcccatgcttacagtgggcccatgcatctgcaggacgcacatcggtcttcccttgtgccagtcgcaggcacacccgcactagtgtatacagtgtgcaccaagtggtctcgacatataccactaaacatgtaaaacagtgggccgatatcattaaatgatggttattatggagacgagcagcctccaagtagtcagtgagtcattgatcaactatgggcgagtcactaggtgaacgttgcattaacgcccccccagagggggccaagcatgctgtaaaagtgactatagcctacagacataggactatggaaggcatctttttaggttcacgccagtgtgctgaatgtttccatgactttaaggtcaggagatatccttaaatgtc

SEQ ID NO: 72326 - DNA, 2653 bp, Oryza sativa
gaaggctgtagatggatatgggtgggggatggatttgcaaaaactgatgaagtagttttaactggacaccttcatgtggcaccttacattcgcgtgattccaattgatttagcagtattcaaggacctgttcttagagcttggcataaaggagcaacttgaccctgtagattatgctagtattttgaccagaatggccacaaggaaagcttcgacttcactacaagctgaggaacttagaacagctgtcttggttgtgcagcatctagctgagtttcggtttcaggaccaccaaacacaaatatatcttcctgattcttcagctaggctctgtctgtcttctgaacttgtatttaatgatgccccttggcttcttgattttgatgaggacatcactgggaatgcaccaagcattgctttcaattcgaagaagtatgttcacaattttgtccatggcaacatttctaatgatgtggcggaaaggctaggtgtccgctctctccgccgtctcttgcttgctgagagttcggactcaatgaatttgagtttgtcaggggttgctgaggcttttggacagcatgaagatttgactacacgacttaagcacatcgttgagatgtatgcagatggaccagggattctgtttgagttggtacagaatgcagaagatgctaaggcttctgaggttgtgtttttactggataagacccattatggtacttcatctattctatcacctgaaatggctgaatggcaggggcctgctctctactgcttcaatgactcaatttttagtccccaggatctttatgccatctcacgaattggtcaagacagcaaacttgagaaaccttttgcaataggcaggtttggtcttggcttcaattgtgtatatcacttcacagacattcctgggtttgtttctggtgagaatattgttatgtttgatccgcatgcctcttatctgccaggaatatctccatctcatccaggtctaaggataaaatttgtaggaaggaggatcttagaacagttccctgatcaattcaccccattcttacactttggttgcaacttgcaacagccatttccaggcacactcttccgcttccctcttaggaacgaggctgctgcttctagaagccaaataaagcgagaacaatatacaccccaagatgtggaaatgcttttctcttccttctctgaagttgtatctgaggctttactttttctccgcaacgtaaagaatataactctgtatgtcaaggagagtgacagccaggagatgaaacttgtacatcgtgtctcgaagcataatagttatgagatggccaaagaacctcatgcgcttaatacgatgcttgcatttataaatggaaatcaaccatcaggaatggataggaatcaatttttcaataagttgaataagactaaagatagtgatttaccttggagttctcaaaaggtctctatctttgagcaaagccctgctgcttgcttggtgcattcatggatcttaacagagagtataggtgggggccatgctagaaagttgtcaactgcctctggtagtaagtcccacttctttgttccctgggcatctgttgctgcttatctgcattctgtgactgtggacaatacaaaagaactgtctggtgaagctgaagtcaaccttgatgatttggttctcaagcaactgtctcttggatcctctaaggacaggaaattttttgagggtcgagccttctgctttcttcctttaccaatcaacactagcatgccagtgcatgtgaatgcttattttgaactatcttcaaatcgaagggatatctggataggaaatgacatggctgggggaggaagagtacgatcagaatggaatcttgcactgcttgaagatgttgctgctcctgcttatggtcacctgcttgcagccattgcacaagagcttggtccctccgatctgtttctctcattttggcctactgctgtaggtgtggagccatggtcttccatggtgaggaagctttatgtatctatcgcagaacttggacttcatgttctgtatacaaaagcacgagggggacattgggtgtcaacaaggcaagctatctttcctgatttcagtttttcaaaggccattgaactggcagaagttctttctgaagctggtttgcctgtggtatctgtatccaaacaaatagttgacagtttcttgaacgcatatccttcagttcatctcttgaatcctcatctgctgaggaatttgttgatccgacggaagcgtggcttcagaaatagagaagaagcaatacttgttctggagtactgcttgagtgacatgggagatccttcctttcctgataaattgcaagggttagctcttcttcctttggcaaatggatcattcacaacatttaccaaccggggggagggtgaaagagtattcttttcttcacaaatggaatttgagcttctgaaggactctataccacatcttgttgttgataactctttacccggatgccattttgaagaagttatatgacatagcttgttctgcacggtcaaacatttacttattcacatgcaattttctccttgagttgttgcctaggatcttgccacctgaatggcagcatgctaagcagtta

SEQ ID NO: 72327 - DNA, 939 bp, Oryza sativa
tgcagctctgtagttactctgtcacattggcaaatggcaaggactaatgctaaatttctagaactatatttacagtaccgctcaagaagatactacaaaaacaaaaacttaatcactttacaaaaaaaaacgtgcgaatcaactgtcaattaattctgacatgaacctaagtcgttttcgcctgcgtgacagaaacagagctaacagctaccaccctgaaactgaagagcaattctgggccgaacactttgcagcctcctccctgtctcctgaatccaagcgcgtccctcccttttccctcctccattacacctcctcaatagtcaatacccccatctccttggattgcattgccttctccgtccgtcgcgttgctccggtgctcgatcggtctccccgcccggccgccagacgacgcgccacatatgaagccccgctcctcgcgcgacggccataatgccgccgccgccgccgcgctcctcctcgcggcgctggtcctctccggcgacgtcctgccggcggtcgtggccggtggcgccccctcgttcaactacaaggacgcgctcaccaagtccatcatgttcctcgaggcgcagcgctccggcaagctgccgcccaccaaccgcatcaagtggcgcggcgactccggcatggaagacggcaagctcgccaacgtatacgtcgtctcgcctcgcgccctagctcgaacatctcgctagctgcatcttctaattttgtgaaatggatcactcgatcaggtggacctgactggcgggtactacgacgccggcgacaacgtgaagtacgggctgccgctggcgttcacggtgacgacgctggcgtggacggcgatggcgttcgagaaagagctgaaggcggcgagggagctggagaacgtgcacgcggccatcaggtggggcaccgactacttcctcaagg
